United States Patent 11,001,841 (CCCTC-BINDING FACTOR (CTCF) RNA INTERACTOME) - sequence listing, part 21

SEQ ID NO: 52909 - DNA, 1091 bp, Homo sapiens
agtgtctctgctccattttattaaagcagaaagcagtgacaattattttcataatgaactggctcttcaaattaatgccaattacactatgcaatcatgattaagattatgcgttaatcaatggtgccaacctacttattagcctctttaaataacgatcatgaggaatgtatgggaaggcagagaatggagaggagccagtggaaaggggggcagcctccagcggggcagggaactctctccagaagctgagacccaaagcagcccttcttgcatgggtggagcttggatcagaacccaggacaatcagatgcctgagctcccaaagctacaggctctctagaagggagagggagcaggaggacccaggagggagagggtagtggagaaccttggccatttagcagttaatgaggtccagcgtccccttccccatctccagcaacactaaagtagtgcagttgacactgccccccagtaatgtcacccctgtcttaggtcaggtcccctggaagcagagcctgaggcagggattcggatgcatggggtttatagaggggaagagtgctcttcaggaaaaccctgtaggggaatgaataaggcagggttgggaagaggacggagttgggcagagatgtgcctctgccaagatctagcctttgcctgatgcaaggtggggagtgtggggaggggctccaaagaatatgtcatactgcagattgtccccaccctgaagcaagggaccgcccagtcttttgagccccattattagttggttattgatggcaggctgcttccaggggcccaggtgagtgacccctcctcctgggcaagggggcctctctcactgggaacaattccctagagaaaggggtagcctgtgagtggaaccaaaattcaaatcgaggtctgcctgtgcctagaacccactctctgaacctctgtggtgcccctcaatatttgctgcttggatgtcccatgatattcagcctttgcagccacctagcccttacacactcattagaacacctcccacccttgtactgagtttgggggtggaggggcagcctctcacccaccatgtctctgag

SEQ ID NO: 52910 - DNA, 1085 bp, Homo sapiens
gcccattttcatgttgccaataaagacatacccaagactgggcaatttacagaagaaagacgtttaatgcacttacagttccatgtggctgggagccctcacaatcatgatggaaggtgaaaggcatgtcttacatggtggcaaacaagagaagagagcttgttcagggaaactcccctttattaaaaccatcagatctcgtgagacttattcacaaccatgaaaacagcacgggaaagacctgcccccatgattcaattacctcccaccaggtccctcccacatcacatggggattcaagatgagatttgggtggggacacatccaaaccatatccctcccctaggcagcagctttggttaaaaaccactttccacttgttcccaccccggagttttgctgtttagccatttcatgcttgtttatacttgtatgtttgtgcatatttatttatatttgagaaatgtttattgaatgccaattatgtgccaggtcttgttctaggcactggagagaaagagatgaacaagctgataagatctgcaggcccaaggaacttctaagtgctgagggtggggagaagaggtggactgtacactagacagcaaatagatatttaagacagcaaatagatattaagctgcatgaagaactttgagaaagcaagcaaggtgtcacagtggcagaggtctcccctactgtttatctgctgtatgcccagtacttgacacatggtgggtgctccctgagtgtttgttgagtgaaggaagggctgaatggaggaacatctttttctggggtgttgataaaggacaaggtcgctcagaattcctttgcacgaacttatgaagatccaagcagcctcatgtgctaatgataataattaagtcagaatcccttatttgaaacaactacctcagggagaggcacaaagcaccaggctgatgaattggttccccagccttccctcctgttgtgccctgcccaggtgagatgtgtgctcacacctgcccaggtgcatacacatgcataaatgagagtctagtggagtaatcacacctccaaggctgtgttaaaacaaccgg

SEQ ID NO: 52911 - DNA, 1044 bp, Homo sapiens
tatctctgagggctgtgtgtgcagcatctcacccgatcctcatggaaccctgtgaatcgagatatcgttcagaggttaagcagtgttaaaggtcacgcagaccatcataatcatccttcagtagtatttgagaatgatcatgtgctaacaagatcatcccccagatctgtagtaaggacatggagtaaggcacatggagcttgtgtgtctgaggtcaaatgcagctggtaggtggcagaggagctgggatctgaacctctgcggagcctacttggttggcctctccaccatcctgtcatcagctagcagggccagagctgtgcttcaaaccctgtttcatctaactccaagccatgctcctaaccactaggctttattgcctcttttcaaaagcaaaggatggcagaggaggagatttcggcatccgtgtccacccacaggacttgccctctctctggccctcccagccctctggaggctgccccgccatgcccactctccacctccagatgggcacttgctttccatgctggcttcccagcagagggtgattcccacctcttcggcctcctccagaatcctaacagccagtatgcatggagggggcgggaggcagcaggcatgcagggatgaggcagaaactgagagtgagagctgctgctgaaaactcacaaattggtcccagagagaaatggagcctctttttgcccatcagctcactcccccaaccattatcaggaaagcagtgtgagggccttggctggagtgaaactcaggtgtgggtgtggggaatggcactggggcctccacagctcccttctggaggggcacggaggccttggaggccagcctgggctcatcctcctcagagaacagggctggagcacaggagctggtgcatgggggaggtggccaacagtaactgtaggggtcttcaggtggacacaagaggccagagccaatgagatatggggcatgggaagcaggtgctgaacagacagacccagggcttggtgggaggtgcaaaatccaaccccaaacagc

SEQ ID NO: 52912 - DNA, 1126 bp, Homo sapiens
ccctctatgactcagtttcctcatctgtaaatcgaaactaagaataactgtacctatcccataggaaagattttatgattccacaaggtcaagggattcaagtaacataataaatgttcaataaacatgagtcattctcattatgtatattacccattctttagggttcagcacaggtgctatctcctccaggacatgttccttgacacctgtaccccaaggctgactaagatgcccctagttctccttccttgagaacatcctgatcttacctccatctgagcattttcctactgcataattggggacaaagaggggcctaatatgaccaaagcagagaatacaaaagaatgaggctgaagaagtttggggggatttttttttcttttgccacgctgaagtctaggctggattcttggattgtgggaaaccagggagggttgcaaggcaaggtgtggccatttggccctttattgccaggcctggctcagcctactgttggaatgacataccattaagctgaacctacatgcatgcaagcagaatgctgttctaaacactgcgttgtcagacagtggttttgcatggcagggaataactccaaagctaaggacatcataatttccacccccaccccaaacacttgccattgccactttgattcagacaatctggtataccaggtcacaccatcctttgttcacctgggcagccacgatgaaaggtgaaagtggtaatatggcatcctcaggcctggaaatctggggtggaggtagctgtgggctaaagcacagctataggagttccttttcttgctacagctacctcgcacactcagagagattttgcagaatagagctggtaaatttaattcagtgtctacctctccagtccctgcctccactcacctcttcccttcctcaccccatttccaagttagtggctacctcaaaggagcctcagagatgacccaagggccttcccagctctccagaggcagttcacagccaacaggcctggctcagaggcttcctaacctccctcccagcccactctctttgagcaggacaagtggtcacgtgacggcagctccagggagggccagtcaaggcctggtaccccccac

SEQ ID NO: 52913 - DNA, 1518 bp, Homo sapiens
agaggggactgtggcacatccaagtcccacggggccagagtggactgtggctgtcgcatgcttgggagtggcattcaccaggtttctacgattgggcactaaccaaaaccaagggccagctttctacacctggaagctctacagcatgataagaattaaaacaagcatcgaatgaagtcatatgatgactaagatcagtcaaattggagttacggtcaatcagcaggaaattgtcaacatcggaattcacagccttgccctagagaaggaaggagaaacaagcggagaggccagcagatctgtgggatgttgcccctcaaggaagccacaacaatagaacaagtttatccaggaaggggagagggtaatgaatccaggccgtcacagtgagcttcaggtcagatagggggcaggacaggatgaggaggacggaatggcttggctaaagagttgatgcagagctgggtcctctggaagatccagccaggatcagcaaggagaaaaatgtgatggacaatttcctctggagaaacagaggctgacaagagaggggtcacaaagtcagccccaaccaggcagctggggagcagacagaactcctcgccagatgccagagacacagcattgagacccagacagaaggggctgcacacgccgctctgtgggagtgggttggagaagctctcatctagtcctgatgccaaattaggaagatggactctcctccagatgtctccactctcaggcatatggcaaagaaaaacactcttctactgaggcgagaacaatcatttattgaatgccagcattgtgctgggcgctcaatacagactggggaaataaaacagtcattgtccatatcctcatgaaacttgcagtcttttaggggatatagacaacaaacaagtaaataaatacatgtataattacaaaatgtgttaaggatgaggagggaaacaaacaggattcacaatgaagaataaataacagagtgatgaaacctcagaaaaagtgatcagagaaggctctttgaggaggcagggtttaggctgagacctggagtgatgaggacccatttgtgcctctctccaggggaggctgggccgagagggagctgatgtcagtaggaagggcaggcagatgtttctacttctattcagtcatgttccttattgaatttccctgtttatcctgcttttattaagagtcatctcaggtctcccatagtagtttgacaaatttactttacagagaaagaacttgctggtatgaagacttgtgataaatactttctagttccaaccgactgagtgaaggggagactctgctgagcttgactccatcagctgctgcaatggtgaccagaaaggcaggccccgcacctagaagaacatggtccctgagactatgctgtgcacctccaagctatgccagagatatagggtcagcaggtatctcaggagcatacactcagctttcctacctaaaagcgtagctagttccactgcctgtttcgtt

SEQ ID NO: 52914 - DNA, 1250 bp, Homo sapiens
aagggaacagcctccctagctccttctagcttgagctctcctggaattcacgggaggtttggagagagagtattcacacttcactgaaaacgtgtttcaagcaattagcaggtctttaccagaggagcctttgaagtccaagcccagacccatctctgtgaagggtttccgcagaactgacaagctggcagacgctgctatcagctcggccctttcctaagtgccaggggctcctggctctggactggcaccacaggactcatgtgagtcaccccgcggtggcagcgccagcatcatcaccagcacagagacctgctcgacggagaattcaatgtgtgctgctgcaactgcaggtagtgccgtggagttcggcttccagtggggtcctgtgtcaagtccatgggattttcctgccctccaggtctcccaaccccaggctggcaagtggaagcctggactgaacttggagctcctgcatcctcaaagagtgcttggccctgtagattattattcattgaataaacagatgaatttctctaacgatagtgccatggcctgcagttagcctctattcctgcatctgcaaggtggaaacaggcagggtgagggggggataggctacctagtctccaggattctgagcttgaactcgctttccttggaagggcttatattgcagtggaatgaagattaggtcataattctgctcccctttaaaagctgcatgatcttgagcaaatcaatggatgcatctcagtttctccatctgtgaaatgggtaaaataagcttgattttgcagggcagttgtgaagacaaaaggagataatgcctagaaagcgcccagcacagcaggtgcttgtggtctattgaatacaagccacacctcttactgtgtcttttctgactgcctctcacagtgtcaaagtagaccatagccacggtgggaggggcgcctttatacagcactccccccctccaccccactgaagatggagagaaagagagagccagccagcatgggagccaaaggcagctgtccccactctcctgtcccgtgaagccacccccagcccgggcctctgggcttctgtttgattccctttccctgacattccatcaatcatcgtaattgcttctcccgaaaaatgaatttgtagttgatttcttcaaaagagggaatcagccaacagataaaaaggttgttttatttaatttgcatgaagaggctgcctgctgctgcccagctgtg

SEQ ID NO: 52915 - DNA, 1076 bp, Homo sapiens
taagagtagaccataaattaatgaatgagtgatagctggctatcattaattctgctactattcgttcattttcttttatttatttgctcatttattgtctacttttgtcaggagttttctggttcggatcttaacatataattatctccaggtccaggactagggagagactaatgagatgcctcaggcacaatatttaaggagacattgctctcagggtcatgctagtgcctgattagctcagctcctgaaaataaccttgctggtcggtattgtaatttccattgtgtagaggtggaaatggagtcagaggaaggctactttacatcttctagtcacctggctggtaatatttgttcccagatctatgtggcttcaatgccttccttctctccttggtctcagtttctctgccttgcttgacccctcagccagggacctgggatgggggagggaggaggagttgcagccacatgcttcttttcatgttttatgtgctgccccagcccccccaacccccaacaaccaccctcatctcctgcaccctgtgcagaggctaccaggtgtctaggtctagtccagtctcctctgtttagatgaatgtgaccatgggcaagttacttaaactcctcatgcctcagtgtccttagctctaaaaagggacaccatagtcatccttatgtcatggggtgcaggagggatgctggtgagtgggaatgtgtagtgggtacaacacttagaacagcacctgccacatagcttcatgtagttgttattgttttgcatagccttgtaatctgaaggtggggggagtctgcaatgagccccaaaccctcagtccactgagctgccctatcaggagagtggtcccccacttccccagggttagcagttccctgggctgccagcttcacctcagttctcctgggatggttagtgcccaggagccactgggaggtggaaccatgggggcggggtttggcccctgacttcctagttcccctccagctacaggcaaggcatgggggtgggttttggcccctgacttcccagttctcctccagctgtaggcaagg

SEQ ID NO: 52916 - DNA, 2010 bp, Homo sapiens
gcacataggttccccctccatcttagaagctcatccaaacaagatctatacacagtagggcttcagccaactcagatcagcacacaggaggtgctttctcagcatggagcctggcacgtagtaggcctctcccagtacaggatctggcacacagtagaaattcctccagcattggcacatagtagggcgtcagccttcctagagtgtgcttcagagcaggcaagtttcagaaaaatgtcccctgggtcaagttttccttctctcttcactgtgctcaagaaatatgtactgagtacctagtactgccccagtttgataccaggtgttgcatgggggagcagagtaagggagacacaaaccttttattcttatttaaagaaccgacagccaagtgatgaaataccacccctttacaaataacttatgactgaggcaggggtaaggagtgaggctgcttggaggaggtggtcctggagatgagtcaagtttctcaagtcagcaaaagtgcaaaggcaagtgtagagagtgagggtgacccacggagatggccatgaaccatcgctgatcactgcagcaaagtatcatactgtggagggggtggggtgtcattctctcattcaacaagtatcaggagctgtgaggggctggcatggctctaagctgtgatgctacagctctggataaaactatcctgcttcatgggggggcaggaggatagaaaatagcagcatattagatgtcagctgctgatagtgctttgaagaaaaataaaggaggggaagggtgaggagctcactggagggggtgagctctttccacatcttctctgataagatgacatgtaagctgaaatctgactccaggaagggagagggcatggtcacggggagaggagaacctgacaggcagagggaagggagggcaggaaggtgggggccaattgccaagagccttgaattctagggtaaagaatttggattggattttgtagcagtggccaggctctgaaggcttttgagcagaggacggatgggatgagagctgcaggaaggagaagatggcagaattgtgggcagctgagaccagcgtggaggggtggcagtggtccaggtgggagatgccaggcctgggtgcaggtagtgatgggggcagggcaagaggaggggcagatgccagggctgtgtgaaggtggcattttctggtgtgaggttgaaggaggatgaaacaaaggcatgtgagggtgagttgggtaccatgatcggaaatgcacacaccaggcccaggagtgggccaggagcagatggtccatcccttctgaagctgttgttttcctcctgcttgtccctctcctccccttgagcctcctctctcccttcccccatgtcctcttttcccttctcctcctctagcacctcctgctacaatcttagaaactccacggtccaaatcccaagtatctgggcttctcctctgctttcatctcacatgtgtttctttctccttctctgtcctttcttaccccttctgagccagtgatccgtagagggtataatacaaatcaaattgtccaggtcttcctggggtacctgacagcctgttggggtggagacagtgtcggggtagttggatgccctggtttttgtgtctcacagaatagggtttgcatctcaaccctgccgtgtatgagcagcaccatgatgggtgagttattggatgcacctctgcctccgatccctcatctgtgaaatgagaaggtgcatgggctagcacggggcctggcacaacataagggttgtgtgggtggcggctgacgctatgattattactgtttgtggtattgttacttattcgccaaatgtgaggctatccacccagatagatccttcccatgcgagagccaccttcagaggggagtgtgtgttccaggatcaggctagactacccaagtccttcctgataatgggcatgcccgagtgtccatagccccactccagaagggctgtccagcag

SEQ ID NO: 52917 - DNA, 2287 bp, Homo sapiens
acttcagaggcttctatcatcccaggggagtgagtgtagaattggtagggtgacagcatgtgatcactcacgagatcagctcccgcgcaaatcatgaacctccaaagccacagttctgctcagctgcacagaaaacatcaagttctcaacaagacagtttctaagaataaacaaacagataaatcgcatgtagcctcttgcctttaccaaagcaagttgtgcagcaggatgtgggtaccaattgggccacagtctctgtgcctctgctgtgtcaccccaccgtctgcacagccaaagactggcttagccaagcccagagcatgttgtccaaaggccattccagcttcatcttcctgaaatctgatttgtctgggagtgtggaaagatgggcttaaacattggccacaacctaactgccaatctgttaggatttgtcaaataaattatggagcatccacattttattggaaaaatattattttataaatggagaaaagcctggaaagacctctaccaaaatactaaaggtgctttttctggatggtgcatttataaatgttgttaacttctttatgttattcaatggacatgcattttgtgagcaggaatgattatatttaaaaatctgagtttgaatgccaatttgatcgtgtctcagctgtgctatctttggcaagccacttcttttccagagttccaatttctacacttctaggactggggtaataaagtcattttcatagcattgttctgagaaagaaaatgagatcatgtgtatgtgtattgtgtgtgtgttgtgtatgtgtgtaccctgaagctagatctggcacacttttagagcaactccagtatgatggccacacacagacactctagagccaggtggcctggattcaaatcctggctctgatatttaccagctgtgagattttgggaaggttgcttgaccactctgtgcctctgtttcttctctgtaaagtggggttgtgatatgaattaaaagaattagggccaggcgtggtggcttatgcctgtagtcccagcactttgggaggccgaggtgggcagatcacctgaggtcagaagttcgaaaccatcctggccaacatggtgacccccctgtctctaataaatatacaaaaagtattagccggacatggtggcacacacctgtaatcccagctactcagaaggctgagacaggagaatcacctgaacctgggaggcagaggttgcagtgagccaaggttgcactattgcactccagcctggggcaacagagcgagactcaaaaaaaaaaaaaaaaaaaaaaagaaagagagagagagaaagaaaaaaaagaaagaaaagaaagacatgcaaagtacacaataagagcacaataaagatgttattattgctcttattactttattattgagtacatgttcttttgctttctttccaggctgttgggattgaaagccctctgtgagctgtgggtctgccttcttggggagagccctgtccacatttggctgttccagagttgaaagagacagagtgagggccctctagtagcttcagtagggggactggaggccaccatgaaaactagggttcagtgtagagctaggatcagagatcagaatagagtttaaggtcaaggttcagtctggatcaagatcaagatgaagttgagaaaggaaccaggtctgtgtctggggccagggcccaagtttgtctcttgctttcttgtggagccaggcaggtcctggggcctgttccacagtgcagggctgggttgtgctcctggatggcctttccctgggtcccaccttcaccctggggcctgtttcagcctccccatagactgcgtgctgcccttcttcccaggcagtctgagccacccagcagtgcccttgacccctgctcagggagtccccaggagctgcgcttggtgccctggtccctgagcgtcttctagcttgaggagcagccagctcagacctggcaggagggggcagcctccacagcacctgtgccaaaccttagctatatttttagaatagctcctgcctgtccacctggcgggcagtgggctggagggctggagggctggagacaaggaggccaggcgctccttcccccaggcattgacaagctgttggaaggcccaactgagctgacctgggttcctacactgggccttgctggtgaggagccggcatggagctgtgtgcacagatggccctacatgcgctcataatttgccagaataagtagttattattaatctcccctgtgc

SEQ ID NO: 52918 - DNA, 1052 bp, Homo sapiens
tgtctggtcctgaacgccttggtgtgctggttgtgtctttgtctacacagcatgtgccagggtgtttctgagccttctgttgttgtgttcacatgtgtgagtgcttgaggtagcctgttcagtatgcttggctgcagctgtccagatatgcttgtgtgtgaatgtatgtgcatgtgccctgtgtttgtatggagcagggcagcctgtgtgtgcatgcgtgttctccgggggcgggggtatgtctgtgtgtgctgtgtctgtggttctgggtttgagtgatgtgcggggcctcccagagagggcctgtgactcagtgcctgtgttccactgtgtgttgggtgctgtgagtgtgcctgtcagcctctgtgtatccatccacgtgtttgtgtgcacgtgtgcgctgctcggtgtgtggacggggaagcacagtttgggtggtgttgggtcaggcccagcccctgtaccccaccgccccacacctgccccttcctgtcctgctggcagggttgatgacagccatgccaggccctacccttagccaggtgggctgtcacttatttagggctgctatttcaggaggggaagcagctggctggcgggctgctcatctgagcctcagcaaatcagtgagctcaggacccactctggggtggcccctcactgctgaagtctgcttggggttggaggcccatgtggctgaggcctctgtctaccaccctgacaccacttatagcaccaccatccaatgtagagctggcttgggcttcctgcctgttctcaaaggaataggcccttacccagggctcctatggacctgtgtgtgtgtgttcgtgtgtgtgaacgtgcatgtgcacaggtgggtacacacaggcatgtgtccctgggtccacacctgcaggcacttgcccactatgcacttatacttgtgtgaggaagggcacctttctgtggcctgaactcatgtgtctgtagctggtttttttctgtgatttgtctatgcatgtgtgtgtccttgtgcgtgcacaggtgtgtacacatgtgcttctctgcgt

SEQ ID NO: 52919 - DNA, 1049 bp, Homo sapiens
aggtcacaccaacctggaaagcattcaggaggctgctgggggttgagggggatatctcactggggattgtttcctaaaggaagctgggccttcagaggtggggaactctcacagagaggccagcacactctcactcctctttatagatcacaaggaatagaagttaaaagcaggggttcaaatcccagttccaccacttcccagctgtgcaactttgggtgagatcttggacctctctgagcctcagatgttcaaagggagcgagtaatggcatgcggctcagagtggttgtgaggactcagtgagataatgcatggaaggagctcagcaagtgcgtgccacacagaaggcgttcctctccatcgtagttattaatgcaactcccaagcctcctcccaggcatgcaggaaatcactgggaagcattggtgtgactctcacgttctgcctggcgtctcgagtgtcctggtctcaggaggctgagcggggggtttgtttattcccagagctgttttctctattgcctgctaccgccgcttgcctcccccagacgtacttatggagccaagtgggcaggaggcaaaggagagagtcctgccagcctgatggagtggaagaccaaggattagctcctgtggagaggcagatggggagacgacactgggcatgcagccgacccctcccctgggctccctgcctcggtccctgacctcggggttggctaatgtctgtccttccttctcctcccccttccaagttcctctctcctcctggaatggaagctgtctgactctgtcttccttcaccctttctgtcctttgcattgcccttggccacctctacccaccccaggtcatctctctcctcatcatgtccctctagatttttctctttccttccttcctcctttttttttttttttttttgagagggagtctcgctctgttgcccaggctggagtgcagtggcacgatctcggctcactgcaacctccgcctcccgggttcaagctatcctcctgcctcaacctccctccttccttcatttttt

SEQ ID NO: 52920 - DNA, 1479 bp, Homo sapiens
aaattaccctccttgcaaatgtttcttagggaattgaggttccacagagaacgtttaacctccctgggaacaaaattcccgttgggactcaatctaaactatctcagaatctttcagagccacatctcagcaagtctggaggcctgtgggtcaaatggagaagaaatgactgcagttgtcataaattcttcttttaggttggcttaaatcacattcccctgggacctctctccccccatttctagttaacccccagagtctcatctatcccctggctatggcaagccctctccaagtctctgggaaaacaagtccatgtgagctccagagaatccaatttcattccttttttcccccacgcaaaggcagtgactcactgttcgctggcgagtgtggcctctgtgttaagatgttatttgcttgcttattctcatcttttcccatttcaatgaaattacatttataatcttttttacctgccttggtcaacttggaagagtcattaaattttctgataggcagcctggtaaactttaattgaatcacgaatcaccatcttctggaaagttcagcccgcgaggactttgggtaccgtataattcaactcgttcatttgacaggcgaggaaatagaagtctaggatggttaagtgacttgcccaaagtcatactctgagtgaggacagctctgggatcagatttgagcctgctttttcaggtaccacacgccttccactccacggcactgggccccttggatttagctgttactcaggcagcactgctatgtgataaaccttaagaggatcaacaaacatttgtcttataattgggggaattaacagcgtttcaaaacctttcctaggaaactgactcagctaatgggcttgggctgtgattggtggcagctggcaactatgggggtcttcctatgtgctctctcccccacaggacatttgtcagatgccttggggattcctcttttcaatgtggcacttgaggtttgagtttgatgctattagtgatggctgtgctggtcatatcacgtggggtgtcttggcaggggtgtgggtagtggaaaggacatgaatggtcttgaaatcaggcactgttactcactgtgggcatggtcttgggcaagtcacttcactgagcctccattttcttatctatccaatgggcatcaggagctgaccctttcagcgtaactgaaaactataaaagatgaacatgagaaagtatccaagtcagagccccacatacagggagccctggtccatgctgattttatcagaagggcagagatgtgggggttcggtttccagtggccggacttgtctatggatgctgcatgtgtgaggaggggagaggggtcactgtgtggaggccacccctgagtcatggagcctcatggtctgatttcctccccttggggagtttgccagctgcagtagatgaagctgccaggctggggctcagg

SEQ ID NO: 52921 - DNA, 1027 bp, Homo sapiens
ctgtcttgactggctcctgccattggtggggccctgctcagcccctgttgacactcttggcatggtaaccttcaggttttgacttgggggatgagctggaggatgcgggtttggttttctggaagggttgctttgtcttgggagccagtgtaatttgggggaagagagggtggcatatggtatcaatttcattaatctggcttcttcatgggagtagagagagtagggatttggcactttgacaaggcccccaaattagtttgcctcccttgggagagggttggaaaggctgcctgccttggctttgtctctggatgagtcattctgtttgctcaaattgtcaattgtcaaacaacagtagagagtgcttcccaggtgggggtgtcagtgctgtcccgacaggcacatctgctcctgagacacccactgctggggaaatgggagccacgttgctacccagttgccagcctgaatgtcatggcaaagaccccagcaagtcctggccttgccccacgtggagctgtggcaggtggggccagcagctgtggaggctccagattgtaaagaggggcagcaactgtgaccatgttcctgtgctgtgaccagtgggctgactaggtgcatgtgagagaggtggaggagctaccagcaaggggcccttgaaagggcaggtggaggtattttcagagctgcccaaagcttgtttggaaagaggttaaaacattccctaatcttgggggagtatcaacacctgtgggtaggatactcagtcaacctccttaacaatgtgcttctgacctgccttatgggaatgagtgtcactcccaatggccaccagttatcctgccctgcggggtagtggtagtgatggtgggggagaggaaaagacaggaagggcggagacaaaaataaatctatggagggagcatgaacagagggaaacaaagaagacacacacacacacacacacacacacacacacacacacacacacacggagagagagagtgaaagagagagagaagag

SEQ ID NO: 52922 - DNA, 1040 bp, Homo sapiens
gtggtgtctcacagctttgcatggctccccaacaagggcttgttgtgagcacatcatcacctagtcagttcctactggactggcccaatggtccaggactgtcttggaataaaatatagggtcattcttcttgtggtagtgaaaggctattgggggaacaaagtcatgaaaaaccaattacaaaaccaagaggaatataagagacattgcagggcaatctgtggaatcaaagcataattgatttcccagtgagcatggcagacccatgaccagcaatgaagaggaacaagtaatctatgtacagtggagtgggctggggaagaggaaccctagagaagtgttgggagccagttctccaagacaagctggatctggggagacttattccaatcagagaaaatggcatagtggtaggattcactgacctgtccaaccattcatccacccatccatccttttattcattcataaaatatttactgagtacaatttttgtgccaggaattgagcttccaatggtgggcaaaagagtaaaggatgtgaggtgaatggtgcatagaatgacccagctagattagaggattggaatgagagaaaggctagaaatgtcatttgagtcagtatatgcggacctccgatatcagactccggtgtttaaggaatttcctgagggcaatgaggcctgatatggtacggtggccccactcatcacctgtggaagacatacggatgacctcctagttcacattaagggagtttcaggagcagagagacccattccagctcgtagcagagagtggtcttttcacaaattgcagaaactgtgtagttggttgataaaattttcccagtcaattctgcctctgtatgtgtttattaaacctttggtggctgctaacacaggtctccagaaagcagaagcagctgacgtgatgaatgactgctcagtttttggatatcacacctggcatcaagcatccttaccctacctgtcaaccttgcccttcacactgccattggagataacactgatgttatat

SEQ ID NO: 52923 - DNA, 3046 bp, Homo sapiens
agtggagggtgcctcaggagcacgcagcagtggggatatcatctccttcagggcagggcttcccaaaaccgatagtttaaattcctccttcacaatttttgcccagcagcataccgatctccatgatcatttacttctcattgttttgctttttaaaagctttaggctgggcgcagtggctcatgcctataatcccggcactttgggaggccaaggcgggagatcacgaggtccggagatcgagaccatactggctaatacagtgaaaccctgtctctactaaaaatacaaaaaatcagctgggcatggtggcatgcacccatagtctcagctactcaagaagctgaggcaggagaatcacttaagcccaggaggtggaggttgcagtgagctgagatcgtgccactgcactaactcgagcctgggcgacagagcaagactccctctcaaaaaaaaaaaaaaaaaaaaccaactttagataagctcattgattttttagccttgtcctgggtgatgttatctgtgaaaacctgagtcccaatgtgctatttatgtatatttaaagttttaaaaaatgttttattgtgatacctatatagaacataaaaattaccattttaacagtttttaagtatctgattccgtaacattaagtagattcacaatcttgtacatctatcaccactgtccatttccagaactgttttatcatctcaaacagaaactctgtacccatgaaacaatagttccccattacccctcctcccagcccctggtaacttctgtcctacttgctgtctctataaaggtgcctattctaggtacctcatataggtggaataaatacaatatttgtcttttcgtgttttgcctatttcacttagcatgacttagaggttaatccatattgtagcatgtatcagaatggcattcctttttttttgtttttttttttttgagacagagtctcgctctgtcacccaggctggagagcagtggcgcaatgtcagctcactgcaagctccgcctcctgggtccacaccattctcctgcctcagcctcccgattggctcggactacaggcgcccaccaccacgcccggctaattttttttgtatttttagtagagatggggtttcactgtgttagccaggatggtctcgatctcctgacctcgtgatccacccgcctcagcctcccaaaatgctgggattacaggtgtgagccaccactcccggctggcattcctttttaaggctgaataatatttcatttgtgtttataccacattgtttacccattcatcaaggatggacatttgggttgtttccacctttgggctattatctgtgctgtttatattttaatatatgcatgtgttaaacatatatatgttaacatattttaacccataggtacataactaataaaggattaagttggtgcaaaagtaactgcggtttctgtcattgaaagtaatggccaaaaatgcaatgacttttgcaccaacctaataaaaagagttttctgtgatcacctgccctgaaagcacagcctaaaataaggacgtgagggcaggtagtttacttgggaggaagcaggagtgcaggtgtggagaaactgaggcagggaagggataaaagccaatgaaatgctgagctggctgctgcccagtatttcatgggtttgctggggcctcaatcccatgaaggcctgaagaaccgagcaaaacacaccacagagtcatctcactggaggacagagaagctgggcacatgtctgcaatttccaacacccattatgttacttccccctcacacttcctgctttctcatgaggggctgagtgaccttcccaaaattcaggtgagacaagggcagggtactgtccatgacagctcttctgaaatcaggtgagctgggaggatgtggcacgcagcatcataaacgtctcctacgtcatctgaaatcatttttcatgcctcatttcatgctttgagagagtttttccctaaagaagtgatgtctaggcccagcgcggtggctcatgcctgtaatcccagcactttgggaggccaaggtaggtggatcacctgaggtcacgagttcaagaccagtctgaccaatatggtgaaaccccatctctattaaaaatacaaaaaaaaaaaaaattagccgggcgtggtggcgcatgcctgtagtcccagatactagggaggctgagacaggagaattgcttgaacccgggaggtggaggttgtggtgagccaagattgtgccactgcactccagcctgggtgacaaagcgagattctgtctcaaaaaaaaaaaaaaaaaaaaaggaaaaagaagtgatgtctaagctgacactcaaagaaggagtaggtagccaggcaaagagtgtgggaagggtgtttttggtggaagaaacagctcaaggaaaggcctggtgtgcagatatagcaagcactttcctaggccagagaagtccagcgccgccaacgcagggaggaggggtggagtgttgcttctaaggaggcaggcagggaacaggctttgcagggccctggtggcctctgtatgctatcctaagggctgggggtagctttggaagtatctgaacaagggagggttaggtgcatgaagggactgcctggagatttgcttttcctctgttgtcctggggcagataccagactggcatgggtcactgatacctgactttcttcccaagggactacagtgggaacctctcaggtctttgtactttcaaggccagtgggcacctagtacaagctcagaactgatggtgatgatgatggagaccctgggcccccatgtgctttccctgagtgtcaacgaatcctcctctggacacagatgttctgccccatcctttggcccctagtctagtagagagaaaagggtcacatggaactgggccgacttctgctcccagcttgctgagggacattgggtgagtcacttttcctctctgagcctcagttttctagtctgttaaatgagaataatgcctgtcttgcatg

SEQ ID NO: 52924 - DNA, 1819 bp, Homo sapiens
tccatagactcctgagcaatagcaaatgcttattgctttaagccactgaattttgtgaagatttgttatgcagcagtagctaactgatacacctccctgctgggagaactttaaggatgtgttgatgtttgctttctagccgagtccataaacctgtggaggtctgctcctggaaggcaagactcaaaatatggttggactcaagttgcagtgatggctcagtatattgatagatgctccgtaatctgggtgcagtgcgtgccaggcagctgcacttcctgccacttacagagaatttgctgtaatgcattgtgatgcattagcataataattgctaagcattcacaaatgaatagctcactgactgatggattttgtacagaatctgtgaaggttacatcgagggtgaaaacatttcactgtgtcaatgaacatacttaatttttctggaagtgctatttaaattgcgtcgtgctatgacattagcataacaaagacataatgcattcgtttatgctgtagtagggaacactgccataatcagcggacacagtgtagggggagtgatgtgcagagagcagccccattgggtccctgtggctgtgcaggggaggtcttgccctgcagggcctgcccccagagttggctccacatggagttctggggcctctggcagtgggtggactctgtttattggcttgtttccttttcactgattttctcttctcaatgctctggcaaccgagtcctgctaatgggtgggtgggtcttggctgacagaagagaaaccctcaggagaattaggaagcattcaaatctgtcaggattcacccaccctcttcagcaaggcagggcagcctccccagaatcaaccagctggtcccagaaaactgttgccttgggtcctcagtctctccagccccctcccctaagaccaccttcagagctgtcacaggaagcatcgcaggggaatggctttattctcttaattttctacattttttgcatatccagctctgcaaaggggaagacagagcctgttaattgagcatctactgcctgccaagctcaagctgctgtttttacatacatcagctctgcttctcagctggctgtgcacacaatggtaagagtgctctcatattagaatttcatggtccagctctgggtttcttttatccagaacttctcagaacctttagtataatagtgcatcttatacatctccaagagggagatatgagtctcaaatctttaagacaatgggacctggtttgggagaggcaggcatgatttcatttgttaccctataaggattcaatgaagtaaggattactaacccatttcagagctaaagaaatggaggattctcaaggaagtaatttgcactgagctggcaaatggtccatgcgggatttgaatccacatctacctgactccaacaccagagggatgatgtggactggcttcctgtggggaggggaggggactgacagccagcctctggagggagtgaccaagcaggactgcccatgattgctgctggtcacacccgcttggactcttagattgtgattggctgttctgtgccagatgctgggtcaggacagagaaatgagggactctcatctgtcctgtgtctagaagcctttttggcagagggatgtgtttcagaagtgtgggtgactggggaggggatcgatcagcccaccctaacccctgaagtgaggctcataagggaggtcaactgagagctctggtgctttgggactgtgctggtatagaattgaagggactgtaactcagatgatgactcaga

SEQ ID NO: 52925 - DNA, 1029 bp, Homo sapiens
tgcaatctgtggcttctgtgccccacagcccatcatgccctctctggcctgactccacctcatggcctttcaactgcagctcctgccaccactgaccagcaaggcttttctgtgtttcttagttgagattcccaagagaagaactctggatcaactcttctttatgagccaggtcataggttgtttttctttgagtcaagttcctctcccttcacccaatcatctgtgtctaaggagcatgtgatacaaaacctgatctccagggaagcaaaggctatgaatagggcagttcccttggaaagggtgcagatagggcaggcacagtatgagctcattccaaatcgagagcattcctgcacctgagcttcaagccccgagccttctagatctgactgctcaattggttgtgtcaagagaccaaaaccagcctttgagttatggatggaccagaactggacaccaatccccaaccacaggtaagacctggcctgttggttcattggcacatgccattggtccaaacaaggagtgtgaatggttccttgcaggccaatcctgcaggtagagcatgtgttgtagcgagggctggtggatctgaagccctcttctattgcaatgactggtctattaaattggaggtggataccatacctagaggggcaattcagtttatagaagtcaccataatcagtagcaaccctgatctgcttagcaagctgtactgctccaacattgtaaggtagcaactgagcatggtcaaggccagcctaccttggtcttccaatatgtataattcagacagttctccaatagcagattgatggtaaatgtctgcagttcttcattcctccatgtatcaatgatctatacaacatgactaccatctgctatcaagaggcggagtttgtttccctacccctcaaatctagctggccgtgtgacttactttggccaatagaatgtgacaggagggacatcgtgccagttctaagcctagacctctgcaaaggctccttgcatgcttttact

SEQ ID NO: 52926 - DNA, 1099 bp, Homo sapiens
ggagatgatcgggttctggggagctgtcagcggccctctgagagctgcagtcggctccttgccctacttgttggccaacagccttcacccagcctggcaggcgctccccctccttcccccaccacccccacttcctgctcacttccctccctctcccggcctcagctctgttcctgacccctccactttcctgcctgcttaaagaccccggtcgctgggctgccccttccacccttccttcctgaccagtgagttgactggaaaggccagtgacttgaccatcccttagaaggcttggcctggctgagggcggggactttccccttccctgcagacccatgggatttttcccttaagtaagtcacctaaggtgcttcttctccagcttgaatccacgaattgttcatatgcacatctattcttttggccctggactgtgtgttcctaaccagcctcctagtggtgcagatgctgcagtccatatgccacacattaagtagcaaggacgcgaggctttcagctgctggcagagtggccttctccaaggactcgtgtcctcccagctcctctggatggtgcgccaagcagggccgcctcctccagaagctgtgggagcagtagcctcatgtgagaccctgcccctgaggaccacagccacagcacctttggctgccagcccggggccctgaccatcagagtcctgtcccaggtactcacctttcaccagcaccacgcactcactcctccctcccacccagtttagctgtaacaaactggcacattcctgagagtttattggagacatgccgcgtgggatgtcctaacctgtcctggctgagtgggctgagctgtggcagcaagagtgggattcaggagccggagggagtagggaggaactgggagcagcgctgggtgcctggggaggactctgttccacctgcagcacctcctccacactcccgctccccgtttgcttattagctcatgttcctttgcacacgtgctctgagacgcacacatgactcctctgcagctcagctggggcgctgctcctcggcattgccttctgcctttattgggttatagtgactcctttgac

SEQ ID NO: 52927 - DNA, 1917 bp, Homo sapiens
cagggcaccttggggatggaccagtgcccacatcttttgcccagcaggacaaggacctgaggcaggtatgcaggtgggcataaactttccactgcctgctcttgcagcccccactccagagatcaaggaaagctccatgaagatcatgctgtgaggcccatgtccccgaatgatggcagctctgggaggtaatttgacacaagagggcttggggctggtagggagggtgctccaggtacagggaaagaccaggcttttagcactttggacagctttgttagggacacccaggaccaccctgctctgctttggagccagaggagggggcaaggcagggtcaaagtagcaaccccagccccatctcagtctcttcctggagagtgctaacgagaaagggcctgccaccaccacctaagaacctgtgttttttcctctcccaccccctcttctttggcccctctggcctgccccagaactgagagcccttgcccgcatgcctggacccccaccgtagggatgatcccgttttagggtgctctgaatgccagtgcccagaatcatctttctgttcctgcccgggcttcacggagcccttgaccactgtgctggtccctgcccaggcttcaagccacatcccagcctgagctgggacctttctccctgctgtccagcctggccccgccaccccctccgctgcccactgtgcatgtgtcaggctctgcctgagacacccctgaggcctggaatgtcctggctaactttcaactttgctgtcattcactgcagcccttctggcctgggctctgcacctcacagcccacgtggtcagatgatcccagcgtgggggcaccccttcagccatgcagacgaagggccatgaaaaaggggattgggacagtttccgacaggaatttaccaccttctttcttctctcccaagggtttgtagccaccgtgcactcttccatccatgccccactcctccctgctagacccagaggcatttaatgccccaaagacacctcgctgtccacactaactctgtcttcatggtgcccagagctcataagttctggagtttgggtaagcaggaaggagccatttgtggatttggaggaggatctctggctgcctaagatggtcactttctggggccaggtgccctgagtgacagctttcgtctttacactagccctgtctcccactggagctcctgactcaggcccctgtcctcacaagtgtgggatgagggatgtgaatgtggtaggagatagtgtgcatgtgtgaggatgggtagctttgagtatggtgtgagcattagattagagcaagtgtgcacgtgtgtgggtgtgagtgtgcctgggtatgatgtcatgagagagagtgaatgtgtgtgcaaacgtgtgagtgtgttagagcataagcatgtgtgtggcccatgagtggtggtatgtggttgccgaggctgagtgggacattgcaggcatgcaaggtttggatcccaaggctcttcgcctgtgtgtgcgagtgtggaagaacatgctgttgcagtctagtctgttttatgaatgccctcactaattcactctttggattcttattgggtgctgctctgtgtcaaagtcaccctgctgggtactatgggcggcatccccacccccatgggtgggcagcagtggggcagacagagactagagcaggcctcagtgcccagaacactgccaggcacctcgtggatgcccaataagcatttgtagaaagaatgagtggaaatctaaaatttcataaatatattattaactgtgataattcacatcaaagaaaatcctagaggcactccaagaccgtataacaggggaacttaatttaaactgggggggtcaaggagggcctgttttgaaggtttccccccatgagc

SEQ ID NO: 52928 - DNA, 1881 bp, Homo sapiens
accgttccagtcatgccagcaggattttgctgcaagcacccaagagtccatggagacattctccaggccagggaagctggggtgctgaagcctcaggagcagccttggtgaataatggatggggattggaggatgaataccccagcttctttgctcctctggcaggatcatcctgggaggtagtctatatgtctcccagcacctccccatgggattgagcccaagttgcccttgatgattatctgctcagcaacactccccttcttggctccattcccttccctgcctcacctcccctctcttcaccagtgtttcctaggagcaagtcccaaataaagcgcttgaactcagatccttgcctcagggtctgctgcctggggagctctgctgagcagacatggaatcgaacctcagtgctgccaggggagctctgctgagcagacatggaatcgaacctcagtgctgccaggggagctctgctgagcagacatggaatcgaacctcagtgctgcccacctgatggacttggagctgtgaccttaactctgcctccccaacccactggcttgactttggacatggtgtgttcattgctttgggatctgcttctgatacttcaaccttgatcagaatttctgtgagtgggcagaggagtgctcagccagccagggctgcagcatagtcccctaaatggatgtgctaggatttctaagggagggttgtatccttgggttgggtgggtgactatttttttctgtgaggctgcaattcctagaccgagatctgaaatgactgcattagttttgagctcagtggctggggagaatttagtttgaccccaaagttattaattgtggagctaaaactgtcacaagacacctctaaggtaagtcggaatgtgttctcccccacaactctggctggaagactgccactcattctttaagactcagcttaaatgtcacctcctctgccaggccttcctcagctcctccaggctttggcagatgtgcttcagcagctccctgctcagggcttggtaactgcacttatcacactgccttgtcacttctcttccttcatatctctctgatcaggctgggagctccttgagggtagagattgttcctattcatctctttgaccctagaacccggggcttggtacagacagagctcagggaacatgaccttaattaatggatggatggatggatggatggatggatggatggatggatgggctgatggatggatggatggatggatggatggatggatggatggatggacagagagatggggacaggatggatggatggatggatggatgggcggactgacggatggatggatggatggatggatgggcggacagatggatgaacagactgatgtatgggtggactggtggggtgagtgggtggatggatgcattggttggatgttgaggaatcatggcattctgtgttgaagccaggccttagaactaagactgatcagctttctacagtggctgtcttcttgggcatccagctccttaggattccctctggaagctcagagaggaggagatagagagtctgggtcccgggggcagggagagggctcctctaggctgaagggtggggtcccttcttcttgggctgggtgaggaatagctgggggaagctgtgctccagggagatttcgtctctaccttctcctggagcgggcatgtctctccaccatccctgcccctacactccttacaaggacaccacagtgaggaggagggggagggaactcagccggaaggggccacactcacccttcattgctgggtcctactctgtgggagatcggacagagaagggccccaagtgtgatgtgcacagcaggg

SEQ ID NO: 52929 - DNA, 1033 bp, Homo sapiens
ggtgaagaaatcaaggcttagacagacttgcctgcggcaacacaggccatctcttcccacttgttgtcaggagcctttttccgtaagatcctggaagcagggccttggacactttggatctggtccatgaaggtgctctctctgaccttggcctgacgtggaagaagtggatggtgctgaccacaggctaacacagaggcaggtggtggaggatctcgggccaccagacatcagctacgagtatactcagcccagcacagagcctctgatcaattcttgactcacctgatcacagcccagctcccagcacaaagagaatgtgaccaaaagagctacttaggatctaattctggccaagaaggcggctggtgaaggggcatgatgagaacttgggaggaagtgccttgccagctctgtttgtgaggtctgggaaggatgcagcctgaacttttgaagctcagaggacacgggagcagggttccatggcctgagacggggatctcagagaactgggaaaactgcaggcccctgtttctggcagtgtggctgcacaccaacccaggggaagataaggcaacaggctggttcctgaggaaactgtgtggtttcttaggaagctcttgggtgagactgaatttatggcagacacattccaaggatggaaaaggagtgatggttgatgatgaaggcttgtgagaagtgatgtgattcctggaagacatcattccccaggagtttcaaatgctgagacattgagccaatgtacagaacaggcttagagaaatagccagaagtaaccataatggctgttacctagtacttttcacatggaggccatgtttgtggaccctggccatcccgtggatgagcccccaggcttagtcaatcatttgaagctgagagcaggggtcttaaaatgcaaaacaaaggtgcccaagggctgctccttcgacagatgtggtggactgaccatgatcaatctgtggtgactgaacatgatcaccatgaacaataatgatgatgattattattg

SEQ ID NO: 52930 - DNA, 1057 bp, Homo sapiens
agggcttaaattctagttgagggagagatagagatggccaggaaaatgggcctggtcacctctagctctccctaggcctggtatggccacttctggctcctcctagactggattggtcagctccaaaccctcccaggctgtatctggtcacccttggtcctttccaggatgtgggctaggcttgaccaccctgggcaccactcagctttaagcctggtcattcctggtccctcttaggactcagactgggcctgaccaccacggcactcctcagactgagtgtggtcacccccggcccctcccaaggtgggcctggccaccctcactttccccagaagctggcaacagctttggactgagtccctctgcctgggggcacctccaccgctccagatgtggttgcaacctgacccacctgggtccatctctctagagctcgcgtgcccccctgcccagtgccatggagtataggggggccagctccctctctctgtgtttgtcattgagctctggaattatatttcttgatttaacaactgcgagtgtttgctgcagctttactgccttaaaaatgttttctaataatccccaggtgtttctcttgcatacaatagcctggcttgttacagcccaattaaatcctgatttgagacacgtaattaaaactctgaacagaacgcgccataaaccttgctccttgccagcctcacgcccaaagtgcctgcccctaccctctgtctcctgcttccagggcctgccgctgacatttgtctacttttggttgtgacttggttgggtggaggcccaatctgtaagtccttggaggtggagctcctagagatagagggatgggctccctgaacccttggggtcccaattccctacatggaattggcttcttctggctgtccctagaaccagccttctcagcctcagcactcttggcatttggggccaggtataattctttgttgtgggggctatcttgtgcattgtagaatgcttcgcagcatccctggccagtagcaccctcccccacaactgtgataaccaaaaa

SEQ ID NO: 52931 - DNA, 1085 bp, Homo sapiens
caaacgatgccatgatctgcagtttccccactgtcacgtctttgctctgacagccacttgcagccaggccagccctcccgtctttattgtgcaccatcgttctgtgctttaaggcttggcccacttccccctggctggcccagcccctggcgatccctcctgctaactccagcactgttgttagggacccagtgcctttgttgttctctgactttctggggattgtgtctgcttttggacttggctacacaccccttgagatctaggacataagcatgccttaacctccttggcctcccagcagcgcccagcattcctctgtggctttcagtggatgtgatgggaaacatgggactggagctgcccaggaggccagagtcagccctagtgggctgcaaggtggggacagagatgcagccacaggtaaggtatggggcctggtcctttcagacagattatgatgtccaaagaggctggcatctggcatcaggtggggacccaggcaagcagggccatcagggaggcaaagcatggggcatacaatggccagaaagtaacagagcccagagtgggagtcgcaggagtaggttaagttcagcaggtgaaaatagaattgagggttctctcattagagaaactgtctttagagggaagaggctgttagataggtgtctgagacaggcacttaagcccaggaaacaaggcaggaaccctgcatcacacccaggggcctagttagggctccagctggccaactggggccgttgatggtgctgacttcctgcagtgctgggccgggctggtcaagtcccttttttcttggctgggcctgcaggtgggaacacagcggtctcaagagtgggaagagggatgaggaagtcaagttacacataacaggtgtattttcagtgtgggctgcaggcactgcagttaatcgctgtccccattgttgtcaccctgcctaagtcacacatgtgccatctcttccattggacagcttttgaggacacacatacgcaaacacagagttcagctatgaccatagcatgccaggcatgaagcttggggagggacctgatgtccct

SEQ ID NO: 52932 - DNA, 1051 bp, Homo sapiens
tcccaacacccatcaagatcggatcccacctcctctagcaggttttctaagacactcccagaaggaatggactcttccctcttcttccactctccagcacctgaactcagtgttagaagcaaagagtcaggtgccagcctgactcccagctctgtttgactcccagctctgttacttactggctacctgaccttgggtaagttacttttcttctctgtgcctcagtttcctcacctgcaaaatgggcgtaataacagcacccacctcattgggagacctaaatgagttaggatgtggggagcatctgctcagtgcctgcatgtagtggtgccctatgccgtgttccctttcttttgtctaggctacagcctctgctagctgtgccccctaggagtggcctcaggaaggcagggatgtgggcctgtcctctgactccctgcctccattcccatctaagagccttgcacagcagagggaagacggctgctggactcgggccatggagcagcatctgggtcataggaagcgagtctggtgataggcagacctgagttccagtcctggttgcaccactagcttgctccctggcctttggaaagttccttaacgcctcccaggcctcaattttctcacctgtgaagtgaagacaataattgtacccccctcctaaggtgctgagcacagccaagctccagcccctccaggatccatcgcatagctgccaacagttcattgcaggctggtcttgattgccccacctccctcactctgcggcgcccgcaggtaactcagaacagagctcctgctctgatgtctagcccacgtgcctggtttgcatggagactgccctttgtccagagggatttacatttttaaagagtaagttcacctgagtcctgtggggcattgactcaaacctcccattagctgcctcctcctctcatgctgaggcttttgcagaaaatcatttaatgttttctctgtgtttaaagaaagctccaagggcccatcaggctcagcctggctggcatgattttgaaacaaagtgcag

SEQ ID NO: 52933 - DNA, 1654 bp, Homo sapiens
tcccccctcagctgtcccaagtagctgggactacaggtgtgtgccatcatacccagctaatttttgtacttttattagagacagagtttcaccatgttggctaggttggtcttaaactcctgacctcaggtgatccacctgccttggtctcccaaagtgctgggattacaggtttgagccaccgcgcctggccctcaacatcttttgatgtctcactcttctgaagactaacctctttgcttggaattcaagaaattctctttctaaactctatttctgggttatgaccccttccacaccctcatcattttaattttaattggttttttaagttgaatcagccaacattcaaaaattgggacgtttcatatgaaattttgggtttccagcttctcttcccacattcacatatgcctcagtccccacccctccttatagtcatttcctgttccagggccagtcactgtcctgctgctgctgtttttctttcagtaaagttaagaaggaaaagtaaaatgtttttattttcaggagtaaacaaaagacagactaggagggccaattttttcaaatttgtttctctcaccagccctgtttcactctaggtttctgctggccctgcaggcattgagccactgacctaccacatgggcaaagagcaactcagagggagggatcttgtcccattcctgtttattgtgatgataacagcaattgtttattgagcccttttctgagctcatttaaccctaaggtgagtctaatcattcccactttccagataaggaatctgagccttaatgaggtgaaggtacccagtggagtgagtaagtgatgggtgtcactaagacttgaactcctgtctgcctgactccattgtaatcccctgtgtattcctagcagctgcccctagcaatgcccacaattggcaattaataagtgccagacaagtcaacttgaattccagagtcacagatgggatggggccaggtgggaaacttctaaccttaaagtgaacagtggcacatttaggatactcctgattcttccttccttcctttggtgcctgcctgggcacaagtggctgctgtgtgtctcttgggtggcattacccagagttcagttaacatgtgctgggcaggaaatctgctgtggctccgttttgcattaccatgtctttgaggtgtgtggacatggtgcaggcaccagatcttggcaggagcattttaacaacctctgtccttgttcgctccctgtagtcctcgcagtggccgcaggcccatctctccaacacagacccagcaactaattgggcctggataacaaaccacacagacacaagccccttcgcattcccctcctggactgcaacgtgggaggctttccaaagctgccaccttctgctggagccggagttgggggaaatggggagaggctgacctgcccaccctagacaggaacagggtgcttggcaccctctccctggctaggctatggacctgggggcccctgtggcaagagtgtgggctctttggtgtcaagagtcccctgtggacattgtcaggaggtggctgcagaagggagatttagtaatgaacaaagcactggctccccagcccagaacagtgtctgtaaatcccaccttgctcaaatc

SEQ ID NO: 52934 - DNA, 1011 bp, Homo sapiens
agacaccccaacctctgtgttcagcaccacggagagcagccagggccgggggtagccggtggcgccatctgcatgctggcttttctagtatgggtggtggggttattgtaaggtcttgctaaacaggcattcttttttttcaaatgctattcctttagaactctggtaggctagtaagaactgttatttgttgttgttcaaatagaataacgcatggtaaaagaaaatcaaggtaatagatggaattttctccttttttttttcctttccacataaattgttcattaacctttggtgccttgtacggcttgtctgctagggagcagcagcagatgacaaaacgagtgagcattccattgtcaaatgtcacacctgataccaagcatcttggttcggcttgtcagcctcatctttcacatcgcattttgtaagtaggattgtgttctgtatttttatcctgccaaatgtgatttcttaaaagtattttgtgtgttattatttcctgagttgtggagacctgcatacctataatagagccatattttctgctagtaaataaaattattcctcattcaggtgatgggaattaaatgtgtcacagcttggtggcattccctaaacaaccccagcggttccaggtgctctaccacctggatgtgtctgggaaggcttgtggtgggggtgggcattgacaaagcctctcccagacagaaaagtcgtgccaggagtgacctcagtgtttctcagaaaaatggtgcacttttatccatcactggggtatggagagttggctgggaacacctggactagagctcaaaggaccagagaaggtgaagagtgttagaatgatagagtcagaggaattgtttcacttgcctctgaggaatttgcctctgaacaagaaatgaggtttaggcaaatggaccccaaggatttaagaggtaagatggcatcttggacgtcacacagcaaatagaaaaatccagatggtcagggaggaagtgagctatg

SEQ ID NO: 52935 - DNA, 2055 bp, Homo sapiens
tctctggactcatagactgtccctccttgcttcaccctctctgatccactgcattgaacatctaagtccccagaaggcactgtgctttcccccacactctgggactctgcactggatttccttttttctttcctttttctttctttcttttttttttttttgagatagagtctcactctgttgcttaggctggagtgcagtggcgtgatctcagctcaccacaacctctgcctcctgggttcaagtgattctcctgcctcagcctcccaagtagctgggactacaggtgcatgccaccatgcctggctcatttgtgtatttttagtagagatggggtttcaccatgttggccaggctggtctcgaactcctgacctcgtgatctgcccaccatggcctcccaaagtgctcagattacagacgtgagccactgcacccggccggcactctatttctttctggccaacttctactcatactaaggtttcaatgaacatgtcttttcctccaggaagcatttctcaacctccatccccttctgagtcccacagcaccctctacttttcctgttgtagcacttgctgtattataattcttagttactttagagataagtgctgtaccagtatgggccatagccaggttgttcaccaccttatccagtgcttctagcacagtgcaggactcctagtagataattaataaatatttgttgaataaatgaatgcaatggtgaatatggtcatttgaatgtaagtccacctaactgccccggcatgcagctcaacactttttccattttgtcaatgaggattttatgaaggatgttgttagattcttccacgaagtcaagatgctcatgctgtctatggtggtcttctgacacaccagttctgcaactttttctgtgccaggaccttttagatttagtcttttgggcagagctggaatatttgtgggagtgagcccttctttctcaagcctaggattggactttacattcattgtcttgttcctatcatgatgaatttcttgagagagacaaactgtcttcttaaagaagagactggaggagagatcacagtcctcctgccttttctgacctcacccctctctccttcccacttgtccgtcagcatctcggctgctctttctgggagctgaaccaaggaagagaacctctgctgtgctgtcgttaataggctgagcactcaggacagctgtgaggcagaaatgtggctgggccattgctctgctgcccatcataggtcaggtctctgtctttaccacatcactggctcctgcaagggtatgtagacaactggtcaacatgacagcttggtgtaaagcagaggtgttgacagttaacctggagattcaggctgtatagacagtcaacggaggccatttagccctgggaatatatgcatcctccacaccaggttctgaggaaagtgagtgtgtgcacatgtttttgtgtccttgcaggagatgaccatatggaagtttgcttctctagcacagacttctcaaactggggctcaacagtctttctttatcccaagcctgatgagtgagtagtgactttcctttgtatcagtggggaaactgaggacttaaaggctggtcccagttcctgactgactgggctgatctgtctactgtaccaatgtgactgagagtgaggatggggcaggtttgcaatggagccctgagcttcccctcctgaacacaacagaactgagctctcccctgaggccaggcccctccttttcttgcttccctccctggggaaacatgacacatcatgagcagaaagagcctgttgcctacatgaccatttttcctgcccagtttaatagaggtgacagccgtctattttacttgtctcgtaacattgaatcagtaaataaaatatgggtgaactctcaggtttagctgaattatggctggtctatggggactgtgggctgggggagagttgagcaaagaaattgaatccctgtcttcttgcaagagaagcagagccttgcgtcttccttctggatccaggaaa

SEQ ID NO: 52936 - DNA, 1028 bp, Homo sapiens
ccttgtgatctgcccgcttcagcctcccaagagcaaagtatttaatatctcaaaataataataataataataataataataataatagttgtacctgcctcacagggtttttgtgaggattgaatgagttaatgcatatgaagtgcttagaacacagccgtggtaagcactcaatacatgttgtctattattcctactattatgatcaccatgcccactgactctggcttgagtttgttccctgtcctacactagagctctgcagaaacacaaaggcatttatttcttcagactaaagaggcttaattcctccagcatggcatcaaaagatgaccacagtgctacttatttattgaaaccagtaagatcatcacctcctcagatctcagctttggtgtctagttatacaaccccagattgtttcaggctttttagcagccattcagtctgttgatttatcctaagctgttgttctcatgagatacatgagatcttttccacaagtattgctgctgatctataacttttcttatcctccctttagtagttgatattttgagcctaaaggcagaacctatcatttatctcccagtaagttctatcattgaaccttcaggcagttattcttactcattgtttctggaccaccagagcctattaccatgtctccatgcttggaaagcaggtatggattacaccctcttctaaccactgcctccctcctggggtctgtgttagagaggttaagtggttattagcctatagtatggttggggttgggaatcactgttctgaatagtgaagcttttggggattcccattctgatgtctcgcatgcttcctgccatctgagcctgggataaacatatcctccctcccttcagccaggtctgccataaacacattaaaaagaaaatgagcaatgtcagagtctgatggctttattcaaatggtcttggatccactatcctacactttaacgagcttcagaattccactggcttccttatgccctcaggccctttatg

SEQ ID NO: 52937 - DNA, 2439 bp, Homo sapiens
tgagcgtttctttttgcccttggaggagtctgtgcacagggctgggtgtagggtgatgctagggagacctccagggagctgactctaaggaggccctcaaatgaggaccctttgcttgcatgactgaccatgagagggggtgcctccttaaatcctggccctgacccagcatctgaatttgcttctggagtatgcttttcctcccacttatctttgtgctccagagacaaatcctaattgagcatgatttggagagatcagaccaaattgagggccaggggactgggtttgaggacaacaggttgttcagattttcttttgtttctcatagccacatttcatagcagccatgcccctagagccgtctgcccttccttcctttgttttatttcctttggaaatcgcctccagggtccacactgcctctccctagtcacagctcagctgcccaggtccttctccttgcttcctttgacctttatgccttgtttactaacagtattgaccttggccatggttttctgggggtgagtcggtatctaggctttctctaatgcatgtgcattgtgcctcccccactagacaaggagctacccaagggtgtctcaggccatctctcccccatcacttccaagaaacagaatgattttttttggagtcaataatatatttcattgattctaagatgggatttttttttcacattttcatatctctgacatcagctcgtgtctcacatgtcatgtctaagtttacttgcagaattttttctttcttggcactccaagaaagaatggcatgtcttgggtctgatgaaatgtggtggatctatttttgaacgtgagtccaatgtgtacttgctgtgtgaccttggggaagtcaccgcacctctgagcttccatttcctcatctataaaatagaagtattaacgttaggttgaaccacgtgcagctattgttgacctacaaaaatcttgtggttgacccttacagtattgtctgcatagcgttattgtgaggattaaaggagataaagtacgtaaagctctttgcatagtgcccgatgcttaataaattttaggagaaaaaagagagttccccaagggtggggccacatctccaccgactctgagctctgaggctgtctgcatctcatgtgcccttggctttgtgctaacccctagtgccccatactccatgcagccttgtatgtggcatatgcccatcgctcacatacccatgggccctgcactggagttggtgggcctagcagtctgtaccaattattcactgtgatagggagcaacagaggtaccctttcttggatgctcataatgtcagctcccagacaccgcctggcccattatttatggggtgcttgttcttccctgattttgcagcattttgattaaaatgcattttgcatatgttcagagctgggaagaccctggttatgggatgttcttaaggggctggtccagagagtcttgatcagcccttctcagatggggagtacaatctcacctcctgggcaggccactggagactggagagggtctgaggctagaggccctaggggatagacactttagctctcctagaagacagcaggtaatgaggacagaggcaaaaggcagggaggagagagtccccatggtgatcatacagatcggagatgatgaaatggagtgagatcctgggggagtggtggtttcaactccaaattctttggtgccatgctgaatggtagttaaggatagcagagcagggaaaagcagcaagaaggaactaagattctggtttgtattaaaagggttccaattcataggagacaattaagtcttgtgctattaaagggactgatgcagacaggctgccgatggaagggggtttatagagttctcagaacaactgcagggatgagctctttaaatatgggaatgagggagacttctgcaaagcctttctgcatctgctttgcagaactgaaatatgctattccaaaaagctgcccaattgggcggaaaagcaggagcggggagccaaggactttccagggctccaggcatcacatttcctgtctatggtgaagaatcaaataatctaggctgaaaagaccccgggggtcattctaggcctctggttctcaaatattagcatgtgccagaatcacccaaagcactcattaagatgcagattgctgggccccatccgcagagcttctgattccgtgggtgtggggtgaggcctgagtgcttgcctttttaacagtttcccagatcatgatgatgccgctcatctgggagccacactttaagaactgctgttctaggtcaatggaggaccccactacatacaggtggatagccagtctctgattgaatgccacctgtaatgggaagctcaccaattgtaggccccatccatgctttactgcag

SEQ ID NO: 52938 - DNA, 1720 bp, Homo sapiens
gagagagagagaatctcatgctaaaatccaaacacaccaccttggctgggcccagtgccctctcccttttcccatcccccccatccctgggatctcagggttctggctggggctttaagaatttaggccctctggagtgtgctaggtgcttctgattctcaagactggcacctgagccggctgagcttggagctgaatgcttctccagcagccaggcatcgccgagcaccagcccggagagggctttcttgcaggtgccagaggggctctctgggctgaggagcatcgtacccaccccctctctttgtgcctcttttgggggctgaaatttcctcttagacaaggagatggatagctcagcagtgtgacagagtgttcaaacaatccgtcttgaatagatgaattgcattgctctgtctttttgtaattgtgtctatcagaaggagaggtcaaggcattgattgcttggatggtttgcaagtaacaaaagagagtgagggagagagcaagggagagagaatgattggattgtagtctgcgagaaaaaatgatcattgattattttatgtgaatatgtggaagatgtattctatgtatgattatcaaatgttgtgcattgaaggttttcaagccatattgtttggcattttattattattatcgtcgttattattgtttgggtgaatcccagtcttaacttacggaaggcagtttaatgcatagattctctcagccaaacgggcttcagtgacctcccgtggggacctgaatttccaggttacctgaccccaaatctgtagtggaggggctgctggacttggagccaggaggtctgggttttctgctgcatctgccaccagtttgttgggccatttccatcaaatcacacctctccctggcaccccaggcctcagtttctccatctgtaaactatttggttggccttaatggttggtatgttctgtggtttcaaagttccctttagtgcaggctggcgggcactgttatgccattgtaggtttcatggttagttctctcctcatgttatgggcatatgtaggattgagggccagcctggaatttgaaaagggaactagacagtggtggcagcagctggggaagcctggccagctcttctgtgtgttgaggagctcaagtggatggtggcgatctccagccagccagtggggaggtttgaagccaaatgactgcagagacataaagcaggtgttggggggggggagggggtggggggtggggaaaaggaagggttggcccagctctggactctgagcatctacagatagagcagaactgagctgcaaggtcctgagtttcctgaatatacaggggcccagcaggcaacagcagccgatccctggggagagacaccccctccctcagagttcccaaaccggcctcatctgtaactcctatgactggttcacccaaattatcctaaacattcatctcttgagtttgggagccgctgtgtataaaacaatgagaaatttctcacagtgactggtgatgcgctgaaacatcgctgccttgtaggagcagacagcagctgaatgaagatcaatagggttttcccccctggaagtaaatagcttcagacaagacctgggagtggcccgcggggccttagagagcattaacttgaggaatttctacctccacttttcagcccagctgctgctgttagccccagctttcc

SEQ ID NO: 52939 - DNA, 1934 bp, Homo sapiens
ggctgtctcacaggactgcagtcaaggtgtcactggggctgtagtcttatctgaaggctccactggagaaggatctgcttccaaactcatgcacgtgttattggcaggattcagttcctcaagggctgttggactaagtgtctcagtctcctgcctggaggctgacctcagttcttaccaagtgggcctctccagcttgtttcttcagaataagtacatgaagagccagagggacagacagatagacagactggaagacacacaatacacacctacagaaagagagagagagagagagagggagagagagataagagcaaacaaaactgaagttacagtcttttataacctactcttggaagcggcatcccatcaattttgtcatattcttttctttagaagcaagtcactaggtccgggatcatcaggagccaggtcagaatgcaataatatttattttgtgggtaagtcatggggattaaatgagatactaggtgtgagtacctagcatggtgcctaagctaagttgggctatatgctgaacaaatggactattattattgctgatgttgttgttattctcaaagcgaggctggcctggggctgagataggacagaatccaacaactagcctcagtttccattggcctgacatcatgagagtgtcacggactattaacaaccccacccaactccatctccatctagtcaaatcctgcctatttccctgggttcacttggttgccttctactctaggaagcttttctccaactggatgatgtgagctgtgtttctctgaatgaccccctttgttcacagggaagggagccaccaccccaggctgggctaactcgcatgaggacaccactaacattgtctgcgttccatttacgttagacaggcaggtctacaatgtttgaagtttacagatttcttggatatagcagtgaaaggtttgtattttttatctgtaaggaaaaattgtgaagtttacatcattgcaaaataaacagaactgtgacttctgtttcacaattggcgtggttcttttgtgtgcttttgacagttctagcatgttactgacagttacaagatttttttctccctctggaaaattgggggaggggtcacgtgacaccttcccactctgaatgctctgcttatgttaaagatgcagaaactgtgactcagggcagttaggtgactggcccaagatcacaaaacagttgaagcaggaactgaggtcagttacctgatcccaagactcatggtctttgtattatattcattcattcattcattcattcaataaatattctgtagtccttgctatgtgctagcctttgtgccaggcactagggattgagtgacgcatgagcaggtccttgtcccagccctaaagagcttttacattccccttctcccctgactcccactggattacaactttgtccaaatagaaatccactttctcagtacccctccttcattgtgtctgtctactatggggctttgaatttgaactggggactgtatttcaggagggggttctatcagccattggtgtgggtggaaacgtagcaggaaatggccttaaagtcccaagagagaaggatctgataagataaagaagttggatggaaggtggtcaaacggaagcccccatggaaaatggagaatgaggtttacagattaaagcaactgattggcttttaacagctgattcttctccacctccgttgctagccccaggtcactttcctgtcccatgcatggcacttcaggagttaaacccaagtcactgccttcctgcccagtgagccaggtgatgggattgcagttaatggtaatttgaacaagtttggtcaactagaaatacataaggagattgaaacatgaaaatgccctcggaatttatacaattgatatattg

SEQ ID NO: 52940 - DNA, 1610 bp, Homo sapiens
aaagaatgagaatatgtattaggccctagatacaacccagtggctctgttgctcagggctcccctgggccatcttggtcctcacttgggttcaggctggagaggtctggcagtaggcacccccagagagggaggtggtatgtgtcagctctgtcagattggaatctggcattggctccagcaggctccacagccactgtagctgggctggggtttgttctggtgggtgggtggaagccagagctctaacttccccatatccttggctctgagctgcgggcccagctttggaaagattgcggggagcaaacaccctgggctctgggaagttcaggcttggtgagaggttccagcatgaaatgggagaactttctttgttttccttccagccacaaaaccagagactgaaaaaggagacagagggtgagcaagagagagagagagagagagaaagaaagaaatagagagagagagagagagatggaattggtccctctaattgggtcagatgacccatttccattgcatctgtggttcctgatgtccagggaaggccctgggggcagtgctgggaggaatccttggcaatgttgggtcccatcactcagtgtatctgggcacagtgttattcactcagttcatttatccatttgcttagcaaatattcattgagcatctactatgcagtaagccctggatataacttgaacaagtcatgggtctgcactttctgcacattgcctacattgcaaagcccccaacggtggtattactcacatcccccagcccttccaagatagcgagctactccctgaaacctaacttgatggcgatattcccaacctgcagtggaccataccatggacatttttccacattactgtatcataacagttccttgtgggagcctaattctggcagtgtgtgtgttactcggtgaatcccaatgcagccattccttatcttacttggtgcagcctcccagaggcatcactcacacttctcgctccaccctagtggtgtgcatctcccaggactgcctgtaccatgcacactctttacaccatcgagtcctccaggggaaagttactctgctcacctccacctggatctcccaaacctacagagaagtattgcctgtggctgctggtggcagtggaaggggacaacataaaggaaaggagaccgagcagaaaagacagaagccaaagcccagatgctcctggagcaggaagagactttgcaaaatggctgcagctccttgcaaatgatgtatgaaatgaggagcatatgccgggagcgatttgtgtgcaggagcttggcttggctccctggtccctcctggcagtgctgtctgctaaggccctgcgctcccagccccaagcattctgggagtcctctgaaggtgggctccaggctcctcctccctccctcttcccaagacaaggtactgtacacagtaggtgcccaagctgtgtggcggacggatcatttctgcctgtcctggttctctgaagacagaacaggagggaggagggctgagtgagtctgagatcaacaagccaaatcttggcatttcccagatggggaagcggagtgcagagaggagga

SEQ ID NO: 52941 - DNA, 1076 bp, Homo sapiens
caggacctcgactctgctggcaggacacctcacccacagagtgttagttgagtgagagatgaaccatgcctggctttgttcatccacgtagcccagctcctagcacagacctggtggaggggctcagtaggcacactaggcatgaggtcagtgaagagacaggagagtggtggtggccatgagctgtggtgctgaccacatccaacatccccagtttccttggtggctggcaacttctagccaataactggtgctcccaaaatctcgtcaccttgaatgacccccagcttgtgttgaggaggggaagattattgtatgctggggagaaggcagtccaaacagctagaagcacaggccctgagccatgtggtgtggctcaagtccaggttctgctacttcctgtttgtgaggctttggcaagacctgtaatcccactgaacctcagttttctcctctgtaaaatgcagatgatgagaagaggctctgtctctccaaggtgagacgaggattaaatgagatgatgtgcagctggtttgacacacgccgtttttacctattttaacaggagtgctgagaaatttgccccagcctcctctctctcactctgggccccagggtgttcttgcccttttccttctctggccagcacagcggtctacctgtccacgtgttctctccttccttccagcttggctaggtggggatgctggtgaagaagcagatggcagccggggctgagtgtgacggtgatgacactgtgaaagggtgataatttattctgttcagccttgactcggagttggaaggagaaatcaattacttctgaaaggcaagactgagggtgacctccctttctgacctctaacaggcagccggcccttggtctcctggctcctggagaacaggcctggaagaccccctggggcccatccctgagcagggacttacggcaaggattgggaagtgaggagcaggctgcaggttcagccccagagagagggggctgggaggcagcagggctctggccccatgcggcagggatgccaggtgcaggagagtgctctcagtgtctttaa

SEQ ID NO: 52942 - DNA, 1020 bp, Homo sapiens
taagtatatgcctctaagtgtgcagctctatgtgtgtataagagtaagtgtgcactctcacttactctgtgtagaggagtatgtgtgtacttcgctgtgtgtgtcagagtcagtgtacacctgcacgccggcccgtgtgcatgtatgtgtatcctaggtggggtgacagggaagatgtgaaggaagattcggtgcagagtacgtgtttgtgtatttgagggtttttgtgatgcacaaacgtgcatgaagtgtctgtgaatgtgtctgggatgcttggggtgtgtgtgtttgtgtgtgtgtgggcccctgctgcatggtccaagggctgtgtgagttgtgcttctttggtgtgaacagggaaacctgggtagggaaggagtatgtgggtgtgtgtgtgcgtgtgtgtgtgtgtgtgtgagagagagacagtgcacgcgagtgtgccgagtggcaggaatgacaaatgattaatctatagaaatctatattctattcttccatgcgtccactccacccttctcacgcgcccatgcatcacctccggaaatctatcacccgactcccagccaaggacaggctgcgaggagcgagtgcctgccttattgatggacttgcctggtgctttttacacatttggatacgtggagaaggaaagctcactctggctgtgtcgttcatgctcttattcacttattcattcattcagtcagtcattcatccagcaaatagttctggagtgcctactgtgtgccaggaatggtcctgggtgctcagggtgtgatgatgaatgaggcatttctggcattaagggccagtgggggtcccagacagcacataggccactttggtagaatgtgcagggggctctggaataatacagggggtttggaaattaacctcggggcagggggcggttcacagaggctcctgaaggaggtgacatctacgggagctctgaagggtgatacaaccaaagggtagggagaggagagggtgcaccaggcaaagagattagcatct

SEQ ID NO: 52943 - DNA, 1050 bp, Homo sapiens
ctgaccatccttttggacacagctcagagccaataataagagtttgagtgaataagtgaatgagtaatgactgacattttgattgtgctatgacaggtgcagttcaggagaagctcccttctgggagtaggtagggatctgggtgcctaggtttctgggctttgtggagggtgagacatttaaagggtttagtttctaataaccagaatccaggatggaggcttggaggaaggtcaagggctaggtttttggcagcgcaaggtaaaaactccatgtttacgcagatgactgggatagggagtataggggaacttgtgggaaaggtgggcttaggagagtgaacagggcagaagctgagagtcttcaagtgctattgaggcagaagggggcagctcaggataactccaaaggcttcagtgaacacagggcactcacatagcctgtgggtctggaggctggaggactgtgtgtgtgtgtgtgtgtgtgtgtgtgataacagctctgaacttcggagaaatgcatgaaggttctgggcctgggaccccaagaggtatttgtgggggtctttgggagatgctgtgagaacttggagtagagggcatggtcccacaaggtgaggaggtgcctcggggtgcctggagttccaggtagggcagacagggcctctgggagggcagatgcaggggcctctgggatgttgggggaaggggcattccttcaagctctatcttcccagcactaattggagtggctggccagggaaaggctgggcttagggcttttcccccttcagttgggatgtaagagaatttcctcctcagcctctgcatactatagaaagcaactcacagagcacatgtgaaaccatgtatacccaactggtaaggccagcagaggtaactgggggaacccaccctcagctcgccttggccttcccctcagccattcacctgcaatgtgggggacccaacacaagaaatagatgaacaggcatctgccttatggggcatggggttgaactcactggggtgggagaggggcccctgggga

SEQ ID NO: 52944 - DNA, 1091 bp, Homo sapiens
cacacacacttacacacctctactcttacacgcttgtagaagctccaggatcctgaacacgtatctgaaccccaccaccccgcacttatctcctcacacactgtagatattaacatccccctcctgccctggctcacagacacacacgtgcactcacacatatgagcacacgtggacacctctacaccctcccagacgcccccacaccctcctgaagcacaggcacatgaaggtacacccccacacgcctgtgtgaacccacacactcctcccgaacccacacaccatgggcacacccctcctcccagcggcagctctggacctgcctgtgcccacccccgccgtcgttccccgtaaatgtgcagccatcccgcgtccccgcgctgccgcagcccctcactcggggccctcaaagagcacgcttataaaaacattcttcccgtgatggagtgcttcctttgggcttcttcggcttgtaacagattaaaggcgaacaggcatttgtcatggggaagtgtacccagttgtgctggaaaatggacttttcgatgagcgtgagagcttgaacctgtcacagaggggagagcctgtgttattgcagcctgccgggccgcggtggccgctgcggcttatcggctgtggcaggcatcacctacgactgcaaggatcccattacggtaagtaatggcttaatcacagccagtttgtaatggagatgacctctccgcgtcccgctggccttttcggatggattgcacctctccacaccgtgactaacagcactccgttctgctctcctgagaaagggccacggggctcagccggacacgacgcagacggctccggggaggctgcagagaggggggagcgagggcaagggcaacgggaggaggaagggcccgggccctgggcaccaccgcgcccaatgtctcacacaggcgggaagctgagacggggagagggcacgatgccacacgcggcccccgtcttttcaagagtgatagtgacagtgagagctgccattgggtaggtgccaagagagtgtttgtgtttcccaggctttatcttgctccagtcacgggaagtagaat

SEQ ID NO: 52945 - DNA, 1063 bp, Homo sapiens
tttctttatttcttaataaatattacatgtaatattacatattatttatataattatattataaatgttatttataataagacatattttcctatttttttttattagtgaggcctctcctaaccaccttatgtaaaccacctctcccatctctctccccttcccctggtttaccctgacagtgtacttaccactgcctgtcatcccactgtgtatttatttattgtcttgctctagacgctgagtctgtgagcacagaaaccatgcctggttttgctcaccatgctatcctccatgccccagccaatttctggcccagagtagatgctcattaaatcattgttgaacgaatgctcagctgtgggactgggggttgggtggctgaggaatggcacctgggaggggttgctgaggaggctgtgggccctggtgatttctcattgacgcttttctcactcaatccttgggtcttggagagatgggaagtggcagttgactctggggcagctgtttaagtctgacatagcaggagccagaaaaaaaggtggccgtgcatgggcggccgtcctatctgccagtcagagacgctctgctgcaaggacggggagttggggagggtccctggggccaccctaccttccctcgtcctccgttttactataataacatctcaccttcaccaaacactgactgggtccaggcgaagttttttttttgtttttttttttttgagatggagtctcactctgtcacccaggctggagtgcattggggtgatctccgttcactgcagcctctgcctcccaggttcaagcaattctcctgcctcagctacccgagtagctgggaccacaggcgcccaccaccatgccaggcaaatttttgtatttttagttgcgacgggggtttcaccatattggcgaggctggtctcgaactcctgacctcaaatgatccgcccgcctcggcctcccagagtgctgggattacaggcgcaagccacctcgcctggcccaggcacagttctaattgccttatgtggattaactcacttaaccctcgca

SEQ ID NO: 52946 - DNA, 1516 bp, Homo sapiens
cctcttatttctcgagcctcgccgactgtgtgccaggcactgtgctcagtgctttacattggtgatctggttcggtcttcttgatagtcctgaaacacttgcattatgatgatcagcactcccacttcacaggggaggaaagagaggtgcagggaagttaagtaactaggccaaggtgatgctgctaccagcaagtgggccaggacctgcgctgacaatgtcaccttgctgtatgggagcccggtgctctgtagattcacacagaggctttaaccaattcaaaccctccatggtgggttctcatcagtgccttaaaggaatatgtttgcagatggtaccaagccaagctggccattggtgcagtgtttctgcatgagtctccccttacagggaccagggacaagggattggcttccttccctggtgttttgtccagagacagatgagcgaaaggggttggtctgagacaacagccctgatggtcactctacccttcagccagaggcaggatgggattgtgatccagaggtttagctgagccttagacatcagaaggaagctggggtcccagaggagtgagctgcaggcaggagagcagggtctggggtgagtcctggaatcacagtcaggggtctgtccagggcagtgggcactgatgagggcttacagatcctgggttggaggagcagctcagagcaccttgtggggcatttatcttcgtcttcatgtttctgatttagctttttttttttttctccttctgtcctcctctttgctctcttcttcctcctcctcttctttcaatatggaaatatgattgtttttctgaagataaaagttcatgctctttgtaaaaaaaatccagacagtataaaagtttaaagacaaatgtaaaaataatccatactccccaccatccagaaataggccccatgacatttgggtgtgcagtcattcagacttttcctgtttgccagaatggtgtcagatcatacaaactggattccatcctagcttctcactttgcaacagaccatgattgccccagcagtatctgtagaggtaccttgtcattccatgctgtatgggcttccatttttggatgcatcattgttcatttagatcttattggttgtacttcttttctaaaatacagatgtgtgtgtttcaagggacttggtatggaaaatactcatgtcctccggccacacatgtttcttcctcctcctctctgaactgcccctggatagaggtccccagggttcgagatggacaaagagaggaggaagaggctcagtgtcctcagagagcaggggagtgagataatgagagagagagagagtattccgggcacccagctggcaggatgactggatgtaggcgagggggacatcgggacgcgttacttgagtgggcagcagagctggggcgatgcctaggctttcttgggcaacttgacattctagatgaaaaaaaatccctgggccatgagagaatgagatgccaaacttcactt

SEQ ID NO: 52947 - DNA, 1076 bp, Homo sapiens
atataactcacaagtctattggaatactttttacatttctaagatattcttggaatgtgacttgtgggtgcataaagaaaaccttggtccgagaaacacagacatgggttctagtccctggtctttcaacttgctgtgtgatcttgggcaagtcccttcctctctctgagcttccattttcccatctggataatgaagggattggaggagataatatgtaagaacctcactagctctcaagtgagcatcatcacaaaatcattcgtgtttattgaatgtttctatgtgctatgtatgtgcttacctgccttatctcactgaatcctataattatttgcccatcttttttcagaggagacaatgacagctcagagatgttaggtaacacacctaggatcacacagccgggacatggtggggcctgtctgattccagaacctcggtggacccttctagaggaaagggactgaagaccaggttctcactctcgaaggcatcaacagcttttggggctgctcattgggccccagtgctgtccttgctacttaacagtaggatggagtcagtgcgtttattaaaactctgtggggtttgaatcatcttgccctgtcgtcagataacagatagtccataggcctgacagtcagacatcatgccgtccctgaacctcatttatgtcctctaaatgccagagctggatgaggtcctttttctttcatgggaaggcccagcatcctaaggaactgcagtcaggtgagtctttttcaggcagcactttcttcataaccttccaacgtgtgaaatggccctttcacgacatgctggcgccggggattttttcttaaattaagaatttgatacattccttcagttcccctctaggggttacagagagcagagaaagtgatgccttgagttaatgtgcaggtgtggttatgcattttgaaggagctcttgacaatctccaagaaaaaaaatgtccctaaatgaccctcggtttttggtgagaattgctaacttgtataagtgctgaagggaagtccaaagcctttctctttgagggtcaaacgacaaag

SEQ ID NO: 52948 - DNA, 2721 bp, Homo sapiens
aaaaaaaatttacctaaactaatatgtccaaaatatggtcatttccatatgtaagcaatgtaaaatttatgaatgagatgttttatatattttgcctatcctaagtctttggaaaccaggttttatacttaaagcacatttcagttcagactagccatattttaagtgctgaatagccacatgtggttagtgcctactgtgttggacaacacagaatcagaaccttttcttcaccctaggaaattctgatttctgcctgcctgtgagtcaatccccttgttaccagatgcaactgcttttctgatttctatcaccatagattagttttgcctgttcttgaacttgtaaagagctcaaactcgtgtgtttggtttcttttactctacataatattttcgagatccatgttgtgtttatcagtaatttgttcccttttcattgcagagtggagttccactgtctgcctatgccatgtttgtgtatccacctttaataaatatttgtttttgaatgaatgtcagtgcaacatggtaagctacataaggagccccgtgcgaaggacaaagtgttctatggattcagggtggcaggatgacaagaattcagggggttggatggcctagggtggtgttctagaaaagcggggcatttggattggacttaaggagatacttagagtctcgataggtgaaagtggaggaggggaggcattctacatggaggaagtgtctggagcaaaggcctggacctgggtggtcaggactggatttggagaatgaaagtctagaagaattaaggtaggctggggccagatctggaggtcttgaatgatgccataaaggagtctgatccttccaggagtacgatcaattgctgctctggagcagggacgcagccctaggtgagaaagatcttcctggaagaggagacgcttggcacaggtcttgacagatgagacaaggtttcactatgttgctcaagctggtcttgaactcctggactcaaacaatcttctggcctcggcctcccaaagcactgggattacagatgtgagccactgcccccggcctggatgagcttttctgtgattttcccagcatcccttttgctgctcatcttcttgctttggtccgggttattgcctctatccagaccatccttcaagcatcttccaggaggaaagcttcctgtcacttccctggccctcatccccatgatgtggtttcctccaagtcaatctcatgctaatgtttttccattacagcatcgtattaaccagaagctgcatttacctggaccatacatcagcccgagcctgtctccagtgaagagttgtgtcgtgctggagggaccattcatcacacctgcccagcttctggaggctctcctgggctttggtgtcttaggtcagagctgtcacaaacatcccacattcaccttgtccctgtgaggggagggagctccaagtactctctggccttgagaaatggcccctgatattccattgcttcagctatgacatctctgtagcatcacaatctatgcaacttggatagagagaggctatgggtcacaccatcaaatctgattgaaattcatcttcaatcaatcatgttgatgttgtatctggagctgacctggaagcctgaatattcctggtcttatttacttctcacaccaacccagctatccccatttcagggattacaaaatggagcactgacttgctcagggttacttatgctgcagaaaaggggcagatccagggtcggaacttgggtctcttgactccaacaccagtgctcgtgccacaaagccagctgcctcagtgagtggcttcctggctggatggctggtttctcagggtactgacttgctttgaatgtcctttctccctttgcctccccagagggcggcttatttctttaagctcaagaagagggaaaagaaaaaaggagacggtgaaataaatttattgccatgttagaaacattggattgaagaattgatccctacagctaagtaatttccctctttcgtgcaaaatataaataaatctgtatggcttacgctgaacgatgcgcccgggccgccggctggatttcacgacatgaaatgcccttcagagtcttgggcttcctctccttgaccccaccaacgaggtgttctaaatggcccttgtgttgtccctgaaggagggatgttggcagctccctcgtcttgcctgctacagttgggcagacttagggatgtcttgcagagtccttccacagctcagctcgaccctggcaggtgtggcccagaacggctgatttccagaaccgtaaatataccagcttaattattactgttattcttttctctaggcaaaaggggaggaggtggagggtggggggttggtatctcaagtgtgtgattatgtaacacagagcactccttttccctaaaggtttcatctaatttctgttaagagatggccagtgtggtgtgtccaaattaatcacggggggaagctttagtcatcctgctctcgttgtggtttaattttagcatgtttccctggggtagccctccttcccagcctctacctagtcttaggtaattacaagcctggaaagaaagagggagtgttggctggcagatgccacccactccttggctggctcagagacagaacttggcctctgtactctccttctgccaagtgggctcctctgggct

SEQ ID NO: 52949 - DNA, 1039 bp, Homo sapiens
aatttgagctttattctaagtacaatgggatgtcattgaaagtgtttaactagaagtgtaacatgatctggtttatgattgcaaatgatctctctggctgctgtgaggagggtaaggtgtatggaggaggcaagagaccaccctaagccatgtgtccagactcagagcccagcacagtgcctggcatagtagaggtgctcaggagctgttgttcagccctccgtagctggaatgaacccacccttccctgtatcccccaatactctctttgggccctcttacctgtgacttggtggtaacggtgctcattatactcctgctggatttgggattcttgagggtagagacctaggtccttctatatgtctcctgggcccctgtaggctcagctcagagcagaagtcaataacctccctgaaatgaattaatataaagggtttttctacagctgctacaagttggattttcacttcagtggtctctaatggatccagacacttaagtgacttctaccaggtcatggggtggcttcctttaaaacctcatcagcaaagagggactgcttgagtggttcccctttagtcctaagatgcgtggaagtggatattgcagagagagagagctctgaggcaaggagcaactcctctacgaaggcttgaagaactgggcaggaaagccagctggagcctatttacaaacctttcctaaaaaactaacaaacatgagtaaacccactgtggcaggaacacctgttctgtggggatgtttcctaacactttacttcaaaatatctggaaagcaaaagcagcctgtacatacactctcaaacttaaataagcaaatctactttttttggacgaattttgactaccctggttctcacactatttacccatgaggctcagagtatttaaccaaaaaattttatgacttacactaggattatatccccaaagagcaggccaaaaatggggatagactagatccttctatccctggaaattttatagaaagacaaaagcttttttgtctcatatta

SEQ ID NO: 52950 - DNA, 1066 bp, Homo sapiens
aaaacataaggaactcagccacagagcaagggtttaccgtcattaatgaaaaatgaatattctttatctaattacacagcataattaattggagtctccaaccatggaggtggaggcgggcagaggaagccacaggaaggcagaggctcctgttcccacagaccccaggaagggttggagccaggttctgggatcctcttgaggtctcctcacagcttagggcccaggccaaccctggcccaggatgcagaagggccgggtggggagcagactcggccccatctttgatgctccacagccgtgggagcaggttcctgcctcgccccagaggtctcttcggtggcagtttgagcctgtgtcagccaatctgcatcctagcatttgattctgtattcagtaaatttatctggcacctcgtgtgtgccagactgtgaatgaaacagatctaagccctgcgcttcggaagggcacgggtttgaatcctggctctgctgctttttcactgcagtgatcttgggcaagttccttcattttctgtgtctcagtttgctcatctgtaaaatgggatgaaccatagcacataactcagagggttgttatgaggattaagggaattaatattcataaagcacttagaacagtgcccggcacatataagtgctctataataaatggtttttttctaaataagaaaacaaatcgggatgggtgctatgaggaaaaagaacaggatgtattaaatagcaagacagaagaacacgaaaggactggctttagaagtggcattcagagggagagtgggaaggggatgtggctgcctgactgtgccccctccccacctgccagccccactgttgccaccaggtctggatatgcaccttctggtgtctctaccttcctctccatcttccttctggggacttcctaggtcagcagcacgttttgactcgccctctgagtgcccccaaaacattttgcccaggcagggagttctgtcaaggcccagctgtctacaggtgaggccagcacagagcacatgtgagaaggcatcttggagatggtgtca

SEQ ID NO: 52951 - DNA, 2532 bp, Homo sapiens
gtaattgccctaaaggaaatacattaatacactgagataaattattttttatttttatttttgagatagggtcttgctctgttgcccaggctggagtgcagtggtgtgatcatggctcactgcagtcttgaatttctgggatcaagcaatcctcccacctcagcctctccagtagctgggactacaggcacctgtcactacgccaggctatttttttttttttcatggagacgaggtcttgctatgttgcccaggctggtctcaaactcctgggctcaagaagtcttccctcctcagcctcccaaagtgttgggattacaggcgtgagccaccgtgcccagacgagagagatcgttttagataatttggtcagaacattcagtcctctccagaaccttatggtgggttcatttgctgtcccattttccagatgattatggtgaggcttcgagggattaaatagggagccagaaaggagccaagcagtaactcagattcagggcactggcctctaatacctgtagtcctgctcactgctgtgaggctccctgtgctgtgctttggccaggcaaaagagctttctatagggcttggggtgggtgaggtctgtgggtctctcccagaggatccaccctgttctttgttgcaaagcatcaggaggaaatctcccatgtctctgactcccttgctgtcagccttcagggcccggtgtgtgcacgtgtgtggcctgtgtacccgtgtggggtgtgcgtgtgcatgtgcatccctgcactcgctcatgtgtgattgtgtatctgtctctctccttccctgcaggcttctgcttcacagaccatcctgaccttttattaggtcactttataattgattgaaatgtcccaggtaccttctcttaactccagggtgattatgacaattatgatgattatcaagtaaaaaaataaaaaagagagcaagagaggaagggggctggggactgggggttgggaattgctggagagctaggcagtgctgtcattaagcgacattgtgtgagattgttcgccttcaaaaggcctctgtgaaaaggagagagtgtctttaaaaacaaggcccattatgcaggcggcacggggtgcacagtgctggtgggaggaccatggggtgtaattagggcagtgacagctggaattacacagcgtctccgcagcggtgccgcctcttggtggttggggggtggggttgggggggtggttggaggaggggacaggtaatacctggcaagttctggatctttgccaggagctagagtcctttggcgagccagggtgacctgggattgggcagaaggggcagggagcgtggggctgccagagccatttatctctaccaggaaggcagcctcttatttttggaagccttttatgatggctcaccaccccttccaggctttttgagcattcccacccctacagggagttggcaaaggaaagccaactgtgtggaacagaggatgcagataaataatctcccagccccctctgcacaggagtgcaacagcctccactcagctcttctttgaggaagggaagctgcacctcctgctggcctgcctggtccctgtggggcaggctgatgcttatctgcagggcttgctccagtctcaccattccaaaccacagggtgggattaagcagcattcccatggcaggtggaaatgtcggatgcctcaaacccttccaatctgcaacagaatgggggttaatgagtgacctagtctctcctctttttccttccaacacagggcccctctagagcatcctccagacctgtggtcccatagcttccgcttatacaacccccagcccagggaacttactccgtatccaacaggctctggagcctgactgtttgggcttaaatcccgccatttattatcaatgtgaccttgggtgagtggtgagttctgtcacctctttgtgcctcagtttcatgaagataataatactcatctttatgccataaggctgttgtgaggactatccaagacacttgatattaaggacttaacccagtgcctgccacacaatgaggcctcgataaatgttcttccaaggtagcttaagcaaattttactggaagataattcttttcttgcagtgagctaaaatctggaagtttttctattgatcctggctctgcatcctagggccatgcagttggtcattcattaattcattcaataaatgcatattgagtgtctatgatgtcaggccttgtgctggtgagggccttgtctgcagaaagttgagatggaattcctggtctgcgcttctccagcccctcgtcccctgctctgcaaagacactgtggtctgtacaagcccagtgggaggagccaggccacaactctggttatgacttgacctaagagtgcatggagaggcaggggtgtttgggggtgggaggggcagtgacagcccaaggcctggggcttttccctctctcagagccactaggagaggggtccttagcactcctcaaccccaggaac

SEQ ID NO: 52952 - DNA, 2053 bp, Homo sapiens
ctaatgtgcatgtgtgtgcctgtgtgtgcaagtgtgcacatgcattggagatgagagggttgttttttttttttttttttgagactgagtctcgcgctgtcacccaggttggagtgcagtggtgcaatcttggctcgctgcaacctccacctcccgggttcaaacaattctcctgccttagcctcctgagtagctgggattacaggcatctgccaccatgcctggctaatttttgtatttttagtggagatggggttttaccatgttgaccaggctggtctcgaactcctgacctcaagtgatccacctacctcggcctcccaaagtgctggaattacaggtgtgagccactgcgcccagcagatggcagggttttgggtggagtttagatagcactggcaggaaggagccaggcaggaggctgtggcccagtcatgggtggtctaggcagaggctatgagaatggattcagagacgacctggaggaaccctctggactggtggccagttggctgcagagaaagagaaccagactgatgttaggaccggatcttgtataaatggcagtaggggtggcgtcactgggccattggaagtcaggactgggtagcgtcttggggatgtggcgtggagaggggagctgggggttttggatctgtttgccccaggtggaggtgaagggaagccagggtcagctgcccctggggcacagaatcacacttccatgactgaaaggggcagggtcaagatgggctgacttgagaggctctcagcctgcccactctctccctctgcccccagttttgagagggatttttcttctcactctccttcccctcctgtactctctaaggacttactctggccttgccagcctagttttcaggactctgagccagaatgggaaaccaagcagagaccagactggagggtgacacaggggtggaggttctagctgcagggtccatttcagggctgtcttttgctgtggacaatggaagtacgagggaaattagagaacaaaagagccccaaacctcaaacgtttacatcaagaattgctgagaaagaggaggagaggggaagaaaccaagtgctgggtgagaggggcaagaattttaaggtttggaggatgtgaggttctggggaaaggaagagaaaagaggaaagggtctttatcgaagagtctaatggggttttaactggatcctttttagactttgagagattcaagcgaagattggaatttcctaattgcttttggccatcagactgtttctttgcctgtagtaccaaggcaagactgggccacgtggggcagaggaattcatttggattaaataagaagtatttcccgcccctttcacattttgtttctgaagacgggatgcatgtcaaacagatgtacgcattgttagtaaatgaatgatggaatttaggattagtagtgtcagagatagcaagaaacataccagttagcatctcggttgaaggaataggaaaccacttaaagtagctcagttgtaaggggaacttggctgtaaggacattgagtctttcctggagggatgtggcaggtcattgggaaagggctggagctggctgctggagatgcgctgtctcctctgtctctgcttctcactgcctgtcttcacatctgtgtcttgtttctctccttccctgcagtccagcttcctttgctactctggtccatgtggcagggaatcagccccttcagctctgggagctacatggaataacaccagtgtctcaggaggagcggaatgtttccctctgttccaatcccaggttcctgaaggatggtgctgattggctctggcagggtgagatgccccaatccccacccctgtggctggtgaggtggagggggcaggattactgggagcccaagtggctgcgggagcctctagctgcagccccaggacaggcagcgaagagctgtccttagagactgctagggctatgcaggcaactagtggctgcttcctgagacagtgctcctttcttgagtgattaattaccatcccagtcaa

SEQ ID NO: 52953 - DNA, 1014 bp, Homo sapiens
catggctggccaattttttttttgatttttagtagagatgaggtcttgctatgttgcccaggcttgtcttgaactcctgagctcaagcaatcctcctgccttggcctcccaaagtgctgacattataggtgtgagccaccacacctggcagtgttcattactgttattagctgcttctgctgccagaatgctgactttctcgccattggcacccttttccatttcaatctctcctatcccaccagcactaggtacccagaggcccataataggtgctctcaacctcttcatctttcagagactcttgtccttaaaacgttgcctctggcccttttgggcaactgaccaaggaggagcagagagttgttattgtcctctttcaatgagatgtcacttcagttttaactgtgccttcatgccttgacccacaggtgtgactaatggtgggaatgaagctatttcaggggcagaggggtctttttggtgctggtcagacaaacatatccagaagttatgttatctactatgccttcgtgtgtggacactgatgatgagtataaaactcagactaagagaagatctggaacttctcacttgggattaagagtggggtgctttatgctcctttggttgagaggtcttttgaggagatctgcagttctcacaataggactagggtacccaggcattgttccatctgtccctctctcctgcccccaggttctgagaatgcagggagacaatggacaactgcctgatgcatagcacgtgtttagtaaatgtggaagagagtaaggagaaagccattacctgaggatcaggaagcccacattcaagtcctgcccctgcctttaccaggcgtctgctcttagacaagtgacttctcttctctgggcctcagttatctataacacagggatgataatacttgactccttcagcggaccaaacgtagacccatatgttcacttggttaatgcagaaatagaagcccagactgcagaaggggcttgc

SEQ ID NO: 52954 - DNA, 1120 bp, Homo sapiens
gagaatgatttccaatttcatcttaactatttcttgtctccattcttacaacccttctaatccatgcactatacttcctcaaacatacaatgcacatattacacccctttttgaaatccttcagtcctttaaaagaggaaatccatatatagatgaaaaccatggcatagatagccatttgcagtctggccctgacttcttttccagtttcactccttaccattcccctgtgctctaacaagatcttgcaatgcaccatttcctgatattccagactttcccaggcaatcttgtcctggtgcatgctatttcttctgtctagaatgcctcatctacttccctctcccagcctttttctctgcctagtggactcttctttcaatacctttctcaaacgttgtctgctctgtgaagttctatctgttccatgttgggtttggaatttccactgccccttccctcactccaccagcttcctgtgcatgtctgtatcctgaaatctttaactctgttttgctctgtctagtaattacctgtttacttgtgcaacagtgttccatgcatccctgcatcttagcacccaacctaagacaaatcacaaagcagggaacttgctgacatgcactgtgtgtaacttgcagtgggtgaagacctccagccccctctccctaccctaaggcagcatttgctctatcatcatatcttgccaagtgaaagcagccttcaccttttaaacgatggcttttctcctccccacagaaagggttcctcattgaaattcaccaggaatgggcagtttctgacagagtctcttggctggcccgtgatatagctgccaacacccagcactcctggaagcagaagggcttttgttcataagccgcaagcatacattttaccacttcccgagatcccaggggaaaaataatccttcccctttttccattggcctctccaaggcccctctggcttcccttttcttggctgggaaaatgaagggtctgggggggcccccagtgatggtggaaatgggggtttgtgagaggcctgttcaaagttggggttggggaaagagctggtggactgggaggggttggggacttcaatttagaccagggga

SEQ ID NO: 52955 - DNA, 1011 bp, Homo sapiens
gccagggaccagtcatgcaagggccagcactgattctcagagatggagatgcctactggtgctcctatagactagctgcaggtccacataacatggctgtcagcttcatgtcttccagcatagctgctcatctcctgtgtgcatctgctgctctctgttaactgggctgattgagagacacccaagactaatctcactaattctcagcaggcagtctgagtatgcagtacagggaaagcaagcatgagatacatgtactacccctcctgacccagcacccacgacactctgctaatcaatcacagcgttcatccccactgggcccagatatggtcttataatccttctcaaatggtaatttaggtagacaccaccaatccatcagagttggcatgtaggatgaaatatatttgccatcctagctgcaggtgatatgggttgggctctagactcatcccttgccggtctcagatcccacatcctagctggcctagaatgccaggcctctctgttggtcttggagaatcctcagacaccatccatctggttagccaagatgtacccctgagggtgatcctaggtctccttctttattcccccatactaatttgcccattcttcagctaaaatgtctgcagcatctttgttctcatcccaggctcactttagggatcccagatcagaccctcattacctctagtctggaactgccaagagtctctcttttttttttctatttatttatttattattatactttaagttttagggtacatgtgcacaatgtgcaagttagttacatatgtatacatgtgccatgctggtgcgctgcacccagtaactcgtcatctagcattaggtatatctcccaatgctatccctcccccgtccccccaccccacaacagtccccagagtgtgatgttccccttcctgtgtccatgtgttctcattgttcaattcccactatgagtgagaatatgcggtgtttggttttttgttcttgcgatag

SEQ ID NO: 52956 - DNA, 2148 bp, Homo sapiens
tcacttaagcccctatatttctgtagttgttcaagagcctttgcacacctccttcttagcgtggtctttaagaagtcactctaacagctctccagctctgtttccagaggaatgcccatgactttgacctatttggggtttccctgaggggttcacatctttcaagagtccagtttgttggtgggtgatcctgtcattctctggggtgcacatattttagggccagggcctagcctgggacccaatcttgattgtaagtaggccagcgaagtctgacctgggttgggggagggattccctgcttcccctcagcccagtcatggtccccacctccatcatgtccccagtgccctgtacacatgaatctctcccagctcctctttttcctctccttttgcttgtgactgcttgagtgaatcagggctgaagatcagaagtccccagtcaaggagctttccccactaatgagctctccgagggcctctgacagcccctccctttgccccgccccaccctgttcatttatttataacacagggcaccatcccccacatcgccagagaagaaagggccaatcagcttgcagtgctgccaatcaacgtgagaacgggggagggcagaagaggatgactcagagaactcgcgtgggggcaaagtgagaagtactataggctctataatttatctcagcatattttcatctagcccaagcctctcacattgcagatgaggtgtctgaggcccagagcagtaaagtgacttcttaaatccacacagccagtgatgaccaagccaagaactggaacctgggtgtgttgattcccagtccagcacgatttccactacagaacgtctttagaatgcatttgtcttgaagactgaagtgaggtctgtgtttcaattgacagcttggtatttttctgtctgtcaacactttgataaatttagaagaaatggacttatgttggcacatctgcgaactagcgaaaagatcaagattgtcactgtgatggtatcttcactctaccacgttggaacaaaatagcaggtgacatgaacattttcaaggtgacatggtgtctttaagttgtaacagattctaacataatttgacttgtgggtagaagttacgatgggtatgcctgtattgagttgacctgtagatcagagtcactattccttacataaggtgcatagcttttcccactattgacaagacacctggaggaggtggagaagtcagtctgtgctttgaggggttatcattgtcatttataatgatggatagagaggcatttggtggttagtgttctagttggacataggccaggagaagcagaatatggcacagtctatataagcctgacatcctaggccttcaaaatctccttttccatccatggatgcatttctctttcaccatcaaacactggaggactggagatacccaactgtcctaggcatgaagagtctactggggctatttgaagatgatattgatccaatttcctgtactaattttttccccctacacaatcccaaaggccaaagggtaggagccttgggggcttcctctgggggtttatctgatggattagtgcccatgatcctggcaggaattgaggagggtgcagaaggggcctgagttcagcagcctgagtgctggagtacagaccacttgagtggagaggacttagagggtggttttttcttacactgtttccttacatctgagagcagaactgactttccccagcaagattaagcccattgaaatcttcctcctgaactcaggctttcctactggacacccccatgcagacgtccacatcatgtctcaaaatcagctcattttcctctaaccttgctcttacccccgtgaaccaaaacaaacaaacaaacaaacaaacaataacaccagtcaaccaaacaaacaaaaaacaatcactcttgtccaggcctggttcagtaccccggatggatttgtctaaggtgccatgggtgagccactgtcaccttagaagatgacattgaagcccccatttctcacttttagctttcagcccccttgctaccctctgtatccctttgccttttatctagattctccatgtatttttttaagtttctttgacttattgcctagtg

SEQ ID NO: 52957 - DNA, 1596 bp, Homo sapiens
gccttcttttgaggtggggttgcttctctgggtttttggaaacaagatctggccctgatggggtgggctgcagtaagtgggcaagagggaggttggttagtgtaatggtcaaaatgcacagttttgggagctacacagcatttggttcaggtccgggctaggtagcatcttagcagtgtggccttaggcaggccacttaacctcatctgtggaatggtgacagtgacatccacctcactggattaaataagacaacatgcggagaagccccaggcacattgaaatacttacatgttcttctgtttccccagccagcctcctgcatcccccttggcaaggatcagagtaacatggagacctgggtaggatttagatagtaatgataactgccccttgcaccacattctagaacttaccaagtactttcctgtcctttatctcatgatagtatggggcaacactgatgggaaaactgaggttgagagaaattcagtgagttgctcaaagtcactcactgggacataggaaaggggaggggtatacttctgccctgagacccactgtgccaactgattgctgctggtgacaaagccttctgtgttagcccattttgcattactataaaggaatactggagactgggtaatttataaagaaaacaggtttgtttggctcacagttctgcaagctgtacaagaagtgtagtgccagcatctgcttttggtgaggcctcaagaatcttccaatcatggcagaaggcagagggggagctggcatgtcacatggcgaaagagggagcaagtgaggggggagatgctatctcttttaaacagccagctctctcatgaatgaatagactgagaacttactcattactatggggacagcaccaagctatttattagggaactgcccccatgacccaaacacctcccactaggcccacctccaacactggaggtcatatttcaacatgagatttggaggggacaaaacatccaaaccgtgtctcctcccaaaccccttaaagacagaatttgtgagcccacgtgtggtggggtggagcaataaggagactcccagggaatttctgcttggtctgggctcctatttagctagctgatgtgtaggcaaggatttctggactgggaagctgttctctaccattctgtttagggtgcactggtcagggtgggtgtggaggggtggctctgtttctcctgcatctgaccttttggcctggcctcttgggtgcccagccaaggcccagtgcccctccctgtggctgattcaccacctccagctgtgtttttgggaaatgaatggagaatcaggctgccaggctgggaaggactggggcaaatagaccacacatgtaggtagcagttagcataactggccgcatggttctgggcaggcagctggcagaggtgttaggccagggcaatcatgaattggggcaggctggggggagtcctggtcaggtaggaagtgaagctgggcaggcagctggctctgcagttggctgaggtcggagaggacatagtgtgggctgacagctggtgtggaggatggaggcggtcaggaaccagcctc

SEQ ID NO: 52958 - DNA, 1056 bp, Homo sapiens
tgggcagtgactagagtcttagagcagataaagaatatctccatcatggcagaaagttctattgcacagtgctgctgtagacctttggtgtggaatgggttgaactccaaggaggtcccacacttctctagatttgggtatggatgcacctgtgctttccccaaattcttattcagtgtgttgcacaaactcctctcctgttggcagaaagagcccagctctgtgccacctcttgtcacgtttcctgcacctgatgcccaggtctggagccccagttgctgttgtaccagatggcccaggagttattaatgagagactgtgtgtgtgttcctgtgctggatctgtgtgctgtgatcatcattttggggctttccttggggaagtaacaaatggcatccctgcccaggagtcctctggcagggaccatctcataaatcagtgtgaaaggctcctagtccctgtggagtcatcccacagccccacagctaagtgacccaaagactctgtggctgccatggcttcacttcctaccactgcctccccagatgtctgggcctcttgggtactggactgccttgactgtcagcagccccaggccccagtcctggttctaccattaaccagtggcctgaccttggaggagtctccttttctctctaggccccaactttctcatctgtaaagtggaagaagggaaggaccactacatgatctctgtaatgcagaacggtgacagtgagagctgcctcacatgagggtgatacctgcccctgagaagtgtagtatctgggatccataatcagtgcaaacttccagcccagagaaaagaccacaggcctgagagtccagggcagcatggaccacctgttttggaatcactttcttaaaaatccagatttgtgggccccactgtggatctgctgactcgggatctctgtggatgatgactgcattttcattgcattgccccagtaattcttgtgcattgtaatgtttgagaacctttggcctaagggcaagtactgcatctccagtgcccttgcttctggggaggga

SEQ ID NO: 52959 - DNA, 1011 bp, Homo sapiens
acctatgaatgaaattctgtgactgatggatgaagggtttctggggccaggggtagtttgtccataaggacttggctactgaagacaccagttgtatcattttgcttgtgcttgtgtttcttttctttcttttttcttttttctttctgagacagagtctagctctgtcccccaggctggagtgcagtggcgcgatctcggctcactgcaacctccacctccagggtcaagtgattctcctgcctcagcttctcaagtagctgggattataggtgcataccaccacacccgggtaatttttgtatttttactagagacagggtttcaccatgttgtccaggctggtctcaaactgccgacctcaagtgatccacctaccttggcctcccaaagtcctgggattacaggcgtgagccactgcgcccggcctgtgcttgtgtttcaagctatcctgacacagggccatagaaataggagtggatctcttgggaatatctctgctgattgccgtcatttcattagaaacacaattatttcgtaaggctgggctaacggtgttggaaatagccaagtgcagcgctggagtgacagggaccacatcccatttgatactaattggtttgatgatggtaattgttgtattgcagacagttgtgactatctcctaatttaatataatcaataaggtaacaacagctcaatgcaaatgagatgtggggacccatggggccatttgtaagttatgttcttaatgcattttcctaattagctgtagcagattcccccctcccccaccttctctggagtgtgagagaagtgatcatctgagatgccatgcttcgctttctccaaactttcactttcagagaggctcagggagagctcatcctggagctcccaggaaccccaaaggctttcttaggaccagctgaaatggagtcagggagtcaacagttcaataggatacttcccttcagattcatgacaccccccagcttgaacctatgtagt

SEQ ID NO: 52960 - DNA, 1149 bp, Homo sapiens
ctgggattacaggcatgtgccaccatgcctggctaattttgtatttttaatagagatggggtttcaccatgttggccaggctggtctcgaactcctgacctcaagtgatctgccctctttggcctcccaaagtgctgggattacaggtgtgagccaccgcaccccacccattgtgctagacttttacacgactgtggcagcgcagtaggtttgcttacaccagtcctaccataaaggcatgagtaacctgttgtgctatgacatttccactgcttgatgttatgacagctaccgtgtcactagtgataggacattttcaggtccattataggcttatgggatcactgtttgtgtatgtggtccgtggatgaccgaagcgctgttatgtgacacagggctgtatttacatggcttgcttcgccttctggcaggtcactccttaaatgtcaccttatcagggggaactttctgacctccttgtctaaaacagcaacccacgctctgttctctctgctttatttttattcatagctcttacatatttatatgtagtggtttacaactttctggtcggtctctgcctgtagactgtatcacaagaacagggactatgttttgcttatggtggaatctcgagcacccaaaacagcacccagggtatgggaggcacccaggaaatattgagtcaaggaagggatatctccatgacaggcatagggtaagtgctcaataaatggcaactggggtaaagccatgtgagcaaatgaacagacaccatcgcaaaggagaagctatgaggaagctcctctgcaaaggctgcctctgcacaggaaagcccaaggcatctggttttctgcccttctctcctcgcttgcctcctttgcaatcgttgagagaactgtaaagctgccagtgatcttggacaaggcttcctcctacaccacggggtaggtatgccagtcttgggggttgtagagtggtagtgcggaggtttctgaagaatgaggttcctggccctgagcagcgaggagaagcggtcttagggtcctcctgccaggcttctggattctgtctaaagtgtctccaaaactggtgtgtgcttgtgtgtgactgtgggggagtgtgatgagtcaccatgcggatgctggg

SEQ ID NO: 52961 - DNA, 1194 bp, Homo sapiens
aaccaggcgtggtggtacacgcctgtagtcccagctactggggagactgaggcaggaggatcacttgaaccctggaggtggaggctacagtgagctgagattgcatcactgtaatccagcctgggtgacagagtgagacaccgtctcaaaagaaaaaaaaagcaccttgtgtgtagtgtgaagggtgggtgtgagggtgtgctggtgaatgtctaacaatggtcacttcagaaaaaaagccttttggccaattgctgtggtgtaaaatactcccactgtgactgttctcgaggtatcaatgtgatgttgctgaacacagagttgggatgagatgctaatggtctgatctcctgagctggcacaagctggcttcagcacaccgctggttggagtggagcagggaggccttatctatttccctagagtgagagagtgagggagctcttctctcattccctgtctcctctcccagcagcgaccataagccctgcacagagttagcactgaggccagaaatattctggaaggacaaacagtggagaagagccctcaggaacgtcctatgccatttcctgatgggatccctgagaactggctctcgggaggaagtcagaggcaggaaagggtgtccatgtgatcagatttcagggctgaggacgggaggagggcatgctgggatgggaagctgatgagctgatgataataattatgacaattatgcaaaatacacaaataataattacagaaaatcatgattattatttgtgggtgtgagatgtctccagctttttggaactgcacagaaatgttggatgcctcttttcttgtgggtgtgtgagtgtcacattcaagcttgggctgtctggcaggagctggggtttccatccctctccagacagctgtctcctgccctgggtcttggtgggatccaaccttcttcacacagtgccaggcctgagtgagctagatcaagttcaggaaaggcagggcctcctacttctagttcccacctcagaacctcactgaggacacagccatgggagggctgaacagggataaggcaatgattaacctagaagaataattcagaggctcgggagccatgtgtctccctgatgagctggtctcatgattcatggctgattagatatctgacccaaatagtgtcaattagactctcttttctggaaatat

SEQ ID NO: 52962 - DNA, 1525 bp, Homo sapiens
ctgagccaccacgcctggcctgaaatacaatctttttttttttttttttttttgaaacagagtttcactcttgtcacccaggctggagtgcaatggcgcgatcttggctcactgcaacctccgccttccaggttcaagcgattctcccacctcagcctcctgagtagctggaattacaggtgcccaccaccatgtctggccaatgttttgtatttttagtagagacggggtttcactatgctggccaggctggtctcgaactcctgacctcgtgatctccctgcctcggcttcccaaagtgctgggattacaggtgtgagccactgtgcctggcctgaaatataatctttagctatagagcagtcccctagtagagttgtttatgagattttttttttcctttagggtcaaacaactgttctgccgagagtaagttgggacttttgtttttctttctttaggactattagaagacacattagtgcagaagcttccaggctgtagagccctgcttcccttctctgacctcacaaagataaacatccttcacctgagttcgtggccatccacctctgctctcccagacccagtgcctgtgactttgagtagtttgttctaaatgtggtgacaaacaagtcatttctgtaagacattgggtcttactttatgtcatttttagtaacagaactgcaggaagatgaagacaatgttgtaatcccagcaagttgctaactgtgcgtttctcccttcttagaatgaatgtctcccccaaaactggctggcaccagcttcatctgtgatacccttcaagaaatgttctctggttttgttttatgctgaaagtagaacacaagtcacatttcagatggaggctgtaaatatctggcattttcttatattgttttatgttttcttgtttttctcttgttgtttttatcttattttctttggggtttttttgtaatgcctttgtacagctcatactttcctgctgacatatctgatcatctctttcatgcagttgccaatattcataactgaaaataatctggtttatcataagtaaaatgggaaacttgcctctgttttttgcaaggggaggtaaagagtgtttagtaattacctatcttaaatctttctgagttggtagtagattcatgttcaaggaacaggaaaaatggaaaaacataagtttaaatcagttctttttaaataactttttattcttttgtataaataaaatttcacaggcttcaaattctcatgctttacttttaaacccgagattgttttttcacttatttattcatatcatgccttatggaaatttctttttctgtattttctctctttgctggtattcacctgattaaatattgctctaaaaatcaccatggcatatggaaagtctcaaaattataccaaaagtgataacttatgtcgttcttaagtggagtgaaaggatagcatcagtgagagccagtgttgcccaccaggtctccctttcttggagggcttgttgggg

SEQ ID NO: 52963 - DNA, 1005 bp, Homo sapiens
cattggtgcaccatgtttttttgcagtacataatgagataggaatgacgtcagtggacagagaggccaggtgtcacccagagagggtttcagcattcactctgcctggggtttgtatgatcatgctggggattgttaactcagataattggaaattatgcagcttgacctaaagagtataatgtccggtttctagagtaaggagttttgctggcctcaagccttccaggagaaatggagaccctatacatacctgtttccatgcctcctagaagttccgaagccagggtaagagttctcattctagaaactgtacattcgttctactcctcctggaagactgcgtgctgagcaggtgaaagggggcaatgcaagggatgggtggcattccctgttctccagtttgcttctggatttggtttacaaatctgtagggtattccttcatgcacccaaggtattaaacttgttagcttcatggatatgacagtgcctgggggtaatgtaggattaactctacctgatttgaacctccttgattggcgtcagctggttcttcaattattttaagagtttttcttgttgatggtaatggtgttttctagactgcagaaatagtatttccttcaaataatgactgaggactgctgcttaacatttttctgcaaaccagaagtcaccatcctaatcgcataactgtagtaagaattagcaaaaattgtatatctacctcttcatatatttttgaaaggctataggttatttgaccaactgtagtaagactggtgctagcttatcacgaataacagagaaatatattcttaaaaatttttttaattgtcaagataattaaatgtcatgctctgtattgcttttattaaatttactccagtgtcatttttttttaattttttatttttttcagacagtcttgctctgtcacccaggctggagtgcagtggcacgatctcagcccctgcagcctctgcttcctgggttcaaacgat

SEQ ID NO: 52964 - DNA, 1032 bp, Homo sapiens
gatgtgggtagatcacctgaggtcaggagttcaagaccagcctgaccaacatggcaaaaccccgtctctactaaaaatacaaaaatttgccaggtatggtggtgggcacctgtaatcctggctacttgggaggctgaggcaggagaatcgcttcaacccaaggggcagaggttgcaatgagctgagattctgccattgcactccagcgtaggcgacagagcaagactccgtctcaataaataaataaataagtaaataaataaataaatttaaaaaatgaacatgtgaagcaactaaatctcatgtctcacagtgggacatgtaccatatattggaaaacgttgctttctgtgttcagcataaaggtcgtttgggccagtctgagtgacatggaagcttcctgcatggaacatgagtcctggggcatccccagcttgagccatagacatagcttggtgctcataatgagtttcttctgtgttttagaaactccaatagcaaaaatgatcgaaggaaccggaagtttaaggaagctgagcggctcttcagtaaatcctcggttacctcagcagctgtaagtagtggtggtgggggaatctttctttggcctgttgttggggaatgtgttttttctttaccttcctctgggagtgctcttctgaggtctgtggtcacttttctagtaactggtggcttttcttttaggcagtaagtgcattggcaggagttcaggaccagctcattgaaaagagtaagttgatgtttttatgtttctcatcagtttatttttaagctaccatcacccttacacttaattcatccaattgtgtatctgaggactgcatttcttatgctcttcccttttccctcttcttcctggaagttttgaaacttttagggtatccttaatcatgtttttctccactccccgacccagacaaggtctcactatagcccaagctggagtacagtggcatgatcatagttcgctgcagcctcaaactcctaggctcaagcagtcctcctgcctcg

SEQ ID NO: 52965 - DNA, 1050 bp, Homo sapiens
tttatttctaggtattgaattttttttttaactatggaagtaggatttaaaaacttactattatattttcacttttggcatgagagaaagctagtttctttctttacatatcttgtacctgactacttaactcttagttctattttctgtatattcttccctgtaagtttgcccatagttacctttgttctgaaaaggagggaattatttttccttctcctttctggactaaatagtctcttgtttttagggctgtggacctggacttgtgctattagggctatagttgaatagcagcatgggatatcatctttgtggccttgcgagggaacataaccaccagacataatcttatttctgtgggaaatgttgttctaaatgccaaagtccaaattacaagactttttgcatgcacttcgttcaaaaagaacaagatttgggctgcctttagattgtgcactgcgtttaaattacagaatctgtttgaattttaggagcgtgaggatcatccccggagaggacgggaggatcggcagcacagggaaccatcagaacaggaacacaggagagctaggaacagtgaccgggacagacaccggggccattcccaccaaaggagaacgtctaacgagaggcctgggagtgggcagggtcagggacgggatcgagacactcagaacctgcaggctcaggaagaagagcgggagttttataatgccaggcgacgggagcatcgccagaggaatgacgttggtggtggcggcagtgagtctcaggagttggttcctcggcctggtggcaacaacaaagaaaaagaggtgcccgctaaagaaaaaccaagctttgaactttctggggcacttcttgaggacaccaacactttccggggtgtagtcattaaatatagtgagcccccagaagcacgtatccccaaaaaacggtggcgtctctacccatttaaaaatgatgaggtgcttccagtcatgtacatacatcgacagagtgcgtacctactgggtcgacaccgccgcattgcagacattccaattg

SEQ ID NO: 52966 - DNA, 3171 bp, Homo sapiens
gttttaatggtttaaatagtcttagttggttcatcctgtggaactacacatgtattcctttgatcctagtactgatctctgggcttaatgtacattggtttaaaaatacattaatgaaatgactcaaatttgggtgttttcaataccttcccttagtcctgagaagaggactgtttaagagcaagatatgagttcagaaattccatttttcattttctgattctatttatttcccccatttccaccccttaatagcttctaccctcctcatctttggaagttgtcccagaagcagcccagaacaatccaggggaggaagtcacagaaactgcaggtgaagggtcagaatccatcattaaggaagaaacagaagagaacagtcactgtgatgctaacacagagatgcagcagattctcacacgagttcggcagaactttggtaaaatcaacgtggtgcctcagttttctggggatgacctggttcctgtggaggtgtcagatcttgaggaagagcttgagagcttttctgatgaagaggaggaggaacaggagcaacaaagagatgatgcggaagagtcttcctcggagcctgaggaggaaaatgtgggaaacgacaccaaagccgttattaaagcactggatgagaagattgccaaatatcagaagtttctagacaaagccaaagccaaaaagttttcagcagtcaggtaatattttcatcttctcacaaattgcagattttcattcctttcccaaaaatttgccatgagtaccagagccatatttttacatggggttattgccatttgtttgttcggttgggttttttgtttgtttgttttttgagacggcgtctcgctatgttgcctagactggcctcactctcctgggttcaagcaatgctgtcatctcagcctcctaagtagctgtgactacaggtgtgcaccaccacacttggctgttattgccatttttaaaaagtgaactgtaaattttgtaaaattcagctgcctgcagtatgagaagctttagaaacacccagggaggtacaaacatgttggatgttgacttcttccactggtgataactacttggataggagtggggtttctttagtctgtgagtttgtcgcaggtctccaggtcagtatgtgattcgggcgagtgagaggaggaatgttactttgcttttctgtttcagaatatccaagggactgagtgaaaagatatttgcaaaacctgaagaacaaagaaaaacactggaagaagatgtagatgacagaggtgaagttaaattatttcaatcatttagatgtaatttgcatatttagagttttgagaaacctaagttcagtctccaaattatctcagtcatccacataaatgtttgtcatatctggcagattactttaaatttacatagtgttatgcaaattgaattatctgcttttcattctgcacattttttaggattaaattggcaattcaggaaacttcctagaaagggttcattattaacctagaatccaagggtgggtccacagacaaagaggggggtgtgtttcctgcatttatccattcctccatttgaccatcagctttcacactgagagcatggcttagggcatccttttacctggcagcctccccttggcctgctttactcaccactgtgctcacctgctctgtccacattgggtgtcctcctcctgatacatcaagcttgttcccaccgttgggtttatagacaaattttcaatagaaaattcctgtttgtgtattgtttgtatccagcaccttccaaaaagggaaagaagcggaaggcacaaagggaagaggaacaggaacattcaaataaagctcccagggcgcttacatcaaaagaagtaagtgtcataggttttaagtatggcccaagtagagtaactagaactccagttgtcaagacccactgaaacaaatggtccagagctgaatcccaagaaccccagtcctcgttgacctagttgaggtcagataaatagggtcgggtctggcccactagatgcaggtccttgagtccatgtcatacgttttaggagtttctaatcaacgtctccacacgagtggactatcctctagaggagtcagtttctagtcccaagggaaacgacccaatgagcagatctgctttgggcagatcactgacttctgtgaaggacagctttggagctgagctgttcagagctagagtgggccctctggggaggggagtggttagcagcactcagccttgctgcaggggacttgtcaggagtgatgcagaacagattcttgcactggctaagggttggatcacatgtggatttgtaacttggagttgcataagtcacaatggaagagtaaccttaggtctacgggggagccctccctcattagcactgcttccagtagctgtggaagcagcacgggaaatagaacacagagatgagaagcagagactcctgttttgtgaatgactttcagggttttgttgttttttttcttcatcttttcttgccattttttacagcggaggcgagcagtacgacagcaacggccgaaaaaagttggtgtgcgctactatgaaacacacaacgtgaaaaataggaacaggaacaaaaagaagaccaatgactcagagggacagaaacacaaacgcaaaaaattcagacaaaagcagtaatgtttaaaaggtttttattaaattatacaaaaacaggcagttagaaattgtgttttcttcctgccccattgacatttctaaggccctaatgcatttgttctgaggtttgacagttgaagcccttcaccagtgctagggaaataaagcctcctcaaccttaaggatttcagtgataagagtctgaaagtctagcacttcaggtagactttggatgaactaagaggttccacagtcaccctgtcatataactgtctgacagaaataggggatgaggtctataaaatggaaagggtggtatttcgtttttattggtaatgaatgatttggaatagaagcatacagaactgcaaatttcaaggacgttagtgtacatggcctggcctttgaaatacaaggagaaagttgggtgcagaagaaataggagaaaactacaataatttctgcctcattgagtctgtgaagtagacc

SEQ ID NO: 52967 - DNA, 1048 bp, Homo sapiens
aaacaaaaaccttatgattctaatgtcagagatcttgcctataggaacaatgggggtgcatatcaattcttacatagtcttatgacccaaatgtcagaaatcctatctatagggacagtggggatgcaaatggtcagtacctagtgttcaggaacttttagcaacaaggatatgggccaaagtgccccctaattagtgcttaattataattgtatttctgtccagaacttggcagatacttcttgtcaaccctttggaggcagtttcactctcatatgccttactctgtgattctgtttttcttttttggttaagagcagaaaccccttcagaaactgaaagccaaaaattgcccttcctagaaaaatgtatgtataaattttgtgtgtggtttcctgaattttatagttctgtacttatttagtgatttgcccggccactcttgactttagaacatcacttttaagttctctgagtttttgttgcaaggataaaatgatattatacatgtgaaacaccagtagaaagcttggcacatacttatctttgcggttacctaaaacaggccagtcatttcagggtccccagacttagttctctaatgaactctcttcaatcacagaattccccctccttaccttatactcttgcttcaggatgcctcctatcttagtctgttttgtgatgatgcaacagaatactacagattgggtaattataatgaacagaaattgttttggctcatgtttctggaggctgggaagtccagtatcaaggcaccagcatctgacaagggtcatcccatcgtggaaagtgggaggacaagagcaagcaagagagggtcaaacttgcttttataacaaactcactctttttttttttttttttgagacggagtcttgctctgttgcccaggctggagtgcagtggcacgatctcggctcattgcaacctctgcttcctgggttcaagtgattctcctgcctcagcctcctgagtagctgggactacaggcatatgccaccaggcccagctaatttttgtattt

SEQ ID NO: 52968 - DNA, 1071 bp, Homo sapiens
gtgattcatatttagatctgttttaaattatcactccagccttttattttgataaacaaaactaacccaagaatatttgatgcctgggttaagaagcctcaaacttaaggtaggttctgaaagttgggggtcatatcctagaacacatagtggggaacagcatggttttgcttaaaggcaatgaggtcaagcagtactaagctctcaagagtacttctaaaactcaggaaaggttcaccgggtataattgcacaatacgagatggaaatcctgtctctgtgttgtttttagactcttagctgatggaaactatagtttacacttagtggaagtatcttgtgcacggcacagatgagagagttagtagcttaattacttagcgcgttgcttttctttgactcaccccttcctcctttccagcttcatacatgagcatcaggggtttgtgaaattagactcttagtgtttgatacaggacatctctgacttttttctgacttcaggtctggcagtatattactttgatgcgtcggatattcctgattgactgtccaggtgtggtttacccctctgaggactccgagacagacattgtgctaaaaggagttgtgagtatttggccctgataggctgtttgtgtttgcgggggagtgttctatagggaaccctggatacctttcctttttacttattaagaaggcagtttggggtcagcctgtctgaccaaactttaggaacatgatgctgaacagcagcctctcagcataagctgtttgaggaattagtggaaccatgggcatatctggtcaatatcatcccacaaaagagtttgtagtttacacacaggatccaaagggaagcagggcctgtttatgcttagcgataattcgtcttcgtgggtttatgggttgagtcattttggaacccagtcatttcctcacttgtttctgaatacgactgaaaaactgtaaatggttccacttaaccttgaccatgcttctggctatacatcctgtacacattcctcctctcctttcttaaactattccattatttttgtgtcctgggatg

SEQ ID NO: 52969 - DNA, 1991 bp, Homo sapiens
gcctcaacctcctgggctcaaggagttctcccaccccagtctccccagtagctgggattacaggcatgcaccactatgcccagctaatttttgtattttttgtggagatggggttttgccatgttgcccaggctggtctcgaactcctgggctcaagcagtctgccctccttggcctcccaaagtgctggaattacaggtgtgagccactgagccagctggaatttccttcttttttaaagttgaatgctatcttgtgtatatatgtgccacattgtgtttatccatttatttgttgacagacatttgggcacactttttaaattcagtttgtttctggtccatctccaactgggtttgatactgttttttttggtacattgactttaccctaaagcatccttttagtcttgatggtgcttcagttgctcatttggggtgctttcttatttagaaatgaagctcaagaagagatctataaaaagggacagtccaaaagaatatggggtgagctctacaaggtaagactcctaaattctctcccattgagtggttccttgggctttcatgattttgtagaagaaaactaattttgatatattgaagctctgttgcgcagagtacaggcaccactgcctgttccatcctcttcctcctacaaagaaactcggaaggcgtactaccattgatctaggtaactgcattttttaaagtacttgtataagagtaacagctatcttttattatacaatcacatatttattacctgtcagtattttttaagatttcctgccaaatttatcatgcctagttaaagtcacatgcaacattttaagttatttagtccacccctctccttttatcgatgaggactcctgtctagaaaggtttaatgctgtacctagctcgactagcttgttagtgaaggaggctttgtatatcttgatttctgatccagtgatctttaaccggcagaggtttatgtccatgcactaataataaccttcagaagaaaaattttcaagtataatcacgtaattaaatagtaacatgataggaaactagtaccgtgaaggcaagctaaactttgtagttttttgtgaaatacacaaaacctataatattacaaacttaaagataatattacaaacttaaagaagtctaagaagtaaatgatttagttcaataatccatagtagttaggaaataagttgagtttcatctaagctagtttttctgttttaaattcagcaggtttcaaaagccacaggatgaaaaaccttttgaattctgatcactgggccttgagattagccacaacgaactctgcccagagactgttttgaagttgtctctaaatattattattttatttttcccagactcccttaaatgtcatccctcttttatttgtactgtagcaaaccatttttgcctttctgaattttcaggtgatagattcatcagatgttgtagttcaagttcttgatgctagagatccaatgggtactcgttcccctcacattgaaacttacctgaagaaggaaaaaccttggaaacacctcatttttgtacttaacaaatgtgaccttgttccaacctgggcaacagtaagtacaactactaaaccagaatagactattaagacatctgttagtaagtcagttgtagggcttttaggctaaagtgttgtccggctgagattgtagtaatgggagtgctctcattggaaacacgaaagtgtgctcattgatagtgggcagaggcaccaggagacggcttctgaggccactgcctgcttcacattatgctccattaattgcatttagtaacaatgaagacattttttggaatattgttttgtatttataagacagaagaacaaagcattaactgttatacttggaaaaaacatttcaaagaattatagctaacattttccttagacaacagtatatttgaaacagttctgtaattcaagctctgattctt

SEQ ID NO: 52970 - DNA, 1473 bp, Homo sapiens
ggaggagcttgtactagggggaaaagggtgatttttttttttttaattgtctgcaggctgttaacattccgttatgtgatagatcccaactcttttatcttgcttcagaaattcctatgcctgtaactcctttacaggcacatcaagttctagttagtatcaggttccttttatcacatctaaactattattttggacttttgctagatgtttttcatccgaagacttgccatgtgcatttaataaaaacgttacctaaattagggaaaatgttatctgaaactaaaatgcatcttacaaaacaagcaattccttttagccatgaaagaaattaacttccaagaaaaagttggcatttacagttggtttaaaaaaaactcacaaatttgagtatgattgtccttgacaaaatctatgaatttggcgaattttatgctcttgtttgaaagctataaaaaatggtggaaaagattaattttcaccactgtagccttaattacatttgactgaaatttatgataaatgaaataaagcagagtttttggcaagtttttgtacaactattcatatttactttgattatttgtattacttttgtatttctccaaggaagcttacagaacttcagaataagggaaccagtgtttgtgccatttcaacaagtaattctgatttgaaaccagactgaaaccatgtcttacagatttgggtatgggttgaaccttggaaaaataaaatcagaaagtctttcctaggtgggtgttgagctttttgctttttctcagtgcttttcttagttttacctgttattctcctttctcttcagaacttgaaggtgcacattcttgatactgaaagttttgaaactacatttggccctaagtcacagaggaaacgaccaaacttatttgcaagtgatatgcagtctcttatcgaaaatgctgaaatgtccactgagagctatgaccagggcaaggatcgtgatttggtaactgaagacactggtgtgaggtacatttttttttttgcttctttgtttttgtttttttttttttgagatggagtcttgctttgtcgcccaggctggaatgcagtggtgcgatcttggcccactgcaacctccgcttcccaggttcaagcaattctcctgcctcagccttttgagtagctgggactacaggtggatgcctccatgcctggctaattttttgtattttagtagagacaaggtttcaccgtgttgcccaggctagtcttgaactcgtgagctcaggcaatccacactccttggcctcccaaaatgctaggattacaggtgtgagccactgcacccggtcgaggtacagttttgaagttcatgcaaatctcatcatttgctcttctgcaacaaaacattttctttcaacttattttgcctgtgtgaagctcagtgctttaactcatatatggagttatcttcttccctcagactgg

SEQ ID NO: 52971 - DNA, 5103 bp, Homo sapiens
atggtgccttgcatggagcaggcactcaatatttgttaaactgagacacagaggtaggtatcttcgtggttaagaccatagatggtgatcaaatgctcatgtacaaattctggctctgccatttagtaacggtttgaccttgggcaaggtgtctgaccactgtgcctcagtttctcactccgcagcatggggataatatatctataggattattgtatagattaaatcagatgatgcctataatttggataacacagtgccatcataagtgctcaaaaatattagctattcttctcaaatacaatcctatcgaagatcaaagattgggtcagctttgtcataccatgtagcttcaagtactaattattggagcaacatatggagaaagtagagatttttgtggttggtggcttcttacctaatttgggtgaactacttgttgcattttaagcaatgacttgttggttatactggttggttatcaaatagtgcactgtgtacttctgccttttgtagatcgagtgcagggagcaggaggccaaaacatgagggaccgggccaccatccggcgcctgaatatgtataggcaaaaggagcgcaggtgagcactgggtgctgtcatcctttctcttttccttcatgcccttgactgctagctgagactgatgaagcctttgctgttctcacccccacttcctccaaataggagttatatattctcaaatataattgtacgtgagtgtcgttaggataaagtgttaacttttggttaaggacatgggtagctggcggtgaaatagtgatggtttcacaatactcaaaagtagaggtcttgtttctcacagccctgacctccacaaatggcgcattaaatctcagagttaaatatggccagatataacaaaacctacaggactgtagttaggaaagccaccagaaaatgtgttttttaatgccaaaatgtagatcatgacattgtggcacttggacagtcatcaaaactccgagttctgctgaggtagcctctaccacagggatttgctgagtgtggcattccgctaactggtcttaatttgtttggtaattagattctccatctccgtctgtcctaaaagatgtgactaaaatacaaatgtcaaagaacttaatatgtgtagtcatctactttgcagtttgttttagaatttggaattccggcgtaaatcaccctctacgtgaaaaattcatttaaaccagcctttgaataattacccaaaaaactcaagtatgtatgtgttttttttttaaagtaaacagtaaccagattttttagaacgtcaccattagttgttattcatctagcagaaatcattacgtgctctgttgcaagaggttaaatggcttttgggcaatctgtttcaaatgtagaagtactttgtgtttactggaattggtatttcatgatcatttaaaaccaaagtaagaagtccttttgatggaaaatatattctgtaaatcaaacttcgctgttgccatttttctgttgtcaaccaatatctgttctttcctcaatttaggaacagtcgtggtaaaataattaaacccctgcaatatcaatcaacggtggcttctggcacagtggcaagagtagagccaaatattaaatggtttggtgagtattatcccctgttactttgctctacaaaatatatgctgagtggaaacggctaggatgtttaaatgtctaaacagcaggagtttttggtgagtgaaaccggcaaggattatctgagaaagggataagaagaattactgggaaaagtagtggtggtcaatttaataaataacttctttttgaagagcgctcaccattagtaattgtaattgaaccctcttaagcagataagaccatccttaatgactagcattcacagaccttagaatgctcatcttaatcttttctgctttcctaaagagatactgttggagaggtggccttgtaggttttgtgcatatatccttcagggtaagtgcattagcccgaagttcctctgaaatacttcttaatggggtttttatttgaacttgggtgacaattaaagggtctcactgttgaactgtccaacagtgaatagagtatcttcagtctcagggtgatcacagcttcttccttggaaaactccctgtctcatttcagtctgggctcttaactttgcccttagccactggtaaatgtatgggcactttagatgatcagaccccagtgtttgcttggtgtttgacctctgtccttgggggcaggtggcagctatctttgagtctcttatactttcagtgggatacttcctaagaactgcaacacagaaaggtgtcaaaactctgcagagaagcatttagcatggctgctgggtactgtgactcgattagactgcctgggtttgaattctagttctgtcatttatgtgccagtgggcaagttattaagtctgtctgttcatcagttttctcatccctaacatgagaataagatgaaacctatctcataagactgtcatggtaatcaaatgagtaaatacaggcagggcgcagtggctcacgcctgtaatcccagcactttgggaggccaaggctggtgaatcacttgaggtcaggcattcgagaccagcctggccaacacagtgaaacccccatctctactaaatatacaaaaattagccaggtgttgtggtgggcacctgtaatcccagctacttgggaggctggggcaggagaatcccttgagcccaggaggcagaggttgcagtgagctgagattgtgccactgcactccagcctgggtgacagagtgagactccatctcaaaaaaaaaaaaaaaaaaagagtaaatatatataaagtgcttagaatagcgcctagcaaatagtgagtataatataagcattacttgctaccgtcattaccaccttgctgttttgcatttatgccgcagcatgctgtttaattgaatgcttttcagggtctccctcacaagatgttttccaggtggtggtgcagggctctatcttgttcccttgcatggactcattggttaatagtccctttgaatcctcataaccctaaaagtggctaactatgactcaaatttcagtgtttcaagattctctgtctatactgactgatcagctgtgattggctccaggtttctctgctagatctagcaggtagtaggacatttgacagatctcagttccattccacgctatttatttctcagtttcatttagttaggaaactggacttggaaaactattgaaaccctttgtgggtctggatttgtggaatagttcatagtgtgcaagtgcgggagaggcagttttttggttttttcctcttttaagtttgaaaacagctccaagggatggatggatcaggtgcttgggtaagtgagggtaatttaaaatcttgcctttcaccgtgtcagtggaagatggatgcgcaaatattaactaagtggcaacattctttatttgtaaaacaggaaacacacgtgtgattaagcagtcatcattacaaaaatttcaagaggaaatggatacagttatgaaggatccatacaaagttgtcatgaagcaaagcaagttaccaatgtctcttctccatgatcgaatccggcctcatgtaagatgtaggatatccctggtgatggaatttcctgggcaaactccatgcagatccctctctaacatatttgtcttttgtttttccttagaaaatagtgactttaatgtagcaatgatgaactttctaagacctctcttttcaccttttcatgtttagtatgaggtgcagtagtgtagtggatcaaagcacaggttttggagttgagacctgaattttaatccttgctctatcccttcctgtgcccttagttgggtttctccatgaactttaacttctttgccttgaaagtatagataggtcggacacagtggctcacgcctgtaatcccagcacttgggaggctcaggcaggcggatcacctgaggtcaggagtttgagaccaacctgaccaacaagaagaaaccctgtctctactaaaaatacaaaattagccaggcgtggtggtgcatacctgtaatctcagctactcaggagaggctgaggcaggagaatcgcttgaacctgggaggcagagattgcagtgagccaagatcgtgccattgcactccagcctgggcaacaggagcgaaactccgtctaaaaaaaacagaaagtatagataaccgacctccttgggttattggctacagatgaagcatctgtaaagcacttggcccatagtgagcacatagcacaccacctaataagagctaaattgataacagctattagtaatattatttattttggtaggcaaacttgttttaagtggtaattccatcaaactttgggacagcgtagaattaggattgagttggtagaactttggtgttgcgtacgttcagcttttgtgagatccttgagattttttctcagctgaaggaaggggtgctggtcacattggttgtcaattgctaaaatttgaagtgcagtaaggattcaatctgggttgagtggaatgagtttcacacagaacaaagaaagaatctgttgtttgtctgcttatttttacttgcattgaataataaattcccagaaatgtagccagtacgtaagcttcagttccagtatgaggaggggagaaaaacattgacatgcatacgtgggttaaatagttcaggctgggcgcggtggctcacgcctgaatcccagcactttgggaagccaaggcgggtggatcacaaggtcaggagattgagaccatcctggctaacacgtgaaatcccgtctctactaaaaatacaaaaaaaaattagccgggcgtggtggcgggcacctgtagtcccagctactcaggaggctgaggcaggagaatgatatgaacccgggaggcagagcttgcagtgagccgagattgcgccactgcgtgccagcccaggcgacagagcaagactccgtctcaaataaataaataaaaataaaatagttcaaagaaaactgtttacttgcagaacaaaataaaaa

SEQ ID NO: 52972 - DNA, 1061 bp, Homo sapiens
tattgaatgtttccttcttcctggaagagtaaggaagctatgcgtatctggagaccacgggtaccacagttgaagactgacattctgaaccctgatgtttctaaagaaacgtcagtatttcagtctgacatatttgaaacatcagtgccttgaaccttaggactgggtcttggggaggattagcgcctagatgtctgattttggagctgcagcatgccaggccgtggctgagagtatgtgagccatgccttgcccttttctgaggctcagggaagtggatggagctagagagacaacaggaaagacggtgctgaagaacatagtgtctttcctctattgtggacctaaagaggtggggaagcaaggacaagaggcaaagagccacactgcccttggcatcatccaaagcattgtctggttgacaccaggtcctggttttgtgtcttttgtcaatacctgaatccttgacaaaagaaaaagtggttttgatgatttaaagaaataagggtgattttgacagaaaatatattttaaaaattttgaccaattgcaatagttatcctcaagccaatttccagaacctgccaccagggggaggtggtgcagcatgaatcattctgaatgctttgtctttgaagtgttcccctattgctgttaccatctcagaggaagtaactgggcatggtgagactcctaaaatgacaggagtttttttggccaaagctggcatctgacttgccacattcctctgagtctggagtagccgcaggggtgggagaatgccagcccagagtcagtccatcggggttacatttccaaggtctgctgccttcatctatgtaatggccgtgttactttcagatctttcagcttcccagagtgttgtgggaatcttggtcattgaatgtaaagggacttagtaaagggtatagatatttttcaaaaatgaaaataactttttttcttataagtgataagcttttataaagatcataggaaaactagaaaaaatgtaaaatgtagaaaattgtaaaacaaacttcattagagatattttgata

SEQ ID NO: 52973 - DNA, 1032 bp, Homo sapiens
ccaaagctgggattacaggcaacagcctctgcacccagcccctttcttgattcttgagccacccgtacctccaagacactgtcactaatctccttagaccagtggtctcaattggagatggtttttctatgaggggacatttggcatcatctagaggcattattggttgttatggcttatggagggtataggtatagtttacacctgtcatttagtgggtaggggccaggcatgctcctacacgtcctacaatgtacagggcagcccttcacaacagagaatcatgtagtccaaaatatcagtagtgccaaaattgagaaaccttcctttatacatgtctcatgatattgcctaatgtcagactctttcttgcagagccatcctcctcaaggtgcgagacatggtcagcagccatgtggagcgagtgtttcagatctatgagcaacacgcagacacagttggcattgatgctgtcctgcagccttcagcagtgagcccctctgtggctgacatgttggaatggttgcaggatattgagagacattatcgaaagtcgtatcctttgcacacatttcaggtcacagccagagctgttctaagtctttcaaatttcagttttcacaagattggaaaactaagtagtttgagtcagttctctttggttcctgaacttggattcttcctgcattcctttgtataatccttcctctaataatttatcgagtagctactacctgtcaggcactgttcttggtgcaaagagacaggcattgaaaaaggcaagtagaatgctgaatggcgataagtgttatggagaaaaataaagcagggaaagtgaggagtgagggtggagttgtgatttaaaatagggtggtcagagcaggcttcatgagaaagtgatatttgagcagagatctgaagagggtaagggaaagagctatgtggctatttggggagagaaagttactaggcagaggaaacatcaaatgcaaaggccttgtggtaagaacattcctggtctattcaggaaat

SEQ ID NO: 52974 - DNA, 1290 bp, Homo sapiens
tacagccgacctgacctagtaggcccccagccctccagagcttggggtattgcagagccgccacaaggcctgccgggagtagtagtttgtatagttcgcagccggccagggcggagccgggtgggttggtggggagggcggggaaacaagcctggaccacaactcccaggagtacccgcgacggcggcggcctcgctgtcgcactcaggctatagggggcgcattgggcggaagaccctgggccggcaggaacttgcttgtgattggatgttgtgggacggcggcttctcattcgtcagcctgtgactgtggagtttgaattgggtggcggttgactgtagagccgctctctctcactggcacagcgaggttttgctcagcccttgtctcgggaccgcaggtacgtgcctggcgacttcttcgggtggtccccgtccgccctcctcgtccctacccagtttcttgcttccctgccccatctccgccgctccccgcagcctccgccgagcgccatggctcctaggaagggcagtagtcgggtggccaagaccaactccttacggaggcggaagctcgcctcctttctgaaagacttcgaccgtgaaggtaaggggccaggccgtcgcggcctcctggggcggtcgcgggatgctggcgggtggggacacgagctgcacagattcgcccgcccgtgacccgtgtcctgtcggctctgccctcccgcagtggaaatacgaatcaagcaaattgagtcagacaggcagaacctcctcaaggaggtggataacctctacaacatcgagatcctgcggctccccaaggctctgcgcgagatgaactggcttgactacttcggtaagagctggagagcttccctgggcggaggccaggagccccttggggttaggtgacacccttcagaaagggctcgctcagatgtcaccttttaatgagatctgacatgaccacttatggaaaattgcagaccctttcactctctgtctcacttccctacttcatttttctctatgaaaaatgggggggtggttggggggcggcgggcggggcggtctctgtcggacaactcagctctgctgtttacaggtccaaaacagctgtagtgaatgggcatggatgggctgtattccaataaaattttagttatggatacactgaaatgtgaatttcacataattttcacacatcaggaaatttatttaattttttttaaacagagtctcactctgtcacccaggctggagtgcagtgcagtgcagtggtgcgatccct

SEQ ID NO: 52975 - DNA, 1022 bp, Homo sapiens
tgatcagaatcatttggaatatcagggtttgaaggagtctgaccaccaagggcacatagcagatctccgccagcttcattcagaaggtaaaggtaatgaggagccaattatcaatttggaaaaaattggagcatttgggagagaggtggggattattcacccccctacatacactgagctccaatgttttaaaagagttacctctgagatgaattatgcttactagctaatgcagttctctctttttaaattagaaatacagaactgcaaatgagaacttctaatgtaatatgagagagccattgttaccacaccaagttgagagaattctagccttgactaatatgatttaaaactccagaaaggaacgatagaaaatctataaaagctcttagttgggaagtgtgttggggctcccaagaccacctccaggtttggtgattcactaggaggattcatggggctcagcatacagtcacacccatggcgatgatttattacagtgaaagtatacaaagcattaatcaacaaaggagaaaattgcataggacaaagtccagaggaaaccaggcttctaggagtccactccctgtagagtcaaacagaacatgcttaattcaacacatatgaaatgctgtctaccagaaaatctgattagagagtcaatgcccagagttttaactgggggctgctcacataggcatcctctgcctagcacatgtcaaaatcctagactttcaggagggaagtaggtgttcagcatgagccatattgtttgcataaagtttaggcacagtgaggcatcttgttaaggaaaggtgggaatctttctgaaatcaagttcccagatgccaaccgaggccaggcttgcaaacaggcctttctatgtgtatcagtctcaggcctgctctgttaactgtcctgcacagtagatgcccagtggcctgccaccactgatgactccataaaatgccagttgtttctagagatggcagaaggttggcaggaatgcccctactttc

SEQ ID NO: 52976 - DNA, 1050 bp, Homo sapiens
gcaagagtaagtggacactgaggttggaggctgggggttatcacaagacaagcaaatacaaatgcataaaatacactgttgtacaccagagctcacagtttagtagagatgatcctactttacatggcaatgacaaaagagataattgactggtgtgcaaagtgtgtagaacacagaagaggaagctagcaagcctcccctaccccactaggacatagacaggcctttcaaggtgagtgagagtctactagctagagaagaaagggaagaggaacagtattcaggatagatgggggaggcggaaaactgaagatgaggaaaccagttagaagcctatgaattcttgaactgacatgctgacactatagaatgaagggatggtttttagataggttttagaaagaagtggcatggttggtggagaaaaggaggaatcagagacaactgcatggtttctagctaaggcaaatgctatccagtgaggtgtgggacccaggtggcagagggtgctggactgggggtggtggagcacatgccaattgcatgacatgttgaccattcattacttttccaggacatctaggctagacagaaatttcagcctggagctcagggagaagagggagatttgagagatacactgcctcccagatctttaggtgtttgtcccagtgtgggagtggagatggttgtgcagggagagcaggaagggagggagtcagggtggacactagagggagggtagagagaggagctcctaaggcagactgccaaggaagttagagaagcaggaaagacagatccatcacggaggacaagggaggagagaatatatggaagataaggagtgattcttgccagggacctcccaggccccaggaagggagcactgcagggtttgcctttgattgggcacctgggacgccctgagtgaccttcacagcagccctttatgtaaagtagtggggtacaagccaggctgcaatcagttcaaaagagatttacctttaatcttggtcaaaatcctctattttgaaaacccagccagtg

SEQ ID NO: 52977 - DNA, 1084 bp, Homo sapiens
caggtcaaagaaaagatcatcctagtcctgtcttggctacatagattagaacaaatgaaatgaggacataggatcatctagtccagcccacttgtcttgtaggcctggatagagtaacttgcatgcagtcacacggagatacgatggaaagtctagagttatagcccgtatctctgcccagaactccattcattgtacttatatttccctaactgaagcaatgtgtgaaatttccttttgacatagcaagattttctttaaaccctagataggtgttacttggagtgctaacccaggaggcctccaaacctcatagaatacagtgtctttggcacagttgaccttaactaaatgaagctcctttctctgcttagaggaaagtgccttctgttttaagactatatggcctttgatgactgcgtgcagtttgacattattggatacaccagggatagtgtccatgctcttccttctccctcttctcaggagttccaggatctctggcctcagttgtccttggttattgatgggggacaaattggggatggccagagccccgagtgtcgccttggctcaactgtggttgatttgtctgtgcccggaaagtttggcatcattcgtccaggctggtaagtctctttcctgtggtgtggggaaataatttgagggaggttggagagatgcaaaaaagctttgacaagataaagatggtgcctcctatgttgccctgaaggagtgtgggccaggtttggagaagtggtagttgcagtgggactaagtttcctggctttcttaggattcaaaaggtttcatcaagggttgatgaacagggcttaacaaggctagccagtttcgatgtccctgctcaccagcctctggtgggctcgggacttctgagaagtcagactggtaactgtcctgtttcctcctcagtgccctggaaagtactacagccatcctccaacagaagtacggactgctcccctcacatgcgtcctacctgtgaaactctgggaagcaggaaggcccaagacctggtgctggatactatgtgtctgtccactgacgactgtcaaggcctcat

SEQ ID NO: 52978 - DNA, 1049 bp, Homo sapiens
cagctgctggacgcggtggagcagcggcagcggcagctcctggacaccatcgcagcctgcgaggagatgttacggcagctgggccgccggcgcccggagccggctggtggcggggttagtgcccaccctgggctgggctggggtggggtggggtctgcccactggctaggctggccaagccctagcttaccctggaggggggaagtatgtctccgccgctttatccctaacctcctttgatctggtgagaggtttcgaaaaagttaatactatccaaatgccaaatggccacatccttgtggggcctaatccaaggccttgcctcccagcctcacttttttcctttctgttccaactagaacgtctcagccaaacctggagcgcccccccagccggctgtctccgccagaggcggctttccaaaggatgctggcgatggagctgcggagccctgaccatccccgagcagaataccctgacttctctccctccccagggccggtggctggactctgaacaactcccttcagtaaaggggccagtcttcactggcagtggctggtacttggctctcagcctggagtggcagctctgctagcagctgggttcactcccacttcatcctggctgaaagcagtgctgtgctttgaaatgcagccaatgaatacccagtctgattacccagatttgggcagaccagcagtgctcgccagagtggtctggcctgctatgggggatccaggtggtgttacatgtccatttcatgttttgggggcttttagccccacaaaacaccttcagtagagccttgattaaaaggaaacctgcagactctcctggtgaccgacgtttcctttctgtcccctctccaagactgatggctgggaaggggggagtggtggaaaaatgtcaactatgggcagggttggtaagaaatgccacagatactaccagatttaaataagcatttaattaggatttcattagtatttaatattgctttttcaattccaaaaagttaaattttcactttttagcagatattttaa

SEQ ID NO: 52979 - DNA, 1017 bp, Homo sapiens
gtgtgcctgttgggccaaaaattgggtgataatgtagtgtcactttctcagctcaatgcagtttctactttttcttatgggaaaatttttcataaaacctttttgcaccaaaacccaggggtgttttttgcaatatccttgttatcctcgtagtgtgccaagtcagaggctttctcttgcccttttcctgctgtgttctcaggcctcccaagggctatttgactcaacagtctacatccttcgttgtgttttggagaatgtgggggtgggggtcagagttcaaggtgtctgttcccttttcctgtgaactctttctagtccctatttggggagggtggctggaaacagatttttgctgaatttctggctcagatcttctagccaggaaaggcaagagcccccaagagcccttttttttgacatacactaatcattggccggggtcttggtgacaacttttaaaatcccaaatagttttatttggattatgtaaaagtaagtgtgaaacatgggaacaacggacttccactgagcgatgtgaaaacgttacaggttcagtacttccaaaggaagaaacctccaaacccaaaaaagaataaatatgaatttgtatttttgaagaatgtgaaataatggtgtttgcttaattgctcattttgtataaacttaatattgtactttaaaatatctgctaaaaagtgaaaatttaactttttggaattgaaaaagcaatattaaatactaatgaaatcctaattaaatgcttatttaaatctggtagtatctgtggcatttcttaccaaccctgcccatagttgacatttttccaccactccccccttcccagccatcagtcttggagaggggacagaaaggaaacgtcggtcaccaggagagtctgcaggtttccttttaatcaaggctctactgaaggtgttttgtggggctaaaagcccccaaaacatgaaatggacatgtaacaccacctggatcccccatagcaggccagaccactct

SEQ ID NO: 52980 - DNA, 1098 bp, Homo sapiens
tgtaattgactccactaaccactctttcacagcattcctgaatcattcagtctctgttcaaatacttcccatcatatttattcattatgcacataatcacagaaaatctagcctatgctatatttatttaccaggaaaaacgacaacaaaaaacccaaactcaaaattagtgttagcaatactataaaactctcatgttcaacatggaggaggctgcataagctcagactcaatgcattggtttgtaagttgcatcatggagccatgggaatggcagtcaaatttcctaacagcttgaatcaaagcaatcagattaagataaagtgggcttgtcctttagcagatagaggcctctatatgtgtaagaggttttcttcaaaaagctaataaacctaaagaagggaaatttttctctccccattgcacagaaaaaaaataaataaataaaattaaaatgaaaaaggaaaagaccaagccaggtcatatagataggatttgagaaagtccagaaactagaattctggttatgtcttacagtactagactttaagttcctcaaggacaaactataccaacatttttaactactataagctcagtactggcacagtgcctggtcaataaatatttgctaaatgagtaaaaaaaagaaattttctggggccaggttaccgagtgagtgacctgcgtcaaaaggaatcaggcatcagagagaacaggctctaatagaactcttatcagaagaagaaaaaatcctacatggtcagtaattaaacacaattaaatttagaaaacttcaaagactggcctgcctcaattttcccaccaaagggagtgcttaattcttgcccttatttttctagcactggtattacaggtacacttaccgtactggaattttctcgcaattcagaatctgtggacagaaggctcaagtcacttagacaaagtgagtgatttgtatcctgtgaaagagaaaaaattctaattgagtaacaaaaatcaggatttacagtggcatatcatgtaacaaaacatttgattacaaagtccctaatgttccacatgtctacatgtattatctgaagaagtataagc

SEQ ID NO: 52981 - DNA, 1050 bp, Homo sapiens
ctgagtagctgggattacaggcacgcaccaccatgcccagctaattttttgaatttttagtagaaatgaggtttcaccatgttagccaggctggtctcgaactcttgacctcaggtgatccacctgccttggccttccaaagtgctgggattacaggcatgaaccaccatgcccggcccatccaggaactattacaggtcaattagaaaaaaataagtcactagtagttacagtaccaaggactaagatgttaccaaacagaaatagggtgaatgatttagcaaggaatatcttttttgctgtggttgaggtcttaaaattgcatatggcttattgatggcatatcacttttcctttgctagccttagagagaccatcttgtcccacctcctaccctatgcagaaatctccctatggcatccctgacatcagttaatcttgtttctgcttgaagacatccagaacaacaagagcagagtgtttcataccccaacccaatacatttgttagccagctctgattgttagaaagcttttacttgtatagaaccaaaacctgcctttctgcaggtgctgcccactggttctagatctgccttcctgagtaaactttctcccacagaacagtccatcagctatttgaagatcatggatttttcttcctcttgtacaggctaaccacctccatttacttaaatgtccctctgtgacattttccccagtctctcatcagcctagtcacctttgattatatgaattccagttttccaaggtcctttttttcttctttttttgagatggagttttgctgttgttgcccaggctggagtgcagtggcgtgatcccggctcactgcaacctccgcctcccaggttcaagcgattctcctgcctcagcctcccaagtagctgggattacaggcatgcgctaccacacccagctaattttgtatttttagtagagacagggtttctccatgttggtcaggctgatctcgaactcctgacctcaggggatatgcctgccttggcctcccaaagtgctgggatta

SEQ ID NO: 52982 - DNA, 1122 bp, Homo sapiens
ggctaatttttgtatttttagtagagatggggtttcaccatgttggccaggttggtcttgaactactgacctcaggtgatccaccctcttcggcctcccaaagtgctgggattacaggcatgagccactgagcccataatcacttttggaatctattcaaacttccaaactgattctgatatgcagatagctggagtactcattgatcagggcctgatcaacccttctaattatgctcctgccaaaattgacttctcataaagtgttctctctacttacttcactatttcccttctcctgccctttttttatactttctttgctctcaccccagttattaacctctgtaagtcccattttgtcttacattcaagacccaactaaaatgtcttatttctttcagtcttataggaacatgtagttaaaagtttgacttctaaattcatgttgcatttgacccgtacctctcttttgatacttatgccaagtggtaagcaaccagttttctgtgcacagtctttctcgtgcacttggatcgtgtatacagttcttggactatagtaggcacttgagaaatgattcagtgaacaaaagacaaatcccggttcttcctctttcaggtcatttctactctccccatattccacaaaaatgtcttccactacttgatggcgtttttgcgagaactgctgaaaaattcagcaaaaaatcatttggatgagaatattctaggtaagcagccaaatgtctatggaaagcatttctgcaaactgagagactcgtaatgagaaatgaggttgaggagggtcccaggtcccttgcagtagaactaaaatatcaagctctgggcaaagattttttaaagcagaaagttttgcgtttggacactcctccccactcctaacaacacaagagtaagtatagtcatgggctgggggcggtggctcacacctgtagtcctagcactttgtgaggctcaggtggacggatcacctgaggtcaggagttcaagaccagcctggccaacatggtgaaaccccatctctactaaaaatacaaaaattagctgagtgtggtggtgcatgcctgtaatcccagctaaacgggaggctgagttaggag

SEQ ID NO: 52983 - DNA, 1029 bp, Homo sapiens
agcatgcttactgtcagattggttttttaattctctcctgattctcataggaggataaagatcagagaatcagtctgaactctgttttggctttgagctttcatggttgttttggatgatacccacaggatacatgttatcccttggtgggcccgaattgctcttgctgcctcagatgacttagccacatggacatgaaggccctgattcatcactccccacctgagccagggcactcgccaggcagcgggcactgctgtttctgtgagtacttccagtgtggactttgcatttcagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtaggtggcagctggtacctgttgtaatcattctggagggaattggctttcacaactaagaccatttcttgtctttctggtttcttcctctccttttgagagggaagaagccccttttaggacaatttaaaacaattattaacaacttggttaataattgttttagtatgcctctgcatttttcctcatacatggaagttcccttttgcatttttgaactgtctctttgcagacctttctctatgcgtttataaatgggtgtgtcagtattgtgtatacaacattgaggatatttttccttttttgtaaaagagatcatattatacattttgctctgaggacatctttttttccctgactgaatatgtcttaggagatctttccaggacagtgaaggtagagctttcttctcattatttttaaaggttgcaaagtattccatagtatggatgagccataatgtatgtattgatgatcataaagttatttccaaagttttgctattatacacagtgctgttgtgaccacccttcacatgtatgtttgtgtatcagtgtatttctatagaatgaaattattagagatgaaattagcgg

SEQ ID NO: 52984 - DNA, 1022 bp, Homo sapiens
gagaggtacttgataaatggtagtcatcattattaaagcagtgggggattaggagtgatggagaagagggagaggaacagttcctgaatgtctgctgtgtaccaggcattgtgctaggttcgtgacccatgtagattgtatttgtttatccttttgaggtctccgtaaatatggtagcattacttccattttacaaatgaggaagcaaattaagtaatttgtttgaggtttcataagaggtgatggatggagtcagtaacatcaccagctctattttattccaaagcccaaggcattttccaaaacagtctaatgtttcttaaagtgccagacacattatatagacaggaagacactcaaaattcagagaaatgactactgagaacttatgtggctggggagggcttcatgaaggaggaggtgggagttgaggctgggcttcgaaggagaggtggccaaaaagtaggagtaacttcatatgaaggcaggagtgcggatggcatgtgtgaagaatctatccttttagatcaggctgtctttgggtgatggattgatgaaggagagtagagccatttgcaaagggcgtcagatgccaattgaaccagtttgggtcttaacctgtacaggaagatttagagcagagagatgaaatcagagtttaatcaggccaagtgcagaggctaaatgggtagggagaagtgggaagatctcttagttgggagactcctgaggtagcaagtgaggagatggtagcctggaggaaggcagctgtgagactgaagaaatggatgactaactctctctggggggccaaggagagaggtgagccgatggcaagactgtacacctggctgataggaagaatgatggtgctggtaataggcgggagagctcagggaaagagtccagaatcagactacagttttacctgggtcccccctgcatacagaacgtcttgtagaaatgcccaggggatggtggaggtgctgagctcagacagggctggacagcctcattcataa

SEQ ID NO: 52985 - DNA, 1044 bp, Homo sapiens
cactgactttagattggtagttgaatcggtagattggtaggagtctttctgctcctgcacttatttaactgctcctttttttttttgagacggagtcttgctgtgtcaccaggctaggagtgcagtggcacgatcttggctcactgcaacttccacctcccgggttcaagtaattctcctgccttagcctctctagtagctgggactacatacatgcacctgcacgccaccacacccagctaatttttgtatttttagtagggatggtgtttcaccttgttggccaggatggtctccatctcctgaccttgtgatctgcccgcctgggcctcccaaagtgctgagattacaggcgtgagccaccgcgcctggcctcactgttcttaacatcttttttcttttctttttttttcttcctaaccactagatgaccagggatgctgttaacttccttttgcagctttttctttccttaaaaagagtgaagtctgatttgggagaaatacctcattatttccatctagcaactgaagttgctcttattcagaaaaccccattgaggatcctgtacagggcccagtacttatccaagtcagtctgtaaaatgttcacctgcattgcatcctgggtacatgcaaaacctggagctgtgttctggagggttttgaactatgcactaaaaaggaaatggctactcagaagtcccacaggggccattctgggctattttaacaaagcagtaatagcaaatacattttgtttttttttaatccaaagttgattagaaatgagccagcttcgccgggtgtggtggctcaagcctgtaatcccagcactttcagaggccgaggtgggcggatcacaaggtcaggagttcaagaccatcctggccaacgtggtgaaaccccatctctactaaaatataaaaaattagctgggcgtggtggcgtgcgcctgtatcccagctacttgagaggctgaagcaatcacttgaacctgggaggcggaggttgcagtgggctgagatcacgccactgcatgcca

SEQ ID NO: 52986 - DNA, 1050 bp, Homo sapiens
gctccataaatgttgtctagtaacacccacataccacacagaagcagagagagagtaatagttgtcaaaggtctcatagctggtaagtgactcagggtctaggagctgggagggagggggccttagacattttctgatccatcaccccagttttacagatgggaaacaggttcagggagagaagtgggtagctaaggttgcactgttcctgtcacacacagtgctagaatgcaccatggttagatcaaacatgtgtttgtgttttactaacaatcaggggctcctgcagatgagaaaagttctggtttgatgacctcatccataaaactgcagtctctgatgggcaccacagacagagatggcatgaggagtgtgcctagccagggcaccaccagcacagtgttagggaccaacgagcgagtgtgagcaccccgagacctccaagatagggctgagggacagccagcgggcccccatcctcacctctgcttcctgcccttagtctcttcctctatacgcaccggaggatggccattaccggggacgatgtctctctggaccagatagtgccagtctcgcgggattttacgctggaagaaggtgccacagggggctgggtggtatgaatcctctcctatgggccccccagctcatctttgtccttgatgggggggcaagggggagtaagctcaattgctaagggcattctcatttccctccccacagtgtccccagatggtgaactctacatccttggtgagtggtcctcttggtctgggtcccactcggggcaggggtgcctgattttcagagaaagaagaatggtgtaaagtaagagcaccccctgctaaacttattgcagcaagtaagaccctgtaggatctggcacagcccatctccgtgggctcatctcccatcactctcctccttgctgctgtttccgtctcccccgataacacacattctcaccccggagcccctgcacacgctgtcctctcctcctgcaagcctcacatctcttcacctagccaactcctactcagccttcag

SEQ ID NO: 52987 - DNA, 1050 bp, Homo sapiens
ccagcatggaccagtctgtggcaatccaggagacgctggctgagggggaatactgcgtcatcatatccttcctgtgctaactgcggccctgagcctgccctggccttgggaagaggaatggaaggtgtcgaggtgtctatcccctctcctgcccctctgaaccatcaggggagaaggaaatcagtatttactaagtacttactgagtcctggactctcagccaaatgctttaaatacgcagttatcctcctaactccctatgaagttggggattattatcctcatttcatagataaggaaggcttagagagcctgtttgtctgttagttcagcacatggtttgagtgctcacccaaggccacacagtgaatctgggggggcaggggaacagagggaaggtgggacagcctgggtggggagaggcctcgcctctgggttgtcttcccttgactctgagccgcaggcggtgcaaggtgtgctgtgtgagggggacagccggcagagccgcctcctgggactcgtgcgctaccgcctggagcacggcggccaggaacacgcgtgagtgaggggcttggtccccacctgtctgggccatggggttgttcatcactgcaccctccagctgaacttcaactgtccctccagggcagggtctgagtctcctagaataattatcacaatgatagttaatattttttgaacactatattttaaaccctgcacacgtactaactcataatcctcaagatctaaggaggaagtttcttgagaagagacagtttaacatactagtccagatcttgagcctcgtggtccaaatgcctgggttcaaacccaggctttgttactaacaagccacatgatctattgtttgtttgttttgagaaggagtcttggtctttgcccaggctggagtgcagtggggtgatcttggctcactgcaacctctgcgtcccaggtccaagcaattctcgtgcttcagcctcttgaggagctggtattacagaggtgcccgccaccatgcctggctcatttctgtatttttagtaa

SEQ ID NO: 52988 - DNA, 1054 bp, Homo sapiens
cttgtaatatagtactctgatatataaaatagaatcaagcagaattgccctggacatggggaagctcagacttcctggcttccctttcaacccctgcaatggcctctgagcagaatcctgggattcttgggaaccatttgaaaactgctgttgtaggtcagcctttctcaaccagggttccccatcttaaacatagagagctaaataaactattttctcagatactctaatgatgggtcatgactgatatcattctagatgtctacgagagaagttaattcattgcacacggtggctgctttggggcagtgggacttaattctcttgtggaaccccagttgagaaaggcttagatgaatgccaatcttagtgtaccagagtatgccatggaatcaggccaggatgagctcaggtacttagagattggttccaaacatttcttttaggagagctgtctaacaaagtgtaccccttccttttcaggaagaatatgaagactcaagtgggaatgttgtgaataagaagacatacgaggatctgaaaagacaaggactgctctagtgttcagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaacgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgct

SEQ ID NO: 52989 - DNA, 1236 bp, Homo sapiens
agatgagatcccattgtgttgcccaggctgatgtcaaactcctggcctcaagtgattctcccaccccagcctccaaaagtgatgggattacaggcgtgagccaccacacccagccaggaaatattttagagtcagaatagatgagactgttttctgttgttctataatagcctcagatgagtaattaggcaagtgatgtaaaacctttgactcttttctttgggatcaggtagagcctgctgataaggagttctgatatgaaggcaagattttcctttattctgtaagaaagaaccttatccttggaagtaaggggtcagcaaaagttacaggaaaacaggaaatttcccttcttattctgcactacttttttctgacttttcatttatggacctgctttaggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaagtaagtctcagcactaccactttctccccattccccattttggaaacagatacagagtttagtaggctaacacttcttggttttgttttgtttttttcttttttagcctattccctactggctgtataagcttcatggcctaaatatcaactacaactgtgagatttgtggaaactacacctaccgagggcccaaagccttccagcgacactttgctgtaaggaattcagagccatttttcctgggaattgaagtaaaaacatgagacttttagagaaaagagtaggagcagcctatgtggaccactggtgtccagagctgaagggaatcagagaaggatggttttaaaatcaagcccatggcatttgacttttggcaccaatgttagtcttaaatacctgagatagtttctggaggaattctaccgcaccactctttgaaccttatttggttttctcttgcctgctcttaaacttctctgtttttgtctttctgctagcattttagaccaatttctgacttcttggttatttctctaccccattgctaatactcaagataaaaaatagggctgactgatctctttcagatcttaaatggatctttgcctcttgagaaaataaaaaatgaaggggctgatatttatcaagccattcttgagacagggta

SEQ ID NO: 52990 - DNA, 1055 bp, Homo sapiens
aatgacatgttgggaaaaaagtccattgtaagttcatttaaaaatgagtattggccgggcgcggtggctcacacctgtaatcccagcactttgggaggccgaggcagacggatcacctgaggtcaggagttcgcgaccagcctgaccaacgtggagaaacaccgtctctgctaaaaatacaaaattagccgggcatggtggcgcatgcctgtaatcccagctattcgggaggctgagacaggagaatcgctttaacccgggaggcggaggttgtggtgagccaagatcccgccattgcactccagcctgggtaagaggagcgaaactctgcctcaaaaaaaaaaaaaaaaaaaaaaaaagagtattaaaaagatagcattactagaattataagtactttatattctgcagggaataacaagataccaaaaatagaaaccctttttgctttgtctgcattgtgtgttcctctgtagatacctagagatgctgcttgagtaccttcaggattacacagatagagtgaagcctctccaagatcagaatgaactttttgggaagattcaggctgagtttgagaagaaatgggagaatgggacctttcctggatggccggtgagcttcagtgggatgtgaatggtggacatgccagggaattgaagtaattattttcctttatcttgagcttccactttagggcattaggtatcaattccttggtatcacttgtgacaatgaggtattccctgccaagtatgctatgttttttttttttggagacggagtttcgcttttgttgcccaggctggagtacaatggcgggatctcggctcacctcaacctccgcttcccgggttcaagcagttctcctgcctcagcctcccgagtaactgggattacaggcacgcgcctccacacccggctaattttgtgtttttagtggggacagggtttctccatatttgtcaggctggtctcaaattcccgacctcaggtgatccgcccacctcggcctcccaaagtgctgggattacaggtgtgagccaccgcacctg

SEQ ID NO: 52991 - DNA, 1003 bp, Homo sapiens
gtgagtctgttacaggggaagttaggcatcggtggtatgtaaagataggagccaccccttaaatgtatcatttaggtaatcttccaatcgacctgcttaaaaaactaaacaggaatcaaggctgttaaagggctattaaaaaactaaccaggaatcagggctgttaaaggtactaggaagcacagaactgttaagactatctcatatccatgtctcttgaggttgccctgggctttgactggagaacccttgttgtttgcttagctctacagttgtgcaaattgcatcattctgatggttttgtatttgcctttcagaggtatatggaggtcagtgggaacctgagggatttgtatgatgataaggatgggtaagtgacagtcacagctaatccaggagttagtgcttctgaggagccatggttagaggactgactttgtgctctatcttctttgaaattttcctgaaattgcagattacgaaaggaggagctcaatgccatttcaggacccaatgagtttgctgaattctataatagactcaagcaaataaaggaattccaccggaagcacccaaatgaggtatgtcctcagaaaagtattttctccagacctatccttaaagcatactaaaggaaaggtataaaggaaactggacatgtgctattcaaatgcacttcaagaaagaacttgccatttagctgcaaggaccatagttagctgacatcctacaatacagtgttttcagtatctccctcagcttttaagccaaggccggctgggcacggtggctcacgcctgtaatcccagcactttgggaggctgaggtgggtggatcacctgaggtcaggagttcaagaccagcctggccaacatagtgaaactcaacctctactaaaaatacaaaaattagccaggcatggtggcatgtgcctgtaatcccaactactcaggaggctgaggcaagagaatcacttgaacctgggaggtggaggttgcagtga

SEQ ID NO: 52992 - DNA, 1073 bp, Homo sapiens
ggagctgaaataaaatgagaagacactcggtggcgacctgctgggcagcaccctgtaccctagggccccttatcagtgggctcctgatctgctgcccccacagcctcaaccgcggggatggggtggggcaggtcaagcctgagaacagtccactttcaaggacttcccaggcacccataggagacctgaaacctataaagagaagtctagatttaagggggcctaagtcccagagtccaggtttggagggctcgggtctagagccctgatttggggagaggactcagtctgggaacccagactgcaggggagagggtgaattctggagtccaggtgtggggagggggcttgactcatggaggctctgtaagagcccaggtttggggccctgggtcagggagtaccagtttggggatgctggagtggggagacaatcctggagcccagaaggagacccattttttttggcggggggagctgagtcccagaggtggtttagaaaaggagccacagtcctgggcccgtggtatgggaaagcctgggtccaggagccctggcttagggccctgcctggctacagccctggcagagcacttggtctccatccggtacgaagccctggcccaccagggaggtagagcagcgggcgcaggagaagcagttgtggtgccagtgtcggtcttcaaaggacacatacttgcctccaccgagtcctggagggaggctggaagttagctatgcagatgtggggatggtccggccctcaacctcacccaataccacatcccactcccttgcctgcaccctacccactccgttctttgacccttgtcccacctacgatggggcgcttgcagctgctgcacttaggtgcaaagagttctccaaaacaggccacacagtagggatcttcatcccgggaggtgaactgctgccctgccaggggcgtctggcatccggtacagaccagacattctcgatgccacggctgatcacggtatgtcactccaccctgtgtcagcgtctgtgggggcagcatccattagtaggtatgagtggggattcccacccca

SEQ ID NO: 52993 - DNA, 1034 bp, Homo sapiens
cccctactgtgtgccctgctatgacaatacctttgccaacacctgtgctgagtgccagcagcttatcgggcatgactcgagggtaaggagagggccaggccaggcaggaggtgggtggtgaccagtggaagggggcaaaggatgggtccatgaggcctgggtgccagtgcccctgctgtgttccccacaggagctgttctatgaagaccgccatttccacgagggctgcttccgctgctgccgctgccagcgctcactagccgatgaacccttcacctgccaggacagtgagctgctctgcaatgactgctactgcagtgcgttttcctcgcagtgctccgcttgtggggagactgtcatgcctggtatgtgttcaggggctcatcttgtgtgagaactggcatctgcgtagggtctttgcatgtgtctgtctgatacatggagacttggtctgtgtaaagacctgcatacacagcatgtttctggaaatttagtatatacgggatctgtttgcctggtatactcctgggggctactatgtacaggcagattgacacatgtgatacatacttgggggcttagcatgtgtgaatatctgcatgtttagtacaggtaggaactagaggtgtgctgagactgtcatgcttgttgcattgggtcttaatgtatgcagaagcagataaacagagggcttaacatgtgtggggacctgcatgcctaatagaaatgctgggactcagcacctatggagaatggtgtgccgaggagatgcgagggcttagcatgtaccgaacctgtcatgcccagggcattagaactttgtgtgggcagatacttacttgcctggtacatgtggggtcccatgtgagtgctaaaatcatcacatctgttatatgagggcttagctcttagtgagacttcatgactgttacatggaggcttgatgtgtgctgaaattgtcatctctgggacatatgggggcttaacataggccaaaaccctcgtgtctagctgggtcatcatgtccggtgtct

SEQ ID NO: 52994 - DNA, 1050 bp, Homo sapiens
tgacaacaaacttaggaggtaggaagtggtagtatctcatttaattagatgggaaaacaggcttagggatttgcccaagatcactcagccagtaagtgcaggagccaggattcaaaccttacagcttgagctgctccatacaccatagccagttacgcagtcattctgagctccaggaggttcactgggaggtgccttgtgaggggagattgttggaggtgcagggttgtgagccatctgtagaggagcagtctcccccaaaccccgccccactgccggtcaggaaggaatacaaggctggctcccttcagtccccgcagtccccagccttgccagggaaaagggcagggagaggggtatgggcagagacaggtgggccttgttggtgccctttactctgtcctcaccagagcccagctggatagactagggcattgggggattctgggaaggaaatagaagccatgcccataccctatttgggttgccctggtttcggagtgctgactgtctctcagggggtggacccaagtctagcctgggcctgagaaggtggcagccgcagtgggccaagccaagaaggaaggaagaggcccaggcaccccctgtggacgcattccacctgtgtggccccctgctgccccgtggctgacagcccaggcaatcctcagatgttgggccagaggaaacctgggcctgagtggcaggaagggggctgagaaagaggagtatcttctctacaccatagcccccagcccaggagttccagctctaaagaccctggcccctggtggcctcatgccctggcctggagcgcaagctggctgttctcccattgcgcagaggcttgatgtatggagagtcaggcctccaagctgggggcatctgctggtgcctggagtctgaacttcaagccagagcagcgcttgttgtcaagaatttcgcactgggggtggatgagaaaaggaggacttctccttcagcttgagccagggcaggccctggcgactgccagcactggagccttgtgggagagtgggttggtggatt

SEQ ID NO: 52995 - DNA, 1411 bp, Homo sapiens
ggctctggccacgggtgcccggggcacgccgagcccgggacagcgcccgccgggactggacccctccgggctatcgggcggggcgggggcgggggcggcagcgagagttgggcgggggagggggctaagtttgaaatagaaaagccggagagagacagacagaccgaccgaccagaagcgctggagaaactgaggttctcggaaagcccggtggagcgagagaccgagacaggcagggactcgaggcacaggaggctaccgagaccactgaaacaaggacacaccgggcgtacagagttactggtggacagacccgaggcatgggggccgtcctaggctttgtggagcattttcagaaaaagcatacgtgggaccccagcgaacacattccctagggcccttccccgggccttggaggtgccctgaggcttgggcgtcattggcctcatgctgaatctgctctctgaggcctgcagagacgctcagagactagagacagagacattcaggcgtgcagaggtggcgaaagagacttggatgcagagacagagaaagggaggtggtggggattgagacattcagccatgtagacaagaagagaccaagacttgagatccacagaggcatgggccccctgggggacagccagtcaagatacagagccgtccaaaacctaaagacagagactgaagtgtgcccagacacagagatgctgagtgaagcagagacagacaccagaaactgagactaagtgggggcagagagacctaggtggtctgacagcttccaggacagcccctgacttacccgggcctgaaccattgggaggtgaggctgtggggaaacagaaactctgagcctaccgatcccccatgaggcagaggccctgagacagtaagttcgagatcaagaagagccccacgcacacacacagccaccaagacagccccaacttatttttgaactcaaatcttggatgggctgcctcagccctgggggacccagggtgaatgaactgttcctctcatgtccccagagcagctgcgggatcttgctccccaacccccttccctaaacttctctgacttccaggccacatgggggagagcagagcttggggttggtgcccggtagcagagggtgagggttgagggagttggatttctccccttaagtctcctgtcagcttctagaaggtgggggaggggtctgttctgatcctgactcacagctgtgggacctggccagggtcctcctggacagtgggcatgttgggggtgggggcagaaggattgaatggttggcatggggcattggaaaggcttctgggtgtcttccaatcacagggctagcagctgaggagaagagccaggctctggtgcatctcctgttcccctgcccttaaaaactg

SEQ ID NO: 52996 - DNA, 1845 bp, Homo sapiens
acttagccagaagttgtcaagtccagatttgaacccatgctgtctggctccagagtccatgattctagtcattgcgctatactgtactgtgtagtttctgaattacatatggtcatttggtgcccaagcttgcaccatatcctaaggagttttaatttgtactttgtttggtgtctccctgtaatgatataaatggcactgaaacatatataggctggggacagttaatttcaggttccactggaataggaactgttgattagactgtggaccctgcgaagacatgagctcagctcagtgacagtggagtgtccagatccagtcagtgcttttggcttttttgagtttcactctgtgtgaccttttagatgcttgtaaagtttgcttattgtgggtttttggttttttaaaattatctatttttttttttttgctatgaacctcatttaacctgtcttttagtgactaccgtaaaaaacaagaatacctcaaagctcttcggaagaaggctcttgaaaaaaatccagatgaattctactacaaaatgactcgggttaaactccaggtgggtgcccaatggcttggttggtgttttgagctccacacattggaaaataaggacagggaggagatggagaggaagaatcgttggccttaatttaacccttctctggttactccaggtgctcttggtcagtgtccaaggcaaaccctccacttccagaggagcgtgcatttttacctttgaatctgggttgtcttatacctggagctgttctaggacagatgactggaggtgctacattgaacgtacgcctcaggggcctgtgtctaggattgctgttagcatacagcatttggttgtctttttgtttttttttttgagatggactcactctctgttgcccaggctggagtgcagtggtgcgacctcggctccctgcaacctctgcctcccgggttcaagtgattctcgtgcctcagcctctcgagtagctgaactacaggcacacactactgtgcccggctaagtttttgtatttttagtagagacggggtttcaccatgttggtcaggctggtcttgaactcctgacctcaagtgatctgcccatctcggtctcccaaagtgctgggattacaggtgtgagtgaccgcacttggcctatggttgtctttgttctagccgtgcactgtgccaacaacttattaatgattttaatctaatagggaatatatcttttaaatttggattttaggatggagtacatattattaaggagactaaggaagaagtaaccccagaacaactaaagctgatgagaactcaggacgtcaaatatatagaaatgaagagggttgcagaagctaaggtaattcactctttgttctgattggttttattggttaagaagggaaacttaaattcatcaatctcaagttattcattaatttcttctggcatttacaatctcacttgattgtaataatgatttagaagtatagttagcatggtagagtggaaagagttcaggtttgggaatgagacagacctagggtttgagttctggcactgccataaattactagccccatgacaatgggcaaattcaactccctgaggctcttccctcatttctgtctcaggcgactgttgcagggattaagtgcgtcttgggaagtgcctagcccaatacctgatatttgttgggatcctttcctttaaaagaataaagcaagttctttgctggctggcaataatgatgtgaaatggtttaaacttttgcagtttttttttttttttggtaccctagaagaatctaatataaagtgagaccatattctg

SEQ ID NO: 52997 - DNA, 1008 bp, Homo sapiens
agggggacggtcctgactctgctccaggtgagctgtgtgtccttggaccacttcttctctgggcctcatttttctgcgtttgtaaatgacgggtttcgataagatagtctacagggttccttttttaatttttaattttttttttttgagacagagtctcattatgttgcctacgttggtctggaactcctgggctcaagtgaccctccctcctcagcctcccaaagtgctgggattactggcgtgagccactgcgtctggcccagggttcctttcagctccagaatgtgatgttcctaaaatgggcaacgttattgttaccacgttatgttgattctggtgaaagaagggagttgatgaaactatgcagttggcttaaatggattaagaaacagtttcttactcatttttgtcctgttcattgttcactgagaatgtgtgtgtttcttctccagcgaatagctaaagaaaggcaaaagcagtataactgcctgacacagcggattgaacgagagaagaaattgttcgttattgctcagaaaattcaaacacgcaaagatcttatggtgaggagagagagccttaggcctctttttttttttttcccccttttctttcttgtaaaggtcttaactcagactagatttcagctgtgtgtaaatcaaccccagtgaaaatgtctgctcctcaggggcagtggtttgagccagtgtctgttactctgacagtgttgaaatgcgccttgattaaggaggtaataagggggttattagtcagtgctttggaacagcaaagggtaggatcgggtagcatatgaactttatagcttatgagcagctcccgtaacatttaaacaggttaacaaaacagtgcatgtcactcattggtgtttaaaaatagacaacattgtgtagttaaatagcagagctgaggaatataagatgcctctttcatattcttatcattcctctaaatgtcaaattctttagctttgtagatcatttaggt

SEQ ID NO: 52998 - DNA, 1315 bp, Homo sapiens
ggacgatgtatacgcgcctggggagctagggcctggcgggggcggcgcatcgccaccctccgcgcccccaccgcccccgccggcggcgctgcaccaccaccaccaccacacactgcccggctcagtgcagtgaccccgcgggccgggcccccgccggcgcgctgcagggcgcgggcgcgcagcccgcccgcgcggcctggactctttttgttcggttgctttggattttacaaaaaaaaaaaaaagcccagaaactttcgaacaaaaccaaacacccggacgaccctctccggtgagcggcgaagacagcccggtaggctgcgtcgcccgagccccgggagagaggagcgaagatccggaactcgccaactcaccccgggcatcctgcccgccgcctgctctctgcccccatcccctcgacgacccccgcccctgcccccccgggctgttcggggccggatcccggcagcggcctccccaaagcgacaggtaacgcagtgcggggttagggattccccgggagagaggacgaagcgaggagagttctccatcccctctccccgcgtggactcctgagcctgcgggtccagggtggggggctgtcactttattcgctacacgcctcttctctcctataaggatgcgccccaccccgctttcccctttctccgggcttggttttttacggtttttatttattcgtggagcctctcggctcctggggtccttctaactccgcccgcgcccttaatttaaatcgcagtatactgtatttatcggggccccggaggggaggtcgcgagagccgcgtctgtgtataaaagcaggaaatagccaaagctttaatctagcctaatttatttttccccttatatttccctaccctaccctccccccaaaaaaaagcaaaaaaaaaaaaaaaaaactaacaaaaaaaattcgagtgttcatttttcgtttcgtttcatccgagccccggcttggttcccggccacgccggaggggtctgcgctcccacacacccagacgggaaggggcttctgccctgctgcagaccgaccgccgcatagcgcggcccctgctccccgcggggccctgccctcctggccacaccaaacgaaacttggaaaagttagagagattgttttttaaccagctgtagaaataagccgttccctgagaaccctccgcctgattccctgcagcttccctctgctccctttccagcccgccgggatgcgggatgccaggggaggccgggagagaaattccccaagtttggggtgaggtgggaaccatgtaaatatgtgagata

SEQ ID NO: 52999 - DNA, 1036 bp, Homo sapiens
ggagggtgccagggtcatcttattgatccactgccttggcgagggtgggtgccatctagacagatttgtagtgcttgccaccatcctaaagctctccccgcataggatgagctcacccttctgagccctcaaagcccctacgtctctccctctaagctcagccccttcaggtgtccagttcttctgtccttcctgtaatctttagagcccaaggcagaagagaggagtagtagtagggccgtcgctgcctttggcagaagagaaaggagcgatctaacttatttaatctcaggtcttggtgaagggaaggagggacagaaggtgaaatatctctttgggaagaatctttccttgtatttttgttttcctgcctcagcccctaggctgtgggtgtgggtaggggtcctcccagagtgtcagtagaatattcaaattaggggtggtcaattgctcttgaaatttactttcatttttagcagaatgtcagcctttgagctggtgttaatgcccacaatccggttatgcagaacacgctctctgcaaatcggtaaatcattagtggggattaatcaactctgaaaggctggggctaggctttagtttctttctttctttctttcttttttttaaaacatactttttatccggatggctgcaaaattcaccatcacaggatagggtgggagcaggggatgataatttaagtccttgtcaccatcattagaaaagtgagatacctttctgggccttgggttgactttgtagtccaattgaagggtgggagtaggcagtttgggtggggtgggaggaagggagggcagttcccttgtgattatatgtgttatgatgtttataatagtgtgtaggtggcttggtgtgcttgtatatatggtgactttatgttagcatgcttgcatgaattcatacgtttctactttagagatgcccatttatgtgcttgtgttagggtgcttttgcttggtttgtattagtgtcagacacttggtttgtaattgtgtcagacagtacttccgtt

SEQ ID NO: 53000 - DNA, 1029 bp, Homo sapiens
ggagtctgatatcctgctaagggtgaatttctacctcttagggttctcatgagggttcaatgagatatgcatgtttgggtttccccagaagcagatcccaagataaggatttgaacacatgcaggaaagtgattccaggaaatgctggtagggagtgggcctgtgagactgggaggggaggaagcccacagagagagcctcttggagcaagttgcaagttacactatgggtaactggaccactgaggatcactgggcgcctgtgttgaacacacttctgagagttaccccacttgctagatgaggaagccaggtcatttatctactgtcatgtcagtcattctgggggttggggtgaaggttaattctctagcactctgagcctgccttgggagggcagagcaggctcctggagaccagaagaagccctcaggcaaggatgcagctgcaggcaatttgaagtcaggctagagtacactgaaatggtagggcctggaggaatgggggtggagcgccagcactgtctgctactcatggagagcttgtggcataggaagcaccctatcgatgatagtaattattgctgataatattaatggtagttttactaatgattattgtcattgtgagggttaaattggaggatattaatcatagctcacatatattgggttcttataggtgccagcagtaagcacttctaagcactttacatgctatctcatttcatacctgtagtagctagtatgtaggagaatgcatgatgtgtggcaggcagtcagtaaatcgctgtttcttcaaacttggaagttctagaacttcaggtgatgaatttgggactgttcaatggacccctagatgctgagggttcttgtcccaaacctcctgagctacaggcagcctccctggtgccttgagatgctgactcagcagagaaagatgtaaattcctaccttggtttgcatacaatttacacatatttatttatgagtgtctttgattaatgtcaaagtgcctgtgtgatttttct

SEQ ID NO: 53001 - DNA, 1051 bp, Homo sapiens
ataaacatgagttactttccaatcagaaaaaaggttgtgttagaaaaataaatttgtcattacattgatgaataacaatcatcatgacagtccgaatagaccaatcttttaataccagtcatgaaaatcagctgagcatataccaagtgatgtgtaacacagatcctgaacaaaaccaagaatgtggctgagaagtgggttgaaagacatttacattgtccccaaattgcctttccctctccccaccctacgagggacagccatctttctgcttgacacctcctctgggggatgggaagcagggtcactgctccatccatccaaggcctgtggcttagtgattttgcccatgagatttaggacactttcaccataatatttattcagttttatggctttaaatataaccctaactcctaataatcaatattgatttagctataatatcttatttatagacatagtcttctggtttgcatatgggctcaaactgtaatgcagtagaaataagccactcactgccctggccctgggccaccaatgaagagactatcagcccctgatggatggctcggaggcccagacagagtttgggtttctgatgcccacttctccccaccccctccaaaatggctgctttgggcaaggcagaaaaccacagagccatcctgggactgagaatgccttttcacctcatgcaacataattgtcattcttaaggagacaagccttccacctggccttattggagggcagttataaccagtagaaatgctaatagaaataggaccccgagggaaagagaaatagctagaagtacaaaagtttaagggtatggcttaagaaaatagagacttgcctccaacttaccccaagtgggcctgactgtgatggtatggatttctagagatattattttgctataattagtgttgaagaggtgtccaggcagcacggcccctcataggggtggccactggcctggccaccatgatcctgtgtgattaagatctacgaggaagggtagaagaagccagaactgtctatccta

SEQ ID NO: 53002 - DNA, 1050 bp, Homo sapiens
cttttagcatttggaacatagacacagggactaaatcagtaagatggtattgggcactagaatggaatagtcatgtagagttggggccaaagtagatgctccaacttatccacctgctcctgggacacactccccttcacatgcaagtcagagttatgggggaatgcagagaaacagacataataaatatatgaataatgttttggttgtctcttgctgtataacagaccagcccaaaacttagtggcttataacaacaatttattattatctctcatgttctgtgggttgactagaattggctaggtccttctcatttgtggtcactcatactgttacaatcagactatggctggggctggtgtcatctgcaagcccagctgggatggatgccaatcatagcaattgacactgtctatagtcagggaactctgctagggctgtttccagagtagctacaaatggcctctccacgtggcttgggcttcttaccgcatggtagttgggttctaagtagaagtgtcctaacagcaagtgtctgaagagaaggggagcaaaaatggccagtcttcttaagggctaggcctggaactggcataatatcaattctaccctgttctgtttgtccaagcagtcatagactaccctagacttaaggggtgggaaacatagactccacctctcggtggggaaaatggcagtgttacaggcagggaaggaattgatggtggccatcttggacctcagctagcacaaataataatgatttctaagggtaactggtgaagcttgttaacaattgtgcaaggcactttatatacaccatttcctttaaggtgctttatatacaccatttcctttaatccttagaacaattttattattacacattttacagttgaggactttaaagcatggagaggatgaaataaaatatggaggatattgtagtgtcaaggagcagaattaggctgggcgcggtggctcacgcctgtgatcccagcactctgggaggccgaggcaggcgatcacttgaggtcaggagttcga

SEQ ID NO: 53003 - DNA, 1040 bp, Homo sapiens
cacacaccgtgccaccatacatccctatacatacatctgtgcaaatgtttctgtagaattgattcccagaagtgagagtgcagatctgagcatgtgacctacaagtgttttccacgttgtttcaggcatcccaattatcacttttagtatctgcagaaccaccttttgaatccaacttagctgactcgcatagcggaagggaaaacaaatctgtttaaagctctcctatctgcaacttccttcctatagaaaaaaaaataacttggcgagcccctgagggtgtaaatataaagtgtccactctaggaagtggtctggaaagagacggcaaaactaagagagggttgaattgtgtgtagaatgtggagtttcctgaaagatctgggagaaatggatgtgtggggagtttatggaaagagaataccagcaatatggcagaaaacttagggtcctatgaaagaattccaacagcaggaacttccccagcatgggttttggctgaggggtttttatatagggcccggatataggatcttcacttaagaaatgtgatttgaactgcgcataatcaatggtgttctggtgggggttgaagaaccaactctagggaaggggctgaaagaccttgatgtgcagcatttgctgatttccgtgatataaatactcatcccatggcacgagtctgctggagggtactgaatgccccaccactgtcctataaaccattgataaaagtctactcaacccaacatccctggaccagtggactccccgagcagaggaaatcaggtagggtccagcttggagtgaagagatcagcaagtgaggacaggtgctacaggatccagaagggagctgggcagccagctgcagtgaagactgagaaaaggatgggaagcctcccttgagaatacttaggggcttccactgtgtggaaagggcttgagttacctctttcaaatgtgaaggaattaccccaaaggcctggaagatgtggggacccctggtgtcccatttggggcgactctagtgttgcacact

SEQ ID NO: 53004 - DNA, 1080 bp, Homo sapiens
ttaattgctcatttatgtgtctctttccctgctctccactgagagctccttgaggtcagggcagcatccccagcccccagcccagggcctggcttggagtgggacccgtaagggtgagctgatgtcctgattactattcctgtgtgtatctgtctgctcaggctgcagtaacacagtacaacatactggtggcttaaacaacatcaatctatttctcacagttctggaggctggaagtcggagatggaggtgttggcagggttggttccttctcaggcctctgtccttggcttgtagatggccaccttctccctgtgtctcacagggtcttccctctggatgtgtctgtatccaaatttcctcttcttttggggataccagtcatgttagattaggtcccactcatacgacctcattttactttaagcacctctttaaaggctctatctccaaacacagtcaccttctgaggtatcgggggtcaggacttcaacatataaatttgaggagggggcataactcagtgtcacacataacactgggtaacgagattacccctctcccccaatttagcaggttttatcatgcaggaggttttataattcacatgaattctgtgggtcgggacattgcagggatgtcttggctctgccccacgatgtctggagcatcagctgggaacattcaaaggctggggctggagtcctctgaaggctcatttgctcacaagtctcacatgtgggctgggatgacacagagactagattgcagttgaaatgcttttccacgtggcttcacttcctcacagcatggtggcctcagggtagctgggcttcttactcagtggctcagggctccacgagcaaatgttctagtgaacaaagcagggctgcatgaacttagtgacagcatctctgtcattctctgttgggtgaagccttccagctgtctttgtgctgctataacaaaatgccatagactgggtcatttagaaagagcagaaatttatttctcacagttctggaggctgggaagtccaaaatcaaggtgccagtagattccttgtctggtgaggatcct

SEQ ID NO: 53005 - DNA, 1033 bp, Homo sapiens
cacattaattcactaattctaataaacagctggataacagtagtgcagagcagcacaggagtaaataatcttgaaggagagctacaggttggggagaccgtggagagagggatgcctgtgaaatggactttgagaagaggagaattccagtaggaaatagaatggaagaaaaatttactgaattttttagaatgggaaaaagaacaattacacattattctcatcagcaaaggatggtgtttgacactgtgatggagtgagaaaatgaaggcatgacccctacctttgaggacaggagaagggagaaagggacaatggcatagtatctggccagccatgctggttctataatcatggcacaaaggaaatattttgggactatggagaagagagatgatcacctgtcaaaaaatagttggcacttggttgtatttttcttttgagtttctgcttagtttgtgatttcctggaaaatgccatctccttccctttcccagcctccatgccaccatctttctacaaatgaattggaaggcagttagtccatctcctgctaatgataacagctaccatgcatgtatggactagctatggcacatggtaccttattaaattctcaacgttaccgtattagttatctattgctgcataacaaattatccccaaacttagtggtttcaaacaatagccacttattatctcaaagtttctgtgactcaggaatttgcatgtagcatagctggatcctctgtctcagggtctctcgtaagctgcaatcaaagggttgcttgtgctatatcgtcttaagcctcgacttgggggaggatctgtttctgagctccttcatggggttgttgggaggattcagctccttgtgggctgttggctggaggcggtgcttagttctttgccacatggtcctctccattggacagctcacagcaaggtagcctgttcatcagagcagcagggggaaagggccaagagggaatgcaagcaagatataagtcatagtcttatgtctgagtcttag

SEQ ID NO: 53006 - DNA, 1801 bp, Homo sapiens
ggtcttgatctcctgaccttgtgatctgcccgcctcggcctcccaaagtgctggggttacaggcgtgagccactgcacctgaccgatgaccagctgttcttacgattgaagaagttgctatctagtttggaggcttaagaatttccaaccagtgtttatccgagttatttttggctgcaaacccaaatataaaatttcacaattgacaattcaggaggcattcttttctttttccttcctgcaggtttaatagactacaacttccactgtttccgaaaagctattcatgaggtttttgaggtgggtgtgacttctcacaggagctgtggtcaccagactagtgcctccagtctgaaagcgctgacacacaatggcacgccacgaaacgccatctagtctgaatcccagcgtcggggctctgtgccagcttactcttcactccagggtcggatgccacgtgctacaggacatgggagctgctgcttgtgggaatctggtgcctgttccactagagacaaggggtagagtttctcatttggatgaaaaccccttcaactggtggtgtacaactgaagctactatatcttttttgaaaatggcaaaaaaaaaaaaaaaaaattctggagaccacagaactcaagtgtgtgtttctcctcttttgggtcccctttaagtagttgggatattttggacctggagataacaccagttacccatccttaccagggaatgttgccatcaattccagttgaaaataatagaaaagactgaatttttatatgcttcacttaggctttcatttgagtagactctaaaaattctgccttgcttaagttctaacactgcctctcagatttcagttttggacattgcacaactaagaccttttaaatgcatttgcttgctaactcggaagacacatagtctgcagcaagacattcctatattgaagaaatgagagaaaattttatgctgcatcaggtggagagcaaggctcaacggtggttgcattagttccctcggaagtattgaaaaaactttgaaatggaagaaaatttttgcacctatgttctgagtaccagatgtctgggttctttcttctgcattagataaatgatcatgctcagtgtaacaaagggaattaaaagttttcccacagtccccttctaggggagaaactcattgtgtcactgaaatgtttagcttactttaatcttgatatcagcctctacagaccttttattctaagctatcgagcttcttgattgcatttggttgaccacgagtgaccctaaggcattgggggactgtccactgggagttggagtgagcacgtggtgctgcaacaggcattgttttacatactttgtctctagtattctgacaccaagtgtcaactgtggtactttctttgcctaggatatgaattcataattgttgcttttgttgatggttgataccctttccattgatttaaacctaacacattatttctattccacatgcccagtagacatatattccaaagccactggaccacttgagtacataagtgccactgtttaatgcaatatgtatattcaggtctgtaaagctaacagtgtgacttggagtgcttcctgcaggtgattctgacttgagtatttacatggaccatggtgatatccaaaagaaaaatgctttttatatttatagattatttcattgaactatatatgaaatgggtatcaataaatgtatttactccaaaatcagcgtttctccttgcctgaggtatggagggtggtggcggaacgttggg

SEQ ID NO: 53007 - DNA, 1104 bp, Homo sapiens
ttgttttcccgaccacctctcctgtttcttctgttttttttttttttttcctcagtcctgtttgtcagagccaagtctttctgcttgcgtattttctaggtcagctcatcaaatacatggcttcagttaatcttctctatgtgattgaaaaattcacatctccagctatgacttgggatcatgctctcgtcccatgtttggagctattagtaagacgttctctcttaaatattgtgaatgttaccttcaacgtcatgtcaatcattggttgatgagtatttcccctgttttgtgactctcgtggctgtcatacttctgtcactagttacgcgagtttctcctgtccaagtgtagataccttgtagttaggtaattgtgtggtgtgattgctgaaggggcccttgcagattggttcacagaggagatttcgtgatctcctttttctattcttctatgttgtttatattgaattttcaccaaatctgatcatttgtttcttgtaactgttacttgggtttcctttccattttcactgtcagtgattccactccaggttctcattgcttcaggccagtggtgctgcagtagtctcttacttgataatattcatgtagttgacatatatgtggagggtgtagtatgtgtcatcttttatcccaaaggcagattagttttcagaaaatttattttatattatttaactactcaaggatctacagtagctctgttatttactgcaacaagtccttcctcttctacctgagttttttttttttttttgagacagtctcgctctgttgcctaggctggagtgcagtggcgcaatctcggctcactgcaagctccgcctcccgggttcacatcattctcctgcctcaccctcccgagtagctgggactacacatgcctgccaccacgcccggctacttttttgtatttttagtagaggcggggtttcactgcgttagccaggatggtctcaatctcctgacctcgtgatctgcctgcctcggcctcccaaagtgctgggattgcaggagtgagccactgcgcccggcctgaatttttaatggaatagttcagatatacacaaatttttgggta

SEQ ID NO: 53008 - DNA, 1158 bp, Homo sapiens
ctaagtattttcttgcttttgtgaggaagcaaaaaatatgttttctgtgaaaatgtgattgacctggcaaatagaatatgcctcgaaggagctcatctaagtgaggcggcaggtcccagaggtccctgttaccttagggcagtaaagagaggagacacctcagctgggtttacagaacacagtctagggggtgagtagccccacctggtgagatgttggtaacgttgtcatttccctggttaagatatacatatgtttgcacctttttctccaaatgtctgattatctatattaaaggatgtgtatggagttgttgtttttaataggtatccctgaaattctgtgtttaggaacactataccttaacaacactctctcccaatatgtttaagccagtattctttcccagagacatttgggaaactgggtggatgtcattgtgcagattaaatgtggcagatgcctagatgggaaacctgtaatgaatagtactttcttttaaaataggttaaaggaagatggaagtggaagtgcttatgacaaagaatctatggcaattatcaagctgaataatacaactgtcctttatttaaaggaggtgactaaatttttggcactggtctgcattctaagggaagaaagctttgaaagaaaaggtaatagcattttaaaaagctgtttttatgttaatttctttgccataacttctcaggttcttgaaaacaagtgaaaataataattgcagtgttagacaaatagctatcagaaaaaaaaagctcaaactgcttttgtccctttccttccatgtatagtccagactttctcttttctttttttgatctttcattttaaatcaagattttaattctagcttttctgcgttcaaatgctttcattacctgtttaactgaatgcagtttggcttccatctgaacaagtctactgaaactagacttttatttatttattgtttatactttaagttctgggatacatgtgcacaacgcacgggtttgctacataggtatatatgtgccatggtggtttgctgcactcatcaacccgtcatctacattaggtatttctcctaatgttatccctcccccagccacccacccctgacaggccctggtgtgtgatgtcccccttcctgtgtcc

SEQ ID NO: 53009 - DNA, 4081 bp, Homo sapiens
cgactatataatgaagattgtactccctgagttataaagcagatagaattgttgacagtgtttaaattgttaaaggcttccctctcaaatacgtgttttattgaatctacatgtgttacttctccaccgtaagtccttttaggcctccagactcctgtagattcctccattctctgtagagtcccgactcccatcctgtttaatatgctctttacataaattgtaaacaccaattgtattcatttgtttattcagcagatacttatgagcactgttcagggaagtgggcttgctgctaggagcgagactgacaaagtctctttcccctggaacttaacattttcagtgacacagctcagaagcacctaaatgaatgtatagtatcgttttaagtacttaccagtggtgtgaagaaaaacaaattaggggaaaggggttgaaagccttgggtacacgagtgctattttaggtaggctggtctggaaagaactttttgaggtgacattttagtagaaacctgaattatgttcttatttaataaatgtcacataactcttctagttttctcggttttagtcttatttttggtctcagttatgtgcttaaaaaaagctttttggatcagattgcaaagacttcggtgaatattggagtttatgtacctgaaaatccttttctcagtactacttcagttgccccctgtgtaaatgcagtaaagagatgaagccaggtgggaaagtgtatttgtcatcttgagtgatgggtatggtagacaagataaagaggctttattgaactcactgaaatcaaatgttaagaaacttaaaattttatgtattataatagttgtcatagaacataaggtatttttcaaattaatcaagctatgttgtgtttttcagcttttatctgactagtatctatgaccattcaatatttgaagcctttagtaaggtggtgcagaaactcattccacaactgccgaccttggaaaacctattaaatatctttatatcagtaagtgagcaatttatatttaattcactgcagcttctgattccatttttgggaatatatttgtgttttcaaattttccaaaaaagtcttgaattaatctgtatcaagtacaaagactagtgacccacttaacatgtaaaataaatgataacatattattcaagttattttctgaattcttaaatagatgttgatgtcaacgtgtaattcttttatggtttgtaaattgccacataacgcctttcttgatagcaaagtaattcaaatcagagatggtttatattaataagaggattattgaaaatgtagcattgcttgatttttagagatttttgttaaattttttgtgatgtcttagaaaacaattcatttgagtaaagaggaagaagaagatttgacttaggaaattgtgtcagtaaatcagagtagagaaataattcctctttcattctttggataatagaagagtctctcaagcaagtgctatttgttttttggtattgggttatataattaaaaatgaccttggatgttattcagtaattctagatcttcgataagttgtaaattgtgattcttaaaaaatactgaacagtttcccatttgtttttccaagaattcaggtattgaaaaagcttttctctttgatgttgtcagcaaaatctacattgcaacagacagttcccctgtggatatgcaatcttatgaactttgctgtgacatgatcgatgttgtaattgatgtgtcttgtatatatgggtaagttatgtatatattcctgcaatatctcagacaggcggaaaactattaacttgatttgttcagaagactaatttctgaggcccctggcaagtggtactacatgaactgggattgttctgaccatagtgctttaacttggagcatgatttctctggaagttggctgctgggtcttactccttcggagaatggctaagaaaagttggaaagcatgactagaactggacttgtttatcactgcaagtttctcccactgttgtggggatgggggagggttgcactgtgtcttctcactactggaacttagttagattgaaaaactagattaatttaaaatggtctgaataacaaagtaagttctggttcctgatttaacctcaggctttgtggaattagggattcttaatctttcagagagcaaagaaagtaattagaattttggatgttggaagaacttataaaaatctgacccatatatacaagtttccaaaataaatctctaaaatttgagctcctcctttatgtaaatttgccaaactcgctatagaaatttatgaaagccagccagcaagtgattttgtagaataggccagaggactggtgaaaactttggagaattactggcttttcaaaagctgataatggccaggtgtggtggcttgtgcccataatcccagatgtttggaagcctggggtgagaggatcgcttggggccaggagttggagaccagtctgggcaacatagacctcagctttaccaaaaaaaaacaacaaaaaaagagttaataacattctctgtaccctctgacttcctagattcccctggtatattaacatcagcactctcaagttgcttttcagatgttttagcattatctttgctttctactacctgtgtcttctctctgctccatctagtctaaatatctctttcacctctgactctgcccttcattttggtcttttgcttaatttctccagctgcctctgagtaggagagtacatttgtcttacctattctatatctgtctattcctttaacttttatgattatatgctctcttttgttatttatttatttatttatttatttatttattaaacggagtcttgctccgtcgcccaggctggagtgtggtggcgcgatcttggctcactgcaagctccacctcccaggttcacgccactttcctgcctcagcctcctgagtagctgggactacaggtgcccgccacaacgcctggctaattttttgtatttttagtagagacgggattccaccatgttaaccaggatggtctcgatcgatttcctgaccttgtgatccacccgcctcggcctcccaaagtgctgggattacaggtgtgagccaccgcacctggccttttttgttttgttttgttttttgaaaaagagtctcgctctgttgcccagactggagtgcagtggtgagatctcagctcactgcaatctccgcctcctgggttcaaacgattctcctgcgtcagcctcccgagtagctgggattataggtgcctgccaccatacccggctaattttttatatttttggtagagattgggtttcaccatgttggccaggctggtctcgaactcctgacctcgtgatccacccgccgtggcctcccaaagcgctgggattacaggcatgagccaccatgcctggcttgttttaattctttacataatcaaaatgagacattgtcagtttattatatattttaggatagtttcatatttcccacttctaatttaaacaatggatgagtagaacgtttgctttttctttaaaacaaatcaaaatttcataaaccaactttttcataatacaaaaatcaaatttaactgtaaaatttattttcaatgttagatacatgttatttattttatttatttatttttttgagacagagtctcactcttgtcgcccaggctggagtgcagtggtgtgatctgggctcactgcaacctctgcctcccggattcaagcagttctcctgcctcagcctcccgagtagctgggattacaggggtgcaccaccacgcctggctgattttgtatttttagtagagacagggttttaccatgttggccaggctggtctcgaactcctggcctcaggtaatccacctgccttggcctctcaaagtgctgggattacaggcgtgagctaccactcccagccaatacattttaaaataccttatacataataaagtacattatattagctggatgtggtagtgtccacctgtagtcctagctaaatttgggggattaag

SEQ ID NO: 53010 - DNA, 1585 bp, Homo sapiens
tagaaacacagagggacattcatcaaagggccaatgatgaccttgcagatgctgggctagaaaaactccatcttaggtaacaacatgtgtgtttgatatgaaagccctgaacaaggtgtaaatgtattcccatctctgtcattacaaacaccatagctttctgctacctgtgtgccctttgccacatcttttatgtttttgatcttgttgttgaattccaggctgtctggggagcctgatattgagaaattacccactttttgcgttttcctggagattgaagtcatgtgaagtgtttccactggtgcttttccaaattcatctcaagagactggagtcaggctgtttcttcatggcataaatctgctttgggactccttcctcttggtttcattacttttccccgccttgcatcagtgaagtgaatctgtcacatttgttgtggaagtctttagcttgagtcttagacagtatctttctcagtaggaacagccttatacagagagtgcactttcaaatctggactgactctttttatttttcatttttatttttcctgctggctcccttccacctcccccctggactgactgtaatatatcttagcttttaaaacactttatacttttatgaaactctataaagtttggcttaggtgggtttatcttataaatgtgcataaggctgctattaaatttagaggactattggtttgtaactactgttaagaaattattattaaataatacctacttgataggattgatttgtgtatttgcattctaaaagtgtatgaggaatatttttgtacatcttattttatttggtgatataggtagaaatgagtattaaaaagtacccaagaaaatattctcttgacgatagaagtagcttaaagagggagaaggggagagagacagcaagttatttctctgtccccgttctattgttgtgacttctttatgggctcaagctaactgctatccctccccctaaaattctctgggtctcaggctccaagatctttcagttattcttctaggaaaccatgtcgaaaagtctcattgacctctagtttgcctggattaaatttctaaataatttgaaaataattcatgttaaaaaaataaaaattcagcaatgtttgtaggagaaaatgtaagtggctctccacaaaaattcagtcttatttttttgggaatccactgctaatagttttttacctggattttgagccgttcttgtcctgtgttccccagtgctccatggggatccttctgattctctttactccgtgtctgtgttcctttccagggcatcccaccctagtggtacatgccatccctttcctcagtaccatgtagggtcctagaccttgttaacttcagtagaatgttgcatcaagcttttatttaggccaggcatagtggcttatgcctataatcccagcactttgggaggccgaggcaggcagatcacttgaggccaggagtttgagaccagcctggccaacatggcgaaactccgtctctactaaaaatacaaaaaattagccgggcattgtggtgtgtgcctgtagtcccag

SEQ ID NO: 53011 - DNA, 1802 bp, Homo sapiens
gggtttcaccatattggtcaggctggtctcgaactcctgacctcaagtgatccgcccgcctcggccgcctaaagtgctgggattgaaggcgtgagccaccgcacccgggccgattattgtgactcttaacaattgcctttacgtttcttttctcatgagagctatcttttccctgtcagtccccgtggcctccccctggacgttttcactttctacttggtatagttactgcccttcttagactgcaaagtcagtgagggcagagtccagtctgtttcactttttaaattactcctcagagcctgaggtaggcattcaagtaatttttgaataaaccagacttcttaagctttagctgtaagacttttataatcttaaagcagattttggtagaattaatgttagctttcccccagaaaaactaatggaggtgatagagattgctactattagtactgagtatggtgcatagaacataggagaaaagatttagctccaaaatagatttaatggaaattaatttggtgtcttcttttgtcaaaaataaagggatagtgaataccaatggattcaccattcagtttctacttttcaaaaaaaatttttttttgtgggatcaaatgtttaaatgttaaaccagggtggaattttaaatttaaattctgaagtttaatagtcataaaattgcctgttttcttttaacaggtggtgtttcataagatgtcacccaacgagaccctctttttggaaagtaccaacaagatttataaggatgacatttccaatagctcctttgtgaatttccagatatgggattttcctgggcaaatggacttttttgacccaacctttgactatgagatgatcttcaggggaacaggagcattgatatacgtcattgacgcacaggtagtcagtaatgtgtttactcctctttcctggtgggaaaaagatgtagaaacaaaggaaagttgtttatcttctttgtcatgtggttgcagcttatctctttggcagtagattccctaacagtgtaagagatgcagttgcagagtgctttgggagcagacatgcattgtgcaggtacagaatatcagatgattaggagatatggtttacatccttgagtcctagttgatgagcagctaacattggctttccacttttattggttgccatattttataataattttataataatagtgatgttattccctgaaaatatcccatcccataacataaagaggaatatgagaactgagtcagtagatattagagtgaatagtttacttaattgtcaaaattgagtttagctcaacaaacatttatggagggcctagcatgtggcagtcagtgagatgaatggggcaagtccctatcctttaagaagcttactttttataagcttaagcattagttaagaatgctttctgagtgataggctctacagagggtgccttcacgtacaggacctaattaatttaagcttcacaatattgttaggtaggtattgtaattctgatcttacagatgagaaaactgagatcagagtttaagcagcttgcttaaagtgacacactgaataaatggcagagctgggattacttaaaaaaattatgttgggaaaaaatgttcatatcatttttttctttcttaaattaatattaaaaattacaagcattaacttggtaattgaatttttttatcttgagacaattgaagagttatttagtagtatagtatatttgaatgtttgaatattgatgataattaggatagtatttttctgtggttggggaa

SEQ ID NO: 53012 - DNA, 1215 bp, Homo sapiens
tcatgggactccggcgcagcggcaagtcctccatccagaaggtgagcagggctgcgcccagtcccccgccccctccccggttctcaggtggccggtagcggggacgcccgggagggcggcggccggggcccgcctgcgctccgtccctccgcactttctcttccactcttgcgagcgcacaggcgcggcccgcgcggggaccccgacctctgtgtccacgcccaagtcagctgaagccaagtggagcgctgaaggcgaaactggttgccgggaggcaggtgcccggtggcaccgcccaagacctccgccccctgggacccagctcctgtgtcatttacgaaactgagacgtactctccagttctcacttggagaacttcgtggactccctcccctggcccgttttgatttgttctcacttcaggtgacctgagtgtttcgggattcccagcagagccccagggagcagcgtcaggaagagttgtgactaagacactgggcgttgtaattctcgctactgatgtgaaggagacttcgctgtagcattactgggaattgggtagtgagattgcacccatttcagtagttgtggcctggtgaatgtaattactggtgctgttccccctgtaggggtgtgtttttaaaaatctgagactttgagaatattttgcagacctagtctgtttgttttcacttttgggccttcatgaacaaatggagggctgtacacgtttgtttgtttatgtttttgagacggagtctctcgctctgtcgcccaggctggagaatgcagtggtgcaatctcggctcactgcaacctccacctccctggttcaagtaattctcccgcctcagcctcccgaatagctgggattacaggcgcgcgccaccacgcccggctaattattgtatttttagtagagacggggtttcaccatgttggccagggtcatctcgaactgctgacctcaagtgatcatccgccttggcctcccaaagtgctgggattacaggtgtgagtcaccacgctggcctacactgtttagtgagggttaaatagaggcaaggttgacttcctccatcagccaaacccattatacgcggagtgagctggtaataaaactagtatcagcaggcacctggtcttttcacctctccactctgttgcaaaggcctatccaaaataaatctgtgatttttttttctttctgaatct

SEQ ID NO: 53013 - DNA, 1003 bp, Homo sapiens
attaatacaaatcactcactaactgtagagccttgggcattatcagtgaactactctgagatttactgtcttcatctgtttaatgagtagaatgtccgtgatgcctacctcacagggttgttgtgagggtcaaatgagaatgtatgtgaaagatttgtaaatggtaaagcactatattcttgtttgttagtcctttttcctttctttgggtagacctacagtcagatgttttgttttatggatcacttattttccttactggtagactgtcgttttatagacatattcctatttcatatattctctccctgttgttagagaacctatctttgtttttggtcaaaacacacatagaaaacaaaatgatccaatgaaaactggtttaactagcaaaagccttggcacctgttggagactatgaccaagccaataaaaagggcatttaaatcagccctgttagtaggaatgtggctatggctggtgcctcttctagtcacaagtttgtttttggagggggtccagaagatcattcccttgcatagatttctcttttaccaatttgagtgcctcctacatgggcagcagtggactaagtgctgggtgtgataaagaggaatgacttaattatgagactgtatataatcaaatacagtgtgggttaggacctgtggcagaccattataataaagcatggccccgtgagggttttgaaagagagagagacttggcttccttagttggtatgatagtttcttggtagatacaggttgaaaattttttgtggcagccaatcctcatgggctttttactcatttgattagtattaatatttatgtcagtaagccaggtgactgtgactgtctttggtaccatcctttttgaacagaaaggcaacatgtgggttggataatcacacttttaggtgaaactgacttgcttaaactgtaacagtcagtgctatttaagaattcaggataagcttagcctctagaggtcctcttca

SEQ ID NO: 53014 - DNA, 1044 bp, Homo sapiens
aggtaatgagttagatggctgtgtttaggttttgttcaggatttactttggattctcctgctttaagacccaaagaaagttatattgagtttttattgatgattctatgtgtttttaacagagtgtgataggtgaattaaacatattaaaagagttctatagcatctgttcagaaaagattatatactatacaaactattcaagtcatacaaaaccatttttcattgtctttcaaactgagaagaatcctattcagcacgcttctcctcctgaggtggttcatactgagcaagctatggggcaaagacagaggaatttaggtgaattttattctaaattgagtaaaaaatagtaaaacaaggtaactgttatattcaacttagttactgtcagtaaattgtattaatatcagtttctataactatccattttaaatcattcagtgatttaagatttaatacaatcaaatctaatgaaagccctttttatataaacctttaaaattgctttgaaactaaaatttcattccagttcatgactgcactgttcaaatacttgatatgcaataaactatatcttcccaaagattcatttgcttataaggaactttcttcctctccagcaaaagtttactgaaaatacccactgaaaagtagataaagagttaagtgacatgtcttaacttaaccagccaataaacaactactaatgtctttgagttaaaaggttccaaagagttaactagcactacacattgtggaatcttggataatttaaaataactgcattttcttttatgctaagtgtggttccttgcaagaacactaggctaacattagggttctgccaactacctgttggagttgagaagcttattagacttcactgtgctttcgtttcctcacctataaagtggcttgtgtacttgtttcacttatctcacaaagttgttgagaagataaaatatattatgagaaatacttagagtaatgtaaaatacattatgtgattaagaatgtggtaagacctgaaagacttaagagt

SEQ ID NO: 53015 - DNA, 1022 bp, Homo sapiens
gctacgggggccggaagaggaagaggtgcggctccgacagccagaggggcgggcatacgcagcctccctcggctcagcctgctactggggatgcagagcgtcctggtcgccatgaaaacaggccacacctcggcgatcccggccggtggtttgcaagtgcgcaggcgcgcgcccccttccgcgcatgagcagtgctgctcccaacccgccagtcgcggtctccggcgccagctacgccgctgccgctgtcactatggcccattacaaagtgaggggggcgcggcgtggctgggggcatgcgggcggtagcaagccgctggtcggctctgggtgggagtggggtcgcgcgcgcaggtttgggcgggagggccccgaggtagtgaggcggaggcggggttgccggactcccagcgccttcttcctgctcggctcccgggctctggccactgacccccggtgtctcttcaggccgccgactcgaagcgtgagcagttccggaggtacttggagaagtcgggggtgctggacacgctgaccaagggtgagcctgggctaggagagggtacctcgtgccctcgtcgtgctccccggcgctgccccgttccccagcgggccgtagcgtggggaaggaggggaaacagatggggcccgtccggggtccagcgaggtgggcctcggggttcagcagggacctggctgctggacgccgcccgggtggggtagcctagctccgctacccttctccgcaccgggagtgaaactcttgcagctgttgcaaagtctcttcaacttccgttgctttgcctccagcagccgcagtggacatgtttgccaaggaccttcagatcccaattcctcccaccttacggtttttatggagtcctcagaatcttgttaagaaagtttccctccaacaaagagcaactggaaaaatgaccgaatttccaagtgggctatgaagtagctgagtgagcctaatccccaaagtaggagattcatagcgaatttggctgtggcttttc

SEQ ID NO: 53016 - DNA, 1049 bp, Homo sapiens
atgcccttgatgacctttaacaatcacccttttatcatggggacaagagcggcctagaaggaggtttttggagtcaccagacccccatggcccctcaccaggccccttcaagctctcccctcccccacgcccgcgcagcgcaggtgcgaaaaccttaggggccacccgggcgcgacagccccaaagcgggggggatgggaccctgggaggggcgggggtgggggtgggggccttcccggtgttgcttggtgaccacgctctccgcccagaccgttccatttcttcagcagggggcgccccgggccgggccggcactgaccagcctcgcagagccaccctcttccggcctgcccccctctgccgggcgatggtgtgcgcccgtgacgtcacagaaggcggggccagcgccgctgccgggtgctggaggcgccattggagccggcttggctggcgagcccggctgaggagcctcttgggccgcacttaccgccgcgtccgctcccggtccctggcccctcagcggcatggcgtgcggggcgacgctgaagcggcccatggagttcgaggcggcgctgctgagccccggctccccgaagcggcggcgctgcgcccctctgcccggccccactccgggcctcaggcccccggacgccgagccgccgccgccgtttcagacgcagaccccaccgcagagtctgcagcagcccgccccgcccggcagcgagcggcgccttccaactccgggtaacctgccctgctctgggtttggcaggaagccaggcccaggcattttttggggggggtggtgggggagggttgggaataccaggccagtttacccagggaccccttctttgccttgagaaaagggaactgggatgccgctgggcctggttgcttccggtgatgggaggcatccgggaggggtaatggggccacagggtcggttttaggttttcctgggggaggagagcctggaggggtggacaccaagaggaagatgggaatacctctggccgctccgggccctccctgtcgctgaagcccct

SEQ ID NO: 53017 - DNA, 1022 bp, Homo sapiens
aggttgtgaaattgcgaaatttaaaggagattaaaaaataatccctgttaggtaaacagaggtttcttttactgtaaattgtactagttaaccatccagctaactgcagatcttgtgttctttgccacaggaaaacaagtaaagggaactctgtctggtttatgccaaagtagctattcttttatgcattgttgaaatagtggcaataagaacatactgtctttgaagccactggggagtgcttggtacggtataaacgttttgcttgtttatgtcgggggagggggagattgagacctacatgccaaagggagtatctaaagtctagtcagaagatctttgtctcttcccacttctgaagaaagtttgaagaaatgagacaataaagtgaaagctcaagtttgtttcttttttattagagcaaatttttcagaacataaaacaagaatatagtcgttatcagaggtggagacatttagaagttgttcttaatcagagtgaagcttgtgcttcggaaagtcaacctcactcctcagcactcacagcacctagctctccaggtaagcccactttgatctgcaaaattcgcattaagagtttgtaaatggtacttataatgatgaatctagaattggcctcctctaatgtaatagaattgctaacggggatgtattaatatttacagatatttttaaaactatacagtcatgaaattggaagaaacctcacattgatttgatgtgcttccatccacccaatacaagaatatcttcctgtataactgcaatgtgtaatattgtagccagggtgcaataaatagccacatgtgggctatttaattttaaactaattaaaattagataaaattttggccggctgaggtggctcatgcctgtaatcctagcactttgggaggctgaggcaggcggatctcctgaggtcaagagttcaagaccggcctggccaacatggcaaaacctcatctctactaaaaatacaaaaaaattagccaggcatggtgg

SEQ ID NO: 53018 - DNA, 1220 bp, Homo sapiens
gtgagtcatcgttcatgctatttctcacatttactgttagtgaaaatttttaaagcatgacactacagtttttagtattcttaccctttttgttttttattcttaatttacagatgtgtcatgaagctttgtcacatatctgggtaccaggtttgacctcaagagatggctgctgtacactttttgcaactggtttgatgtcacatttcagctccaactttgcatcctgagaacacttaaacgtttctgcaggtccattttatacaacttgaaagaccgtaaaactttctggttgccacaagcatatctttcttttctgctcatccaataaacagctgtgccctactgtgatagattttccaaacaaaaatacctggagcagcagtttagcaaaatatgccttcagtggcattcaacaaatggagtttccccaagcacagttctgtaagaagtgcgtgtgagagtgtgtgtatatgtgtgtatgtgtattttaagttattatttgtattgtgcaaaaatttttttttgatcttggggattctggctgtgaatttggtgcacgacaattatggtaaaaaaacatttgcttggtctaaagaagatcattaatgttttgtgaccatacaagttgtaacagtggattgtttttatgtgtaggtattgttaaatacagggactgtttccaggcacagaatatgaatcgtaagttaggatggacattagatgtgattatgatgataaagcgaaggtctgcggtcctatatctacagacacgtggtgagaaattagaacaaactggagacgggccattgacacatggactctgcctgggcatgttaggttaattctttgactccaagccttaaaatactcacatggagtcagcgctcacctcattcacacaattatcatagagctccctggacactgaacctctaaagggaaaaggtctaccctggagccaggagcatcagggttggcttgggagcatgagaggtgagcccagggctaggcctgggccaggccccggcagcactgctacttgggaggagccacttcacctttgtattagttattaaaaaatataatttgggctgggcgcagtggctcacgcctgtaatcccagcactttgggagtccgaggcatgcggatcacttgaggtcaggagttcgagaccaccctggccaatatggtgaaaccccatctctactaaaaatac

SEQ ID NO: 53019 - DNA, 1038 bp, Homo sapiens
agacggctgagggaaggtcggcttccggcgtcgcgctgcaaacgtctcgctgaggtcatcctttacggcaggcgtccgcgtcgctagctagtcgttctgaagcggcggccagagaagagtcaagggcacgagcatcgggtaggtaggggctgcttatgtccgcgcggcagcttagcttaaggaccttccttccgaggtctctttaacagatttcctcttggcttgctgtgtgtccccttctcccagacctgaactcagggcgtgttccctgccctcccaggccgcttcacctccacagctaatggcaccgaagcctggagattgccgctctctccactttccacatttgtttaggtttttgccggactaatgttttggctttctgtttcttaacctaaagtctacgatccttatcccagctttccaggctctgcgtgatttcggccccgccggcctcctgagctcatttcattcttttcaccgtcatgcacgctgcgctccattgtcccccaaacatagccagcacttccggctgtaactccgggctgttgcccaactggaacactctgcccactgatcttcacttggcgaactcgcaagccatgttaaaggcattttcaagtctccgggcagagttcgtgcttcctccttcgagctcttacccactcgtgttccttgcagtgtattcgcaattccgagtgtgtgtctctggtgcttacgttggagctgctttcccccgcatctgagtgcctggaacgtaactactcagtaaatgatgactgagggatgggaaggaacttaagaagttaaattcacctttttgttgagatggagtttcgctcttgttgcccaggctggagtgcagagtggcgcgatctcggctcactgcagcctctgcctcccggattcaagcgattctcctccctgagactcccgagtagctgggattacaggcatgcgcccccacgcccggctaattttgtatttttttagtagagagagggtttcgccatgttggtcaggctggtcttgaactcg

SEQ ID NO: 53020 - DNA, 1111 bp, Homo sapiens
agaggaatgggcggttctgggatgaagcaggtggtctgagaggaggggcatttttcctgcccccgagctgagggtagggatggaagcttggcctgagtttcccagaggttgaggctgtcacttcagcacctgccctggcactagaaggtaatgggaggaggggtaagtgctaagataaagggcaaagctgtgccaggacctgggtcctttcctttctgcttcctgtggctagatcccttctagatgttctttgggaagagggctcacacgctgctggcacaaggggtgccctggcagggaggctctgctgcccgaggctgcctacaggcctcctacaccatttttatgtttcttttgttatctctttgaattctgtgcctatggtggggatctgccaatgacccaggaggctgtctctgccccttgctgcctctaggctcagattcgagaatcctggaggagctgtggccacagacccattgtgtccagccatgtaggctacctcgctgtctctacacagccctgtgagccggtattccctataagggaaaatcaacagctcttgccctccctggaccctacagccaaagtcaaagctgggtacccaggttggctttgcggcctgtaggaaggctggtagctgaaggcacataccatttgtgctctgatggagcccttggggtggtgggccatgtgtagcagatggttctgggaagtgagcttgacctggctgagggaaggctgcccagtctggctggtggagcccagctggccttagagcaattgtattttcactcaactctctccactagctaaactgaccagaaaaaatgggctttctgtcccatccccccaccccatcctcatgctgtgccacgtattcccacaacagcccttggaataagcaaatgaacatttaatctaatgcctgctgggtgccatgcatggcatcaaccagtactacatttgcatttgacaatgttcttaaaacatcctctgaggtggaatattacccccattttgcagatgaagaaactgagtctcagagaggtgaagtgacttgcccaagatcacagcaattgtaagtggccaaaccagaatatatacccag

SEQ ID NO: 53021 - DNA, 1103 bp, Homo sapiens
agtaaatggagtagaatttaaacccacagcattctgtcatgggatctgtgagcttaatcctccaaatgtgccaaatagcaataataatagttcctaggaataggagctaacttttacatgatgctttaagatttatagacatcatcacatataatatcccccaaacctcatgaattagttttgggatgtattgtcttcatcccattttccaggtgaagaaactgaggtacagataggcaggactagaacctctgcttcccaagtcccagtgttccttatgggaccccttttgtctgctcacattcacccctttctccttcagatcacttctccctgggctcccaggccctcctgcagcagcccccgcctgggccatgtcttcctcagatgaagagacgctcagtgagcggtcatgtcggagtgagcggtcttgtcggagtgagcgatcttacaggagcgagcggtcggggagcctgtctccctgtcccccaggggacaccttgccctggaacctgccactgcatgagcagaaaaagcggaaaagccaggattcggtgctggaccctgcagagcgtgctgtggtcagagtcgctggtaagagaggtcccccagcaggctggacgctgtgggtgtgagggaggaatgggccagggcacagcagctgtgtggggagccgaggggtcctcaccagggcctctgacaaagcagccatcatctgatttgttattattattcttggaaagacgttgaaataacattaacgaaaaactcaaaagaggaaaatctgccaccccttgctcacgtgagacctgttttcatttctgcaccttcttccctgtctttgtccccattcagttatattttctatgcagttgccttcatggcttaggtaccattctgcatctgactcttttcagttaatcttatattaaaaagattttccatattgcactttagactttatggttaccatttctaaaagctgtctatttcatgactttctaaatcctactcttttttcactttttggctatattagacaatgctgctgagaacatggttaagaatgatttgacttctgttatttccttataatgaaatcc

SEQ ID NO: 53022 - DNA, 1080 bp, Homo sapiens
tggagctctttctagtgggcaacgaggagtccttggaggaagtccttctcaaaacctttgggcctgcagcatcagccagtaacagaattttagagctgtccctagggtgcaggaaggggtttacttgtccccagtcttgaagggccataactcagggccctgatgactcataaacctctttctcctgaagagagagtgggctgtctcattcttccttctttatgccctctgcctccatccttcatcactcatgcatacttagatcgttttgtgatgatttccacttccagtcttctctgaggaggcccacgggatgatttgcttgctgcttcagatttggagtctagaatagaagtggagtggactcaaggaggcttaattttacacaggcaaggctcctaaggaccctgctgggtcaactgagcaaagggatggtgggtgctgcgctgtgctgtgtttctggcatagatgctgatctcctttgcatcctgacactgctgaatgcctcttttgaggagggggctgggccagtgaggctgaaaatggggagactgccatggttaaaaataacttgtgcactgcagttgggcgtgtttctttagcaggagaggagagaggcagcagagacgaggcgggactgcgactttagggtcttgctgaaatcttcatgtgattttagaatgctgtgggggctccaccagagtaatggaaaaggcagccttagctctgcagggactccttcacaggaggtgcaggggggcatgtctgggagaccctggatgctctgaagctctctgaagcagaactttaattgtgggaggaaatgaagtcagtcttacgctggaagccagctgtggcctgtgcaattttctcctccccctggatcttgcttatgaagccaagtgggggtgtctgaatcactctcaccaaatagagatcttccctttccctggcccactccgtgtcctgagctggtcttagggcctcgcccttgcttgagaggcctgatggggcaagcctggtggtcacacatgtcagagtagagagggatgtcggggctgagaaacctgctgatttcag

SEQ ID NO: 53023 - DNA, 2041 bp, Homo sapiens
tccccgtatgtgttgtgaaaaaggggagtgcagtgactcagagctaaggattggatccctctctggttgttcatttattcattccttcaactaaaaaaggggttaagctatgtgccagtagaaagcatctatgggattcattcctaggagtatcagcaaatgctgctgaaataatcattcccaacatctgctccattgtggccttctagtcagacgacaattgtctctctgcacagcccttgtttcagttggctttatattcacgttcattgttcccaggttcatttccctcaccagctctggaggtctctgtagtcaggagtcccatcttaccctttttgccctgggacagagagccatgagagcactacctggtcagaagctggagcttactcctctgggcccatgtgtctctcctccaagttgggagctctgagaagacatctcacaggcacctctctgcttcattcattcattcaataaaaaaaatggattaagctcctgccatgtgccaggcactgcggagataactgaatctggagttacaagacttaggcaaatgacctcacttcttggatcctcagtttccttatctataaaagggagatggtgataaagggtgtaaaagggaaatgaacgagaatcagaatgtgctggaaaaacacaggttcacatggcccgttactgcacttaacagtgtcattccttgtaacctccctggcagccagatgaggcagtggagactcaggaggccagcagtttcccaggccagcaaagaaggagcccaagcctcttatttctgtccccttcttttgttctttaggcctttgtcagggagcagatggaagtggcttattctggccaagccgtgagtgggaagaagggaatgcagggatgggaaatggaaccctaaagacaatctcattgggaatccttactcctcagctgccaaacttccttgccctgaggctcttcgagttttgtatccaggaaggctcctcctccttcccagcttctctacttcttcctggcagtgtcctcagagtctctggccctgtcctggagcttggtttcagtagcagcagagaagagcagaggagagtgccctgaaagtggggcagaatgaattgtagctacacaccaccagctcagctccagctctttgaaagtaaatctgggtcacattagctgtgggctggaacatgaccacgtgggcagaattctgtgcaggcagcagaaaagacagccaatctgtcctttctctgaggtgcagggcccctgtgggaccccagttggtgagggaaggtggtttctggattgcaaggtgtaatgccatcttaatgccatcatgcttttctaatgacatcctaggtgacatagagaaaggtatggaatggcagtttggctcatgcctttctgtttgttatgggagaagcctaggctgaaggtaggaatgcagaggaaggactggttactttggggactgtggaaggccatcatttctcagtctcatgggctcaggggttagatgccaccagagtagctgacactgcagcaggatctagggctgcacttgttctttatttcagcagtcctccccttgaggaaaggtctgtgaacagatccatcatcactaaagtgttatatggagcctggctggcctcctttttctggttgctgtggctagggcctgccatgatttggcccggccactgcttgttgccacatgtcagttacaagcctgccagcctgaaagccctgtcttggctttcctgtaggagcagaataggtgtcccttgctggaatctctgcctggatctgggatactgctacagggaaggtctgaagcccctataacttgaagggtgatgattatgagctgaagcttctgtcttaagctgtgccccacccctaccccagaagataccaggcttttgccttgtggtcaggggaggattctgcctggggcctcagtggatgtctctgggatgccctcccccactcattcacacatttcttcatgtgctcactcttccattca

SEQ ID NO: 53024 - DNA, 1043 bp, Homo sapiens
agaccctgtcctgcctcagagcaggaagagagattgggtatggttcagcagggctcacattagcctgattccttcaagagtgaagataaaaacagttttactgacaaagaagctgggagacagcagaggggccaataccttttataactactattgttaggttctgaatgccagccttggcgctcagcatcttacatgctgtatttgacctaatcctcaaaacaactttaggaggcagatgtgctacagcagaggaagcagaagcccagagagtttggtaacttgctcaaggtctcccagccagtaaggggccaagcttggaatggtgctagctctgcctagggcaacccactgcctcccccattacaaggaacagtagtttaataacagctaacatctgtgtagcacttcaaggttcacggagtgccttaacatccattatctctactgtgccttgggaagccggtgcggtgaggccttccacgcccctttgggatagctgcctgtcaggggtccagcctctgctcatttcttccaggaagcactggagattatttggagttggctctgacgagccacgggagaggcctagggagaggctgaggtggagcgacttggccagttgctatggtaacccagatggctgagtaaccattttgagggttgctatggtgatgggctgctggtggcagggatcttgtcttcctgggtggctggcaccctccaggcctcttaaattgagatgttgcactttctgaacagaagagggcagcatgagagcaggcaaaggcttcttaccccagagcggatttgggaacttgaggcaaagcttagaaaaggtttctaggagctgggcagaaagggagctttggctggtgcccaagaggctggtggagcttcacttctgagactagaactaggtaattttcttccaagagctggtcaaaggataatgcttggggctgccccttcagtgcctggcatcagctactattggggaatataaaagttacagcagacagctacccttgcaaggaggaatg

SEQ ID NO: 53025 - DNA, 1054 bp, Homo sapiens
agtctcacccatcaggagcaaaagaaaatcaaagaccaaaaggagaaagcctcagagcttttgcgactgtgtggtctggctataaatttagactgttgcttgaaagaagcgaaaaacctccccttcatagacttccttcttcccatcccccctggcagccgctttgttcctctagccttgtaaaattttctctgtataaaacaggaacatcagccaaacatgtggacttccccactttccattcattagaagaatgcattatttcaaaatctcctgggagcatttaaatgcaaattttgtcaagaaagcaatttgagtcttagagaagctctctagccacaacctaaagcagaagtttcttctttgatttgtgtgtttcttaaaaggaatctcaaccccttgccttctccctgcaacgcccccaggtcttctctgattctcacagcggactcttcccctttttgcccctgttctttcttcacctttggcaagcatcagtcacacatcttgaggaacctgctcacaaagtggcgcgtgtagcagccccaggtgggaatggagggacttttctatgtagtgtaatggacataaggaggcagatgtctgtgtgggggtgagatgtctgtgtggaggtgtttgtatgcgtgatttctgtctgggccttcttaggcctgctggtataaaataatatgggaaatgcagatgactcagcactgacacagtcaagatccccagagttagcatttctatattctctgctgtttacgaaaaatgtgcttgtgccatcaatcagcaactcatcctgcattttccgctaaaagccttttactgaaaaatgcatatacttcaaacttattccccttctttttgtaaactgagctcattagcagctgacaccaaactgagaactagttttgtttgtttgtttgttttagcacggaggattaaactggaaggaaatgagcatttgtctaaggatcctccctgtcctctttcaggcccttccctgcatgatcttcatgcccacaacttgggcaggccagcaaaacttgat

SEQ ID NO: 53026 - DNA, 1051 bp, Homo sapiens
gacactgagcccacaaagaagcccgggaacaaagggttttccagaaacagaagaagctgaacaagaagtgacggggcagatccagcaccatgaagtaaaccaggccaaggagccagagcctgagaaatgacaacccagggaggcacgaaaacgggattctgaatgcaccatggggtgaataagaggagagacagggagacataaatctgtaggggatagaccctccagaattattaaactgtgacagccatctgaacagagagacagagatcaaaagggagaaatgtgggaacctgagacggaaccaggactgttagggaacaaagaaaggactctggagcatagctggtcagggaagaaaaggggaagccaattattctttgtcatcaggggaaaggaaagagtaaagaaaggaaactggaaaatatgggtagggatttattaggggccattttgaggacagagctcccaacatcatttgatccaacattcggttgtgtatcattcaatcccaatattcatggagtgcgctggagccatgagcagtgaatgaagaactctggtcaatgtaggtgacacgttgtgcccgccaccccccatttagcagttatcctcccctgttagcttgatttttcaggaggtctggagaggtggttgtgggtaagaagttacactggctgatctcacaataagggcacattagcaagtaaaaaaagaattcatgcaacactgagcaaccaaaattgggacttgggcttccattccagttcccattctcaagagtttgaaggagaaacttcttaaccccaggctagggaaggtgtctttgtaccttgtgagtagtgccaagtattttggtcaatgctcagcacattggtaacaagtaaaacaaatgacgcttttcgctaataggtgcatgctggttgtttccacaccacaccctgatcagaaatcaggtgagcaagtcattaatcatatcttttcccatcaagttttgctggcctgcccaagttgtgggcatgaagatcatgcagggaagggcctgaaagag

SEQ ID NO: 53027 - DNA, 2249 bp, Homo sapiens
gagaaaccctcctttgtcccgctcccggcggcgtaggtcagcgctgactggggctcccgctcgccctgtggagccggcccgggtctccctgccgttcggccggcccagcctttcatcctgacgcgcggggcctcccacccagcgggactcccgcgtgggccggcctctcgcgcccctcggctcgggccccagtccgggccgggcgggggtcggcagcccctgggggacccgtgtgggcagcccgggcccagccggccgcagcctggggccgaggactcgccgggacccggaggcggcggggagagggggcggggaacgggccgggcctggcgctcctgacaggaggagccgccgccgccgcccgccgctgcagccgcgccggggcgggctgagggaggagcggagccgaggggtgaggacgcggaaacgcgagccgggaccggcggagcgcgagcgggccgggtgcgagcggactgaggagcggagcgcgactgccgggccgggcgaggcgggcggacggcggagagcgagggcgccgtcgccgtctctgagacgcacaaagggtcgaggctggggccgccgccgcctcagcgcgcgggcctggaaccggcagcccccggggctcggcgagaaggcggtgcgggcggccatggccggctacgtgccgggtcagcagccggccaaccgcagccaggagaaggagttcgtgcaggcgtacgaggatgtgctggagcggtacaaaggtagggccggggactggccggcgctgaggcccgcgggccggcgcagcgtggccttcggagccggtcggctcggcggctgcaggtggggcggccgggcggggtcgcacccaccgcgcggggcttggccctgagctgctgcttctcggggccagtttatttacagagttgagataagccttcggaaaccgcccccggggcagtcggcgcgctcagagcgccagttacatgatttgccctattatccggccccagctggaagaaggcgagacaaggcgctggcctggagaccggccgccgtggggagttgctggggaggaggaggaggaggagttgggcgcgggagaaaccacccgctctgctctgggtgcgagcttcctcccagaggggctcggacctctgtgtgcccgcggagagtccctccctcgcccccttttgtctctttgagtctcggatgagtcgcgtggaagccgaggttggaaagcaccttggtgtcttcggggtggggtgggcagcggtgtgggtgagtgtgcagtttttggtggcgagaccttaccccctccatctccccgggggtctgggcctgctggaggtaggggtctgtttttttcctcccacataaagatttgccttggagctcggatttcagccctgaaggctctcttgcgagacacttctgcaagttaatgcctaatctgcgccttgggtgtatggggagaaagttttgacagacaagagggcctgtggactgcatttccctaactgctgtaggtgcccctgaatggaagccagggatgcgtggccttgggaggcccttgccttgatctttaacatccggttctgggagtttgctttggctggcagttatgctttccacagacggggagattttcccagaaacgacacaggcagcacttttccccattttattcagctcgggcccttgtgactaggcccttagtttctttttatctgaaggagaggaaacttcagcccctatgactgagtccagcgtacttgtttacagcacctatccagtgaagggaaactaatgaagaagctgtaaaacgccccccctctcccccctcccccccactttttttttcttgtggcattggaactctgcttgggaatgcagcaggaaaaaagtagagatgaaatgcgaaaaaagacctactagggtttttgcttgttccctctgcatcagctcctgtaaactgtccagcttttcctgcctgcagcaagttttctgtcaaccccctgtggtctttctttttaagaaatgtggttcatttcagagcacaaagaggttagattgtgctgctgaacttcattgaaaaaatgctgctcagtgaatggttgcattaagtttcctttgcaggcttttgagtaacactgctctcttcagagagaggagatacattaggaccgtcccgggctgtgacagcttcaaaccagcagaattaagacccaaaataggtgaagaaatctcagcacctcactggatgg

SEQ ID NO: 53028 - DNA, 1840 bp, Homo sapiens
ttccattttattttactttactttattttgaggtggaatcttgctctgttgctcaggctgggatgcagtggcacgatctcacctcactgcaacctctgcctcccaggttcaagcaattctcctgcctcagcctcctgaatagctgggattacaggtgcacgccaccatgcctggctaattttttctatatttttttttagtagagatggggtttcaccatgttggccaggctggtcttgaactcctgaccttgtggtctgcctgcctcagcctcccaaagtgctgggattacaggcgtgagccattgcacctggcctattttattttttaactcttttctctccttttttttttttctatctcctaccagaaggaacctttaatgtttagaaaaacgttgatttatatcttatttaagctttataatatcctgaaggatagtattacacagatgaataaatttaggcacagagacttaaaattactgtctaagagccaggctccagatttctgggtgaaggtttcacattgtatcacagaagggagttttaaaatcacagtagatgacttgggctaagtgagaaattgtgaaaatgctttaattgttagtatcattattgttgttagttttagtttctgaagtatagtcacacactttaagtgacatacatttccagatctctgaactgtggagaatttcttttccccttattatgggagaagttttacgatatataaatcacattgaaattttcatacaaaaataatacaaaataaaataaaatacaaaaaatacaagaaataaatacaaaaataatttttaaaatagtacaaaatgatgaaattttgttaacacagtgattggaaaatatgggttgaggatttgggattgtttacctaagtgacgctctgaagcaaccttttggttatatgtagattcagcttatttatcctttttagtggatgttgttcttttttttttttttttttttttgagacagggtcttgctttgttgcccaggctagagtgcagtgtggtgagatcagggctaactgcagccttcacctctcaggctcaagtgatcttcctacctcagcctcccaagtagctgggactaacaggcatgtgccaccatgcctggctaatttttaagtattttgaagagaaaaggtctcactatgttgcccaggctggtctcaaccccctggcctcaagtgatcatcctgccttggcctcacaaactgctgagattacaggcttgagccaccgtgcctggcctacactcagtttttaagttcctttttagatcaaagtcctagagttggagtggatagtttttagccagaacaaaagagtaagtgctacttctggacatgaacactgttaattcagaaagtgagtcaagtcagtctgctgggaaatcacaagttttggccacattcatgctgttgaaataataaaatgtgtccatgtgctaacagtgcttatgggagctactgccttgtcttgggcttgttggcaaatgacgtaatacaaaccagggaaatgcaccagcgtaagcctattatactggtatttttcagtgccaattccaggtttaagagatcatggtggaaagaatacttcagagtgcatatctgagaacagaaacatcccaagatcaaaagtcacaaatgaacaattatagattgtaaggagtctgttgtgttttctcagtgttcttgaaaacacccagtctttactcctttttctaagtaaggttggccctttcagcttctgataattatatattgagccatgttgtgactaggttgtatggaatgctagagctcctgtttt

SEQ ID NO: 53029 - DNA, 1033 bp, Homo sapiens
cggagtctcactctgtcacccaggctggagtacagtggcacaatctgggctctctacaacctccacctcctgggttcaagcgattctcttgcttcagcctcccaagtagctgggactacaggcatgtaccaccatgcctggctaatttttgtatttttggtagagatggggtttcgccaagttggccaggctggtctcaaacttctgacctcaggtgatccacccacctcggcctcccaaagtgctgggattacaggtgtgagccaccgtacctggccaaggatgggatcttttttgcttgcctgggatctgatatcctccacttgctgtggctacctaaaattgtgttatagtggaagtctgctttcatttggcacaagcttttatttttctctgtttaaaattgctttcttctgtatgaccatgtgtcaaccatcaggaatgttccaattatcagggatgatttgagtagtcacctaagactaattaaataattggtcagtcagcatctttcttttagacaagagcattgccagatgtactgttggattccctcttaccatggcaaatttccatagtgatttttattcagaacgataaacacaattcgtttgtgttgatgaaaggaaagggcttgcttgaagtgttttttggagtttatagttttcaacctgcaggaacatgttggattgagacatataggaagtgatttttttttctgtgctttttagtcagtcaacaaccatgaataagctcactgtgtgcactatattctactagtacctacaagcagatactatgatggggaaagtggtattagggagatgggtgagccacttagaagcactgaaagaatgatattgagattaggggtagggagaggagggtctggaatgccagtaggaagaatttgagttttatgtgatgggcaggattaatgaagaggttatgtaaatgatgggtgacagtagaaatctactctctgggaagccgcattgtaattgagtcatgaggttagattaagggatgatgt

SEQ ID NO: 53030 - DNA, 2822 bp, Homo sapiens
tgatcttactgttaaatggaggaaacatattggcaaactgacagttactgtctattgtagggagggctatcatatagataaatgctgatgctgtggtagtgaagaggagtacccagtatagccagagtgagaaagtgtccaggaaggcatccaagagtaagtgaaacctgaactgttacctaaaggatgtgggaccctgagcaaaaagtttggggaaagagcattctgggcagcatgaacagaagtaaggggatgagcaagcttgagagggggaatattgggcattgataaggttggagcataggatgtgagggaaggagagatgagatgagatagggagagtgggcaggacaaaaatgttgactggctttgtatgtcatattgtatagagcttggactttatcctaaaggcttttgggagccattgaataaaagtaggcaaggaagactatgcttagatttacattttaggagtacttttcctctggcagcagtgccaaggaaggtaggggcgaggaggaaagactagtggcagacaagttaggaagctgtcacaggaatttaggcagggagtgaaactaaggttgtgaaaatagtaatgtaataaagcaggcaaatcaagaaatgtgaaggggtaacatccatgtgttttgatgactaattgtatgtggtatatgagggggagagggaagaacctaggatgacttggaggtttctggcttgagtatttgtgtgggtgggtcgtgtcatgaactaaaatagagaatataagaggaggaaggttattttctgtgaagtggtggcagtgatggtccacgagaagatactgagtttaatttaggttacattgcggtcgaggcttctgagggatgctaggtagagatgtccaggaggtagttggttgtaatgaacatgaaacttaggagagtgataggtgagagggtgagagagtcatcagcttatcaaaccacagccataggaggggagaaggagctggctttaggagtgtatgtatattgagacaaaaactctggggaactccaacaggagagtggtgtcagaagcagagaaagaggatctcctgaaggaaattgtccacagaaagggagtggccagaaaggtaagaggaacaggagagaagtgagtttcaaggagagtgtgacacacattgtagattatgcagaggtcaaataaggcaaagactacagatgtccaaaataaaggttactgctactggaacattttcagtggagttgtgggaagtgaatggaaagtgcagaagaggagtcagtgacctttggaacttggactttgaaggaagagagaggaggaagacaggtgaagaagggtggggagagttttgtttatgtattgtaacacaggagagacttgagcatgtttattttaagtgctgttttgaaagagccagtagagaaggaagatataatacaattcaaagacggggagaaaaattgatggagcatgggctctagagtcaaaagttgtgtcttttagaaagatcagagggttaaaaataagaatgcaggtgattaagttggttggttagaggtgtaggaacttgagggaatttctcctgatgctcatactctctctatgaagtaggaggtgaagttatttgctgagagtcaggaggaaggaaagaaggggtgagtgtgtatgtgtgtgtgtgtgtgtgcacgtgtgtgtgtgtatgtgtgtgtgttttccctctagccctagaagcactcaacaacctgattgtaatagattccaaggcagacaggtagattgatctaggatcagaattttccagcatagttttgacggaagaatatggggtccttgtagtttgtcttaaaatgtagcatcagtttgattattgattgtttgtactgttgttctctggctggcttgtattttggctccccagtgaaattgtctactcctctgggaagaagcatatatgtaacttttgcattcctgcctgtcatttagctaaatactatgcagaaattaattcttaagtttttgttgagataatttgacttttggacaggacatcttgactcttgacatagagagaggctttcctcacttgtggtctttaatccccatctcattatctgacatggatagtggaggattcactcactctccatgagtgaactccaggcctagcttcttcattagtcttaacaggttagctttactactctccccagggcagttgagctttgctttccatgaaggttatgtagttaatttgtactaggcttgtgaagacctgggtgtttacaagactggacagagaggctgttgtggaaaatgcagcctccttcttgtttattttggcaggcaggcaatgaaggagatagatttgttctcatgactcagagccctacctgctttaccttaacaggttcaatataaccaccacctttcagatgtgatagtgtccttcagagtttatctgacctttatatctaaaaagagtattagttaccctttgccctctacttgcttggttttttttcacttttattccagtgtagaggatatttcctaatgtgttagggccagctcagaattgatgtagttctttcccattggcacattccgcatctttgtttgtttattgccatgttcgccacagtgtgccttgttttgcgctccttgttttgtgaagctggactcttatcagataaacttgccatgagtcacactggggagtggaagtatgtctccactaatttggagaatctttgatcttgtttcactccctggtttggcttgtccagtgcaatttgtctctcaacctgcaa

SEQ ID NO: 53031 - DNA, 3986 bp, Homo sapiens
agcatttatctttgtgttgcaaacaatctaattacactctaagttattttaaaatgtatagttaagttattattgactatagtcacccttttgtgctatcaaatagtaggtcttattctaactattttttaaaaatgtggaacacttcacgaatttgtgtgtcatccttgtgcaggggcctccctaacctctctgttgttccaattttagtatatgtgttgcttaagtgagcactagaatgcaaacttcttaagaatagaggtttttatttgtgtattaactaatttccctagcacctagaagagtttctggtataaagtagctgctccaatcaatattgaatgaatgaattggaaatgttaagttagttcactcttgttccccataaggaaaagaggcatggaaaggcacaataacttgctcaagctaacgccatatctccttaccaggtaagtgggttttaaaaaagtttaaataaaacgatgcttaatcacagttcctttatgtgatttggtactaatgtgtattatggacttaactgtattatctctatgaaaaggggtgggggaagcaaaagggaagaagctaatatatattgagtccttactatatgccgggtattttgttttattttatttatttatttatttatttatttgagacagagtcttgctttgttgcctggtctggagtgcggtggcactatctcggctcactacaacttcgcctcccgggttcaagtgattcttgtgcctcagcctgctgagtagctgggactaggcgcgtgccaccactccgggctaactttttatatttttagtagagacggggtttcgccattttggccaggctagtctcaaactcctgacctcaggtagtccgctcgtcttggcctcccaaagtgctaggattataggcgtgagccaccgcgccaggccagtcttatttaattgtcataaatgatatcctatgatagtccagtaaccttactagattttacagatgagagaactgaggcttaaggaacctaaatcacttcccagagggtcacacagctagtaagtgactgaactgggttttgaacccaggcccgattaactccatttggccctcttttaccttaaggcacaggaaaattttggatttgtggtctgggttgctttaagattcccagatcagactactcttgaaaatggtctgatttgaactactcaagtagagttacaaaaattgtttaccttaagacagccccatggagcagtggggttgtgtctgtagcgctcttgagtaaaaaaaaattctgtgttgcacatactcccactcagttgtatcgtatataattcacatttcagactttctttttaaccagggatccagaataactacagaaaggtgattatgtaacatacttgtacagtgcagccacttctgtgtttggtaatattctttttttttttttttttgagatggagtcttgttctgtcactcaggctggagtacagtggcgcgatgtcggctcactacaacctctgcctcctggattcaagcaattctgtacctcagcctcccgagtagctgtgattacaggtgcccaccatcatgcctggctaattttttgtatttttagtagagatggggtttcaccatcttggccaggctagtcttgaactcctgacctcatgatccacctgcctcagcctcccaaagtgctgggattacaggcgtgagccactgtgctcggctggtagtactgttaagcgctaagagcacaaacaaaaactatgtctaaaatgtagggcaggtagagcaggtgaggattaaacccagttgaaatcagcggtttcagtagtaagtgggcagatcataattacctgtgttgctcagagacctaagctgagagtgggggtggggaaaggtcacacccattatctttggagaaatgatgagagtaaataacccatagtttccagtttattccagaagcattctcgccagagtcacaatgttgaagtgggttttgagttagaccttgttaccccagatcatccaaggttaacatagtttccttagataccacagccattcattgtgaacgctgttagcttcctcttaggtagctttatgtagcctaccttagaaaggagggtggggtctgggaggggagaggagggaatagcaaaagtagcagagaaacaaaggactaattaggaggttcctcagtcatttgggagtagatctttttcattagctgatcactgagatcaaggatggaggtggtgatccaggaggaggaggagttgtagtaatcagaagcagaatagcataacttggcagtcagtggtggtccaaggaccagcagcatctgatagcttgttagatacatatatatataaattttttttttttttttttttttttgagagagtctcgctctgttgcccaggctggagtgcagtggtgcgatcttggctcactgcaacctctatctcccaggttgaagcgattctcgtgcctcagcctcctgagtagctgtgaccacaggtgcatgccatcacacccggctaatttttgtatttttagtggagatggggttttaccatgttgaacagactggtctcgaactgctgacctcagatgatccacccgcctcggcatcccaaagtgttgggattacaggtgtgagccactgtgcctggcctgaatcaattttaattttatcaagattcccaggtgattttttttttcttgaggcagagtcttactctgtcacccagcctggagtgcagtggtgtgatgacagctcactgcagcctcaatctccccgggctcaggtgatcctcccacctcagcctcccaaatagctgggactacaggctcgtgccaccatgcccggctaattcttgttttgttttttttttttttttttttgtccgaggcagagtcttgttctgtcacccaggctgaagtgcagtggcatgatcttggctcactgcaacctctgcctcctgggttcaagcaattctcctgcctcagcctcctgagtagctggggattataggcgcatgctaccatgcctggctaattttttttgtatttttagtggagatggggtttcactgtgttggccaggctggtctcaaactggctggtctcaaactcctgacctcatgatccgcctgccttggcctctcaaagtgcgggattacaggcgtgagctactgcacccgaccaattcttgtatttttttttttttttttgtagagatggggctttgccatgttgcccaggctggtctcaagctcctgagctcaagtgatccgcccaccttggcctcccaaagtgctaggattacaggcatgagccaccatgccaggcccccaggtggttttttaattcgattctgtgcccgttaaagtttgagaagcaccaagtttgtgattaggtggttagtgcaaggggctttggagttggacagacctgggattgaaacctggtttggccacttactacctgtgtgactttagataaattatttgaactctctgtgacagtttctcatatgtgtaataggggaactctctatttcatagggttgtgggggagagtaaatgacatggtgcattttgcaactgacactatcttagatttaatgaaatttagtaatgtctgtatcatattaagcactgagtctagcacagcctagcatactcaataagtgttattactaataattaaattaggcaaatttacaggaataaagaggctttctcctcttcctctttttctctttatctctcaatgagtacgtttgtctgcagttttataaagctgtattgtgtgtgtacactctttggtgttttgcctagcattatttaatggtagttatagcagcagcattaacacatcttgtacttattaatgtgccaggcataatttttatgtactttatgcatatattatttcattcagtccttagagcaaccatg

SEQ ID NO: 53032 - DNA, 1368 bp, Homo sapiens
ctgccttacttttgagtctccctttgatacttaagagttctgccatagggccaggcacggtggctcacgcctgtaatcccagtactttgggatgctgatggatcacaaggtcaggagatcaagaccatcctggctagcacggtgaaacctcgtctctactaaaaatacaaaaaaaaattagccaggcgtggtggcgggcgcctgtagtcctagctactcgggaggctaaggcaggagaatggcgtgaacccaggaggtggagcttgcagtgagccgagatcacgccactgctctccagcctgggtgacagggtgagactccgtctcaaaaaaaaaaaaagatttctgctattgcacccttttctgtagtctttccctcacctcctggtaaaattttacttacctttgaagctcagttcaagtcctcccttttacattaatccactggaaagctaacccatgataactcattctgcttcataactcatagcattaatttctaccactcatttgccagttgaccatgaaatgccgtgtatcgtcacttgtattttattatttgttatttaacttatcacacatttgcccagttagattgtgctgcttgggctcatggtgatttattctttctagtcccaattttgcctaacacaatgtcctacatttagcaagtactcagtaaatgttgatgtgattggattttgttagtacttcacacccttctaaagatcaggtgcttagagccggaagcctaagggaacacttacctggctgacatcatcttggctgcctgtcaagatggggtgtgtgcctgagagaactgcccgtaaatgaaatacttgtgcaacaggttatgttttctcctttagtgggtgggattcaagacttcacattgggaaaaagagatagtaagtgtaggaagagggctgaaaaggggatggatgggaggatgctaccttgtgagaggtggggatatggctttattaaaaacataaatattaaaggctggcgtattgcagagagaagcttcttggaaccagcaggctaattaggcaaactggcttctctggtgcaaaccagttgttaattgccatttattttctttgctataaaactgtaccagccatctacttactttctcattagagtgaatctggagaaaaggcttaggttagatttaggaaatccaggagaaaaatgcaggacagtcagagtaagaccagggatgggcataatcctttctctcacttgtcttaccagccctagaccttaagggtggccaggacctccttgcatttgccagtagaggttgctattgaagtagtgtaaaacctcttgtttctattcctgctaactccttttgccccat

SEQ ID NO: 53033 - DNA, 3451 bp, Homo sapiens
attattggttagttatcattcccatctctgaggttcacatatgcagtggaccaccctgcctttagctgtccagactttgactgcaacctgtctttctattccactcctcctcccctcccccaaatgatttgaaatggagaggaaaggaaatggagtttgatggttttaactcttctgtggctgtggcttagggagcagaatgttttgattgcttgatttaggggtcttgaggtctcctaatacaatattctttttgttaatagaaaggccccactccattttttttttctctgagtattttggactcaaagtcttgtgttgaaatgtcggtacctgcccccgaaggggaaaagatccctttcagagtttatttttcccccccattcatggggaattcttctcattatcagaagatgaagattactggtcctttgaacagagtataaatatagccaacaccctaatatatttctaatgattgggctttagctttaaaaacattaggctagatgcctccctattttttgtggcatgatttagctgtaactagcctggaggcaataacaatactaaatgaccttttgtagtcacattaaacattgaaatggtactgagactgccttggtggggagttttggcctatgggaatgatgtgagttttggtttctactcctttctctgttttcagataaatcctcctacatgtcccattctctggctctgggaagtactgacagtagggaaaagttagtacactcatctcattgttcagatcaagtttcctgggtgcggttttgcagaacttcctacaagagctgactcaagagttctcttctattgtggagatgttcctgctcttatatgtcatactaatttatatccttgaaattttgagcagcatcatttggatgtgttaagttgggaatgaagaaagtgaaaatattttcagagattccttgagaaaagggttccttttgctgggtaaatcaacgttccctagatgctgtggctaagaagtgaagaattctaagccaacttttttttaccccttttcttttctttacttttttttttttcgagatggagtttgctcttgttgcccaaggctggagtgcaatggtgtgatctcggctcactgcaacctccgcctcccgggttcaagcaattctcctgcctcagcctcccgaggagctgggattacaggcattacagacgtgtgccaccatgcctggctaattttttgcatttccagtagaaacggggtttcaccatgttagccaggctggtctctaactcctgacctcaggtgaaccacccacctcagcctcccaaagtgctgggattacaggtgtgagccactgcgcccggccttttttttttttttttttttttttttttaagagacagagtcttgttctttcacccaggctggggtgcagtgacatgatcataactcactgtaaccttgaactcctgggctaaagcgatcctcctgcctccatctcctgagtaagctaggaatacaggcacatgccatcatgcccagctcagttttattattttttttttttttgtagagacagggtctcactatgttgccaaggctggtcttgaactcctggcctcaagctatcctcccacctaagcctcccaaagtgttggattataggtgtgagacaccttgtccagcacctgtttttcctttttgatgtcagatccctctgaataacaagttatttgcctttttttccctccataagactgtgagcaccttgagagctgcgagaacatctcacttatctttgtatctctgatgtttaggacagtgtccagctcaaagtgtctataaatgtatgttgcattgaatagtggagggaagctttaaatacatttactgcagacagatgtatgcttagcatatttaattgggagacattattagaaagtggagatggataaagaaaggaatttttgtggatatgatatagagaatttttgtttcctaaggatttaaaatttttgtttgtttatttatttgtttattttttagagatggggtcttgcagtgttgcctaggcttgtcttgaactgctgccttcaagtgatcctcctgcctcagcctcctgagtatgtggaattacaggcatgagccactgcacccaacttgcctaacaatttttagagtaacagttattttgcggttcctttacgtggagaacctttagaagtgttccatctgactaccttggacaaggcactgtgaccttctttgtagcagagactaaagacacctgcccatttccctcaaatggagggatatccctcagtaaaggaaggagctcagaattagattgggggtagagaaaggaagcattgagtccctcctagccctgcactgtggaaatgtaaagctattattatgataattgctgttggcaaacaagaaaattctcagcctctggtttgtacctacacccagtcacaacctcaggttgggtggatgcagactttaaatattggggtcacctgtagctgttggaaaaggtccctgtggtttctctgggtgttgtgcaagcattacttttttggctcttttccctgtatccatcagtaaaaagtaggaagtttgaggagctgtgctttcggttggcattaggcattggagtgcctttatttcctacatttaactggtaaatatccaacactccataacaggatggccctgcttggaaattcttacctagggagtgactgaagcctaagaggaactgcacagccccctgtattgaaaacggagtagtcatttcctagagcatggcttggatcctgatcagctgatttcctgtctctacagggatgtgatgtgattcctcccccttccttctggaagaaatggatattttttttcatttcctgtttgatagcatattttctgagtaccaggagacacttgatgactataaaacatttgatgtgtggggggtgggaaggaaggaggcttttgttttcagcagaatggctttcatttgaggaattcaaagcacatacatgaacccaagctgttttgttcccatgggagagacacaggctctaagaagattgtttcgaatccctttcctgggctgtgtctacttgacctgcactggtagagccccttctcccccataggttagaaaagctcggtccctcatggagctctgcatgctgtggattctgctcttgccacatccgctactcagccctttttgtgcctaaatccgctggagagcaactattagtccctgggggaagtgacaccacccttggaatggaacctggctggatgccccttgatccctgactgagtgacacagactgggacaggaatctggctgtccagatttcctgtcctctgtcctcactagccgacttggctgcttccaccctggggctgggggtatggggtgtggtg

SEQ ID NO: 53034 - DNA, 2348 bp, Homo sapiens
acatagatgcctaataaacatttattgaatttaattgtaaaatggatcaaagaccatagttaataagagcttatagggcacttaataagtgccgggcaactgggcacggtggctcacgcctgtgatccctgcactttgggaggctgaggcaggcggatcacgaggtcaggagatcaagactatcctggccaacatggtgaaaccccgtctctactaaaaatacgaaaattagcagggcttggtggcacacgtctgtaatcccagctacttgggaggctgaagcaggagaatctcttgaacccaggaggcggaggttgcagtgagccgagattgcaccactgcactccagcctgggtgacagagtgagactctgtctcaaaaaaaaaaaaaaaaaaaaaaaaaaaaagtgccagtcactgttataaatgctttatgtcaaattaactaatttaatccttagaacctatctccattttacactggagtaaactgaagaacaggagggcatagtgatttgcccagggacacacagctgttaagcagcagagttaggtttcacaatttgctctagaattctcatgtactcaaacattatgctataatcagttgttcataatattttcacgctgttaaattcctcctgaatgcctgtctgtcttgggtgtagctcaaagaatgaaaagcagaagcagcataacttgttgaatatactcttgagcctgcgtcagaatcacctgcagggcatgttaaaacacagattgctgggtcccatcctcagttctgattcagtaggtctggggtggggcttgagaaattatatttctaacaagttcccaggagatgctgatgctgctggtctggggaccacttggtgtagcatataggtgttaagagcatggactcaagctgctgaggtttgaatctcagctctgccatttattaactgaacttgggcaagttcttgaacctttctgtgcttcagttctcatctgtaaagtgttttactgttaccacatatatcataggattctgacggagattgaatgaaataacatgtaaagtgcttaaaatggtgcttggtttgtagtaagcatgcagtcttagctacagtaatggggataggacatgtttcttgccttgtagattttagagtctagttattagacttaaatctaataattttaaaaagtacaaattcaggtattagtttacatggttctgattctaccttagatttggaaagatgaaatgcgtgtatcttgggggatatggtgggtagtgggagaccaggaggaggaaaggtacatgaaactagaagataatggaaagttatatagtcagaatttagaaaggttggaattgccagtggttttggtattattacctgagaacttgagggagatagaggaaggtgcctgtgctctctgtttgccaaagagataactgactccttttcccatttctctttcttagagctggtatctggtctgcaggcagttccggcagcatttgctttttgtggggaacagtggctaaggaagtgatttgctactggcttcagaagttgggctctgctgcctttatcctccacagctgcctcacatagttttgattcttcctgagaaaggcagttgttaggtttggaagtcttcagattccagagacagctggacagctgaccctctggtagctatttcccaaactgccagcctcctgttgcctcatctccctgggccccttcttttttgctttgaagcaatatcctatatttagtgaactaaccaatttgaggttagaggaaatttgatgggggagtctctcccaccttaaaatcctggatggatggagtatttgggcccaggaacaagatgtatcctgttaaaaaaaatttaacaccttcatcaagtatactccaaatgacagcttacagtgctatgaatgtacctctagctcatgggtaaggagcagtgtttatttttgggtgccctgaagaaaatatttgggggaaggagtggggagaagctcaggcagctccatttatggttgagcaatgcttggtattctacagaagggaccatatggacagtggaagagagtttagcattctgattgttcacctcttgctccttccattctgatggctaattagggacacctcattagctatcagagtggaacaagtatttgccaggctgacatgagcctcagccctgcatcctgcatcttctgctttcccaacctgctgagtcaccacctaggaatggcagtagccaggttaccacctggagcacctggagcactcttggcataatgcactgttgactggttttggtctcctagacacagct

SEQ ID NO: 53035 - DNA, 3142 bp, Homo sapiens
gggtcttagctctccttccagcttgttccacaaggcgctgacctacttttcagggacaattaagtgtttgtgagcaaaggaaggcggtgacccgagtgaaggtgaaccagagctgcattaaacaaacatttggagtcactttttctatcttacacaggagggcccatctcagtccaaatggaatggcagatcaggctgattgtggtagccacattctagatgcttatcaagatagtcaactaacccttgaatttttattctttctatcaatgtaccttaatatcagaagttacttttcataatcattgtaccccttgtctgtgggctatacgaaaagatttggaagcaagttggggctcttagagtgaattattgatacaagctagcttttgatataccttttggtgtatcaaagatacactttctggtggcaatgtctggttcatttgtaacatcttggagaggattggaatctcttttcctttttgtatcaggccaggataataggatagaggagaggccagatctgtagagaatgagcaagtggcttgtttagggtttcctgcccttgtgaggtaagggctcaaggattagattcagtctttccatttgcagtgaaaggaagtaaactcactttcccaccctcatcctggaggttacttatgttatttgcagaccccaacttctgcctctctgttaagtatacttcttatgcaggttgcccttactgttacatcttaccactgggggaaagatccaaggctctgggaaggacagtgacagttgtcctacattggctagtttcaagaccctgagggaattgccaagccagcaattaggcaatttctttttcttttcttttctttccttttttgagatggagtcttgctctgtcgcccaggctggagtgcagtggcgcgatcttcactcactgcaagctccgcctcctgggttcacaccattctcctgcctcagcctcctgcctcagcctctggagtagctgggactacaggcaccagccaccatgcctagctaattttttttcatttttagtagagatgggctttcactgtgttagccaggatgatcttgatctcctgacctcgtgatccgcccgcctcggccaccaaggtgctgggattacaggtgtgagccacggcgcttttttttttttttttttgagacggagtcttgctctgttgcctaggctggagtgcaatggcacgatctcggctcactgcaacttccgcctcccaggttcaagcgattctcctgcctcagcctcccaagtagttgggattacaggtgcctgccaccacccccagctaatttttgtatttttaggagaagcggggtttcaccatgttggccaggctggtcccgaactcctgacctcaggtgatccacctgcctcggcctcccaaagtgctgggattataggggtaagccaccgcccccagctggaaatttcttaaacttttatttttagcaactccatattcatgagaactctcataatcttctagtcagtaaaaagaaaagttattgaagttattgatactgcacccagagatccagatcaaatcttaaggaaggaagaagcttagaggagaacttcaccctgccactctctcattggaattcccttctaacaacgtgtgaggtgtcagccccatttgaagaactagtttatatatcagagcatggcctggaaatcagcgtggcatcaattttggtcttttttttttttcaaatagagacaaggtctcactatgttgcccaggctggtctcaaactcctgggcttaaatgatcctctctccttggccacccaaagtgctgggattacaggtgtgaaccactgtgcctcaccagttttggtcttacagatgactaagttttttgggggagggtattttaggtgacgtgcaattgctccattcctcctagacatcccagaatctggtcacaacctccttttttccacttatcctttcctttatgcacattaaacctgttctctgctgtttcccagtctgtcagcccctttatggtgtcagtgcttcctgacctatcatgtacaatagggctcgtactggcattctcagatctcttttttttcttccacgccttttctatccccagtgctggacctgtgttcattttctccactgagctactgagtgccactgcataacagtgtgctgactgactctattacagatttatgagctctagccacagcctggctctcaatcctatcctgaaacctttttattctcttctggttgactgccattcatttttttctgcagcagccattccagtctttcaccattctcttcaaacttgttgctccaccccaccttataaactctcaataagtaatttagtcttttacgtctcaatttatctgtaggctttaccagtccttaccacattccctcctatttcagaggcaggtctctgggcatatacatatatattttgtgttcttagttcctcccttcctagtgactctttgtaaagatattcaggttttctccatcctaagataaaaattcctttaagcttatctcttcttcagactaactctctgtgctttttttttctttaccaccaaactacctcaacagcctttcttctacttctttagtcatcgtgagccactatagccaaggtttgtgcccaccatcccaatgaaaggctcttgtttgtgatgacttgcttgcagaactcagcagcctctttttgttctcacgctgtttcatcttgtcacagcatctgacaccatttggacctctttccttccctgactgtgtgctatctctggatgagttgacctactctggtgatttcatttaggaatttcatctgtgtgtacagtgatgactctcttgtcagaatctgtaactacctattgtatgagcttttcccccaggtccaaacttgtatttccaaatgactactctccttttccactttgtagcctacagaaatttgcatgtaatgtatccaaaattcagcttatacaaccactatggagaatggtttggagaactaaaaatagagctaccatacagtccagtaaccccactccttaggtttatacccaaaagaaaggaaatcagtatattgaagag

SEQ ID NO: 53036 - DNA, 3373 bp, Homo sapiens
tgcccaccaccatgctcagctaatttttgtatttttagtagaaatggggtttcaccatgttggccaggatggtctggatctcctgactttgtgatccgcccaccttggcctcccaaagtgctgggattacaggcatgcaacactgtgcccggcgtgcacagtgtatatctttaggtaaaattcttaaatgtgaattgctgtttcaaaaggtatgtgtacttgtaaatttgatggataatttgattcattgctttaatttttttttcttttttaaactccatggaatatttctagtcacattgctgtaattgttaattttgtatatttcaagcatatagacaagtacagaaaatgtatagcagatacatatgtacccactactttttaaacagatgttgacaccctcattgacgttctccctgttaggtgcttttagcacttcctcaacattgtgatgttctcccacagaattttatcttagacgtcacagtaaaaaagttcctcagaattcatacactaccattctggaggtgccaccatacattctatcttggactttctttttaaatatagcctcattgttagcaaaaggcagcttcagaggaaaattccgttatgttatttttggtgtctggaatctgacttttgaaaaatgtttattttgccttcttcctctactcaaaagcaacaaaagaatgctaccagaactttatcacaaaccaagtgacttaaacaaattaaaaaaaaaaaggcagttggtggcctatgtttctagagacttgtttgatttgctggcagaacagcccaggtgagttgagccagtaagcacttttcttccactaggtttttcagaataaccaaatgtagttctcctaagcaggcactgatctttagctgacttagtggtgcagctgtatcctctgggttttgatggagttgatgagagaaactgttcttgcgggtggtaggaagctgttgacctgacctctgttacacctgactgtttcaatatgcctttgtggaaatcaatttcctacccttccatctctctgctagagatctataaccttgttccagtggaaggtgactcttacctctgatcttttcctaggtcctcagaatgcctggcagtgaggcttttaggttattttgggattttataaactgagaggggaaccttagtctcaggtggggctagaatctgaggtcctataggtacagatttatcctaaaagcaagtgtttttgccttctctctcagttgctcagtgcttcttacctcatttgatctcttagtattacataagcaccttagggaggaaaggactcaaaggagccaaccatttctccttggacccacagccaaaaagaaaaggctcaacgagagtgagcttattcgagggtctgtagcctaaagcatgggctcttttaaagcctcttgttgggccgtgaagcataggtctaatccacgtgaagtaattacccaggcctggggtggccacagggtgagcagagctcttcgtaccctttttgccagacctacacttaatttcctttaaagcctcacttggtcttgccatttcagccctttccttcgaagtatgaagcctgactttttttgtcttcctttcttcagccctgcagaggcagctgtggccctggggacagccctttcttcaaatggcaaactcattttctgtccagcagaccagaaggacaaggtgtaattcaacgcttctctccaccagacactgctgccagggggagacaatgaagaaagtgatctttgttgctccctgaataggtccctgaacctggcacctgcttttgttactggctccttaagtcactggagacatttttgctgtttcctgggttagcagctgctttgggataatagtagcaactggttgtcaggatgtcagttctgcctcaaagaaaatcagtgtatttatatgaggagagttaccttttctgttcttaaatttcttcagggtttgtctgaagagtgagcagttggaagtcagctgtgcccttagtttgatgaccccatgaccctcatctttgaatctgaggagacactgccatttctactatccaagtactaaccaggcctggccctgctcagcttccaaaatcagacgagatcaggcgtgttcagggtggtatggccgtggacgagacactgccatatttttttcgtcctgctctccctctggtgagactctgagttctgggttctagcatgtaggtcagtgcctcctacctggtaagcattcaacagatatatgtgggatgaatgattgaatgaattccttgatcttgctgtccaggttcagtttctctgacactgatacgtgggtgctctatgggagggggacctttgtttttaggagaaagattgcttcaaaggaattatggaaggtgttgatttctagggggctttgggggaactatgggaactctaagatatgattcgttctcgcctcattggtctagatctttctcctcgatagtaactgtctgctgacagacttgccctgtttcaggagcagtatcctgaacctgactcatctgggctctgtccttgagcagggtaagggattttttttttttaacagccatcctgtcactgtagattcagaagccctcaggaccacatctcaggcactgtagtcttggacttcctgatctggctgcattcagtcaagttccactcagctcttaggtgtctgtgcctttgtaagggctgttggagacagaagggctttttttccgctttgtcagcagctggccagagaatgcctattagtctgccagatcctaagtctttcacgtttccctgtctgtgtctggaacttagggcagaatctcttaccacctgaggttacatctcactatttgcctttgtgggacccattggaggataaaagatgaatagccatgaaaggcatgcagagttattgaactatggttctttgaaatgctgtgactctgaggaaagatccctggtctccaagaatacaactggagccagaccattgcaccaccaccctcctttcccaagagcctctttggaaccatcactcattccatagttccaaacatccttgtttttgtttaatttttatctgataaatgttatgaaacaattttaatggtgaaacacacagaggaaatgacaaactagcatgtgttgtcttttaaatgcacttagttcaagtggttaagtcagttgttcctgttgttagattgctgttgtgtagtcgactttccttctttaggtgggaagagtctctgaatagactttaaaaaagcaaaaggaaccagctcttctttagctgattgatcattcctttacatctgactctttt

SEQ ID NO: 53037 - DNA, 1028 bp, Homo sapiens
cctgttaatcttgcctatcaagttgcattttgagaaaaatgaaccatgtatttgtgtttctccataactcctaatactcacatctgcacaaagtagtaccttgctggttctgttgactgactagtagcattggaaggcacaaaagcttgggttggttattactttccctttccattatcttttttttttttttttcctctaagttggggtcttgctctgtcacccaggctggagtgcagtggcgcaatcacagctcactgtagcctcaacttcctgggctcaagtgatcctcccaccttagcctccccagtagccaggactacagtcatgggacagcacacctagttaacatttttagtttttgtagagatgaggtctcactatattgcccaggcaggtctcaaacttctgagctcaagcagtccgcccaccttaccctcccaaagtattgggattacaggtgtgagccaccacacccagcccctttccattatcttagcagctgtcacaattatttagcctgatctttttaggtgggcatactcccttttctctctgtttttacaatgctacttacacagtttctccacctgcatccaatctgtaattgggagttttgcagagcagtgtatttggtatgctgtgaactcttccctaggtcacccaatggcatcttgtgagccaggttgtctgaaaaacttcaaatcttggtggcagtgtggtgggtgtatctcccatatgagggattgttccagggatctgactcaattgacagctcctgaatttctaatatgccaaggcttttgtggtaagatgagcaagaatttttcaagctcagatttggggaacatagcttcttgccatgctatctcattggcatgatgtgtgacttttgggcagattacttaacctctgtctatttactttttctttttttgagacagggcctcactttgtcaccaaggctagagtgcagtggtgtgatcttggctcactgcagcctcaacttcccaggttcaagcgatcct

SEQ ID NO: 53038 - DNA, 1123 bp, Homo sapiens
tctaggtatccatggagagggtcctgtctccctgaatggttgtgctttcaacagttagggaatgagcttgacagtttctgcttcttccctccccttgccttgaactgccttgatatgcagtgcctcctctgttgtgtggctgtattccagtccgtaaacatgactgctgtaaggagagtacagagtattgtttattttgtaaaacttgtctcattgccatgtaatatttgctcaagagctcctgttgtggtgatattcttgtggtgagcatggccctttaaagattttgttctcaaatgttaaatgagcccctgactggtgtcctgaaaagcatttaagcttctctccctagagtttaagcaagaggagcagtaatcccagtggagcctgggctggggtctagagagaaggtggcagatgaggtggcagatgacaggcaggggcggttgtggtcccgtagctcatttgcacaaaggaggggctggcctctcctggggaggtatttccgctcactggaacaaatgagggcgctcaaaaggctgtaatgtaatgaggcttctctggtgacgtcacttgtaaatgtggtcaaagtccagttcttgggggctagtagaagcgggagtagagatcattcggtttgcatgctttcacttctcagctgtcactgtgccatggtgcctactttcagccagtgaaccaactcaactgggccgggcatgaacgcttacaagtatcagaagttcctggagggactcaacaaccttagaggtattacaaggcttcaggctccctaccctttgtccttgctgatcgtgtgagcacttattatggtgtgtattgtatagggtctgtaaaaccctcctgctctgagctggccctattttttatgcgtttaggcaattaaacagaagggatagagtttgtaaatgcaatcctaagtgagtaggagagaatctccttaggtacttcagcaacagcctgttgtcttgcttgaacggacaagtaagaaatgtcccctgtattcttgagctcagagggctcagggcactccctgttttctttgaggtggccagacagtgtgggtggagggctcttgccatagggccctgcagcctcacctagg

SEQ ID NO: 53039 - DNA, 1412 bp, Homo sapiens
atggagagctttgtatgctataaagggatatacaggtcgggcatggtggctcgcactcgtaatcccaacactttgggaggctgagatgggaggatcgcttgaacccaggagttctagaccagcctgggcaacataatgagacccccatctctacagaaatgttaaaaaattagctgggcatggtgatatgcacctgtacccttaactacttgggaagctgaggtggaaggatcactctgagttcatcttagaggtacagaacccaaataacacagcaaagagccccagagtctggagtgagaagagtgctgctctctggtgctagagaccatgtgaagaagggaagaatacccacatctgactaagcatatgtgtaaatgcaccttcctctctgagacaaagagctgtagtatggggctttagagtgaaggtaatagatcttttctctccacactactactcaccttgaatggagttctgttttctaatctttcattcactattgtttgcttcattcacttatatacactgtataatagtctttatagcataaaacatacaatatatagcagtttctcttgttgacccaaagaaaggatcagatttaaactcttctttgctcctgcaacctgagtctttttcaggtgggagaagttcctggaaagaggacatgtagtttttttggtttagtccttatcattttttggaatgttgctataggtcttagacaactattcccccaattctgggctgccaggcagagagttagatacaaaccattgcctttgtcaaatcctcctgtgggttgagtttcacccactgtgccccctgattaaggtgaatggttacttcccttcttcttttcacttaatatctttgtgtattccagaagggctgatggaaagaggtaattggctcccctcttcatttagttactgactgttgcttttcttggcatggttcagcttgtagacattcctccatctagtgggtaactgttgaagggaatccagtgggagaatagagacattgtacaagtttttgaagttctgatccccaaattcctatgaatttttggtgttttgatccagaattggggtgcaatattttccactgctcgtgctttttctggagggctttaacttatatttctcaagcctgtcaaaaaccttagttattggggtgatttctggccagatggacctctctcatgggtatgacaggctgaactattggcccgagtcctgatttttggcagagtccagacctgtgccatgactgggataagtaggtaattagggattaattagggaagcagagaggtaggtgaagtagagtggtgagaaagtggttcactagcctttactaagaaaaatttatgataggactatgagataactgacttttaaaac

SEQ ID NO: 53040 - DNA, 1258 bp, Homo sapiens
tgctttactctgaagcttttctcacagcaactctaggcatttaaatagcttcattgatccttccaaccctagtacccttttctcttgtagtggtaagggacccattaatgttgattgggaaactgcagtagcaagaatgaccatcaatattgtacaggaatcccacattggaaccctggattggtaccagattgagattctctttgttttcttgctgttactgagctagcaccgaggtaataaattgggccagcttaatttgataaaataggttgacaaactttactgtgtcaacacacccctgctttggtagatttctgcctctggaagaactagaactggtgctgtgttttaaatcaatgtattacagccaagtgcaaatcagcttctgttatgtgggactgatagccttagagtagaattatagacttgatgagagtacatccttgtttctgacttggagtggacatcctggagcagataacgtgaggttttgtagctgatgatagactggggatatttggaggttagctggagaactgaaagaaggcacatgtgtaggactttgtgtgtagggggccaataagaaagtctctgcagcagttaggatagtggaaaatggcttgagtcactgacaggcttgcgtcctgcatccttcatagtgagaactgtgtgcctttcccattcccagagcccttaagcaaagctgtcataaaagggcgattctctccactgcagggaatctggaagtctgcatgcttctggggtgaggcctgtcaacaccttttacagcactaggcacctagtagaccatgtgcttatttggatagttgatagttttgtcctgttaaagttttttctctccttaattgtatactttttaggcttactgcatgtcactgggctagagagggtcatcagcacaaactcactttggggttggtttcagttgctgctgtttttgcaatgtgtattttttttgttacaactggagatggttgttatacgatccctatttctcaaagagtgagcctgtatagctaacaagcatacaataccattttcccctcatccttgattttgttttcttgtcatgtaggcattagtattgaaaggttaaggccttcatcctcactatgctgctgtggtttctattggttgttggagaaaccccaggctgataatactacttttatgttgattactcattgtaacaactgtggggatggtactttcaatgaataccagttgttaaata

SEQ ID NO: 53041 - DNA, 2020 bp, Homo sapiens
gttagccaggatgttctcgatctcctgaccttgtgatccgcccgcctctgcctcccaaagtgctgagattacaggcgtgagccaccgtgcccagcctctccttgccctttagttctctttacctggaatgcccttgttctttatacttaactgaaatctgtctattccttcaagtttcacttcaggtctttcttctgatgaagacttctctgattatcgtagtccaagttgatgtatcactttcccaagctagttttatctatctattgaaatggtaagcttttttgagagaactgttttatagacatttctattattcccacggtgcctcgctcatgcctagccaagtttaaatgctccttacagagcacttataaaatgtggtgaccaaagccaatcactctttcattcgacaaatgtgtatgagcacctaccatgtgtgctgtgctctgcactgggatcccagcaataaacaacacagaaacaagacaggttatactgtagagaaggagacactagacaaatatttgttggtcaacagaatttgtggaagccaggcaggactctaagtgaggacaaatgacaagaagagggagaatttagaaaataagatatcagtgaaacgactattataggaaaaaggtgtttaatggattcattcagcaggtaatttattgaatatccactgatacaaatgtattcccaggtattagggatataccagtaaataaagcaaagtcctttcccttgtagagcttatattctatcatttagaggcatttttgaaaagcaaagcacctaatattggatgaagcccatctgtgggaggacagcagtgaaggagttaaaatgcttctagggctccaggctttgttgaaacagatggtttctttgcactagggaatgtttttaagagggattagaggactgggctgaggaaggcctgagacctctttccctcacgccatagcacacacacctgctgttctggcgcctggtagctatgtaacttgtcccccacttggtaggcacttgtttgcaggcttgtgattgtgactgtagggctggctctaagcttctgacatttttattttcctttcgtgatttttatttgtggtccaacagcaatgaagtcccatttgaatttaacagacgttgggacttgtctgcgttcctttctggtccatatttacttttacataattgtaatctttctgtttgtgtgtgtgtgtgtgtgtgtgtgtatgtgtgtgtgtatttttctcccgatccagttttattgtggtaaaatacacatgacaaaaaattgatcattgtaagtactttaaagtgtacagttcattgacattaagtacattcacaatattgtacaaacaccatgactattgaattgcagaactttttcatgatcccaaatggaaatcccatatccattaagcagtaattccccttctccccaacccctggcaaccactaatcagctttgtgacttgcctgccctggatttgctcattctggatattttatataaatttagtcatgtggccttttgtctctggcttctttcacttagcatatgcacatatttacatgccttttccatgtaacattataaggattttttaagtgtttcgttacagacattataattttcttttttggacacagtctcgctctgtcgcccaagctggagtgcagtggtgctatcgcggctcactgcaacctctgcctctcgggttcacgccattctcctgcctcagcttcccgagtagctgggactacaggcacccgccaccacgcccggctaatttttttgtatttttagtagagacggggtttcaccatgttagctaggatggtctcgatctcctgacctcgtgatccgcccgcctcagcctctcaaagtgctgggattataggcgtgagccaccacgcccggcccagacattataattttaagttatcttgttgataatggcttcatttagccattcatttattgttgaatatttggattgtt

SEQ ID NO: 53042 - DNA, 2718 bp, Homo sapiens
tacttgggttagtgctgctggggccttcttgccttctggcagacagccctcctcccttttttgtccttgctgacccatttaacagaatacttttaatttctctctaccttgctaggaaaataaagaccacttaggaccattcagggccacacactgcttacaaaacccagtgtggagtagaaaaagcactggaggccgggcgcggtggctttgcctataatcccagcactttgggaggccgaagcgggtggatcacaaggtcaggagatcgagagcatcctggccaacatggtgaaatcccgtctctactaaaatgcaaaaaattaactggatgtggtggcgcatgcctgtagtcccagctattcgggaggctgaggcaggggaatcacttgaacctgggaggcggaggttgcggtgaccagagattgcaccactgaactccagcctggtgatggagccagactccatctcaaaaaaaaaaaaaaaagaaagaaagaaagaaaaagcactggaaacaattgctagatcttaaacattcacttaggaaatgccaaacctgtagatttggagtaagaagcagagaggctagtgagagagttcagggtttaggcctgatttctatcctcttccacctaccacttgttgcatttccttcactgtcagaatttgattgttctgtgtctgtatcttcagatgtgtttttcctagtgtatttgaaaaactgttgaacagtcccctctgggcagggagggaagagggttagacaatcaggagtagagactctgttatttctctctccagacctagaccctggagttaactgaaggtccagagttactgaggggcggctgtgtttgtttttcagtaggctggctttactgagtgggatacaagagcccaaagcacaggccattcccagaagcctaacattttcatatttctttctctgccaaagaatctttggttagggttaagaataactagtctgtctgtggaaataccaaggccttttgtttgccagaagaaaagcgcttttgattaaggctgccttttctctctctcttttttttttcttaagctgttgtgggaagacttcagagcctctgaaggtgccgtatttaaggggtgtaggggaaggaatgatagctaaatagaactaagggagacttaatcgtgctttaccgcacatttgtgcagagattaacaacagcaacaaaatctacccagtttttggtcattgcttctactagcctttctttcttcctgtcttttatgaaatctacccaaaacagtagttcccaaaggacctgctgtactgatctgaccttgaatcatactctatcacttagtgtgatttggggcatgttacttaacttttctctttaggctagagttttgcaactataaaatggggattatagtagaccattttcatagggttataatgagaattgaatgagttaatatgtggaaaatacttaggacagtgcctggcacatagtaagagcttatcccagtaaatattactgctactgtgtatggcaaatgctgagtgtagctttattttttcgattagtaattccaaatgtggctttctagggttagcaaagtcagggctttttttttatagaatgaaaaggaagcagacattcccattaggcattaactttttatcagtcagaggcaaagggaaagatttattctctgtgtggacgcatcatagaggctcagtgtcttcttagttgaatgtcaacaagggaatcaatttcatcatgaagaactactctttggcaaaagcaagggcgagggttgggttgtgtactttcgtagtctttgtctgagagtagtgatgtttcttgtgccccaggaaagcttgaaccaaggtatagagaaagggcccctgatcctccaaatttacagtagtaagagaagcaagaaatatcttagtaggaaaaggggaaaccctcagggctgggtctcgtcccagtgactctactaccaggtctggagaatgtcactagtggaggctctgggcaagtgcctggccactgcatttccctggccatagtaagagatgtgcagaatgacctgccctaagtctctgggctgtttgttttataaactgctaccttcttccccaaattgctgggagtggctaaggaagtggcacagaaatttagatttttgtgtctttcttgcccttttctgtattgtctttagtttttagaaggactttcttggctgccttctccctcccccaccttgctccatcctctcttgcaaagtaaaatctcatcttcctgcaggaggttaggttgtaaagtttacacataaagtgaggattccaaataatcaaaattatcatggaaaatatctcaaatgacccagaaattaaagtatataaacatggttttgtgtatatgccagaacaaagttggaataccatatgaaatagttggcctgtaattaggagacattttatatgaaaaaataagtattctcaaaaactagaatcatgtacagcattcagaatgctcacaatgtgaagaggcacaccggacttagacatgctaaagtctcagattcaagtcctctcatctcatgctcatgttcatcctggtaaataacttcactttggtgtaaaacctcattgagtggaattgtgagcaaacttttgtactgtttatttttctcttcctggtcaagtttgcatagtta

SEQ ID NO: 53043 - DNA, 1009 bp, Homo sapiens
gatttttatttatttatttttgagacctagtttcgctcttgttgcccaggctggagtgcaatggcgcaatcttggttcgccacaacccccgcctcccaggttcaagcgattctcctgcctcagcctcctgagtagcatgtgccaccacgcccagctaattttgtatttttagtagagacggagtttctccgtgttggtcaggccggtttcaaactcctgacctcatgtgatccacccgcctcggcctcccaaagtgctggcattacaggcgtgagccacctttcccggcctaactactgtttctatagaaggagttttccagattgatgcctaatgtacaaataactgcatcatcagtccctggctgtcatcattttgctgtgcaaaaagggaacatcagagaggggtccaggagccactccacatatcattcgtaaatgttattgctaatggagagagggatgatggtgggggcaggcgtatttgtgttcatagaggaaggtaggactgtaatctccatgcctagtttctgattggcattgataatataaccatctttcagagagtcagctccaagaggtaactgggaaacatctcagttttgctccgggcactatttcctttgccatctataccagaagctgtggtgaatgggaaagccattgctttctgaagtgcccttaggcctttctcagtgactcttaagttttaagaatcatttgggtgagcataatgctgaaatcctgtagctatgaaagctgcactgccatggcaataaaactccccattgaataagtaaaatggcaatttccaggaatctgggtggtagttatttcaatcaagttgagaaatgggatcaccgagagggggatttccgcagaatctgggctgtcagggaaatctttaggctgtcagggaaatctttattccccattgtcttctccttacaaattccaggagaggagtatgaggttatatttgtgtcctcagtaagcccataaaggtcagc

SEQ ID NO: 53044 - DNA, 1695 bp, Homo sapiens
attcgtttatgtactgaacataatcttagtacctcacagacagtgcacatgtactaacacctttcctgaaaccttaaaatataagaaatatagaaatacaggtagtttgtaagtctttgctcttggggaagccaattttggatttcctttgtctttttgtcctatcatactccttgaaaggggtagtaaaagcatttttctctttttccctctctgtagttcaccccagtggggcacatagttgctggattcagcaacgttctttcccaaatgattcttaaggcatgcgggtcactgaggtttatttttaaatccataacccagggttcagcagttgtccttactgaattcccgtgtggaggctttcagctgcccagacacccccacgtctttactgggcacattccagcagtcctaaagtcctgaccctcaggagtgaaattctggtctggtgtctcactcctggaattccttcatgaggcatggctatggcatgaatcaggtgtcagattggaaagccaagagatcaggtggcttgtgatcataatataaaaaatttctaactggtaaaatggttttggagacttaatgcgtattgaaagtttctttctgctttattgtcagccttagccgcctcttgatggtctctttagttcctttcctggattgtctaggagcatgctggaggcagtcagaacataaggagttaaattgcagtgaacttatggagaatgattaaacagtgattaagtgatattttaacttctgtttacaggggagaaatggatgtcatcaggaaaagggtttgtttgcagttttgactgaagtcatcttatcttagccagggctgcctgcccttattcaatttcatttttagctgcaaggtgaactcccccacacacttattttctgatgtccatctttgtctttgctcatattccaccccttcctttctttccccagaccccgtgttgctctaggaaaacttgctccactcagaacagagttggggtgggacttagctgcccttctgcatcttctgtttctggaagtctttgggatgaaccatacatgggagagtcaggatactggaatgccattgaactagtggaaaaagcactagataggcaattgaagaggcctgggtttgaattccagctctgctacttattagctatgtgatcttggacaaattacttaatctctgtaagtcttagtttcctgttctgtaaaatggaggtgataatttctacctgaaagaataggaattagagaggattagagttatatatgtaaagagcattgcctgacacacacacagtaggcattcaattatgtgtgatcaaagaggtcagagttgatggtagaatttagactgtctcggttagccttttgcctgtttttcccagtgctaattgtatagtttatatattatagtttaaagttatgctgccaggcgcggtggctcatgtctgtaatcccagccctttgggaggccgaggcaggtggatcacttgaggtcaggagttcgagaccagcctggccaacatggtgaaaccccgtctctactaaaaatacaaaaattagccaggtgtggtggcacacacttgtaatcccagctactcacgaggctgaggcaggagaatcacttgaacctgggaggtggaggttacagtgagctgagatcacaccact

SEQ ID NO: 53045 - DNA, 1043 bp, Homo sapiens
gaggtttctgaaagggagctaaatgtgcttattaaatttgtgatggataccccaaagttggcagaagttaatcttcccaatttacttacctctctctgagcctcctcaaccccaacccaaatacacaaaccctgtggttcattctagtgtcacttgtactttctgtttttcattctcttcctcatgctatctctcctcctggagtgtttactcttcttatttcagactgttgaaatcctatacattcttctagtcccaggttatatttcttatctatggaagccttttttttgacttccccaacaggaaatgaccatttcattgactgaatttctgaagttccattcactgagttcttatagtcttgccctcctgacacagcctgtactgctttatgttaagactatctgtatacatatttctccagttagattgtaagctcttaaaggatagtagcataagactggctttgtaattttttttgttattgataacaatcaacatagtacctaggcaactaaatatttcacagaaccacagaattttagagctggaaaagaatttagagatctagaatgtgaactcattttatgaatgagtaaacagatccagtgtagttaaacgatcctgaagtcatttaataagccaagaacagaactggacctataatcgtctctagttctgtaatgtctaaatgcattgataaaatctgatatgtgcttatttagatattctggtttatcaaaggttaaccagagagtgctttttgtttcattcttgttgaaaatttttgtcaatatctttttggttttagtaattaggtatgccataggtaatttcttttcttttctccctccttcgctgcctctctctcttctttctttcttttttcctcccctccccgcccctctcctctctcttcctttctcttttcttgtcttttctttctttctttctcttcttttgtgtgtgtgtgtgtgtgtgtgtttgtttttgttttttttttttttttttgatggaatcttgctttgtcacccaggttg

SEQ ID NO: 53046 - DNA, 1054 bp, Homo sapiens
cactttgggaggccgaagcaggtggatcacttgaggccaggagttcgagaccagcctggccaacatggtgaaactccgtttctattaaacatacaaaaattagctgggtgtggtggtgtatgcctgtaatcccagctactcaggagactgaggcacaagaattgcttgaacctgggaagtggagattgcagtgagccgatatctcaccactgcactccagcctgggcgacacagcaagactctgtctcaaaaaaagaaaaaaacaaaaaacttaaaaatggttacccagatttccttttatgacttgttcagtcagaggcagctgggaggatgcacgctggggaaagcattactcaccaggcacacatagtggccctgactgctggcaagtagtctgggctgtgttaagagtgagtcacctcggggaatggaaaaattgcaaggtactgaggggtaggagttgtgtgccagtgactgctccttttctgtctgctattttctctataaggactcatcacaaaaccataaatactgacgatcctgttgaggcagccgtgaagccaaccaactttatggtgataatgtttcccataaaaggaatgagctgactggacatagcattgttgccttctatgttacaggtgtatatagattttgacacaagcttgaacttgtataatgaaagttccatgtgtgagaatttcatcagaataaaagcaacacagttttctttgttgtttaaaaacttagtcttctgtgtctatctatctttgtccagtaggggtcactgagggttaggctctcaataagagaaacactaatctagtgataaatgagctggattccttgtctattgtgacatctttgtatattcagtactatgttttttaaaatattagagcagaaacaaaaggcgtgaacttgtattaagaactttatgggcgaagcgcagtggctcatgcctgtaacccgaggcgggtggatatcacctgaggtcaggagttcgagaccagcctggccaacatggtgaaaccccgtctctaccaaaaataca

SEQ ID NO: 53047 - DNA, 1089 bp, Homo sapiens
ctggagcctcaagtgcttgatttataaaatggggtaataatatatagttcccagggatattacagggatcaaatgaaataacagatgtaaagatgctttatagtagctgcttaataaattttagtttcccttccaagcaagtccatcttcttcgaccatcacagcccaggagcttcttcacttctccacagcaaggggtgtgtcatagtcatcttggtgtccatggtatctggcacaatgctctgcatcttttaatgaaatgaatgaagtgctttgtttcagaagagagggagctccagcttagtctccactggactatgtcatcaatttttcctttctaattcttattcccttcagcaaacactattacatttcacatatcaagaattctctattgaccctacattgctctctctgctcctgtttacagcaaagttccttgaaggagttgtttttccctgtccttgattattcttctcccattcattagttcttgaatcgctccagtcaggctttttctctaccatgccatcaaaactgcacttgttagagtcaccagtgacctccagaatgctaaattcaatggtcagttctcaatcctcaacttgacatattaatagctcttgcatggttaattgctactttttagaacgctttcacctggcttctgggatagcttactcttttgggtctccctctaatccactgaatcctcttttttagccccttttggttgttcttgctcttccctagataatgttgaaaggcttccaggacttagtccttgaacttgatctcttctctatgtttactcactaaataatgccatctagtctcctggctttaaaattccagcctgggccaggcacagtggctcacacctgtaatcccagcactttgggaggccgaggcaggtggatcacctgagatcaggagttcgagaccagcctgcccaacatggcaaaaccgtgtctctactaaaaatacaaaaattagccgggcgtggtggtgggcacctgtaatcccagcttcttgggaggctgaggcaggagaatcacttgaacccggtaggtggaggttgcagtgagc

SEQ ID NO: 53048 - DNA, 3051 bp, Homo sapiens
cccttgagaagtaccccctaaatgagcagtttgctctcctcgctgatcttcatcacacctagatgtcaggtctgcttcatgggagcttgctctgtatgtatcctccctggactgatgttcaggctccttgcttctcctcccgggttgtgggtatggagggtttgccctctgacaactccagggtacttgtggtgctcatacatcctcatgtactttgctttctccccgcaagaggttccctaatgcttctgtgacttttttcttctggctacatcctgaagtctggccttgcaggcaggctgggaatggaaagttaagagtgtgacgtcctctgacaccctcccttcttgtagaagggtctgaggtttgtttatttaagctgagcagaggatgccaaagatagaggtttgagtcagcttgacactggcttaggcgctccttttcactctccttgttccttcttccctttcccctcccccgctggccagttgtttcctgggctttgtctgagatacactgtacagttttagtcccagtctactagcgcctgctgaaaaacagtcagaagtgagatggaggagaagctgccaggaagtttctgacaacactaagctccggcctctgcctctgctgatagtacaggacaacagtaacctcaggagaaaggcatccagaggcctgcgctgagcttgtggctaactcaagggaggagaaaggacgggcctggaaatgcccctcttagattcatcttatttaccaccaaccatctttattttgactcacgttcttggagttgctggtgttctatactggaagaggcatgccagaggtagagcaggtaactaactggtacccagttattctttaaatctactgtggggcttttgagggtggggtgaatgatggaggtcttcccagttgctttccttaaagggccagtacgtccttcagctggggtgctgtcagacttaagagtgtgtgtgtgtgagtataatgaagaagctggtctgccctggggccactttgggatgggggtggtgctcttttctgttctgtgagtctgtctggagagtgctggttagatgaggtgatgactgggctcaaaactgaagggaagtggctgctgtgctgacttagtctttcctcagagaactgagctctttctttctcaatctcagagtggtttcttggaaccttgtttttaactgaaaacatacagtaactcttttaccctcctccaggtatagatttgggttggagaagtttctgttaacttggtgtgttttggggtgagaaaaggcagaggaggaagggtcagtcagtggaaggggtcgtgcgatgtccttgccgaggggcatcctggaacactgggtgtctgtgttctctttgatatcattgatactgttcctacacagtttggctatgtgtatccaaatcatcttgttcaatgcaaggaagttaatccctctcttccctagggaatcaggctttgataattaaaaaaaaaatttttttttgtaatggcaccagaaccctcattcttcccatattgctattagttatattctgttgacttctaaacactcagagcagggatcagccctgagtttggctgattctgagtctccatggttgaggattcatatggtctaacttttactggagtgtatacccttgggtctcattgccttcagtactctcattgtgatgggctcactaccttcaaacttaggtatgtagacactttttatagtgtatcttacaagttaaggtggggatttgatggcttattatttagctttctattaaaagttcacaaacgcctgacagaattagaattagattcaatcattccccagtgtcctttccagtacgtcccagaaaagcttttgactaaatattcagatcctagtgtgcatctatagcagcggaaacaaagacagacattttagaagtgtgtttgattgtgtggtggtgtttttaaaaaagccacctcaaagtggctttcctgtatttgaacttagaaagaaagagataggcaggcttaagttgtttggtcctatttactatttcacatgtaatgagaaaataaatacaatatcatttaggtagaggctgctgcttttctttccttgtgcattatggtaatgtcatttttaaacattaaataactaattagttgttaatatttttaaagtttatcttcagtataggactttaatggaacttaagagctatcactgtattttaagtgctttcttttttatgtttagaaatgttaatttcataaacagccataaagtaattgaaataaaaagatacattgtaaaagctttttatttctatgaaacaactttgattctaataccaaatagttatatcgggaatgtgctacgtttgctttatctgtaaaatgagagatgtcatttttcaattggaggctatggattccaaatcttccatggagttacttacgagattctgtacccattttattataattgcaattttaagatgcatttcatttatttaaaaatgtatttttaaaaataatatgtacactctaattacctgccagttggacatcacagaataaagtttttccaccatctctgtgtatatatttgtactattaataaatgtacacttgattaaaaacacaaagatcgcttcttctgatgtagtcttttttttttttttaattggagttacatacagtattgcagaacaaactatagcacataggtcttgtgcctaataatagtaataataatgattcaggcagagctcagttgtatgagctcaggtgttaactgaactattataatagtgaagtgggtaattaattcatctctatgtagtaatactgtattactggtttagtatgtgtaccagaagtttctgttcttttgtctcacttttctatttgtgtttacatattatgaggaatgttcatagttgtttttttctttctttctttctttctttcttttttttttttggagacggagttttgctcttgttatccaggctggagtacaatggagcaca

SEQ ID NO: 53049 - DNA, 1683 bp, Homo sapiens
ctctggaaacttgctttcctaggtgctgcccctcctccctccctgccttcaggaacaggattgaaagcagcattagcctgaagaagtcgttctatttagggagctagagcagagggccagtgattaggcccttatctgcagcggggcctttttgagtggtgtggggcagggctgcagtgtctgtcctgacacccacagaggctggacttttctgtcccctggttgggttagaactgtgaagaaccaatagaagggctgggccagctgaatgaaaaagcccttcattgtgtttcttcaacattccagtgtctggtacaattagccaagactcggaaaacaagttggacaaacaagcaggcagccttctactgatggatgaaaggatttctggcacagctgagttaagtgcactgactgtaaagacagagtaggaggatctgggaagaagaaggggactttggaatgccattcctggctgtgaggggaaagaatggagcaacaagcaaacggtatttttgaagctgataaaatttgctgtgataatctacctgggaggctggctgaggcgaggctggctgaggtggggctactctgtaaagtaggtggaatcactggggagttactgactcttcccttttggcagctgtaagtgcggggaagggaaactttctttggaatctagggatctgttcacagtggacggtgagtgtatgagcttgctccattatagtctctcccatcatgagaccttctcatttggttaacactatatgtacttctgcctgagaagaggcacacctgaggagcaagttgttgggcaatggatgcactgttcctgacttggcagtaaaccacttagctcaccagctctcctgcaactaagattcaccacattacaagcttctgctctgcaaatggagggtaactcaaagaccagtttcttcctactcaggtttactcacttcataccttgactggacttttgcatatggagctctcccctctgtacgctctattggtctggaaacacagagttggtgctacttttgaacagcatgcagcatgctatatgcctgagacatggacccagtttttggaagtgccctagggaggagcttcctctctgacctcaagggaagaaggaggtcagtaggaagtggtgggtggagccacttctctgttctgctgtctcctctctacacctcacagccctttttgaggagctgcgaagggtgcacaggccagtagctggaggttctttggtaccccctccttttaggtggggtcagcagacacaggggcgccatgtggccgagttaccaagatgaacacgagttcaacgcccacctggtttgtcgcatgtgctgtatgggttagtatgtgaagttttttttttttttgcttgtccgggcctgaggatcccaaatagcccttgctctcattgactcataggaatgcatggacttcgaagccttgtggtgttacaacctttaggcttgttaaaatgtgcagtggaatagattggggtgccctacttcctggggaacttcttaagcttgcagtaactggcagttaagagcccaagctttgggtgtagaactttttttatagagactgaattcatgctcatgcttctgcctgtatcaggaaaccacttttaaggtatgttgcatagtgctgaaa

SEQ ID NO: 53050 - DNA, 1027 bp, Homo sapiens
acagtgggcctgatatcgtgtgaaaatgtaatggacacaactttagttagctctgatttttccaccctgccttcttatctcagcacacaagtgatactggcgtgttgtgattttgttttttcaggcagggtctcagtctgttgtccctgctagagtgcagtggcacaatgatagcttgctgcagcctcaaactcccaggctcaagtgatccttctgcctcggcctcccaaagtgctaggattacaggcataagccaccttgcctggcatggttttgaggtttttagatattgaactggattcttgtaggtaactcagttctgatttcattttgtgtgtttcttttaccaatcttctaatcatacttggccaattgagaacgctctccggtggttttatgttttagttcttactatgtagaactttaggtgttgcaagttgtgggaaatacaaaaaagtaaatcatgttctcttcaaggagttaatgatctccctggtaatataagaataagcatattaaaagttcagaacactatataattatataagtgctgattgagtgattagcccagtaagtaacatagatatttggaggacacagagactgttgagaactggagttgtcagaaaaggcagccaaaatttttcttaaacacaaatctgagcatgtcattctccaatttaaaatctttcaatgcttccccttacctataggataaagttcgggttccttaagcttgtcatgaaaggtcttgatttggcccataccatcctatctcgccactacctagttgtctttcagctattcctaattatgtgcagttctttgaacataagctttttcttgtctccatgaatttgcattagctataactttatgtagcaactttattccttcccttctctttctggcttatactcatcttttaaggttagatagagtcactcctccttgaaacttcattaagtcccccatatttcctgtccctacccaggtaggcttaacctcttatgttcatgagcactct

SEQ ID NO: 53051 - DNA, 1026 bp, Homo sapiens
ctcctgggttcaagcgactctcctgcctcagcctcctgagtagctggaactacaagcatgtgccaccaaagcctggctaatttttgtatttttagtagagacagggttataccatattggccaggctgctctcctgggcttgtgatctgcctgcctcggccttccaaagtgatgagattacaggcatgagccaccgcgtccagccgtgatttccttttgtaaatttcttccatggctactagttgcctctagagtttgatgtcacctaactctttcctgatgtagagcactttgcagcgtttccaacccacctgtctagcttcatttctaagcactctgttttttgtagcttgcgctatagccacatgagacaactcactgccccctaaacactgtgtactttcacacctccttgcttatttatttctctccctagaatgcacgtcccagcctcctctgcctgaccatcacccacttcaccttctaggcccagctccagtatcaccttcctgagattctgacctctgttcctcagattaaatcaattgcaactccatctgtatttcatactgccttgaagagatgcctgtgtgttcactcatcgatgttctctgttacagtactcattgaggactgggattgtattatgctactttctctgttaagtgctgcacatagcacatgagaagtatccaataagtacttgttaccttgagtaactaatatttcaatagtgttatagcgtatgaagcacattcttatctgtcttaatccttaaaataaccctgaagtaagtaaaggtgttttatccccttaattttaacagctagggaaaatgagaattagaggagtgaagtgactttgccaaaacgatacagctagtgagggatggagctaaggatcaatcaatcatgaatcttctgatcaaaattacttgttcttcctgctaactatgcccccagctgattctttttttttttttagacaatactgatattaattaaacgtaaggtaaactccaggcat

SEQ ID NO: 53052 - DNA, 1037 bp, Homo sapiens
gaccataacatctcagaacctcagcttccttggtttctttgatggaatggtggtaataagtaaacttcacaaggtaattgtttggattaaataaatagaatgagatgatggctgattataaagcatagtagttaatggcaaagactaaaatcagatgaaactgaggccggtttttccacttggtgaccttgggcaatttacttaacctctttgtgccttatttcctcatgtgtaaaatagaaataataatactacttaccttagagatgtgagagatagataacatattaaacatttagtaccatgtttgatattaaccacactttctcccaaagtgagatctgtttttccatagttccaattttaaagttaattggaatttcccacaaagaaaattattctgaaattcgctattagaaatatttggtgtaagagaagggttaaattggaaatacaccccaggaaacactgggtgcctagcatttagtttcctttgcagcactctagaaggcttttctgactctggctggactcatctacccatcattcgccatgctattacattttggctcatagtaactcctaagatgtctcaggataattaagactccccatcttcttgtccaaactttctaggacgttgttgcatgttggttagagtgtgtaatagatctggcatcaatttaaaaaacacacacgtttctggtaaagtattatcatttcacatgtattttattccaatctgaaacttcctgaattttattatttaattgttgcttccacttttaaattctttaatttgtgtttacctagaaccagagatttttatgtggatagtataataattcaatatcaaataaaaatctgtctgtttcactctcattcacaggtccgcaagcacatcaatgatctttatgaagatctgcgggatggccataacctgatctctctgttggaggtcctctcaggcatcaaactggtgagcttctcctaatgaatggcctcacaattgtggccctacaaatgacatattggtc

SEQ ID NO: 53053 - DNA, 2508 bp, Homo sapiens
gatattcagctccttctaggattggggcttggcttccctgggtcctttgttttggtttcgtatctttttttttgccttgcaatagaattaattatatattttttaatggcctaaaattgacagaagcttttattagcatagccggcacatttaatttctagttcttgctctctggctcgtgtttataagtctaataagtaatcagaattttactttcattgtgctggactttattcttcaccactcacacagttacattttgggcaatgtgtctggtacatttaatgaatttgtaatgattttatattgaaaagtgatcttttttggttgtattgcttacgtaataagttgaaactatgtcaatctaatttcttttcctaacctttgaaaacctttaagtgtttgtggagatactgataggatatcatctcttcaccaaaaaccatccagatatctctttgacagttattctcaccatgttttttccccatagttgacttagaaaagcagagagggtaggaggctaaggagaattgaagatgtgtttcatcataagaagtgttcaatgtaaccatctgctctggttttgatttagttttgtatctttttcggaggtgggagggtattttcatatttgtttttccttttttttaagtgttgcattcatttcctttccatctttttattgtgaatttcttgttcctctattgtgtctttgccttggttggtggccaaaggagccagcagggctgaagaccctccgtctggtgagcatgccctcctggtgccatacaaacaacgaggagcaggcggaggaagatgatgatgatgtagtaggtcctcctggggatgccagcatcccagctggcactgctggcactgcagggccatcagagtctgaggttctccaggtctcgaagtagttcagttactatttgccaccttctcatttcaactgggaatttgggtcccaaagaaagtagttaaaactaattgtgccttttgtcactgttaggtgctcatggactgggaattgtttttcttagctgagaagggttggcacaaaaagaataatggtttttggaggtgtcaagttctcttctgacctggagacccatagctttctggtggccttgctgtgttttctgagtccagattgcagaattgtggaaaatttagttgacagcatgacaattaattgctcacaactccacagtctagactaactggtactctccacctctctggcctctaggttatcatcatacaccccgtcatttgttttcaaaacagcctgtttgcaaactcactgcatggagatactctggctttgctcaataatatctagttgctatagaggacagagatttaacttgcatgttcttagggtatttatttttggtgaggggtacatatgagtaaagattagagtataagaggagtgtattctgcctgcaggccctaaattatagtccaaaatctttttccagaaacaaggattaggcaatatcctcattctctgtcctcttaaaatcattttaaaaatatcatttgtctcccttctcattgccttagaatcttccattttataggcactatcatcttctaagccatattcacaattaatttagctgaaatgactgagaaaaggttcttgctaaaaagatttttcctaaacctttgactgaagaagttatcctgtgcccagagaggccttgacatctctgtgaacagattctcctatttgagaagtgttgcttagaagtgttggagagtgcccagaagatgcttccatccttatctctccatgtgttagggtactttttgcccattttaatttggagcaatgttgttctctgcagacacccgcaacagagctaccttatattttatcagcctttaattagtgtcaatttgacacttacaaaagaagtgggtataatctagtgagagtgatatttctctccaaattttagtaaaatataagcaacgttagaaagtaagcagaagaaaatgttctaggggtagatatccctttctgtgatactcagtaggcaaagagactgcattcactttccaactggtaatagttgagccttggacggggtaccagaggcactgggtagagatggggttctctccagtgggttgtatgacatctgggattgagtgactggcataactttctcaggagtaattatgttgacagccctacactatcaaagttttgtttgctgtgggtatttcatgctggagtaaagggtgcccttccttcagtggcagctatgttcctgggaaactggttgcttcctaatttttgcctcccattttggattttttcacttgtttcttgagcatatgtaacttctcatttcctatggttaaaaatcagctatctgtattttttttttttttttttttttgaggtggagtctcactccatctcccaggctggtgtacggtggcatgatcttggctcactgcaacttccacctcctagatttaagc

SEQ ID NO: 53054 - DNA, 1311 bp, Homo sapiens
ttagcagagacggggtttcaccgtgttagccaggatggtctcgatctcctgacctcgtgatccgcctgtctcagcctcccaaagtgctgggattacaggcgtgagccatcgcgtctggccggcagtttcaaaatcttgcatgctgcatgatcccatttatccaacactctggaaaaagcaaaacaaggaatcaggatcagatcagtggttgtcaggaattaggggtgagagtagggtttgattacaaggagggggccagcacaagggacctttttggggtgatgaaactgttttgtggtggtagttgcatgaatctatacatgtgttaaaactcatagaactgtacaccaaaaaagaaatcagtttaactgtaaatcaataatgaagtgatgcaaaaatttaatcaaaacaaaaagtcctagagctctgagccgtgcttttatttctttttcaggtgaaactagtgaatattcgcaatgatgacatcacagatggcaaccccaagttgaccctgggtctgatctggaccattattttgcatttccaggtagggcatgtgaagtttggaattcctgttgctttgtttggacatggcctagaaagttgcactgccttccacagacagcattgagccttccttctctctatttgtcagtgaacaaaggtggatgggagttggaaaggaaaattaagattgatctgcagacaagctgttgtatcgtaaacgcaaaacttcctaattatttgcttaattaaatggagggatttttttacccatttgtggtttggccctgtcctcagcagtctggttattagaggtctgtttgctcagctgaatcaaaatgaggctcttgaaggactcagaatatgagggttgagaaaagctgttggtgttgatgctttagaatggtggagtgaaggttcatagtcctgctctaatgtagactttttctcatctctaataacctttaaacaagcctcgttaattagaatactttagtatctgggtttgtatatgtgctggcaagcacaaccttgcagcggccatcacacccaagagcatcttgaagaatattcacatggtcacatggccttcctcttcctaagaaggcaaatcctttttagatctgaattgctattggaaaagtacagccctatttttataaaaaggctgttcttttacatcccttttaggtcagccaaacaaagctatttctcagacagctctctctgatacacagttgctgcacatgaggctgatggattagaggctgatagctagtgggaatagaaggcagggtgccgacttca

SEQ ID NO: 53055 - DNA, 1248 bp, Homo sapiens
gctggagtgcagtggcgcgatttcagctcactgcaagctccacctcccaggttcatgccattcttctgcctcagcctcccgagtagctggggctacaggcgcccgccaccacacccggctaattttttgtatttttagtagagatggggtttcaccgtgttagccaggatggtcttgatcttctgacctcatgatccgcccacctcagcctcccaaagtactgggattacaggcatgagccactgtgcccagcatgatttgttcattttaactaatttaatgtaagtggtgacccctgcagctgtgtaacacatctattatttgtaacgtattatttaattgtatgaataaaacattcattgctacagtgaacatctgtgtatatgcatccttgtgcctatagcaaagagggttttgggattgatacctggactggaattgctgggttatatactttccttcagtttgcctatattttgccaaattgctctcaaaggtactgtatgacttacagtattgtattgggtaacatttactactatttgacatattacatgtttacttgtttatttgctgcctggatgcctgcattagtatgtaagcttaacaatggcagggatttttgtctcttgttcttttctttgcctggcatagaataggcagtcagtaaatatttattaaatgaatggattgtttcatgaatttgatcttctcaaagctttggagtaggtagaccaaataaataggctgtaatgtctgttttcttatgcccatttctcagataaggaaactgaaacacagagaccgactgacttttttgggttacacacccagataggatttcttttttttttttttttttttttgagacggagtctcgctctgtcgcccaggccggactgcggactgcagtggcacaatctcggctcactgcaagctccgcttcccgggttcacgccattctcctgcctcagcctccccagtagctgggactacaggcgcccgccaccgcgcccggctaattttttgtattttttagtagagacggggtttcaccttgttagccaggatggtctcgatctcctgacctcatgatccacccgcctcggcctcccaaagtgctgggattacaggcgtgagccaccgcgcccggccaggatttcttgtcttttggctttgtccaagcttgttttaaggtataggttaagatttatagttcttctaaaagatactataaactctttatag

SEQ ID NO: 53056 - DNA, 1179 bp, Homo sapiens
gcattttgaaattttcaaaaaatgggaggtcttagctggctagacttgaggtttacagttttgtgcactttatggcacttggtgcttggcatatagatgaggcaccatttgtgtttttggaatgaatgaatgaatgagttcttttgctttggagtctttcactctggctgtctctgtgggagacctgtgggcagtaaacagttatctacaaaaagccaaaggagaaggcataaagaatgtataggcctcaaagtgtgctttcccagaaggcagcaagtcttgtgttaagagaccaggttagatgagaaaaggtcttggggaaaggtctcgtaatcagaattaacttagttgaaaatacatctgatatacctactgaaaactatagtttagcctatcttaaatgtattccgaacacttatattagctaaccgttgagcatttggccaaaatcatgtaacacaaagcctgtttgatagtaaagtgttgactagctcatgtaatttattgagtgctgtactgaaagtgaaaaacggaatggttgtgtgagtacttgaagtacagtttctactgaatgcatatggatttctcaccactggaaagtcgaaaaataagctggaccattttaagtcagggaccatctatatcttaggatccccccgggggctggggatgtctcataacttttagttccagtaataaatgggaagaaaagaaatttactgtaggtcaagtactgagccaagtactttatggacattatctcattaaccttgtctacaatcccagtaagtaggtggtagtatgcacattttacaagtaaggaaactgaaccatctaataaactagttaggttacttaacttatgagctgggaagttgaacctaggtccaccttactgaaatctctgctccttccctagaccagtttttctctggagcagaaggaaatgaaggtctgattggtctgacatatgcagaaattttaaaaaaagaataggctcacagaagtaaattctcagagaaactctacagcagtagtagtcatattaagcagctatttctcttgcctctaagtttattagtttcaggattttggtttgcttgtatgtcattcataaaattcaagtgcatcttaaagttcccatagttccaggtttcttcactggaggagtgaaggcct

SEQ ID NO: 53057 - DNA, 3020 bp, Homo sapiens
cttcaccaggcttggttcttcttggcccgggcccttcccttcccttgctggttagtaccagccgagctggtttgctttttccctttttggtactattctcctcctccttcctccacgttaccttctgccacggcctctcttctttttccctccattttcaatttacacttacattttccctcctcctcctggccctccctagtttttcccctcccctggtttctagctcctttttgctttctgtttgtgttactgagggcagtgctccaattacctcatatttggagagaggaagctgcagccaatccggtttctgtctgcttttaggtcaagtgatttctgaactgcagtgagatgctttgaatttgtcttgttgcagctctgagcctgtaagatggctgtctgaatcggcagcggctggaagagacagagagaggcggggagggagggagaaagaattggagggattgccggcatagtgcatgtttttaaatgtgcatcgaatccgatgaggccaaggttgggatttctgtgggatcccaggactggcttagctgcgtttttgctgagattaggagaggaaggaaatgggaaattcactgggctgttttaaggagccgaaagagtcaatagctattcctgagaaggctcccatatctcctaagaaaagggttcggttcaaaaggaggtggagagggaagaaaatccctactccagaggcatctcaccaggaagaaacctcagaaggaactggagtcattgaagagactgaaaccctaacgaagttaacagagagtctccaaaaggaagacggagtgggaggggtagagcatacccccccagatattttgctgcctggggactcagcccccaactcacgggtagtcgatcgggggatgatagtacaggtaaaggagagattccaaggggaggtccagaccgcccaccttttgttagagaatgagtcatcagttgctggaggggtctgggattccctggaagaggggatgactgtcattgctcacctgcttgataacccagcagaaaggaactgcgagaagtcagtgagccaactggtggaatttcctaggacagcatcctgcagcagcagggctgtgttgctgcctttgcaaggagagactgcagtggagaaaggaaatattcagcgtgggtttcggagctgtgctttgcctaggacagactaccccactgataaaggaaatcaagaacaattttcagagggctggagtgtggaggaaggaaccaagagtgtttcaggtgcccctcagacagcttcctggattatagaatgttctgtttcttcattactactggaccagcctggaggccaaagacgcacggagccttcccatgtgggtcaagtgcccccccaggattccagactgcctacttctcagagtgatttgtccatcagtggtgtgactgtgagcattttgccctcctcctctggctatggcagtgatgggccacacatacatgggatccagcctaaagatacagaacctgaaaagagctctacttccttctcagaagaggatggcactctttctctggaggcaagccacaccccatcatggggtctggaagaggtaggtgggcatgttcaagagataatcaaactgctgtttggattcttggccctcaaacatattaaagctgagtgtggtgagcagtgaggatgttggtgcctctcaaacttacccccatgtgggttagtatctgctggagctcagcaagcagaatctatttcaggtctgccccttgatgcttgaaaccaagacttgtctctggggaatccctgattctgagtagccaagtggcgtaattgctcaagctatctggtgggatgatctctcaaggtgcaatgctagatagtacttactctcaggcaggtctgtttaccagcttccctgctacgagaagttgtaatgtagcacaagagacgatggggaagggcctaactgaatctctggaatgaatctctggaataaatgtggaaggggtcaggcagctgttgtcagtgtacttgctcttcctcacaggagagtgatattcttactagagctgatgcaatcccatccctgttgggaaatttctgacggcagcactcattcagtatttgtataggtggagagggctcatccttctttggttcctaattccaggattagaggagagggacagagttatctggggattagttgagagagagagagggaggttagggcaatttgaaggtttaaggctagaaaagtttgttttgtgactggatgtatttagggctttaacatgattttgttttgaggaatatattgaggcatggatggtgctgctggtggtggtggtaatggcagtttctgtgaatgttttaaaggtcaaggagcaagtgagaattcagagatgtgaacactgagataaggactcagcaagaccatgggtagcacagcatctggcatgtaggtgtgtgattgtgtgggtgattgaagttataattcaccaatggctaaagaacttttactgggatgttggcctctgcagcagaagaaataaaaacattaggacttcaaagtgcaaaatttataaaatgaggtagggcactttccttgcctagatgggggccactgatactgtacaggggccctgatgtttgcagagcagggatatggtctacctactggtgccctgcctatcactagcagcataaggctgaggatagatacaaattctgagcaatctgtgcctagaatttcctctttggggatacattttccccacagacagccccatcttagtgccctctgttattagagtttggagactcccaacaggttgaagaaaaagtggccattgaaaaaatatctattttatggatgggcaagaggtttcttgggcctcatataaacatggatatgtgtggtggggagtgtgatagttgtgttatggtaggaaggaaggcagtgaaactactgggatatggggcgcatgaatgtattaagcta

SEQ ID NO: 53058 - DNA, 1104 bp, Homo sapiens
ccaccaggtcccacttccagtattagggattacaattcaacatgagatttggtagggacacagattgaaaccatatcaacaagtatttgggtttcatcagataaaaaagaatgtcaaagtcaacttttatcttgtaaaagttggaacagatagagtagttgggggtaaaaccagctgtggaactgattgttgtacaactggcattaaaattgaaattgtgtagtcatcataacattataggacacatgcttgtaactgagtgtgagattttcagaaatttggcatataaagttttaggaactcctagtaaaatcaatcctagataatagaccatagatagcaatggcacctttgtatgggctggatctccacactggcaagggaatgttctgcatgagtctgtgaggagtcttaaagaaaagattgttaggagaaacctttggaccatgatctgtagtgtgaccatattggcaacagtatgattcctttgctgttcagtatgattcaaattggtgtgtggcattttctgggtagccaacctctgcatctattccttctaccttttcactgcagacacagtcatactacttatgtatagccaaggctgaaaaactaagtgaccgagtctcagctcagacacctggcatatttccaggttttgtgtccatcatgtgatacagggaccacagactcaccatcctatatgacagataagaagtaacttatcaagataagtgtgacattccttcagaatgaaagtccttaaggccaagaggctgcaactctcactggtccctgaaggaactgtcttcagggagctgctcccctccctaacaggctgttcacaggcttgaggacagtagcagccagagaaacagagagggcaacgcatactgaaaccgataggcagggcaagagcatctctgctaaagtgggaaagctgggagggcaagggtcagaagagcagctgctgctgttcacacaccaactcctgtctaaacaggagacagctggcagtccaattgagttgttttttgcttgcttttttggtggtggttttgtttttaatatgtcagagtagtaactatcctcagaaaataattt

SEQ ID NO: 53059 - DNA, 1060 bp, Homo sapiens
catttcttgttattaggcttccagggagcttatagtcagttcatgaaaaagggtgaataaatctatgtcaccatctgctagttcaatcactatcatttttttgtagagatcaactgacataattgattaaacaaaaaagaggaatgaaaaatctaagaaagttttagttattgttcctgggaatataatctcctaatttgaagtgttgaaagtaattgtatacaagccttaacattaaaatttttttttgaatcactcacattgcatatgaaacatacacatacattatggggatcacaaataaacacagcagaatgaatgaaaaaaaaaaaaaaccctaatccagtgttatgtaactggactcttgtggtttgaaatgaaatacccagagacaatgtagattcagaaaagtgctgttattaactttaaaatcttagaaaagtagacagtattttctagaaaattcactaaaaagatagctttattgaaggaaaaaacattgatgttaaagatgcatgtgaagtttgaataatacagttttttgaaattacaaaggcagaaaatacattaatactaaatgcttaaatatactgcttaattttaaatatgtgtatatgtgtaaataaatttctaaaagtttgggtattcaggaggactacagagcttcccttcctgtattcctgttttaccttcatacatctgttgttatctgggaaaatatttgggataatcatatgttagttatggcatgtctcaactaagttcttgcaggccaagcatgtcttctttttttgttttccacctttttacctggccaacttctacttattaaaactcagcacagatgttgttgttgctgagcaatcctctggcattgctagtttggattacttgcttacctctgtcacaacattgatctctttgtatagtaaattgtctccctgattaaattgcttgaacttgaggcctgaggctgtgtttttttattttgagatatcaagaatttaagcacagctcctagaatataatggttgctcaaaaaatattaacagtataagta

SEQ ID NO: 53060 - DNA, 1033 bp, Homo sapiens
gggatccaaacatctatctcattacaactatgtttaaaatctgaagtaaagctgttcattgaagtagttttagtgcaatatacagaaatactaagaaatgagagatgttattagaaagattatggctgtaatgaacatacaatatcaattaactaactggaatttcatttttgggtgaagaacccaaatactcagattttgttttgcttattcaagttctgtcttgttttacatcaacaaatctatttcctgttcccaataatgttttactttaatatgtacgtgaagcagctacagtgaaggcagtgggatatatcaatgttgcatttagccagtgaaataggtagctagaaatgttaaggggaactgaaatagaattggtactaggaagaagctgtttataggaagagccgtgatccattattgtgtccttggctctgcagctccatagcttctctccccactaccgcccctcccccagccccaggtagatctggagttgattaatagttttagtaaactgactcacactgatcacatttgcttgagattggtctatgtgaatttattaatttacaaaataaattttaactgccaagtgattcaagaatttgaattggccacttactgcttttgttgctttagaatatctatatgggaagcaaataataatctgaaggttgtcaggtgaacatgcagtcagagcagagaggtggtgagtagaggaatgatttgtaggatgggcttattagctggcatcatcaaagtagaatagtctgatttcttctgtagaaatgtacctgtcaagggcataagatcctatgtcccttgaatctgctgggtagggtacagtttcaccttcacaggcatggaggcagtacttcctggcttcccttttctgtactcaatgcaagcttcccatactcttctattctcacggtctttcttcagacatcttagtaatatttagtagcctgcagctttcttttattctaaatatagtgttaaagttcctggcccttttttttttcca

SEQ ID NO: 53061 - DNA, 2278 bp, Homo sapiens
ttcttaagcacttatggtatactcatggtatcaaactatatatccagtatctttatcatacatggacattatccttggccctggaaatgagtctagatattgctaattttgtaacaattagcatagactatttggtgctaaatgccagcaaagaatgtctctttcatccccagctgtaattcaagatgaggaagtgttttatcagtcacttatgtatcagcttgattaggtagatcatggctcttttcagaatatttttagtagcttggtttgtagcctttcttagtgtcaggaaattgaaccccatcctgagagcccttgaggagctttgaagctagtactgtgagcattaaactgagcagcatctaggcaattaaaggaaatggattttatatagtttggagtggcctgagctactttctcttgtgcttgttttggatattgctaatcaggtgtgtgatgtttaccttctggcaataggaagtggactccaggtggcaagaataccaaagccgagtggactccctcattccctggatcaaacagcatacaatactgatgtcagataaaacttttccccaaaaccctgttgaactaaaggtaaagtcaaggacttaaatttttttggtaaaatctttctagggagtaagtctccaagcttatcactgctggcttctaggtgaggtggtatgaaaaattgggtcctatagtttgtgtccatttattcaccaaatattaattttataggcactttataaccaatatatacacttcaaagaaacagaaattctggccaaggagagagaaaaaggaagaattgaggaattatataaattactagaggtaagtgagcttatcctttgctgagacttggggtttgctggtctgtactgttgttgcttcttgattatagattccttgtattcttttcccaaactgcattaatagaagtactctcctggtgacaaataatagcaccactctcaggctggtcttaaaatgttgtggtaaaggggcaatgtcagccatctctgttttttaaagggcttattgaaaaatgacatgtatttattcagaaatcttgagttttgtggacaaatttttctgcttctcagagggaagctaaatctttccctagggtggaaagaagagagacttctattcagaatttgattcccagagaatttgaagttgtagaaatgagaatttaaccttgccagaataaaagttattgaggggaaaggaggatttatagaaagtgtaaaaggaatggaatgacttagagtaggtagtccctacattctagaggtgacttttctgctctttaactcaagggtgaagaacctgatacatatttgattgtttttccatgttagacaataggaaaaactgctgaatggctgggtaaagaagcaagaagtgatgtgcaaataataaatcaaaactgggacaagagggcatggctgtgtttttggactgaaagagtatctgtttcaggtgtggattgaatttggccgaattaaactgcctcaaggttatcaccctaatgatgtggaagaagagtggggaaagctcatcatagagatgctggaacgagagaaatcacttcggccggctgtggagaggtgggtccagatcctgagagtggtctgacattatttattgagctgctgtgaaccttgcacatgactatggttttatcttatttcaggctggaattgctgctacagattgcaaacaaaatccagaatggtgctttgaactgtgaagaaaaactgacactagctaagaatacactgcaggctgtaagtctctgactgttttgtccaacatctgtgtcacatgtttcctgcttctcaccctctgctctaattgttgaagttagcaatcgaggaatccagatgtattatttccctttttttttttttttggaattgcagtagacttcttggctccctctgtcctagtgagtggggcaatggaagttttcccactgttattctctcttcctgtctcaggatgctgctcacctggaatcaggacaaccggtacaatgtgagtcagatgtcattatgtacattcaggagtgtgaaggtctcatcaggcagctgcaggtggatctccagatcctgcgggatgagaattactaccagctagaagagctggcttttaggtgaggaacaagggactcaaatggagggcttgcttgcttactgctgaggctcatggatcaagagtagagcaagagtcaggcacttaatcttttaacctggacatt

SEQ ID NO: 53062 - DNA, 1137 bp, Homo sapiens
tgttcataatatcaccttgtattcatataacactttctaaacacttttccttctatgatctcatttttatttttatttttatttttatttttttgagacaaggtcttgctctgtcacccaggctgggacgcagtggtgtgatctcggctcactgcaacctccgcctcctgagttcaagcaattctcctacctcagcctcctgagtagctgggactacaggcatgtgccaccacacccggctaatttttgtatttttagtagagacggggtttcaccatgttgtctaggctggctcatttttatttttatcatatctttgtcaaatggataaggaagattttatttttaaaaactatactatagatttaaatcctttccttttttctcttcttccatttcagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgtggccatcagctcctctgaagatgaaggcaatctccgatttgtgtatgaactactgtcttgggtagaagagatgcaggtgggtgcatatccaaaagcttatgcagtacactgatgtttactggatctggaagcttatctaagaggaccaaattgctttgtgttccctgtgcagattcccttaattattattattcttttatttgagtgatggggtcttgctatgttgcccaggctggactggaactcctgggctgaagtgatcctcctgcctcagtctcttgagtagctgggacaataggtatatgccaccatacctggcttgactttcttaattattgatgctgcctgagacccaagcccccttctccttaaatcttgcatggatgaggttggcacaaattctcacagtcccgtactgaatagcatacagttttctcatttgaaaccctttggaatcttttccctcagctaactgtactctgagtgagagcttggtgaaaattgcaatgtctttacatctgttaccttttttttt

SEQ ID NO: 53063 - DNA, 1048 bp, Homo sapiens
gtcaaggaggccaggttgtatgaggtgcgtagccttcagaatccacattacaggagggacgtggttggaacggatgaaaggacagtacacacaataaagctgtattgaaggaggagggtgctctggaaaagaataatgatgatgaagagcggtttatgacaaattcccttttcacatgaagtgtatctgttaatctttgaaataaacttgtgagaaaagtatttttattaacccctttttactaaaatgaaaagtgatactggaagctgaggtcagaattagtaagtagtggatgcagcatccaaactcaggccctctgcctctataaattcaggcactttttacttccccatctgcctgcagttgagcgctggtttagagaaactattcacacagtttcctctctccttcagtcactgttctatcttcccagtttatatttcaactcttcccttcaaaaaagcagttgagtgggaatcaggcattggttttgcttagaagcctaccagaattgctggaaacacaggatagtgaggtctgttgtttgtaattaccctgctcaactgttgctcacttagtgctgctccaagttataaaatatgactcagaaatttgttgtctaagcttctgttttcttagagcaaccaatccatatctctatctagacataatatttgcatagttgcaaccataacacgtagtttacttactctttctctaatgtatttttatttcattcttttttaatcagggaaagatgtcccagaatttccataccagctatgctgaaactcttggaaagctggagacacagtattgtaaattgaaggtgagtttctgccgattctcttacattctgctcatagagtctggttccccccaatcaactctcttccgtaattcagaaatctcctggtttggccctgttttggttttctgcttattaggttatatcatttactatgcacttattcatatctattataacattttcccaattttctaaatgggtcagaaactactgttcttgaacgttttaaataaatag

SEQ ID NO: 53064 - DNA, 1069 bp, Homo sapiens
attcttctactaactagctctataaccttgggaagtcatttaatctctctggacctccataaaatgagataatagcaccacttcaaagctaccccctcccctaatagcacgtattccccaacggttgcataaaagattaagatttaataagctaatctagacaaagcatttagtctagtattgttcaactgggatatactctggactttccacaaatttctgaattctccttaattcatttattaacttttttgtttcaatctcttcgtttgtaaaaatgggaagggaaatttaacattggacaataggacactgctttttattcttttcaatgaaagatgtagacaagttaggattagtttttgctacttttagtattttcacactcagaagatttttaaagattttgtaaactatgcaaatagggagtttcttgtttttgtttttaacatgcactttagacagtttaattctattgatttagggttcttaaaaaatataggcttcttctgattggagaatggcatatgattctactgaattaaagaaggaagattggatactataatacaataaacaggctgtgtgagaactgaaattaggctataacagagatataaagaaagtgctctgaaagcatagtaaggatcagtatccagcttcacagaagagctatttaaattgagtcctgcagttaatagaatttagagtcagtggaggacattgtaggctgaatagtctaagcaaagccaaccagtcattgatacccatgtcctggtgtgtcatgtactggtgtgggtactgacgtgcaggaactgtccactccagccaagttatctcttgtctctggtccaatgcttattctgtgttcccccattttactcacatctgggtcaggtcccatgtcctttgtgaatcattttccaataattccagtgtttgtgcccttctctgcaatcctctggcatgcactgtttatacatctcattttgccaccaattctatattgtaggttcctttaaaatagggaacacagcttttatttatgctatccgctccccactgccaa

SEQ ID NO: 53065 - DNA, 1023 bp, Homo sapiens
acaatagaaggggcattggctcacagctttcagaggaaaagtgacttggaccatatttcttcaaataactatccagacagatcctgacttgactcttgttggtgtggtgcctttgccaaaagaagagaaacagtggaagaattccagaggaatttatttatgcctgggttttgctgcctagatcatttacttacaactgagtgtggaagagaccttttctatgtaaccccctctaacaaaaccattttggattaaaggaacacctcttactcgtgggaagcattgagcagatgccagtcaagtatctccacatcttttctgttggcttctctatcattagcagagttgtacttggaaaatagtattgcgcatatatattgagtctgttaaactcaagcccttctgtctgtgtgcttgtttattgcaggcttacagtgctgctgtccagtcccagttgcagtggatgaagcagctgtgcctgtgtgttgagcagcatgtgaaagagaatactgcttattttcaggtgtgatggatttctgtgtttgtgtgtgtgtgtacatatgtatgttaaaggtgaggttacaaacacatctgcgttagtgtgcttttgttgtataaaccaccaccttaaaatttagttgcttaaaacaatagtcatttagatagctcatgattcagtaggtgagcagtttgggcagggctcagctaagtggttcatcttatcttgcctgtcttactcatggctgcagacaggctgggggctggttggtcccaaatggcattgctcatgtctgagagttggctaggtgctgaagcaccaacccatgtgtctctagcatccagcagctttcttcacaaagtggctgtgtttcataagcagcaagagagagcgagtcctagagcacaagtcctttttttctgcttgtgtcacatttattaatgtgcctttggttaaagccagacatgtggctgtgcctggcttcaaggtgaggagaaatagactccacctcttgatgggagtag

SEQ ID NO: 53066 - DNA, 1056 bp, Homo sapiens
ttgtattcccatagttcttcagtgatgcacgagagctggagtcattcttgaggaacctccaagattccattaaacgaaaatattcctgtgaccacaacaccagcttatcccgccttgaagacctgctccaggactccatggtgggtgttgcctcagtggggatgattacttctgagaaagagagtaaaccatatcagctgctgctgtttatatccttgaaagctccagggcaatgggccattgttgtaataaagtttggcttacattcaaatagagtttaatcgatgttgttctgtctctttcctttttttccttttcttttcttaaataagttgctaataagatttctttgggtatgttattgaagtaaaggcctagtcttctcctctgagccactttgagctcattgtactttctttgcatttttcttattttaatgtaatagttggagccaaggatgaggtgttgagcatgaagaaaaggttgaaggggattagttgatatcaaattcttttttactctcttatgcaaaaaaaaaaccaacaacaacaacaaagaaatacacctgagtcaaaattttcctccttggtagttttcttttggatgataattaaaattgattttaattcaaagaaacattaaaatcttatttagatgtaatatttgtgcagttatttatgaagcaatattaatttttaagaaatagttttacatttagtatttagttcaaatcaattttatattctttttctccaatgaattatttcttcaggagtgctggtaattaaattagcagaaagactacttatatttagtgaatgtatattacacagagttggcaagacaaggctcaagctacatctcaaattaaaatagaaatgtatatgcaatagggaacttacttttcctttgtgagaagtaaggggaatctcgcatttcaatagaaaagtctgaataagagaactagaataacccaaaacagttcattttttttgtcggtaaaatttgagcatttgtgaatttaagtttttttatttttatttttttacactttca

SEQ ID NO: 53067 - DNA, 3376 bp, Homo sapiens
ctctgagggagtggagtattcagttttctttgttgacttagtcaccctgagtagcagcattaatgtcattttgtttttcttatcattttgtaggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgaggtgaggaggtagaaagggtacctctgggccacagggggaaggaagaaagaagggaagccttcagttagggttatgatgataaaagatcaaattacagcgtttttaaaattagaatttaaacatgctgaagtctctcctatcatttaaaaaaaaaaactaaactaaaaacttcaacactataatcttgacctgctccctgcctcagtgattggcatcattatctactcagttgcctaagtgttgacagagatggtactttgtagcacttgggagatatccttgactcccccacccctcttatcctccacagctaataggaccatcaagtttgtactaatttgtaaatatcccttaaacgtactttttctatccctgctaatattaccctaagagcataagtggctgggtggagaggctcatgcctgtaatcccagcactttaggaggctgaggcacatggatcacttgagctcaggagttcaagaccagcttgcgtctctgcaaaatatacaaaaattagccaggtacagtgacttgcagctatagtctactcgggaggctgagacaggagaatcgcttgagccgaggaagtggaggttgcagtgagccaagatcgcactgtttgcactctagcctgagtgaaactctgtctcaaaaaaaataaaaggcataagtttctttcacttggattattgtgtcagcctccccatttagtgcacaaaggatcctaccaccagcatgttctttttttaattttaattttatttatttatttatttatttgagatgaagtctcgccctgtcgcccaggctggagtgcagtggcacgatctcagctcactgcaagctccgcctcccgggttcatgccattctcctgcctcagcctcccaagtagcggggactacatgtgcccgccaccatgcccgcctaagtttttgtatttttagtagagatggggtttcactgtgttagccaggatggtctcgatctcctgacctcttgatccacccaccttggcctcccaaagtgctgggattacaggcgtgagccaccgcgcccagcctattttattttattttttgagacggagtctcgctctgtggcccaggctggaatgcagtggcgccatctcagctcactgcaacctctgccccctgggttcaagtgattatcctgcctcagcctcccaagtagcagggactacaggtgtatgccatcacgcccagctaattttttgtatttttagtagagacggggtttcactgtgttagccaggatgttctcgatctcctgacctcatgatctgcctgcctcagactcccaaagtgctgggattacaggcataagccactgcgcccagcgtttgtttgttttttttttcctttaaataacaatcctatgcttaaatcttataataattactcattgctcttgggaaaaagccgaaactccttaatgtggctttaagttcttgagtaatctgtctttacctctctagccaagactgggtcatatcctttattgcctggtaaattgcatttgtcacacagtattataactacatacaccaccagaatatgtggaaatacagactatgcttgtctgcttaccactgtacctatttatttatttatttatttatttatgttttgtgacagggtctgactctgtggcccaggctggagtgcagtggcactatcatggcttactgcagccttgacctccctgggctcaggtgaccctcccacctcagcctcccgagtggctgggactacaggcatgcactactatacccggctaatttttgttattttttgtagagatgaggttttactatgttgcctaggctggtcttgaactcctgggctcaagcagcctgcctaccttagccttcagaagtgctgggattataggtgtgagctgctgtgcctggccaattgtactgtttttatctccagtgtcctagcacatagtagacactcaagaaatatgtattatacaaaagaatgaatgaattaagaaatggaaaaaaaatttaaaaatgggactgtgcttttgtgtgtctcgatatttctgcctgtaagttagggataatagtcttgatcacttgcctctaagagaaagacttgataattccaaaatgcttaaacattttcaggggtttgggtgggatgataggaagtagggagaggaaatatcataaaaacaatgttttgattattcaccttccattagtttttactctagtagatttttgtgctgagatcgctcttgagcctttatagtcttattataactttcatagtctgggttacttgacatgtaacaggtatttaatacatacttatttccttgatttatttggtgtcacagtttttcctgtgttgtagatttatacccattatcttttggcaaaaatcagaagccctcactaagtgatagcagatcttttcttaagcagatttttttcttaaggatttgatagctttgggatgaggcaccaggaaataatgggttgttggtttatccattagcaatcactggtaaatttatctcttcagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcaggtaacttggctcagctgccactggtacacccacctctgctgttggcctcggtgaaccagtggagggatgagtgtgcatttgtgatgtttttgaacacagtggtaaagttcctcctgggagaggcttctcattggagatatcaagtctcctactaccagccacatagtagatcttcaataaatacttctgttcagctggagtatcttcagtgatatttcttttttaaagaactcctggttataaatagtttactctcagaagattgatttttttaccagcctggtcaacatggtaaaacctcatctatactaaaaatacaaaaattagctggatgtggtggtgcacgcctgtagtcccagctacttgggaggcttaggcatgagaattgcttgaccaaggaggcggagtttgcag

SEQ ID NO: 53068 - DNA, 1007 bp, Homo sapiens
tttttgtttaagttgctatttttgttttattagtacatgtgttgtttaaagctgagccacatcttactctaggggactattgtgaggcgactgtgccttacctctctgaactcatcctctgctactctccttgcttgtacttagctgcagtcactctggtctttcctctgtttctcacacacagacagcatattcttgcctcagggcctttggacttcctgcttgcctctgatatttacatgtttcactccctcactttgttcagtttatcttagaaccctcatggaccaccatccccactaactgcatgccactctctgtcttctttactcattttatttttcttcagaactcttaatactgcctaacagattgtgtgtttgtttattctctcctattagagatttttgtccattttgtttacctctgtatctttagcacttagaaccattcctagcacatagcaggtattcaataaatggttattgaatgaaagaatgaatgagtaggtgagtgaatatatttatgaataaattattttatttactttctttacttttttttttttttggtttgagacggagtctccctctgtcgcccaggctggagtgcagtggtgcaatctgggctcattgcaacctttgcctcccgagtaagtgggattacaggtgtgtgccaccacgactggctaatttttgtatttttagtagagacggggtttcaccatgttggccaggctggtctcgaactcctgacctcaagtgatccacccacctcggcctctcaaagtgttgggattacaggcgtgagccactgcacctggcccctgttttatttactttcttatataatttttgtttccttggagtgggtaattgttttgttttttagtttgcttagttgtctccaaactctcctacattactgtaaaaggattcccaatatggccaaacaccacaggcaattttcatttttcttttggaaacatttattctggaccattctat

SEQ ID NO: 53069 - DNA, 1637 bp, Homo sapiens
acccaaatggagtaaagtggactcaggaataccattttagagttcgagacctgaggttcttacaagctagaagcagcaatttgaatggtaaaggaaattcctaattagaataagtaacatctttggtcttcttggcaagggtagaaggttgcaggctttttctcactctgtaagacaatcatgtcttttgcataagaatatgtagtaggtgaatacttgtgaacaattattaagagttatgtccagtggggcacaaagggtggttctggggtgctggtaatgttctgcttcttaatctgaatgctgactaaatggaggaattcaaattataaaaatcaacatgtttacgattatggtttatgcactgttttgtatatatgttacttcagtaaaatggaggaaaagaggaagtgttacatttttattctgttgcaatttcttctggctttttctttctagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatggtgtgtgcactgggaagagggaaagagaatagtagaatgagagcctttcaaggggttgctgtgaaacccttcatataaatgagagagtaacatcaccacttttttccatttgagtagctacgaacttgagatagagaagaacttatagatgaattctcaaaatcagatcatggaagaagtctgttgatatttcagtcattactgctcatcaacctatcacattttcttgtggctgtaacatgtttggactctcaaagattagtatacagtatgtgaaatttaggatcaggtaggattaggcagaagattccctaaataaagccttgctttcattagtaggatatcaggtctgcttatctctgatgtcgagcttactggtcttttgtgtttgttcattcacagaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagaggtaagccctaagagccatgtggatgctggttgtggagtgaatgctttcagagttcattggatggcaagagtatggcacctaagaaatgaggcaatagactcaagacagtccttctcaggagttcttcttgcagtctataaatgtcttttacccgtggagaagtgtgatttcagctccatgtgtattgctaaatgttgattagtttcctacagagttgagaaggcaaacagactagtaaatttttctaagcagtatatttgggctatgtattttgaaactgcttagtagagatgctactcttttattctatcccttatgtgcctgtgttactttaaatgacttggttaccttcagtcatatgaccaataaatataaggaatgactctgatttgaatgtgggctctgatacatgctctgtctgt

SEQ ID NO: 53070 - DNA, 1501 bp, Homo sapiens
ctaccttttttgttcaattctgtctccctctttatgtgtgtcttgttcctggcagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagtgagtgagctgaggttttgggtccaagagcaatattttccattgggataagaaagagaaaggcttaaagtatttcatgaataatacagagagattatagatcctgaagagcatatactgataatgagaggtcttggcttcagttcctagtaacattaagtaggttcatttggactgcagtgaagaagtgccagtgatatgaaaggggaattaatttgcagtgttgggactatgatttacctcacttctgtttgattaaatatttctgaaaataatacttaatggcataaagacaaaggaagagacactaaagaataaaaagaaaagtttttagttacactaggtattagactttgaaggtcttccctcttcccacccatctctacctatgaccttgaagagtagcgcatcttaaactcttcatagtgtaaaatgggtttctggcttcatgcctttcttccatgagtccaccacatgtatgcatgttccaatgccacttagaactttattttgaattggcttaaattggcagcataaaaaccacatttacttgttttcacaaaaccctgtcaacatctaaaaatggtgacattgattttggttattatgttttatgaacctctctatagcactccaggtatataaccctggctcctaaaattcatgtgttaatgaaggaatgtgtatttgtccccacaggttaaagacagttgatgttatagtacgtagcatacaggatgctgaactcttggtcaaaggttatgagattaagctgagtcaagaagaagtagtactggcagatctctcagctctggaggcccattggtcgacattacgggtgagttgctctgagtttcttaggaggttgacctaacatattcattgctttgggttagcagagaaatgcaattttggatggcatgacactgatttaaatttgcatttgaataaggcagaatgtcattaaatatattttaatatgtattcaaagaagaagggactgagaagtatgtctagctagaaagggaagagaaaggactaggtttttctatttattttttcccttttcaccttaataaaatcatggattaattggatacagtcagtggttgtgccataagtttataaatcacttagctgttatctaatttgattctcacaagccactctgtgaggtggacaagaagagatttttctctccatttacagatgagaaaaccaacacttactctggctaaatgacttattttggtttcatatgttataa

SEQ ID NO: 53071 - DNA, 1136 bp, Homo sapiens
ttgaagtcttatcacaaagctggttagactagagaagtgatatgacttattggaagtagcaggaaataatgactatttttcacttctctcccctctctccttgagaaattatagtgattcataaatcatagctgtgctgtactgacaggtactctgtcatcagggaatagaactgtacagccaatactaccttattggtcaccctggtaattcttggcaacctaggtgaaaaatttgacaaggattattgtgggatgctagaccacaaggcagcatccagggctagcaggtcacaactggtttctactcacttttttgaccatagggcactggtacatgcataggtctcactcagccttgcatcgctgttccccgtagataaagatggatcgtttgtggtcaagcccagctggatacatgggttaaagagggaattacctcatttactttattgtatttgtaccaaggtatctgatagcagtttccctttgttcttctagccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggtgagtgtggtagtagctctggcgagaagagttagaaatttaaattttctttatcataaaagaaaatgatgtactggcaattaaagcttcctccaaatggaagatatccaaattcccttttctttgagtggtttgagcaggatcgtcccaagatactggttttgcatttagactagagaacctgtaaggtaccttcagttctgagtttctgtaactgtattgaaaccactagatggacagattaaaattatctttattttgtttttttttatattacattttattttactaggattagatatggggttttgaaaaccaagggaaaattgtaagtagaagaaaatgattcttttttttttgaaaatgatttattttaagcattttttttttgttggtattttgttttgttttgttttgtttagcattatggttaagagtatgagatctggagttgtattgcctggattccaatt

SEQ ID NO: 53072 - DNA, 1313 bp, Homo sapiens
ctctctgggtttcactttccccacaggtgagatgaaagggttggtcagactgcaactaaggcgtgagcaaactatgacccacaggccaaatcttgtccacacacctgtttttgtatggcccatgagaaaaggttgaaaagaaaatcaaaagaataatattttatgatgtgaaaataatatgaacttcagtttttagtgttcataaataaagttttattctaacaaccacaccctttcatctatatattgcctatggctgctttcacttataatgagagagatagtatggcctgatattttctgtctggccttttacaggaaaagtttgctaacctccagcatgagtggtcaccaaaacgcttccagcaataaaaagctatgatttattacatgatgtatgtgaattataaaaccctgagtaactgtagcgaaattcatcctttcctaggactatgaattgcaactgatgacatacaaggcctttgtggaatcgcagcagaaatcccctggcaagcgccgtcgcatgctttcctcttcagatgccatcactcaagaggtgagagggtgggggaaggaaatacaccactgtcttcccttaaggaaagattcatttgcctgggccttacattttgatttagggctcacttttctggtgaacatgtgactgcatgaacatttcctcttattttgaactatttaaatttcattttctggcagacgatttatttaaattgttcttttgaaccacagttcatggacttaaggactcgctacacggcattggtgactttaacaactcagcacgtgaaatacatcagtgatgcactccggcgtctggaggaggaggaggtgaggacagttgggtccaaagtcatcttgaaagtacagtaaaacatcttagccagcacggtggtgtgtgcctgtagtctctggtacccaggtggctgagttgggaggattacttgagtctaggagtttgaatccagcatgggtgacatagggaaatcccctctctacaaaaaatatttaaaaattagctgggcatggtggcacacacctgtggtcccagttacttgggaggctgaggtggaaggatcacttgggcctgggaagttgaggctgcagtgaccatgattgtgccactgcactccagcctgggcaataggctgtctcaaaaaaaagcccaaaatatcccacataccccgtaaatatatacacctactatgtacccacaaaaattaaaaaaattttttaaaccagcaaaatatatgctatatatgtaacatataattaaattattatataatatatat

SEQ ID NO: 53073 - DNA, 1115 bp, Homo sapiens
tctgcatattcagcctctcttataaaaaaaaagctgttaaaacattaaccataccatcttttgctttttaaattagcaagactttctttatatccatacctacataatgtaatctcagtaggcttcagtctcttctcttcttacagattcacctgtaaacctaagaattatgaaaatgagtaagatgctatatgtgaagagatttttttaaaaagcatcaaataattattgagtgcctattatatataaaacagtggtttgtatttttcagaaaggtattaaacctaggtataataaatttagctcacaaacacctgtgagcaatactgtaggctgggctaaattatacttggggttattttcacagcccacttatttaggtaactgtatctgtttttaggaagacttcatttaagaaaatctgaagtcgtgccagcctaataaaagacattgctagcatattgattttctatttcctattctagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggtgagaagaaggtccatctctgtttacctgggtagaataatatgtgataatacattaggtggaatagtagaagtcacatgtgggccattccagaagtgattgctacctgagtaaatgttaaagaaacttaagaagccatcttgtttgttcttgtacctttttatcagctgtagctcattggtgataataatttgacctaagctgcatattttctctaggatttaaaaaaataattttaaataatttttgactcttaattcttgggttttgaagctttttctctttatttctaccatgtaggttctgtcagaagagctgacaacaaagaaagaacaagtctctgaagctattaaaacatcacagatcttcttggccaagcatggtcataagtgagtattaaatgagagattatggcacatctggggcacctggtctatcagtctaaaacttacagccataatgagatttcagaatgga

SEQ ID NO: 53074 - DNA, 2498 bp, Homo sapiens
gctttaattatatctgtaatgtcttatttctaagaaagggtctaaagcggccaggtgcggtggctcacgcctataatcccagtactttgggaggctgaggcgggcaaatcacctgaggtcaggagttcgagaccagcctggccagcatggtgaaacccagtttgtactaaaattacaaaaattagctgggtgtggtggcgggcacgtgtaatcccagctactcgggaggctgaggcaggagaatcacttgaacctgggaagtggaggttgcagtaagccaagatcgcaccactgcacttcaacctgggtgacagagcgagactccatctcaaaaaaaaaaaaaaaaaaaaagagagaagaaaaagaaaaggccctaaagcaaatatgtaaaatagtaaattgtgaaatgaaagctggatagctagacaacaggtaaataagaatgtgttacattcttctgcctgtttaaaatattttattttaaaaagaaaataggtatagaaggagtaaagaaagataaaactgaaaggtagagttataatcatatagtggattcttgaagtctaagatttcagaagcagaataatttcagatgataggatctaagtttgacatttgggggtggggctaaagtggagatgaggtcatttgaactacaagcataggggtgacatagcattgacatcatcaagaaccatgacttgatttgagataaacagaagaactgactgaaatgccaaagtctccgatgaatatggaagaagatcatccatccaagatgaagaagtagcaattttgaagcaatagagcagagtttggagattgtttttttttctcctaaaaaagctttaatgcttcatcttccaggctctcagaaaaagagaagaaacaaatatctgagcaattgaatgccctaaacaaggcttaccatgacctttgtgatggttctgcaaatcagcttcagcagcttcagagccagttggctcaccagacagaacaaaaggtacttttagttttcatctccaaatattgggtggataccttttgaatggtatgaaggcagctttgctgattcagagtcatgatcactagctttccatgaccaatgtgacttaatttttaacctcaccttagcagccatttgtcttgtgtttctttactggggttccatgatgtgttggtcagtcaaaagcactagaagacacttacaactaaccctttagacctggttcaccttttttgtcttatgccattttgtggcagacagcagtctaggagaacataaattctgtattatatgtgatcacagggcagtaacatactcccttgtggcattgtcactcaaaagttgatagccaaaagttctggatattgggaagaaaaacctgtgaacctcttccctctatactaaggcagtaagaaatattaagttccaaagcaaactggtagagtagtttcactgactaagacgctggttcccctcacccatagtcatctcatcatgtggcatcttgaccagttcccctccatattcatttcctggaccatgtgaaagtcatcatagttcctactggttgtcctaagttcttcctggatacttgtgcgtgtgtgtacacttaccatattatatacatgtgtctctgggatatatatgtgtgtttgcctgcttatttcctatgttgtgaagcaatggccaacttatgtggggcaggccaaaattaagctcacgtgatagtcaaatttggtccagatgatgctcaaaatgatattcagacaaagcatgtcttgattctgatccttggatataaattttgtgcaacaggagctagagttgtaaaaaccacaagacaaaaccagctatgatttgatggtgtatttccaaaaacaaagtgctggtgtaacattctccatttaaggtagcccacttccagtggcttgttgcttcaccatataagggagtatgtgaaaagttttaacaattgcttgctgagaacatccggttctcattttgaaaggttaaaaaagaggggggaaaaggaaaaaaagaaaaaaagaaagacaggacaggctgctgagcaccactacattgagcatgatgtgtctcctgtatgtgtgtttcatgtgaagtattgttctgattaactgacatccttgcttacaagtttcactaaccctttggagtttaagcacaaatgcacaaagggaaaagaggacgacctgtttggggttcttttttgcaaaaacaaacagtcgcatgctggacgctaacaccaagcttacactgtgtgtgtgatacggctgagctgctccataaggctctatcttttatctgcccaaggcgtgccctgcaactctggtaagtagaagccttttatgttttctttcctcctctccttctatctcttaatgcttgtttaggtcagaatgtccatgtttggtaggacagaaatgagtttctctggattttttcccagctgagtatttcctgcctatccttc

SEQ ID NO: 53075 - DNA, 7207 bp, Homo sapiens
agagaagtctgtcagttattccattgattgaacacatatgtagaaatggagatgagaaccaaatatactgttctttcatttgctatccattctgtattcttattgtatgcacctcatcaagcttgaaatcctcagtgcgtgtttctaacacctgaggggaaatggcttaatgattttaagggtttccttattatttatccatattcatcccatatttattaaatgacagctactgttcctagaccttcatggacaatggatcagctcttacagaacttactcactgagataaaatgaaatgccattatttaggaggcagggaaataattggaaattgcttccacaagatcctctatcaataagatagagagttaaataagtaatcagaaagtagcactgaccaaagagggacagataaaattatatacagaaaatgaaaataatgaacatgaaaagaagagctgaaaagttggagagtaataaaaatgatgaagtgttgtaagtggttaaacacttaaataatttaaaatctgaatgtattattctgtgataaaagatctcaaaaatgagaattctttaggagctgtttctaggatttgcaagggtaattttgacagcgtatatgccttattcactgaccttcggacctaactcctgtgttaagatgtgactctactgtacttgtcttttacagttttctgggtctgactctgggaggacaaacaagatttagaatcagaccttgatttgtttctggaactcactagttttgtgaccttggacaagttacctaaactctgtgcctcattttcatttcttcaaactaaagattcaaacaattgttttcataggattactgtgagaattaaatgtcagtgttcagtagatctagtaataagtgatagctgtagtcatggttattgtactacccattctagcctggatcagaagaaaagttactagtggttccataggcaagggtccccaatctgtttcttccttgacttgctacttccaagacctagaactaacttaatttagagccattgccttgggagaagctagcattgtccaagaatatgagtatcccacttgctaaatagttgcttgagtagtatacacaggcctgtttactgggatgcacaattgttctggagcttctgggctgcataaatctctcttattctatggaccagtcctgctgtgctcatcagcagggaattgctacttctagagtcttctgtgtggtttgcaacaccaaaaacttgttgtatggcgttgaattctcactttgggggaactgttacgtgtctttaagaacatttatgatgatttagtcttagaaataagattaaatcctatcattttcactgcttaccaccctgtagagcttgtcactcagatatgcttaatgccactatctctcaagtaatctaggaacttctgacctattaaacattctgcagtttagaaaaactcttttttagtcttaacaccgggtggcttgcttcagaatatttcctacatgttggggcttatcccatgctgggttttccttgtggtcagaattttatatactgtagtactttttttttttttttttgagacagagtctcgctctgttgcccaggctggagtgcagtgatgcaatctcagctcactacaacctccacctcccgggttcaagccattctcctgcttcagcctcctgagtagctgggattacaggtgcgcaccacacccagctaatattttgtatttttagtagagacgggtttttcaccatgttggtcaggctggtctcagactcctgacctcatgatttgcctgccttgggcagattataggcgtgagccactgtgcctggcctgtatactatagttctttgaatgactcctttcaatagttgtgctttgccattggctctgattcagttttctttttcttctcttttccttttttttttttttttttttttttttttaggaatgcagagcagttgctggggtgattgacctaggcacagtggagatatttcccatcttcaaagccatgcaaaagggcctccttgaccaagacacaggcctagtgcttctggaatctcaggttatcatgtctggcctcattgcccctgagacgggtgaaaacctctctttggaggagggcatagccagaaacctcattaatccccagatgtaccagcagctccgggagctacaggatgccctggccttaataagcaggcttactgagagcagaggccctctttctgtggtggaagcaattgaaaagagaataatcagtgagacagttggactgaaaatcttagaagctcacctggcaactggaggtttcagtctttcccctagtgagaactgtattaacctggaagaggcttttcatcaaggcctcatttctgcatggcttcattcagtattagagtcttatcttagaacatccaagaatttgatagaccctaacacagctgagaaaattggtttgctggatctgatgcagcgatgtattgtccaccaggaatcaggattcaaattactgcctgtcaaacaattggcaggggggatggtgagcttgaaatcaggccggaaggttagcattttccgtgcagttcaggaagggctaatagataggcaggtcactgtccggttgctggaagctcagctttttgctggtggcatagtagatccaagaacaggacacagacttacagtggaagaggctgtaagacataatctgattgaccaagatatggcctgtgctatcctcataaggcagcttcagacaggaggcatcatagacactgtcacggggcaaaggctaacaatagatgaagcagtgagcaatgatctagtagctgctaagatcgcccttgtgattctggagtccctctggtcattcatggggttgctgtggcctgaatctggagagatcctcccaattacagatgccctagaacaaggtattgtgtctactgaactagcacataaaatccttagtaaccgacagcatattaaggctctgtttctaccagcaaccacagagattttgtcctggaagaaagcaatagaaagtggtatcctggatagagatcttgccaataacttaaaatcgatttgtatacctgatgtgatgccccacatgcaactagcagactctgcagaacaaaatattaatcctggagcagcagttctaccgtgcagcaagagccaccctaaggccacagcaagccagagtgagaatctgttgttccagctgatgactcacagctatattaatgtgcaaaatggacagaggctgcttctgttagataaagagctgatggagacactaacatccagagatgagtatcaaacaagtcctccaaaagtggttgaaattgggcatcaaaggcaaaaaactcctgagggattgcaagaatcagctaatgtgaaaatctcaggaactttcagcagtgggtggactgtgaggctgcctgagttccagttttcttctcagaacaaagaatatcccgatcgggaagattgcactacagaaaaaggcaaaaagaccactgtagaaacagaagattcttctgtagagaaccctgaacaggatctgtttgtagaacaaaaagagagaaatccaaacattgatgctttgaaggtaataaataaagtcaaattagaggtacaaaggcagttgataggtacccaaagggaagaccaaacagcagtgtctgtcagagaaaatgccagcaggggacacctcctgaccatacctcctgctgaggcggaaggtgtgccgttggtggttgacaaagatgttttttctgttgaaacaccaaagaaagaacatcaacctctaagaaacacttcctttacatgtcagaatgaacaagcacacactcttgagactgaatatattcatgatgaaactggaggatctcacataaaaccccaaagcaaaaagttacaagttcaggtaaagaaaactctaggtataaagttagaactaaagtctgaaactgatgggaatgttcatcctctggacaaaaaggaaatgttaaagaaaacatttctggctaaggatgaccataaagaaagtcaagaagcacagaacatcgcaggtggtagtatgatgatgtcagaaaagaccgatgaggaagatagtggcagggaaatttttctgtcatgcagtcatccattagaattgcttgaagaagctaccttaaatgtattatctgcacagttactagatggtggtatctttcatgaacaaacaggtcaaaagctcttactaaatgaagcaatatcccgaggcattgtgccaagtcacactgccgtgaagcttatggagaagctgaacatgtttcaggggttctttgactctcagacttgtgagtctttgacaactgaagaagtcattaatgaaggtctgatggatgagaaattattacataatgtcctcatggcagacaaagctataagtggtgtcttagacccccgtacccagacactgtgctctgtaaaggatgcagttacagttggacttcttgacaaggaaacagccaccagaattttagagaggcaggtggtgactggtggaattattgatctgaaacgaggcaaaaaagtttcagtaactttggcctcaactcttggcttggtggacgttgctgaccagccagaacttataaatctggagaaagcttccaaaggtagagatgctgaaaaaacagttagggagagattaattagtttacaaatggaaacaacaggacttatagaccctgatagtaaagcacctttaacagttgtgcagtccattgacagaggtcttttggagagagaggaggccgttcgtttgttgactaagcaagtggtagatggaggtatcattcaccatatatctgggatgagactttctgttgataatgccttcagacatggcttaattggtgaagatttagccgagaaactcaaaagagttgagaacttaaacatccatcagatttttaatcctgaaacgaaggaaaatatttccctccctaaagccataaaattagatcttattacctcagacctgaaaagagaaatccaggaggttcaggcctttactggaaactttgtggatctcatttctggtcagagattgaccttggcagaagctaaaaaagaaggactgttaactaatgaagcagtattgtctccaggaatgatgcatggcattgtagatcccgagaactgcagaattgtcccctactcagaattagtcaagaaatgtaagattgatattgaatctggacagagatatctagaagtaattcccttctcagacattaaagatggggtgagcgacaaagtgcttacattgtctcaagcaattcagcttggaaaagtagactttgcatctacgctgaaggttctagaagcccaggcaaatactggtggaatcatagatactgctactggaaaaagactgacattggcatcagctttggaagagaaactggtggatgaaaacatggtcagaattattgcatctcatcaggtgttaaatggaggaattgttgacatatttagtgatcagagagtgactttagtagaagctattgagaaaagactgatcagccctgaactggcaaatatgatccaaatagatagttcagagttcagcgatcacagggctcagattgaaaagcaagaagggattgaagtgtgtgcattacaaaatgaatttctaggaaaggatatgttaattgcttgtaatcagactgctgaaatgagttgtaataaagtagaagagagtgagagattatttcaagttgaaaatcagtctgcacaagaaaaggttaaagtgagagtttctgatggggagcaggcaaaaaagagcagggaaatttccttaaaggaatttgggtgcaaggatcaacgtaagccaagaatgtcttcagatgctaaagaatttatcagtatcataaatcctcataatcttaaaggtaaatccttgggccaagtgtcattgacacacccttactctgaatgtgattttaaacttaaagaagtggctagaaataacatgggaaatgatacaaatgaagagcaggaaaaagcagtgacaaaaatagaaattatttctcatatgaagcagtctacctcatgtctagattctgaagaaataagagaaaatcaaggggaagtgattttggaagtacaagaaacatattgtgaaacgtcaggcaaattgccgagtgagcaggttttgcagcaaccaatgaatgctcgggtgaaaagtaagagagagaagagggaggtgattgtagaagaaagtatcagaacatgcaaaccagcatttctttctgaagaaaagttgtatcaggaaactgccattagagatgagcatgactcccatataaagagccaacctagggaaatgacctcaagtgaaaaagggaaagaagctgatacagaaatgggattttctattacttttaaaattgaagagtcctcttcccaagtggtacctcaaggaatttctgtaaaacatttagatgctttaacactcttcagctctaaacaggccaatgaaggaaaagtaaacaatttaagtctctgcttgactttaaaaccagaagaaaacttatctcgagaaattgcctgtggggcccagagtgaaccattcccttgtatgaccccaagacctgaaggattgcactaccaggaatcagatggaaaagcccaagtgacaggcccatcccaaatttccaaaacagacaagtctttccaaggaaccaccagacaggagaccaactatcaagattcctgggttacttcgaaaactaaggaaaccaaacatcaaatttcctcatctaatgaatgtaaagaaaagtcataccaagaagtatcttttgacccagcaagaggtcttaaattggaagaaatcacagtttctagaccagattcaaaagaagtcaggtatctagaattctcagacagaaaagaccttcatcatcagggcagcaaaagtgatgataaactttgtggaactctcaaatctgaaatagcaacacaggaactaactggagagaaatttctagaaatggcaaaccctaatgttgcaggtctagaagcaggatccattgaggacatagtgactcagagaggttccagagtcttgggatcctttcttccagagaaactgttcaaaggag

SEQ ID NO: 53076 - DNA, 1023 bp, Homo sapiens
cctaaagatacaattagtttaatgctaaaattcttaactgggtacagagtttacatatgtgtaattgtatgcctctatacattttaaggcactagatgattctctaagatataacttagtttatcatcatctgtttgtagcaaagttgttggaaaattaggcattggctctgaatgtctttctgaaatctgcaagggttttaaatagaaacgagctaatagaaatactaggatgatgctacctgaaatcagaatagcttttggaaattttggtaaaatgatgcttgtagattgatagctctgagcttctgctctctgaggaaattggtaaaatcacctttgtctattgatttgaaatgacttaaacaaagtgttttattttatcccactctatgtgcagtaaaaattgcttctatttgtctaacaaaaacccctgcctgctttaaagctgacttacaggagaacgtcagaactgagtcagctttctttttggctccacagaatgtatttacccggcaactctgtttagaacatgatgaaaagctagtatcctatctgtctctgttacggaacattgaaatgaggaccaaacagattcaacctttggagctaaacctggcagaactacaggatctgctgtgtcaggccaaggtaggttcccagagacttccaccacagacaccagcttcaagatagctgcctccatcttccttgaagatttcaagacttactagaacctgcttgcactctattctagggtaaacaatctcagacccttgtcagataattatgggatgggctacatttggatagaccggataaaatttatacaggataaacttgaacagaccttggatttggctatcaatgtaattactaccatttttttttttttttttttttgagatagagtcttgctctgtcacccagggtggagtgcagtagcggtgatctcggctcactgcaacctccgcctcccgggttcaagcaattcccctgcctcagcctcccgaatagctgcgac

SEQ ID NO: 53077 - DNA, 2365 bp, Homo sapiens
ggccagtcacagtggctcatgcctataatcccagcactttggtaggccaagacaagaggattgcttgagcccaggagtttgagatcatcctgggcaacacagtaagaaattagccaagcctggtggtatacaccctagtcccagccactcaggaagctgaggcaggaggatttgcctgagcccaggagtttgaggttgtattgagctatgaatgcatcactgcactccagtctgggagacggagtgagaccctgtcttaaaaaaaagaaagaaaaatatattcaaaagcactgccatttaaaggaccaacaaagaaacaacaacaacaaaaatagattgaaaaagtctaactggagatctctgaagaagacctggaaacactcgtctcacagaaaccaaaggaggaggagtcagccctagtaactgccacagggagattgagtacaatgaggactgaaggggagattcagctcctgaaagttattggtgactttgaacagtttcagtggagtgacgggatataaactaacttgcagctggaagaaatgggaggttggaaagtagagacaattaatatagatccttctttccagaagtcttaggtacaggcaaggaatgaggtgggacactacttgaaggagatggattgaaaggaatgttttgaatgggttttggactgaggagaaagaaccaattaaaagggagaacttgaagttagaagagagaggaagtgataactgatagaaccagtcccctaaaaacgtagaaagacagccttgagagggaggaagagtggctatttcactgaaattggaggttaagagttgtcataggattggagtcaccatgaagacagattgtagtggtttactggttctctcaatatctagtgtgtggccttgggtagggtggctgaaccggggctgaggatgatgccccaaagaactatgtcaagttcttccacagcttatttccggcttatctgttgaggaccagaatattacagactagatgagtggaaaagctggttggggttagctttgtattctttggttccatgaccctggaatttagagtggaagagtcatccgttcggtttattttgtagcacattaattctgcacagctgctccttggggaaaggcataatgacactctcagagaggcagcaagttacagtggagggagcacactgcactgagtgagaaaacctgaatccaagtcctggctgtactgcttaccagctgggtgaccttggacaccattcacattttttttttaagcaatgaggcatctcttctgtaaatccagaacagtaacatctaccttgcctacttcatgaattagtgattgtgagaaccaagtaaactaatgaatgtacataaaaacattttctaagccctaaagtgtgtgtagacatggggtgagagagaaatgtgttcacagctgattcccagagggtttctagtcttgcttttataggtaactccactttattccctcaggtattagaaagggagttaaaggatctgaccaccttggtcagtcaggagctggagtgtgtgaatcagattatcatcagccagcctcaagaagttcctgctcaactgttgaaggctctagagaaagatgccaagaatcttcagaagtctctcagctctgtgagtgacacttggaattccaggctactccacttccagaatgctgtggaaatagaaaaggtagcattttgcttttattcataaaggctcacaaagtctgggtggctgggagattttcataatgtgattttccatttatttcttagactaaagtgttaaatcagcacacacagctagaaggccgacttcaagatctgagagcctgggttggcaataaaaatcttattctgaacagcaagggatctaacagtgaaatagatgttgacagcctgaacctctgcctccaacagtatgaggtaaactcaagcacattttctttgtcctttgagttgtatcaattttatttccctgctaggcaaaccaatatccatatttatcttttttttttttttttgagacggagtcttgctctgtcacccaagctggagtgcagtggcacaatcccagctcactgcaacctccgcctcctgggttcaagcgattctcctgcctcagcctcctgagtagctgggactataggcgcctacctccacgcccggctcatttttgtatttttagtggagacggggtttcaccatgttggccaggctggtttcgaactcctgatctcaggtgatccgcccacctcggcctcccaaagtgctgggattataggtgtgagccaccacacccggccatttatctttcttagaaagtctgatttt

SEQ ID NO: 53078 - DNA, 1011 bp, Homo sapiens
taatttatgaggagtttggagagactgaaagtgagagagacttttttttttttttttgagatggagtctcgctctgtcacccaggctggagtgcagtagtgcagtctcggctcaccgcaacctctgcctcccgggttcacgccattctcctgcctcagcctcccaagtagctgggactacaggcgcctgccactacgcctggctaattttttgtatttttagtagagacggggtttcaccgtgttagccaggatggtctccatctcctgaccttgtgatccgcccaccttggcctcccaaagtgctgggattacaggcatgagccaccgcacctggccaagagagactttaattctaatttggccctagaatcattagtgccagttatgaaaatacaggaaattagcctctctgattctgttggttttcttcatgaactgagaaatggaagtatcatggttttttgtgttttgtttcctttttccatttaccttaggatttgaaacagcccatggctgaaaggaaagctcagctggatgctcttgcttttgatattcagttctttatctcagaacatgcccaggacttgtcccctcagcagaatcgacagatgctgaggcttctgaatgaactgcagaggtccttccaggacattttggaacagactgccgctcaggtggatgccttgcagggccatcttcaacaaatggagcaggaagccctggtgaaggtcagactgaaccagcagctgggctcagtttgtctttggggatgtcctctgtcattgggttttctggccagactctgtgtatcatgattgcaggagcctgggtttaccaattttgaaatttcatgtcatgcaggccagtatggttctagtccaggaggcacttgttctggctgttgttcttgccatgtctttggttttatgtatgtgtgagagaatgtatgtgttgacatgtgtatacatatgcaagtgttttcttttagtgagacttttccttcgctgta

SEQ ID NO: 53079 - DNA, 2416 bp, Homo sapiens
gggttctgaaatcagtttcattctatttaatctatttcaaatgatttaccataaggttccttgacaatccttaagtggctgacaaggaaattttattagaatcgtattaatttttggctctttaagaattaatattattttcttgcacctttcctcacagtatagtgcccagtgcttattcgcttattcaatcatggaaaacagtatgtagaagcaggatgatactaaaacaaacaaacaaacaaacaaaaaactaaccatcctaccatcttccatcacaactctcttcttgcaaagctcaactcaacataattacattaatagtaacatcaaaaccttagaatacccagaatgatgttcatgccatttctgctatttgaatagtaagttggcatatagcaagatgatattagaattgtcattatcaccataaaatttgtctcaagggctcctttattaaatgttgtgcaaaaaattgagcttttgagtcagactttaagggaattagggtagttggtgccatatgtcctgtattactgtctcattttttcaactatattgaaattgagatatattaatggaaagctttaggttacctttgaaaactgagcatgtgcaatgctcgcattcaggagtttatatagcatgatataacctttggataattaatgaagtaaaattcatctgagccacattaagacaagacccagcccagattcagggtagactcctgagctgcagcaggtgatagaactgcatgtgaacattctccctgagcatgtaattaattccacaatgcttattaaccttgttattgtcagaaatgctctgcttctctcaatatttgccttggatgtgtgtgtatgtctctgtgttaacttgtttgctttgcttttttcagattcagtctgcacccatcctaacccatgaagatcctgttttacagctgaagagctcttaggagttctcttccagagcccttctatttgtcctaaagagggggagagagggccaatttgggcacctgtttgtaagtgcaggtgactaaagcgccatcagaaggtagaaactggtggaaaatggttttagaaggatggtcaggagaacacatcatgctcaattgctcagtcaggtgcttcaatgtcatacaactgagataaaatctagagaaaggatcaggcacagaaacatattccctctctctccttgggcctggcctgttcctttgatattagtgtagacacctaaaggactgagccagttgctattcttgggcactttccttctcaaaatagccaaatctagcccttcatgcctggcgtgtaatcattttatttaatgagtctctggattgatgagacatttgatttataaagtcagctcaattattaagaagctcgattaacttatgaattatccaggtctttgatttttctttctactccaattcttctacttttgcatattatgtagcaaatctctggttctagtggagggattgatcagaaccactaaattattatcatcaccattatcatgtgtggatttcaagcatctgggctctttcttctccatttccaaagataataacagcagtctggtgaaggagctctcaaaccaaaacctgaactagaaacattctcataattatcctgattatccaatccatagacccagatcaatggactgtccaaatgaggggagctttccgaatatgatttctatgtcttttcctattctagtctcccaccaacttttccatccttgagatataaccttcctgttttacatttcagggagtttcttgtatttgcaaaatgtgaattacgaaatgtctcttgacccctttgcattttaattagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggtcagtgtgaatctgtcaattttgacacaaagtctcgctctatcgcttaggctggagtacagtggtgttatcttggctcactgcagcttcgatctcctgggctcaggcaatcctcccacctcagcctccccaggagctgggacaaagtcatgagccaccatgtcctaattttttaatttttttgtagagatggggtatcactatgttgccaaagctggtctcgaactctgggctcaagcaatcctcctgccgtggccttggcctctcaaagtgttaggataacaggcttgagccaccatgcctggtgattttttcattccttcgacaaatatttagtgctcaagggttagcaataatggtaaacagacatcatccctggccttgtgaagcacacagtctagcag

SEQ ID NO: 53080 - DNA, 1052 bp, Homo sapiens
ggccacattaaggataaggagtgatacccaagagagtataagggcccatcaggcctcgactctgctaagatcatgttgtcaacacttctttatggaaagaatgatctctttgaggataatgcattgcaaaatgaaaaatctctcatgttcatgtttatggacaacctccttttttggcttcactaaatatttgcttagaaaacaaaatcaaatttctttgcattgatttaagcctaaacctgaagcaaattgtagttagggactatatacaggactatatgtcatcctagccattccatctttataccattagaggacttagaagcactaaagtcgaaggctctgccattcctattttcttgtgttaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaaggtaatagactgctatgacgcttgatatttttcaaaaaagaaaattttggtaccaacacaaataaaagacagtgaggggaaaacaggcttatagcatgcacagaatcatgaggaagggctacttcaggagctagtctggtttttgttttttgagacggaatctctgtcacccaggctggagtgcagtggcatgatctcggcttactgcaacctctgcctgccaggttcaagtgattctcctgcctcagcttcagcctcccaagtagctgggattacaggtgcctgtcaccacacctagctaatttttgtatttttagtagagatgaggtttcaccaggttggccaggctggctagtctgtgtttttacaagaatctttatttttacaagaaatgtccaggaggagtttaagtcaggacagttggtaaaaagtacatattcctattcctcc

SEQ ID NO: 53081 - DNA, 1313 bp, Homo sapiens
tttgagacagagtattgccgtgtcaccgaagctggagtgcagtggcacgatcttggcttactgcaacctccacctcccaggttcaaacgatactcgtgtctcagcctcctgagtagctgggtctacaggcatgcaccaccacacccagataattttttgtatttttagtagagatggggtttcaccgtgttgaccaggcttgtctcaaactcctgatcctgaagtgagccactgtgtcctgcctctttttttttttttaaagcagtaagatataatgaaatgtagagatatttttaataatttttcaaaagattttaaaagatatgaattctcttttgtatgtgcaaagactgtttatacccagtcttagaattagcataaaattatctcctcccctttaccccattacttaacctgtggttgtatgattgagtatgtaaagccttctcactagactacctcggtggctttcagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggtaagggtgttagcttatcctcactatgctagagaaatctctcctgccctgagcaagtaaccacaatcaccttgcccctaaatccagtgagcacttctcagtttgtatcttctttgatgtctcagcagctttgacactgttggccactcctcttgaaatactttctcccttggtttccataatactactctgccctgaccatctttcttactttcctctggccaggttttcaaatactgatgtttccaggtgtatcctaggccctctttttatctttcagaacatactttccttgggcagtctcatctactcacaacactgtaattgccatttgcactaatgaattctgtgtatgcatttccttccagccctgatttctgtcccgagcttcaaaacggtatataaatctgtctgcctatttgcaacttgggcccataagcacatcagcctgaaaatggaactcctatttcctatgatactcctcccacaattaaacattctctttcctttattcccacttcattgtctgaactggacatcatcctagattccattctctctctcactctcctatgtcaaatcagtcatcaaatcttatggtaattatatttctt

SEQ ID NO: 53082 - DNA, 1906 bp, Homo sapiens
ttctagcttataggtagatggtccttgaagattataagtacaacttaagagtcagcatctaaattaaagggctatacctaaaacaaggggctgaactgaataaaatgaagttaacagggaaaaatgtgagatgcagcaaaactgagagaggtgtatgacttgacagcaatgtgggtgaaaagaccaaggctgaatgtaagcagacctcacatggagtatgaagtccagtcttgtatacctcaaattattgtggattgcctactgattgtcctttgtttggggggatttttttttaccaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaaggtaagggggcagttcctggcatccttggtgaaacaatcatggcagccttcacacaatgtaggtagtgtctggggctcagaataagaactccaggacacagtaggagagctgatttatacttggaccatgggcagaaggtcttcacaaacaatgcacaaaatgtaaaatacataggtactagcccaaaggcctgatagctagctaatacctaatacctagcactggcaggagtatatcacactgatggtgaaggtggaagtattccccttcctgtatcctgaccagcagacttggactcccaagagacatagcacacaggggaaatttaaaccaattgcacagtctttatttctgtctttatttcacagagcatctagggtgaatccttaccttccttcctatctaaagaacttgctcgctcttctaaagtttagaatccagtcagctcttcttacctgtcttatgccttctgccaacacttctaatccccaagaaagaatactttttgcacttcttaacccctacctttgtctgcaaccttatgttcatttctttggaagcttgtcatacatctcattaaattttcctgggaatgtaagaaggtcaaggtgaatagtatggagcaaacaatggggacccacacttagagatcattgctacccatctatccatgggttctggcaatacccttatctgaagttacagtgagttgtctgtaacaaagccaggcctctttctttgggcagctgctgcctttggcctgaccttgcttaagtctgcttacctttctttctctggcacagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaaggtaagtcaggacacaggctgtgttgtggtgtcaagaccttgtattccatggcgtaaagtaccccaaaataaagcaaatgcttacataaaataaaggcagtggttggga

SEQ ID NO: 53083 - DNA, 1036 bp, Homo sapiens
agtgctaaacacttgcttctaatatttatggctatggttaaacttacaattattctgtaaagctgttcagtagctccggattcctagaatcatctttgattacttagatgtttttcttttgtttttttcatggacaagcagcagttgcaggaggaattggctgagcaccaagtacctgtggaaaaactccaaaaagtagctcgtgacataatggaaattgaaggggagccagccccagaccacaggcatgttcaagaaactacaggtataaagcagcaacagtataatagtactcccttaattcctagtatgtacctctattctgcaatatgtcacattgtgttgtgcaaatatctgtggtgccaggctagaggctgagaatataaacatgaatagacatagattgtcatcaaagagcttatcctctaatgaactttattcttgcaccattgaaggaccttcacaatctggcttcagtcccttttccccagacatctatcttctagccacatctacttttctttcccaagtaaaccacttacattgtattacccctgaagtttttcctattgcttagctgataacatttattgaatgcttaccaagcgtggtgaaatcttgcccatgcttcaagatgtagccaagagtatatcatggtgactatagttaataacaatatatcgtatacaggccgggcgtggtggctcacatctgtaatcccagcactttgggaggccgaggcgggcagatcacgaggtcaggagatcgagaccatcctggccaagaagatgaaaccccgtctctactaaaaatacaaaacaaacaaacaaacaaaaaaatagccaggcatggtggcaggcgcctgtaatcccagctactctggaggctgaggcaggagaatggcatcaacctgggaggcggagcttgcagtgagctgagatcgtgccactgcactccagcctgggcgacacagcaagactccgtctcaaaaaaaaaaaaaaaaaaaaaaaaaaatatatatatatatatatatata

SEQ ID NO: 53084 - DNA, 1094 bp, Homo sapiens
caggaaagcctggagagcctgttgcagtctattggggaagttgaacaaaacctggaagggaagcaggtgtcatcactctcatcaggagtcatccaggaagccttagccacaaatatggtaagatctgtgtcccaagagctagcatagagggtatgtttgctatgtgccatcattacataatgttgaaaaagtaacaagagggaacctaatatctgtgaatcatctaataagatttagaaatgataactaatctatgtaaagatatttctacccagttgagctggaatgaaagtggagatagcaaagtcatgtggtagaaggggtggagaactaaggtgatgagatgtgtggtattctggaggctcggttgcagtcctccagtcccccttgtgagatagcatatagttattagtttgtggctcagatgtcctggaataagtgaaccaggagctgacagacgtgttcttcatgacagaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggtgaggatatatctgccatgttagcagaataaagggaagagaagggcagggagagaaccagcatttgctgagcgcatactacatcagtcagtatactggaaactacctgcattatctttgggaattattacagtgatcccgtaaactaggtatcatttgtccattttttaagcaacacagtcaatatttatttttcactcttattacatgttcaacccaaatcagcagggccactcagttcatcatagtcactcaagggatgcagattgatggagatttcatcctgatataagctttcatg

SEQ ID NO: 53085 - DNA, 1212 bp, Homo sapiens
ccatttccaaaactttccttttgatttagtttattcattggcatcattaatctagaactaatcacctaacttctgtgagcctcagtttcggcaccttccttgctaaagcaatcagcacttgaattggtccttgaaagagtcaaatagctaaaatgtagcagggccggaattgagatccaaagcctgcattctttccattgtatcacagtacctaaatagcagcctccctttagtttttctcactttcactttagcctagagtaagattgaagacctctttccccagaaatgtccaaacaagggcaatatattcctgagtttggtacgcttcaatgttatatgcggttgttcagccaaacctgctatggaaaagattatgagaaagaaaggccatgttaggtaactgatgtctggagtcacagaatgaactactcttagctcaagttgactttataaaacttagtctggcaagtaacaaaactgcttcattgacagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaaggtaggtgaacaaagggactccaagaattgggctaggcactggtttgaatacttgtattaactggtctccagctgtggtggggaaatgtatgagaaatccaagttgtcagtctgcatcagaacagaaattcctacgttttcttcatatgataaccatctacccatacagtccttgagaagcatacactctctttgtatgtttgagaattagacaaatatatttgagcaagtaaccagataatatgatcaggaaattgaggatagaagaactagtactacttcagctagtaaaggaaaagctagaatcagatggttggaaggtaccttcaaggatgggaccaaccttcctcccattccctgcaaaatcccttctgtactgtctttgatccgtaattatccagcctctgcttacacctctaacctatgtcttccttttgttgaaataagccaaatatgcctctgactaactgtcatgcacttatccttattttctcagtaaagcatacttcatcctgagcagatgaaagaaaagcgtttgattgctttcacagagtgagtgcc

SEQ ID NO: 53086 - DNA, 1352 bp, Homo sapiens
cctgccaccacgcccggctaattttttttttgtatttttagtagagacggggtttcaccatgtcggccagtctggtcttgtactcctgacctcaagtgatctgcccgcctcagcctcccaaagtgctgggattacaggtgtgaaccaccatgcccagccattatcttaattcagagctttccttcctctaggcagaattagatagaactcctcttatgctcttggaattcacagactgtccataatactgtaatagcatttatcacattataatgcaattgataatctgagcttctggttttagaaattgtatcataattctattttgtaccccagtgtttggcatggtgccagtcatatagtaaatgttcaatagatatttgataaatgaataaataaatcagaaggatggtctcttaatgcttttcaaaacactagggagtatatacagaacagatgtccctacttatgaggaaaaagccccagatactacatttggccattttcttctttaaacagagtctactagatgactgggcaagtaagggaactctggtggaagaaatcaattgcaaaggtacttctttagaaaatctcatcatggaaatcacagcacctgattcccaaggcaagacaggtgagtacaggctcttcaaaatatagtgaataaaaattgctctttgcttttggcctttggagatgcctccttatataattaaagtgaaaatcaaggttggatatgaaaacaaagggcatgcccaaagcagtcttcccctgcaacctgacctgtcaccccttttgctatataacattgctccattttgcaaaattccttcccatgatggaaaaagtaaatgaactagttgtcccacttagaactatcaaatgaacactgaataattaaaatgagattttcatcttgagaatttcccttttttgaatgtgtaaatgggatgggtaagcatcatctttaaacttgggcactggccagccacgaagtcagaagatcaaaaccagcctggccaacatggtgaaaccccatctctactaaaaatacaaaaattaggccaggtgcggcagctcacacctgtaatcccagcactttgggaggccaaggcaggcggatcacgaagtcaggagattgagaccatcctggctaacacggtgaaaccccatctctactaaaaatacaaaaaattagccaggcatggtggcgggtgcctgtagtcccagctactcaggaggctgaggcaggagaatggtgcggagcttgcagtgagccgagatcacgccactgcactccaacttgggcaacagacagagcgagactctgtctcaaaaaaaaaaaaaaa

SEQ ID NO: 53087 - DNA, 3631 bp, Homo sapiens
aggctggtctcgaacctcctgagctcaggcaatccacccacctcagcctcccaaagtgctaggattacaggtgtgagccaccgcgcccggccaactattttgtaatataaccttgcacatgactttttgtacagtgaagtcagtgcatatgagagttttctgtccttttaaagtatcattatgaatatttttcagatttctgtataatatttatcattacctcacctgatttttacctatcttgggaaacttctgaaatataaggaatcagtttggggagaatgtatgtgaaattatggtgattagaaacagaaccaaaggcccaaagcacaatttataagaatgttgatgagccagatttattggcacttaggatttctgttttttcttggggaaaggtgagcaagaagaggttatgaaagaaaaggcaaataatcttcctttaaaaacaatataagaagggctcattttaatgtctttattagaagaaggctgctttttaggccaggcacggtgactcatgcctataatcccagcactttgggaggccgaggcaggcagatcacctgaggtcgggagtttgagaccagcctgaccaacatagtgaaaccccgtctctactaaaaatacaaaaattagccgggcctggtggcaggcgcctgtaatcccagctgtttgagaggctgagatgggagaattgcttgaacctgggaagtggaagttgcagtgagccgagatcatgccaccgcacttcagtctgggcaacagagtgagactctgtctcaaaaaagaaaaaaaaaaaggctgctttttctgtccttaatggtattttcatttttattatattgaaagatattgatataaaaggtgaaactttctggctttattataaaagcttattccaaaatatggcaagtaccattctagactgaataattttaccagtacttgcttcacaaaattagggcggcatccagagaattcaagttggagatttaataaaaagggaatacgaatttcctctagaagggattaagaatcattcctgctaagaaccttgagtgacgttttgttgcctggcagctaaaataatttgtctctttccatgagtatgttgtcttgtgctgtgttaacttcctgatacctaagcttaaagtgagggccaaaggacaaattcagtgcctatatgtattcctaacacgttggtcttgccctgtttgtctccctgtccttctgctcaggttccatactgccctctgtaggaagctctgtaggcagtgtaaacggataccacacctgcaaaggtgagaatgccatttcaacagtgcttctttgttggatgtgttaggacagtgtctatgtttgcatctgtgtatgttgcaatatgtggtggaagaactgctgccagaatgggtgtgaggataaaaatctggggagaagcaactgtggtttgctggctatagaccataaacaggttggcagcccctgaagctaaaggtattgtagaaatacaatagattggatcactagataaggcaaatagggaaggaactcaaagaaaatatatgttaatctttgaattataaagaagttatactagagataatctagtctagctctcagcctcccagctaggtgacttctctgtagtttggagaagaaggaatggaagaatgctccaagtcccttaatcccaatagtaaactaaggttaatttcttactttgctcccttcacttttgttgttcccatgtttagcattttaaggtatacatctgagtatataatgccaaaaccagaaagcagattaatgagaatgcttttgttttgtgtatataaatgggaacttttgtatgatttagcaggaagataatctctaattcactagaaggagtaagagagatgcaagtaatttaggagtgaggagtcaaggagcatactcgaagagctgtctccaatctgatttctgtttctatgatactagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggtactgtgtttacattagttgcctcccaacaccaagaggaagagacagctgtaccagtgttcctgcccaagcccaggtatctgagagagagacatgggcaacaatctaggctgtgatgggcagtatgtttgacattctaaatgattaatatgccttaactctcctagagaattttcttatgaaattagaaattgttataagttagattcagaaacaaaaccaggtatgtttgcagaaaaagaatagccctccccagaatcgttagctcattgagaatgggatctcattttctatatgatgctgtaagcaagacaaaccattcttatcaaagtatctttccaattcttagagggatctaaataacagtgattacagttcattcttaagattgacatgtgagactaggaaaaatgtcagaagatataagaccacagaaaatcctgtaggcaagtttcaccaaaacttttaatattcccattgagcgtagcatctcatctccttcaagatatgttatcatcatatcttggtatttttagtttattttgattaataattccttcttattgagttctactgatgtattatacataaaagaaactcagatcctgccatttagattttcattttaaaataaaaattgaagtagaagggttaagtatcttaacaccactaaacaagtcattgataggatcctagtagagtctataataactgcccagttttccaatcatttctaccacacacacaactttgtttcctgtccagaatctcatggcatgcatggcattctttctcctaggccttcctggctgagttggaacagaattctccaaaaattcaaaaagtaaaggaagccctggctggattactggtgacatatcccaactcacaggaagcagaaaattggaagaaaattcaggaagaactcagtaagttttcacaagagtgttacaaatttgctaagttacttgtcttcaaagcaagtagagaatttcagcacatcctataaaacaggaattatttttagttaatttttataaataagcaattaggatccagatagggccagagcatgagcctgaattgggaagaaaattagaaattccactcaaaaagtcagaagtttggctttcttgggcaagtcaaactggtaatctactgtgatcaagaaccaaagagaggccaggaacagtgcctcacacctgtaatctcagcactttgggaatctgagacaggaggattgcttgaagctaggggttcaaaccagtctgggcaacatagcaagatcctgtctctacaaaaagcaaggaaaaacaaattagccaggtgtggtggcatgagcctggagtcctagctactggggaggctgaggcgagacgattgcttgagcccaggagttcaaggct

SEQ ID NO: 53088 - DNA, 1495 bp, Homo sapiens
aagtaagtttttattaagcaattgttaagtgatactgcctcagcctaatagcctggtcctttagttttctggcttatagttttaaagtagttggcactatttggcacaatccaacatcagtttttgttttgacactgctttttcttttttggagacaaggtctcactctgttgcccaggctggagtgcagtggtgctgcctcagctcactgcaacctcggcctcctgggttcaagcaattctcgtgcctcagcctcccgagtagctgggactacaggtgttcaccagcacgccccactaatttttgtatttttagtagagacggggtttcgccacgttggccaggctagtcttgaactcctgacctcaagtgatcctcccacctcggcctcccaaagtgctgcgattacaggcatgagccactgtgcctggcctgacactgcttttagatagatctgtttttttcctgtctaaacatcttggtgtcatttctatttcagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcaggtaagttggggtgaagaacatacttctgccattattagaggcaagcagaaagaaggaatgggttaggagtagtcccaagattctaggattcccttacgtaatttgtagactcagaatggtgttaaaccaattccttctcctagttgcagtgagaactgttgtagttgttacacagtgaacacttaaaaatgtgaaggtttacatagcatagtcctaaagataaaagctctaataaaatttcagtcagcaagtagagattcatccccatagatgtactgataaatggagttccacatatactctcattgatacccactttttttttttttttaatattatgcataccacacacacacggtctcgctctgtcacccaggctggagtacagtagtgcgatcatggctcactgcaccctcaatctcctgggctcaagtgaacctcccacctcagcctcccaagtagctgggactatagacacacgccaccatgcccagctgatt

SEQ ID NO: 53089 - DNA, 2466 bp, Homo sapiens
cccaaagtgctgggattacaggcgtgagccaccgcacccagtgattatttttatttttagtagagacgaggtcttgctttgttgcccaagctagtcttgaactcctgggctcaactgatcctcccacctcagcctccccaagtgctgggattacaggcatgagccactgcacccggctgcttctggacttcttatgataacttggtagaagaaaaattgtgccattaatttattatttatttttctggaactgtttatgactttcacgtttaccagctagaagtcaaagtttacttctgttacttagatcaccttacaaggttgatacgaggattaaataagatagtgtacatgaaggagcctaattatatgcctctttttggtaggccctcaagtaacattagttcccttcccccaagattagaccgtatactctcagcaaacattttaaatgccagggttcaggctttattgatttcaattttattttctcatttcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaagtaagtctgaaccttgtttttctttttcttttacatgtatttatttgcttgtaacttggaaaccagtcaagtatacattttaacttctgtccctagttttattattgtcacttccatcaccatgaaagcacactgtctgaagactaaatagtctctcggacttctgagcaaactggtttgagcatttttctttttctttttcttcttcttcttcttttttttttttttttttttttttgagacagggtctctctctctcacccaggctggagtgcagtggtgcgatctcggctcactgcagactcgacctcataggctcaagcgatcctcccacttcagtctcccaaggagctgggaccacaggcgccaccatacccggctaattttttgtattttttgtagagacgaggtttcaccatgtctcccaggctggtctcaaactcctgagctcaggcaatccgcccacctcagcctaccaaagtgttgggattaca

SEQ ID NO: 53090 - DNA, 1047 bp, Homo sapiens
caggctggtctcgatctcctgacctcaagtgatccacccgccctagcctcccaaagtgctgggattacaggcattagtcaccgcactcagccccctgtttttcaaattgaggtatgaaaagccgtaagttaaacatagtctcatcttcctaaagggtttattttacatagattttaggggaggatattgatgtatatttgatatattatggaataaaacataaaattatcattaattgttaagataaaacatgacacttcaaataaatctcccatttatatagtaagcagcttaataatacatcccagactcctcaagagtacaagttctttgcctataggaaagaagtttgagaagtactgccttaattgcaaaaatactttaattctttgcctgagccaaaatctccattcctgagattgtgtgagtataaattaaagtaacaggagatgattacatgacccaaaagtgtggatttactgggttaggagcacatctgttggatcttggttctcactatattaacctgttgcccctagagttttccttgtggtaaatacgtaaaagtctctcactctgccactgtacatggaatagatttggaaaggatactttcagcactttgtttccatcactagagttaattattcctgcttacacagttaacactcctgccattaaagtaaaattgtgatctcagagaccctgcttgccagcgttatttatcttaaaaacatggatgcagaggtaatgttgacaccagctcagagccacgtagtcctagagacgtcacagttttgtagacaggatccaagtgcaaaaatgtggctgtttcagaagggcccctctaggagcttgggagaaattcagcactaaagtgggacattggctgaaggccttcttaccatgtttggagatagtacaattttgagcaagaggagtcatcgtatttgggtttcttgaggcacccagataaggaaagggtaggtagagaaaacgtaaacccgtgaagcagtgcattcctcttagaaacttcctttctagtgg

SEQ ID NO: 53091 - DNA, 1575 bp, Homo sapiens
aattactgtgcactttgatttctatattgaagttattgtttagggcctctatagtattatactggttggattggctgtgcatgtgtgtgtggagaggaggaggtaattttgggatttctgcccaccaccatgatattggttattatttcctactgctatcacttttcactgctgtcatttggtctgtgtagtctattcctcccttctaatcttcactgagctagaaaatgagataaacaggcctgttaaaattgcattagatatgagctaaaatgtacaaaagagtccacatgcaggcataaatagtgtttggatttgaggacaagtcatcttttccttttcatttaatccttggtttctagagacattctgacttttgatgttgctggaagatttcaaaaaattactgggcattactttatcttatttctatcctagtatgttgcctaatagtgctcagagttcaatagcacttagttgcttgtcatagccaaattcgtttcactgatttctaaaaataagccttccacctcagatactctggatgtgaaggctgggactggacactgatcggctgggctcttgcagagtgtgttcatcaacagtggactggtgttgacaaggcaagcctggaagaagagtgggagaagggagaagggtggtggagtgtcctgtgtgtagtccattgtcaagtcagtaggtagttaccataaaatgatcagtatccaccctcaagttggggatgcaaatcaaaagccctgttccacctgtccaccttgtagggaagtcaaaagctttggaaagagtttttgccttctcccagcaaaaatctttggtcaggaggggaggagcatattcttggctgaactcatgctgagctcatcggaagtgaaaacaatgagaggagaaaaattctgtgtgtcagttccatagtccccaggaggccgcataaagggaaggtctttttggacccattctgaggactgagtcattttcatgatttgagtgtggagttcctgggttaatgtattatagtccagccatagattaatctttccttactccagcagcagaccagatttataaagtatgactctgttttcagattcaaattatttttaataaggtaaaaacaaagatgaagataaatatttttaaaaacagcattagctgtaagttttcagctctttttttaatggaatcatacttttagcacagaatctgcacaagagaagaggatatgaatctgggagacggaaactctgctttaacccagctaactccatgggagctagaatagacagatgagttaggcctgtgaagaaccccccagtcttacttgggactgtacagtcttgctgatagatccatggatctgcagtctgtggggaaaattatttcttccttaaatgaatgtggaatactaaaatacattattcctaggaaaggctttccctcagttgcttctgaatgattagtaggtcctcactggcagaccagattctatcacatgggagtggaagagagttcctttccactcaaaccaggcagagatctcaggcttcctgagttagg

SEQ ID NO: 53092 - DNA, 1022 bp, Homo sapiens
agaattttctctatgcctgaccagtccccaccccacactgccacaaggctcctgctgtggaaatcaatcagctgtgtatctcaggctgcttcctgtagggtgtgttatggaatggcatcagcccttgcaccagctgggagtactgatctcagtgtgattttatcagactatgtttcttttgagccttactgtttggaacaaaggaccctctgttaagaatgcagagagctggtgtgattggatagctagcatatacatacatggttcctatgggaaaaaaacagacataaattatgctatagccctctaaaattttcatctccaaaatgatttcctgaccttctgtctgtattcacagttctttctgtaagtgcttatccttcccccaaagcaattcgaaggccatctgatctgataaatggttgtatccttcagaactagcctatttctgtgtctccagtcttggatgtatttgatccccactatctttccagtgttatttcctatatagaccatacactacatccagttaccccagacactccttatacattttaggtatttgatttctgaagtcatagctcaagtccacttctttataaagctttttttttttttttttttttgagatggattctggctctgtcacccaggctggagtgcagtggtgcgatctcggctcactgcaatttctgactcccaggttcaagcgattctcttgcctcagcctcccaagtatctgggattacaggcacgcaccatcttgcctggctaatttttttgtatttttagtagagacagggtttcgccacgttggccaggctggtctcgaactcctgacctcaggtgatccacccacctcggcctcccaaagtgctgggattataggcgtgagccaccatgcccggccttataaaggcttttgatctccccagctcactactcctgatctcttaatcatttacaatgtataactcacttggcttttatcacataccacctaattttgacattttctgatt

SEQ ID NO: 53093 - DNA, 1116 bp, Homo sapiens
taattcatttatgcatttctatcagaatcctacaaccagcaggtttttctgagaccattttggccttggcttgtatgctctacaaattcatattattttcaaatcattaaccagaattaaccagaagacattaccagctcagtgacttccccagccactcagttgcccattagatcagctctaatgatctcagggattttggcctaattagcttttatcatagaccatgttatcttcctctgttaccgtacaatggcaactactaagtcagcatctttaggaaagacatctcttaatattaatcaatctttaattaaaacattgagggctgagccaaaaaatatcggcagagtttcagaagcaagcagcttaaaatacagatataattcatctgtctgccaatctcataccagattgagatgttttacagaaagtctttaattctttacagtttcagcaaatatgtgtttttaatgtttttaacatttggtcatgtgtatatatgagtcaaggaaagaagataattcaaagaaattatatgtgccttagattttctccatcttgaattaattgtatttatcaagtgaaccatttaatatctctgtcatcttgcaattcattcccaaaggataagctctggttttggtctaattctttaaattcatacctaagctgtttgtttctttgtcatcaatgataagaattttccttagtaacgaaatgaaagagatggtttttagaaatctcttctctctgtattatttattctgccttcttttctaatattgaggagcaggggctggacgcagtggctcacgcccgtaatcccagcactttgggaggccaaggcaggcagatcacttgaggtcaggagttcaaaactagcctggccaacatggtaaaaccccgtctctactaaaaatacaaaaattagccaggcttggtggtgggtgcctataattccagctacataggaggctgaggcaggagaatcgcttgaacctgggaggtagaggttgcagtgagccaagatcgcaccattgcactccacctgggtgacagagtgagactgtgtctcaaaaaagagggggtgattcaacccagagacctctttca

SEQ ID NO: 53094 - DNA, 3186 bp, Homo sapiens
caggctagagtgcaatgacacaattacagctcattgtaaccttgaactcctgggctgaacgattttctcagctcaacctcccaagtagctaggactacagatgcacatgcctggccaattttttaactttttgtagagacgagtgtcttgcaatgttgcttcggctagtcttgaactcctggcctcaagggatacccctgcctcagcttctcaaagtattggaattacaggtgtgagccattgagcccagccagaatttgcttctttagagtcctgccttcagctctctacttagaaatatttgtctttgccatctctgtatatctgaaatcctaatgagtaaatgtgattccctccataaagccttctctgatacctcctgccttccttcttcccacccttctgtcaggtcttttctaacttgcaaagccccatgattttgtcatcaccatggttttggtgaccattagtctaaaaagagggattaatacactgtcttttggaaagtctacaggcaggaaagggcttacaggggtcatgagagttcctgcagagtgtgtggaaagttttctcatgggttcacgagtacatgagagctcaaatagcatcaaaatccttagtatcccacttaaagcaaacttcgtgtcatgctatgttgctttatgagccactccgtagccatgtttataataataaaagtaccaaaggatggcagtgactgatgcccaacaggtacagactaatactgtggagtttctacttgctactaaataatgcttgtaaaatctaaagatcctaagatgaaaggcattgtgtagatttaaaatgagcaagatccaaccagtcctctgtatcctcttctactcagaattagtcttccaagagagagcacccatcaaggtgggtgataaggcatcatagaatctagggaagtgtgaatctggggtctccagattgtcccagagggctggcattttaggtctggagcagacaagggcaggatgccaggtccaaaacttggaaagggagctatgttagggtgtgaggagactccacccggctgtctttcattaggaagactgcaggaaggagctggaagggccaggatttttctttcttctaagttcactgaaggaaaatctaacaccaaattctgtacttgggaatttcaaaatgagtagagaattctttgaactctgtaatcaattaaccggaaactcatttgaaatttggcttcagtgcatatgtttgtggttacaggggtgggggaaatatctgaagagggtctctggagctccctgtatttctcttttaaaaagtttatacacagcatgtgaaatgaacagatgcttttttttttttgtagctatcagggcaacaagaggtggaaagctgtatcaggtatttatttcagtccctgagatggctattggcagagtttcacatacctaaactaaggagaaactcatgaacagataaaaattaagacatggaggagaacttgtgcttcctctcttgatttatttctaaacacatactgatgattttttaaaaagagcaaagcactcagaaagtattctttggctttgggttctggggtttttttggaggtgcggtgggaggattagattactatatgtaatttctctttaggttgtatttaaatttgttttcctaacaccctaattagagagagtgtgactgcagataataagtaattcgaatctgaatttcatagtcgtaggaatgctccatttatttatttatatggatcactgatgagagtagtaagaatattggtagatagacatgggagggaattatttaagaaaagtctggattggttgatacctgacttggtgaggaaacagtaaaggaatttctgttcatgaagtttgtgattccacatcaagataattctttatggctgggaacagtagctacgcctgtaatcccagcactttgggaggctgaggtgagtggatcacctgaggtcaggtcaccagcctggccaacaaggggtgaaacccatctctactaaaaatacaaaaaattaactgggtgcggtggcgcatgcctgtaatcccagctattggggaggctgaggcaggagaatcgcttgaacccaggaggcaaagattgcagtgagccaagattgcgccactgcactccagtctaggcgacagagtgagacagagtctcactcaaaaaaaaaaaaaaaaaaaacattctttataatagaataaccacccatgtttcatccagagccagaattcctcagattcttccaaccagaggggccctggcatgctaaacagtctgttatgatatctgaacacttaagtgaatgtatttggccagggatatttgctagtaaaattgatctttccttccctgagtttttccagttgtgctgaataattaaaggaaaattaaaacctggattccctaaactgttaagtatcagatctgtaagctgtcagtccttaggattacagtgtatcagagttagaaaggactttaaaattcatctgaacaaactgcagaagatttgtaaatctgttttcccaaatctctgccaagtgattgcttgaatttctgctcaaacacctccagggtcaggaaagtcaccagtttaggggacactctattctttgaatagctgtgagaagctctttgttggttttaaatctcacatcttagtgtgccagcttaaggagatacccagaacaagtttccttcctcccacgtctcagcccttcagatacttcatgctaattacatctcctagaactttctctaggtcagacattattgggtcttgcactgtttgttcttcataggacagggtttctagtgtcttggcagtatacgaccaagaggacacaggattctggggcagtgcctttaaaagttttagaactaaaaaatattaaaactagaaagggtgtcaagacacaacctagtcggcctccccacccctttcagtttacagatgggcagagtcttttggatttgagtgggtagaattgatcagcagccgttgttgaagtgagaaatgaagtgtaaagcattttaccagagaaaggtcttttagttgcctaattccgattacaggcttcagcgcacttctcatttttgccaaggaccagtctgattccctaagtaagcctaaggctcagctca

SEQ ID NO: 53095 - DNA, 3803 bp, Homo sapiens
ccccgcccgaccctagcggagccttttgttcccagccagaagtttgcatgccgggaccgtgacagctgcgggcggggaggacggcggggccgcggggccagcggcgtggtggagaatagaggcggctgcttgtcatgcagcccacggcgtggcggctgcgggccggggactggcggcggcgggcgaggcggcgcccacagcactcgggactcagctgccggagggacaaactaacttcctgagcgcgggacctgaggctggcgcggccgggagccacctgcagcctgcggtgaggcgaccctggccctcggggcgcgcggcatggcgcggggaagcgggccgtgctgagcgagcccctccgacagacccgcggccgctgctgctgcccgcccgcccgcctgcctttccgaaggcctggcgcggggctccgctcgccttgttttgcagctacagcgcagggttggcctgggagccacaacaatgccatgatgttttggagacaggaagccccaagctggccccgaatgaaggacttcctgtgtttaaagttgcaggaatatccgccgaccagcccagttcaaatgcaaacaccccagctagggaggacgaatggctaattcagaccagctggactctccagggctggaactgaggataaaatgaaaggaattcttaggagcttgggccatacttgaagactagagaggctgtgccattgttattaaaggatacaatcggcataaatttgctgctcccaactctgcttcggtgagaagtgagtggaactagatatcgaaaaagactcgtcaatatcagatgatttttgttgactgtatttgaaagagcagtgctcttaaaaaaaattaaaccataagccatacaaggaattattttaaattatatcgtctgtcaaccatgaggctgctagcctgtgaggaaaaagctgtttgtcttagagcttctcccagaatggtttcaaaacggaacttccaggcctttctggagggcagatgcaattggtggtttggggtatgaacagctaaaaggatttataacttatgtagaatgcatttggggggaacctgtgaaaaatacttttgaaagattgatggttcatcttgattgaaaaaggatgggtaagccactcagcagaccagactgtttaaggcggaaccccagctgcctggggaaaggagaggaggaggatggctacatagaggactgctatgttccacaacggtctatatatgatacgatgaggataaatgagcaaattgaccaggggtcaaagcttaaccagacttcaaaaagcaccatggaaaagatggaaggaagtactatatccagcaatggtacattaggagcagcatctaatgtttttgaatctagagcaccagaaggtaagaagctggatgagaggataatatttgatgcactaaagctaagcagtgatgtgcagaagtcagcacctgtgccacccagaaggcggccaaatgcagaacgcaaagacaatgttaacaggagatcgtggaagtccttcatgccacccaacttcccagaatttgcagagaggatagaagcttctctcagtgaggtttcagaagctggtgcttcaaatccttccttgcaagagaagaaggagtccagttctgcattaacagaaagttctggtcatttggaccacagggaacctcagtcagagtcagtaactctggaacatgtgtccaaatccataggtattccagaggtgcaagattttaaaaacttaagtggagactgccaggactttagatttcagcagcacagtgcaaaccctcctcatgaattccagcctgtagaatcagaagctgtagcaacaagtggtaacacagatgtaatgcaggaatccagattctcaagtgcaacctggccgagggccacaaaaagtttagctaagggaggcttcagtgagaagcagcacccccttggggacacagcctgcactgtggaaatgccacctctctccccttgcctgagtgaagagctgttagatccagaattgcatgttctcataacccccagcctgagagagaaaacagagtctgagctaaagtttgaggaggatgagcgatggattatgatggaggctgagggagagtgggaggaagagaaactgtcagacagggaaaagacttttctgatggcagatgagaagaacagcctggcagatatttttgaagaaagagaacaagcaaacacagcagtggtggaggatggatccgattgcttagctgctgtcttgaggacttttggccacctatctcttggtcagatttgttgccctgatgacccacagccagccaaggaccagttggctactgttcccaaggatatacccctggattgcgattgtgttcttacaggtgaggatattctcggtgaggtggcaaacagaactgctcaggggttagagggacttgtttcagattcagcatgtactgtgggtactattgatgcagaacagctctctgacacagactcagtgcagatgtttcttgaacttgaaaaggagtgtttatgtgaagaaggagtaactcctctagttgagctacagaatcaaatctcttctgaagggctggctgcatcccaggatgcagaaaatttactcgtaattagtcatttttcaggggctgccttagaaaaggaacagcatttaggccttttacatgtaagggcaaaagattatgatactagattggattgtggatattttaataccctggattcttctcaggtgcctaatgctgtggaacttattgcccacgttgatatcatgagagacacttccactgttagcaaggaggaatgtgaaaaagtgccttttagccccaggactgcagaatttaagtccagacagccagctgatctggattcactggaaaagctggacccaggaggactgctgaactctgatcacagggtttctcatgaagaaaaattatcaggcttcattgcttctgagctggccaaagacaatggcagtttgtcccagggagactgcagtcaaactgaggggaatggtgaggagtgcattgagagggtcaccttcagttttgcttttaatcatgaactaacagatgttacctcaggacctgaagtagaggtgttatatgaatcaaatttactaacagatgaaattcatttggaaagtgggaatgtaactgttaatcaagaaaataacagtctgacatcaatgggaaatgtggtcacttgtgaattgtctgtggagaaagtttgtgatgaggatggtgaggcaaaagagctggattatcaagccacacttttggaggatcaagctccagcacatttccacagaaacttcccagagcaggtcttccaggatctccagaggaagtccccagagtcagagattctgagtctgcacctgctggttgaagaactgagacttaatccagatggagtggaaactgtgaatgatacaaagcctgagctgaatgtggcatcatcagagggaggggagatggaaaggagagattcagattcattcctaaatatttttccagagaaacaagttaccaaggctggtaatactgaaccagttttagaggaatggatacccgtcctccagagaccttcccggactgctgcagtacccactgtcaaagatgccctagatgctgcactgcccagcccagaggagggtacctcaattgctgcagtgcctgccccagagggaactgctgtagttgctgctttagtgccctttccacatgaggacatcctagttgcttcaatagtctcct

SEQ ID NO: 53096 - DNA, 1225 bp, Homo sapiens
atttttagtagagacagggtttcactgtgttggccaggctggtctcgaactcctgacctcaggtgatccgcctgcctcggcgtcccaaagtgctgggattacaggcatgagccaccacacccggcctgagtaaatattatgagtacctactctgtgccaggtactaggctcctgcagtaaatagaattgacatggtccttggccttgtggaacttatactgagtggaggaggcagatattaagaaaaccacacataaataaatataaaataaatacatagttagaaattttggcaaattctttgaataaaatgatgtcaatggatttgaagacaatagggtggattgaagatatattttggaggtaaaatcaacaagatctgattgtggcttctgtgttggggctgagggagttatcaagggtgacttttaggttctggtttgtacagtggagtggatagtataaattattgatttaaggaagaggtaagggaaagtgggagacactgtttcatttttgaactgttaggcttgggatgcctgtggttcatttttttgcatggagatattaaaaaagcagttggatacgtagctttgaaactcagagagacaaattgagagtcataagcatttattgtggttagtatttaaacccacagaaattgatggaattgcctaggaagaatatagaaagagaagagagtccaggactgacgtcgttctctcactcccacccccaaagatcatttagagatctagaagaggagaaagaaaacaaaggacaacagaaaagaatcagtcaggataaaactggaaaaatgcaataacaaggctggatgccgtggctcatgcctgtaatcctagcactttggaaggctcaggcaggcagatcacttgaggtcaggagttcaagaccagcctggccaacatggtgaaaccctgtctctaccaaaaaatacaaaattagctgggtgtggtggcgcatgcctgtagtccccgttacttgagagactgaggtgagagaatcacttgaacctgggaggcagaggttgcagtgagctgagattatgtcactgcactccagcctgggcaacagtgtgagaccctgtctcaaaaaaaaaaaaatgcagtaacaaagataaaagtgttttaaggagttctttgggaaattttctattttgtgtcctagttgcatcttacaaccttgcaacaatttttactagtgt

SEQ ID NO: 53097 - DNA, 1054 bp, Homo sapiens
aggctggtctcaaactcctgagctctggcaatctgtctgccttggcctcccaaagtgccaggattacaggcatgagccacttgcctagcctattttacttttctgtgtcatttaaagtgctgtccagtaggacttgctgccaagatggatttgttctctatcaatagtccagtagagtaaccactggccatatgtggctttgactatgtgaaacgtggctagtgggtctgaggaactggattttaaatttaatttaaatgtcaatagctatatgtagctgctggctgtcatgttggaaagcacagaaagaatttaaatgtcagttgtagagtgagataggatttggttattgagtaaaagagggccctgtaatgtggacttgacatcttccctccataccttggctttctgccttctttgccttttcattccttcaccttcaccaccaccattttattgtaccaaaagcagctttaaacttgggatgtttttcctgcctctatctgatttttcttcagcagaaacatctttaatgctacaaaatggaattatagcagttgttttttctgggaaccatgttgttggagaaatagtcattttaactgaactgctttgtaatgttgcctaagaaaatatggtataatcaaattatagtaaaaaaatgaagtgcactcataattacttttataaccttcctttttcagtgttccctggggctttccctccctggtaatcttagccagccatagaccattctttctagaatcagtttcctaatcctagtgtggtctgtagtctcatattgaccaaaattggtcttactcaaacttatcattttcttttatatttatttttgtcctcttccattttctgtcatcctctggccttaattgactcacctggctcatggaagaaaaaggaagggaaataaatccaggctagtgaaatatagctggttctatccctctgataactgagagaaacccaatttttttttttttttttttgagatggagtcttgctctgttgcccaggctggagtgcagtggctcag

SEQ ID NO: 53098 - DNA, 1575 bp, Homo sapiens
cctgtctccactaaaaatgcaaaaaaattagctgggcatggtggcgggcgtctgtagtcccagctgctcagaagactgaggcaggagaatggcatgaacccgagaggcggagcttgcagtgagccgagatcacgccactgcactccagcctgggcgacagagcgagactctgtctccaaaaaaaacaaaaaaaaattaagcaacagattttaaaaaaaagaacaaaggaaagagtcattgggttaaagacctaagtagtgtcataactctctgtaattacatgtccataggagaatgtattgaaatacaaaaccacatgttttcttgatgcttcacgtgcaaatgcttgttctttctttttattcctggtcgtctttcattaagtcataaatgccccaagaataaccagtctctgcgtggtatagagagtctaatagcctttgtattaaatcttctttggcttgtaattatctagatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtgagtgacaatggggtagcaagtgtactggaaacggaaggcatagaaaagagacatctgaatctaaggtttcccgaaacctgaatggaaataaaaatttagcagttgcaatctataattactaaaagaggtcagtagtaatttgaaaactactttctccgttctcataatgaacctacatgttcatgatacaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaaggtaagtgagaatgttgggacagtgaactgtaacagccgtagggagtagtagacaacacatttgcttatagtttaagaagcagttcaggagttttagtagaatcctaaactactttgtgtcgtcctgaaaagaaaggtggaaattgattttcattatcttacttaaatctggtttactgtggcatatattagactgaataattttacctgttcatgtatcctatttcagtgttcatctacaattttgtgttaagaggtttttggtgttttcagggtcagcaatattctaaatagtgttgtatatcatgtacaaagttttatctatattttttgttggtttaatttctattttagtgcagttttttctttttaaaaaaaatttatcccaaaggaaattttatttttttctcagctttattggtatatagttgacaaataaaaattgtatatgtttggctgggtgtggtggttcacgcctgtaatcccagcactttgggaggccgaggcaggcggatcacaaggtcaggagatcgagaccatcctggctaacacggtgaaaccccatctctactaa

SEQ ID NO: 53099 - DNA, 1545 bp, Homo sapiens
gggaggcggagcttgcagtgagccgagatcgagccagtgcactccagcctgggagacagagcgagactctgtctcaaaaaaaaaaaaaaaaaatgtttataatatacaatgtgatggtttgatatacatatacgttgtgaaatgtttaccgtagtcaagataattaacatattcatcacttcaaatgttaaccattttttacggcacttttctcttggttcaaaggaagttccctgttagtcacataatgacagtcactgctccatttaaaaatttaagtgtgtgaaaagtatacgagtggtgagaactgtgctatatctcctgtttttgccccaaggatgaaaaaaacttcttttactcaatgaagcttaggatttggcgggttggtttcttttgttttttttctttcttcctagttcagatttcaaaatgatcctgtgttacagcttttcattctctttataatagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggtaagatcaaaggaattttgaggagtgggtcagaggtttgttttgttcttcttcgacttattatcactataagttcttggatgattcatatagatttttggaaggtgtttaatggcttttatttgaaatgggataagattttagagatgatcctcataatcagaatcacactcaggaaatggtctccagcatcttcataaatttccgagagctggaaaactcattgctctgtgtggttgttctgctgtagtataatcatagttccaaatgacagacacagactcctacagtccagccgagttattttctgagtttttcaaacagatttccccctcttatatttataaataatgcttttgatacttggaattgaaatgtgtcatatttcttttctattagcttatagtaatattagatttttttgcctttaggagctagtctgtggttctgttaaatatctgggaattcaagagatgcatgaacttacctcaataaatggtcaaaaagacaggcaacaaatcctccttcaaggaaatattccctttctcttttcatagctataagttatcctgtgacttgagcttaataagtcacatagatgtctttacttttatacagtcctcagttttaaaattaaataccagctaatgagaaatcaataagagagctgatcatttgttattgtatcctttacatttcctaggtagcctatggcagtcttcaaataattccctcttcagtctttttatgtccacctgcccatgacttggcttattccttacctgagttgcaaagtatggcttgcctatgttagtggaagaaacaaaatggaaagaatttaacttacttgtatttccagatttgtactgcttattttcttttctctctgtccatttccagtaatggtacc

SEQ ID NO: 53100 - DNA, 5296 bp, Homo sapiens
aaaatatgtttttctttatattcaaacataattgaatttccagtaatcaaaatgccaactttttttatttaaaccacttcttattaaaataactttgtcagggcataactagcataggacctggcgtaaattaggtcttcagtaaaggtttgctgaacttaagtgcatcatatactcccaggcctcttcaaatgccatatcttagtctgtttttagtaattcaaagacaacattatgacctttcattattaatctgcatgctaatacagttctgtggttgttttcttgtctgttccttgtcaggctatctccaatatccagacttcctcctcactttgtaatttgctgcttttattttatagagtaaaacaaaccacaggtactttggaaagtacatctcttagcacttctctggtctcagtgacagtcatgtatcccaggaaaagccaagcttagttatggatcttatattaaataagagttaagattccaagtgagctataaagtctgtagttttttttgtttggtttttttttggggggggtgctttttgtgttggcaaattcagccagcgtgaggttttttgtttgtttcttttttgtttttttgccttaaatctggattcaaagttatgttctggggcttgaaattaccagaagcctgactggattttggggagttggggagggagttctagttcataggcaatatacagtctttactcttcagatatcttcactcataaatgaaggtagtagtgacagagagaatgaaaacagacaactttttgcctcctttaaaccttattttggtcagatgttcaggtgatatatatactacattctgttttgatttgtgttaaataaggagaacattagaagatttgattctactgttgctactcaccaggtgattggacaaatctttctttaagccttctgactgaactttctcttttataatagggggataattattcttttataatgggggataattattctgtccaccttacaaggttatgacagaatgagaataaggttaatggtgtgaaatcctttaaaacatcgaaatgctacataacgtgtgttctgtttactattggtatttaaactatacctggaaaagactattcttttactgagtatagtactattaccagttttaatgtgacttttcttcctgagcagcttgttctatatatttgtgtaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggtagggagtggttacagtaaatgaaaatagaaaactggaattagaaatcctagaaatgagtaaactgcctgcagcattctagaggatgtgtgttttgtgggtttaacttaaaatatggtcagattattaattggaaaagtcacattcttgaaatacaaatagaaattgactgataggctaccaccggaataaacagcttttgttcccaatttttatattatttttgcctttcagtcggtgagttttttaattgtttaatttgttgtatcatttgttattcatcattttgtgtttacttttcatttattttgtttctgttattcattttttccatctggatttccaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggtattcatgtttccatttttattggttatgttattctgttattttgttattttgattcatgtttctcttcatttatttttttttcttcattacaaacacttcaactttattttatacacaagtgcatagttagtggacttgatgctgactgctaatctgtttttggatgagtccatggaaatacttatatttaacaagttaaatcagtaattctagaagatggtacagggtatatagtcaggggccatctgaactccaactcatgatttacattattaggtgatgggtcactaagattctatttgagcagttttatgaaagataatgtgctttaacaaaaccagatctatctgtgtagtgcccaggatttgatcatacagttaaaaaacttttaggatatttctggatttgttcaaattccggggattctgtgtcatcttaatagaagagtttgcctttttcatttcatttttatgaaatctgtttgggagagtaaaaataggtaatttttctaatagtctgattcttttgcttcgtcaactttaaatatgaagagagtttttaaccaggattctgatttaagtcagtctgttcttactgaatttcttctcttgaactttctgtttattccttattttggacacagtagacaattttgctcaatttcacttctgcctttcttgggttcaggtttggtaccaataattggtaaagctgatgtaattctaagtttttctcatccagcgcataggaaagcttgcctataggtatctgatttaattattttgaatagtcaatgggctaaccaaggagaagatgaggggatcaaatatctgatgtttaaattaaactagtattcatctctttactttaaatttgatctcttaaaggtctcgcattttgtttcatttgtagtgccacagtttcaggattaatggtattctttcctttcaggctttaaatgaagaaattgttaatagaaagaagaatgtagatcaagctattaaaaatggtcaggctcttctaaaacaaaccacaggtactttgaaaagtgtgtctcttagcacccctatggtctcaaagacaattatgtacccaaggaaaggagttccctgccttagcctcttctttatgtatatatgagaagcttagtattcactgattgtattccctactgtgctccagaaggttgtttcctgctaaatcttttgaaaactaagttatctcacatctggttatagatgatgatttctcctctccttcagtatcttgaatgccaacatgcactgaaaggtgctggaaacatctagaaacacttgacgctgaactcagattttaataattcagaagtggcttcttttatccagtggaaagtttattttatttcccatttgcccttagtatgggataggtgaaatcattaccacagagagagagagagcgtctatgaaattaaagctctgatttgaagaaaggggatcagagactcctcattcctaggtctcttaaatatgagtaattgtgtgctatcttccataggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggtgagctgttactttaccataaaaagaaaaaaaggcttcctctttgtcagaatccttaagttttatcaacctttaccttaaatataaactaaaaatatgtgccccctttcttgtttactcatggacagtaagatttgacataaagacatatacgttacacatatgttatgaagaagaaagaagttgaatcaagtttactttgtaacattttaacctctattatttattctctaaagagtgcttcatggttttatttgatttctctgcaggatctagtatagttctagatgcatagaaatattgtataggtacttgttaggttaaatactgagcctttggttaaagcattatttatcatttctgttgaagtaaggagatgaaagaagtattagttgttttacccagagacaatgtggctcaaaaagtcttacaggcagttctaagcaagcaacaatgaagtctaaagtcaggcttcagaatgattgaaaaatctgagatgagaaaaaaataactgaaggaaggaggtcagagtcctgctgggatgtgtggtagagatagcaatttccacccagcacagttgctgatgtgctttatttagcaaggtatggcctgaaaactcttttccctccttaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacaggtaatgcttataatacctctgcattaatattttagacagtattgatgtgtgagatacagtactatgacccacataaatacagactcagaaataagaatgggctcaagctaaatctggtggaataaatatgtttcattgatgggaaatgattgggtagaagtttgtgaggatggatccagaatttgaccaaaatacttgacccctttgagtagagaagtacttggagaagagtctacatgaggccttttcttagctaatgccctgctaagaaggctgatggtgatgggagtagataatatctagattcaaaaggtccaaatgcaccacaatcttagtttgacataattaactctcttagcattagatggaagagggggaaggaattactatcaaatatgcaaaccaaaatagcagagctatctaaaatagaaccttctcagtaaacacaggtgtcatatttcccttgatcttttttccttcctactttctggaaaaaaatcatttgttcttttgtgtagctggatacacacctcttaatgtgccgtagtacaaaaaataagttaatataactccttaggatcatagtgatgaacatatgctttttgaatcacacagaaatttgctctgagt

SEQ ID NO: 53101 - DNA, 1028 bp, Homo sapiens
tttaaaaatgtgttgttcttttggggtcttatgctgcttcagctaagcgggcacttccgagttaacttgactcatccgtctactgccatattaggtttatatttaaacatctgactaaacctactactgttccatgtctgggtaggaaagagcaatggcaggaagagtgtagtctcataaaaacactgattagaggcatctttcttttgaaggggattgatatctgttatttctagctgtagaaactgagttctgtaacttactttaaagaaattgaaatgtggtcagttttaacttgtttgcatcttgatttgtgattttatgaaattcttcccagttttgactctactttgtgagatataaactgtattactgaaaatccaggccttgctttgttgaataaattgcagttatgtggagacttggctgtatataatttgtttatttttctttaatacgtctattagtatgagcaagctgccgatgcagaactagcttgggttgctgaaacaaaacggaaactgatggctctgggtccaattcgcctggaacaggaccagaccacagctcagcttcaggtacagaaggtacgtgcccactctttcctgagctaatagaatcatcagtaacttagagtgactaggagagtttctgactatcccatgtcaagtggaataatttagtggcatgatggtaaatagaaattaattttctatgtatttggttgagatgaggaagaatttttttttttgctttgtgagaaaggaaaaataggcccattaatccataattagcaatttccttgatagaaatttttgtaagctactaaaaagataagctagagaagatgttggataggcaaagtgtcaaactgtataagaacaatttttgatgtggctttttcatagattttgtcttaacctttagtaataacaggaaaagggtctttttacttcttaactacagtttacttttcaaaggctttctccattgacattattcgacacaaagattcaatggatgaactc

SEQ ID NO: 53102 - DNA, 4533 bp, Homo sapiens
tggcagtgggaacctgtaatcccagctacttgggaagctgaggcaggagaatcccttgaacccaggaggcggaggttacagtgagctgagatcgcgccagtgcactccagcctaggtgacagagtgagactctgtctcaaaaacatatataataataataatgctatatctaaggttgtgtatcattactgaaaggttaattttgctgtgtttttcttatactattttactgctttttaaacttttatcttttaaaaattatagaaataaaatatatgtatgataggaaaattagaaaatttcagataagtatgaagaagaaaataaaaatcacttgtaatctttactgatattttaaaataatttagttatgtattcttttagactttttaatgtatatatacctactttttttcttaagagtttataatagtaatacttatcctttttttttttttttttgctcacataggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgagggtaaggagcatgccaagtttcattttattgttctaaaatggtctctataatttatttaaaaacaacatttgttagtgtctataggtgcaagttctgtgttacgaagttaattcttaatcagttagaattcctttcataatacataatctgaattatttccttggttgtttaatatcaattgattaaacactaagattatagagatgtcgagaaccttagaatgacagaactaaagaaagaactcactaaaaatcaatggaatttaaaatatttccggggataatagggtgttgttacactcaaggtatggttggacagtactttctacttagttaggcaccaactggagtgaaagccatgaggtaatgtcaaaaaacatttgctctgtatagttaatgacacttcaaaatgtttatttctggtttatggcttgtgcttattgctattcttataagtggaagtgtataaactggacgtagtcagcagtaaagtcaaggagtggttggattgccaaaaatgttgctattcatagcttatccagcttggtatctcagtctggggaggtagacaattattaaaccatgtagagtaaaatagagtacatagaagtacttatgattacagaagagtgtggagtagacttgtatgacacagctggtaggggaagagaagagaggatgtttccaggaaggctgctagggtgatgagacatcagaactgactttcaaaaattaaattgggtaatgtcagaacctaagacttaggtgtttttctgttcccacacaaatggtgagatgctgggccttgctggtttttaacaattttgtttgttcctcttaaagttgatattagctctgatcaaagtatctaaatacataaactggtataaaagtactcattatggtttaattctttttttacctagcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacaggtatgtgtgtgtctgacactcataaccttgaattgtctactgttctaaacaagaggtctctgtatcaggtatgtctctgtgctcaggaatgtccagagcagcatgttaatacgtgatcggtagatagaacagaaagcttagcctatcttcatttttattccaaggaacattggcatactgacattctaaggagagtgaaatgagtcttggctggtatatattgtctgttgatggtttctctgaaaactttatgttgtgatgatcctttagcagatgattttggataaatttaccttgcagattcaaaagcagtgactgcctcaaaaaagtacttattgaacctgttacttttttgctttagagcaacagcacattagttttcttaagcaaccagctaactcatagtttaagatgcttgagtaaggagtagtaagagccaaagagaagcataaaccagcagagggatttaaagcatgtaactacatactttcaactaatatattactcttagtggtactgttgtcatgtctgggtattttattcctatgtttagtcaatattcttggttaatatttgtacttactcaagtttctccccccaccttccgtcccatctctcactcacattgtggaatgtgttactttgtgttgttgctgcctgctcctgtcttccccacatcgtcacatttcattgttgtgttgaccgcgcccaccattacagattacagaggtaaggtacccatccccattgggactagggtgttcttataatgctgaaaattgaggtcattacctgtaagggaatttcccttaactttagtggaataaatttaattagtgcagtttattatgccagtttcatttggggtggaacctagaagtgagagagtgatgggaagtgatgttgttaaggaatcccaccatgttttttctataggacacttgaaattgataagcctttctttaactaaaaccagagttggtttgagatagatttttcttaggaggcatgcttatctgttttgctcttttctctcctctctgcatcaaattttaatgagaacttttcagttgtagtcatgttattcaaagtaacagaaaagtgggaaggtaataattcttcaagaataaggttagatttggtcttccttaattacctttcattattccaacgttttttctctcttattgttccataaggtgggtcgttaaactgcatgccatgttacttttaaactacaagtcgtgtagcatattaagtttcccatccatttacacagctggtggagggcatctaacttgttggtctagtctgttgcatgcaactgtcatctcagatgttgacatactgactctcagcagtttcatagtcttgtcccttttttgttacattagttggaataggagaaatattgtggcagcactaaagatttgaattggtttctagtatattcatatatttagattcttaaaataaatattggctttttttttttttaatgggccagctctgtatatgcccaaaacagttttgttgttgtttttttctttttcttttttttttcttttagacaaagtcttactctgtcgcccaggctggagtgcagtggtgctatctcagctcactgcaacctctgcctctcgggttcaagtgattgtcatgcctcagcctccctagtagctgggactacgggcgtgcgccaccacacccggctaattttttgtatttttagtagggacggcgtttcaccatgttggccaggctggtcttgaactcctgacctcaggtgatccacacacctcagcctcccaaagtgctgggattacaggtgtgagccaccacccctggcccaaaacagtttcttaaccaaactcaacacttaatagccattgggctaaactgagcacaggttatcctaaacagtagtaggataatatcttgtccttattccctaacacttctccaagaagagtgatgaggtatgctgtgatggtaatgttccaacatttgtttagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaaggtgcttgatgattgtcattatttttaaaaatcaacagaataaattctaggctgtggttatcttcagcatcccaccagatttatttatttctttgaatgtaaaggcagtccccagtaatgagtattccagaaagtcactggaaaatcatttggaattcagaacacatttcgccattgaaacaaggttacaattggtagttagattcccaggccaggaaacaaaagctcctttaacccctaacgtgagtaaactacagtatcaatagtgggtagaacatagctaccttttgtaacactttccatgggaaacatacaagtttaacacagaacactggaaacaagagttctcatcttagcccttttgtaagttaggggttttgtatcttagcactacctttatagtagatgatagctcatttctggattacttctgtgatccctgtatgtgggataccaatgtaagagga

SEQ ID NO: 53103 - DNA, 1168 bp, Homo sapiens
tccctctctctaaaaaaagaaataaataataggccgggtgtggtggctcatgctgataatccaagcactttgggaggccgaggcgggtggatcacctgaggtcaggagttcgagaccagcctggccaacatggtgaaaccccgactctaccaaaaatacaaaaattagccaggcatggtggcacatgcctgttatcctagctacttgggaggctgaggcaggagaatctctggaacctgggaggcagaggttgcagtgagccaagattgcgccactgcactccagcctgggcaacaggagcaagactctgtctccaaaaaaaaaaaaaagaaaaagaaataatagtaaaactaaaatagaaaattatcctttagttataaatgcttagcatttttttaaaaaatagtttcattgaaaaggtcagagttacatggaatttctgaatagaccaatttcaggctcttcagaaagtcctattcatatctctttttttaacctcctcagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgaggtaagaaggaaacaaaaccctttttcttaggtgtctgtcctctagaaaaagcactttatcaaatcaaagtgaggtatgttaactgcttagccaggctgagtaccttaaaggtttttgtttttgtttttgttttttgctcttgtccccaaggctggagtgcaatggcatgatcttgactcactgcaacctccgccttccaggttcaagtggttctcctgcctcagcctcttgaatagctgggattacaggcatgtgccaccatgcctggctaatttttgtatttttagtagagacagggtttccccatgttgaccagagtggttctgaactcctgacctcaggtgatccacccaccttggcctcccaaagtgctgggattacaggcgtgagccaccactccaggcctaaagtttctttttaagtgagacattctccaa

SEQ ID NO: 53104 - DNA, 4086 bp, Homo sapiens
atagatggtagaaaataaaaatcaattttggactcattatctagagataacagttgttacattgacatacttttttctagtttttggtgctatttttcttttcttttcttttcttttcttttcttttcttttttttttttttttttggagacagggtctcactgggtcacccaggctggattgcagtggcatgatcttggttcactgcagcatccacctcccgggctcaagcaatccagccacctcagcttccctagtagctgggtcatatgccaccatgcctggctaatttttttatgttttatagagatggggtttcaccatgttgcccaggcttgtccagaactcctgggctcaagcaatcctccagcctcggcctcccaaagtcctgggattacaggcgtgagacactgcacctggcccaggagtctcttttttaccaacaacatttcttacctcatattgtccatttagcataagccaagcctatcttgatattatttctctaatttcttacttttatttcagctattttttcatagagaaattctttccctccccaccttgggtcaataccaatacatgagccaatttttaggatctggcacagagtttttttcaagatcatagaccccagcacttctgttatactctattgtcagcacttaaatttgtgacttgtactgtgttattttacccttgatatgtttctctgtaatagacttctagctgttgattataatttctttggaggcaggaaggggtgaacctttggtaaattattgaacctcaccataccttttctatagtattttatatatacatatacctatatgtaatatatattttgtatatatgaaaaataaccatgtagagtctgaagctttagtgtccagataagtgaaactgacagttatgttgagcatctgctattgatggggtataaatcacatttgcaaagtttggtaagttctgttctgttttctattttggcttatattctattcgtttacatgtagactattaaggaagagacagatggtctgcatgaagagctggagtttattcggatccttggagcagatttgatttttgcctgtggagaaactgagaagcctgaagtgaggaagagcattgatgaggtgtggagaaatggatgaggcactcagttagaacattagtgggcccagactgaagagtggtattgattgaagaatctgattgaatgtttttcccctagatgaataatgcttgggagaacttaaacaaaacatggaaagagaggctagaaaaacttgaggatgctatgcaagctgctgtgcagtatcaggacactcttcaggtgagaggccaggaggtgaccaccaaggaaatacaggttctgttttttgccatttttgtcatttttggaattaagcacaaaagtggatcaccttcacaggactgcagacctaagatagtggtgtttccacaaatttagccaaagttccccacttgtagtgaaaaaagtagcgacatctgtctgaattcttactcttcctgccatgtttatcattgcctgctcatcatagattcattcagctacgttgtgaagctggccttactgtgaaagtcattgcttgccagaggttccaaacccaggttatcttcaagcacagtttggcacagttgcttcagaacatcatgagcttgctagctgggattgaaaaatcttcacttttattcaaatttagtatttccaaattgtagtttattttgaacattatcttgataatgttggctccattattaaatcaccatattattaatataaagatcattattctttatctgtgccccttacctgaaatcacaaacagcacaaggtgctttgattgatttatgtcttcttatgttagcagagataatgctaattctctcccaaattcttctggttgtttttgactgtttacttgtcttttgttctaggctatgtttgactggctagataacactgtgattaaactctgcaccatgccccctgttggcactgacctcaatactgttaaagatcagttaaatgaaatgaaggtttgtatctgggtatggcttttgaagaagaattgttttattatagtttttaaaggcttgatttgatgttaacattgagtgtgtctttgacaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacaggtaaggcaggtggtagatgacatcagtgaactactctccgctcttttctaatttcgtattgaatattccctttctgtcttttcctgagtagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtaagtattttcattttttcatctctaaccctattgatttgagaccagatgctgccaccagcagcctttgaatgttgtgtatatcttaagagaaccaagttagatgatatccatagagataaattatgttgttcaacatgttttaggtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggtacatgtgacatccaagtaaggtaggaagagctatacagataacagaaagcctatctaagtcagagagaagagatcaatttgaaaagcaaagaatcccttatgtcttgaggggaaggttaatactgtgctgtaacttatctagaaagagcagcttttgattgggtagttcttttctgaattcatttctagctcagtctctttattcacattcaaagttagcagatcttcactataacagattccctttttttcttggatcaagtcaggtctcttcctattcaacagtaccttaatcaatagtcaattcatctgatcgtatcaggcatttataatatgttatagtgaggtctgaaggattctgctagattctagcaataatattggccccatgctaatctagcaacagaacagctttgccagagagcagccgaaaattccttcctcaagataaactcctcatatcatttggaaagttgacttttaaagctgagaaatgactactgacatggttgatatatctttttctcaaaaggcccagggcttccacagtgaaattgaagatttcctcttggaacttactagaatggagagccagctttctgcatctaagcccacaggaggacttcctgaaactgctagggaacagcttgatacacatatggtaatagcaattttttgaaattgagcataagcatcccatattcactagctcctttccaagttcacagtcataattaatatgtatctggaaatctacaaagtagtgcatttttatcaaacatatagtataacctttggggattgctgcctgttacaggcttctaataccttacagtaggcagcagtagtgacagggaaggtcagctggaaattttgagttaatcagctttactggcacacatatattgacttgaagatgacagcatcaagaagacaaatatacaacacagatgtgctttcacttaagaaggaaactacttaaggggggtttagggaaatcaaatagttacccgacagtatttcaagaatgcatgctagaacaaaaagcaacataatttctaggcaaatttttcatgaaaaggggaaatagattattggagtcttttgagggatctctaatccttaaaaaatgtttttcttggccgagcgcagtggc

SEQ ID NO: 53105 - DNA, 1024 bp, Homo sapiens
gtaagccgagatcactgccactgcactccagcctgggtgacagagtgagactccatctcaaaaaaaaaaaagtttttcttctatgggtgataaaattattttaatattttaatttgccacttgttatttagtaaaatatgttaatacttacattttaatacaaatgaattctaagtaatcagtatttagttattacaattaattttattattaagtatggtgggtttcattcccttatggctcagcacttgaactgaatccaaaagaatggcttgtaatcaagatgagcccttcctggactttcccagactctgctacagaatctatatgtaggtgtcttccagagaattcgtagaattgatatctttcctgccttttcttgtaggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaaggtacagtgtatgatccccatgtttgagtaatttgctgagtgattgcatgtataataattgccatcttatttatatgaagattttttgaagaccagggtattgtaacagaagttgcagaactgattccatctgtgttgagttgcattgatggtataagtttctgttgttatttgcttttataattattcattccttacctgttaagacattactgccattatcgcttcgtgatgggctttatgtcctatattaatcaccaatttgtgttctacttaaaaacaaggttttgctggagttggtatcttggggttgagagattggggacagggcatatagggactgacgaataattctccacaaggaatttggttcctaacgtaaatgtagtgtgcaaggaaatttactagaaatcaggagagaagtaaattatatgacctcttcccactcatcctcaaaaatcaaatt

SEQ ID NO: 53106 - DNA, 2420 bp, Homo sapiens
aatctacatctagtgttgtcagatttttgcctagaatgtcttggcttctttcgttacctcttcttcttatagcataagcataatttttagactcatattttcatatgccatattttctgaaaacatgtatttaaacaaagagtactacattgaacatcatcttcatagtaaattgcttttcatttagctgtttttataccacaaaaagtacattaaaggaaactgaaacattacccaaagcaggttgtagatcctgcagctgtcaccactaaagggtctgttcacttacagttattgaatagtcttattcccgttcaaggaagtggagagtagcagagaaaggaacttagctgcttattgtgctctatttccttttccatgtacacagttcttgcccatttgtttcagacactaacattaaaatgtccccttctttacaaataaagcatgtttggacgttgattaaatgaggcttcctttttagaggtcatttcatttgttgtacaattcatgcctttgtcgctgagcctataattcctgaaattggcgctttttctttctgtgtgtgtgtgttttacttgaaattcagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtaagtatgatattatgatgctgcattctttttgaaagcactaattgaaagaaatgcccctttatcttatcttaagctaaaaaagagcactattgttccctcaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaagtaagttggggaagaaagatactaattcactgaagagtcttgggctgcatgtattgagtctctgggatgattctcaaacgtgctgtatagtgtgtatattcattcctgttaacttatttcttatgtaattttagttccatgaagcttggaaaaaactgattgactggctagaagatgcagagagtcacctggactcagaactagagatatccaatgacccagacaaaattaaacttcagctttctaagcataaggtaaagcagttaattgctcttaggtcccaagccatagtattcgctaaagcttgtatcttgccaaaaataaaaatcagagctagtaaaaagaaaaccaattggttaatgtttaaaagtcaaaatgatgaagccagggttccattttatatctagatggtctaatcatgatatttgctcatttaaataacagtttaaggaaagtagttatgggagtaactagttaaaactgtaggctttcacaaattgtcaggcacttctatatatggtataaacaaaaaattataaatttcttaaggataagctatggttaattttagttcaaaaaaagtggtgatattcatactttatttggtttctagcctgaaaactcaaattcttttgttccaaatcaagatgtcgtctgacttttaacacttttttcttttctttctggaaacataggagtttcagaagactcttggtggcaagcagcctgtgtatgataccacaattagaactggcagagcactgaaagaaaagactttgcttcccgaagatagtcagaaacttgacaatttcctaggagaagtcagagacaaatgggatactgtttgtggcaagtctgtggagcggtgagcatgaatgtccccttcaggggtctaaccgggatcccaaaagcaagaggttcttaccagattctataaaatggtgataaagctaatgcatcagtaagaggttttgtaccatcttaacaccaccagttagttcaaagactgttataatttaaataaaatgtgtaaaaattctcattttaaacttgaaccttattgtattagagagaggcctataaaatcaaaccaacaataatagatcagtaactcaaaagtatttgtaaatcatcaatttgtaataccaacaactgtcttattgactgctcttggacactccaaagcctctacatgcattacctcatttaaccataatgatacctgacctttgctgggcaattactactgaatatgtaccaaacagtagctgataatcatttaatcctcataaccactgaggtgggtaccatttttattccattgtacagatgagaaaatgaccataaagaggttcttaactccc

SEQ ID NO: 53107 - DNA, 1044 bp, Homo sapiens
attttacagatgaagaaactgggccttaagcaacttttcaaaattatgtatctcctaaatgcctgagctagcatttacagccacattttctggttgtttttttctttcttttttctttttttccccttgagattgggtctcgccatgttgcccagactggtcttgaactcctgggctcaagcagtcctctcatctcggcttcccaaaatgctgggattacaggcatgagccactgcgcccggcctggttgttttttcttatgcattgctctgcctccctctatgcataaaagacacatgattagaacctaccaagaaaattattatttcccagtggtttcttggactcaaaacattccttgaacaaacaaattctcctattttcttttctaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagtaagggatatttgctgtcccaacccaagggatagatctgagtgggtttatttggtttttcttttactagaatctgttccagtcagtcttgaaataagtataacagagttgaaaattgatattctgaatgttctataaaattttaatattcattttgagaaataatgaattcagttgattttcaaagatctacaaatgaaagataacctttgtggagttttgatgaggccatgaaatgtctgaatgaacactggaccctttccctagcatgtcccagtatctaggtccttggctgcagagagaggttgaatcttttgtgcttggttatttcaggcggaagtgtttcgagacacagtccacatgctgttggagtggctttctgaagcagagcaaacgcttcgctttcggggagcacttcctgatgacacagaggccctgcagtctctcattgacaccc

SEQ ID NO: 53108 - DNA, 1018 bp, Homo sapiens
tgtctggggtctcagtctgtcctaatgaggtgggaaatgtttccctttttaaatttttatgttatccactcagagattttaatcatggatttgttattatattctgttatgggtattttttaaaatcatggtttttacaactataattatatttttccaatacaaatatgtttaccaacatgaaatgaaataggatataaatgagagtaaatgaaaaatgggactaaaaaagagagaaactaactcgaatgggaaaaggggggcatacctctgtgtgtcctattctttgttgtcatctccaccagagaaagtcattcttgtgtaaacccctcaccttcccacatcttttagaatgaaaatgccataaataactatacaggcttttagaggtctgcgttaacacatggaggaaaaagaaaacattgaaatttatcccccctcagtgtaaactaacagtgctgctaatgtagactttttacgtttttgttttcaaatcttttttgtttaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtgagtccctggttcagaggaggactgcacacgcccagtaaactatcactatagtatagtatagtatttttcccccaggtaaggaatctttcactcactgtgaataactcagcaaaaattaagttaacattttagtaaagactgttttcttggtaatgtgtggcaacctggaggagtagtgttggcatagtgctatgttaatgtgacttccagtggacatgttgtgtagtgtctgctccttcctgggaaatcctgtgttaacaggatgtacagctgacccttgaacaatgtgtatttcaactgcacaggtccacttatatgcggttattgttcagtaaatacagtcagccctccatgttggtgggg

SEQ ID NO: 53109 - DNA, 1815 bp, Homo sapiens
ttctggtgagggcttcaggaagcttagaatcatggtggaaggcaaaggggagccagcgtgttacatggcaagagagggagagagagaaagaggaggagatagcaggctccttttaaacagccagttctcatgtgaactaacagcaagaactcactcattaccatggggagggcaccaaggccattcatgaggaatttgcccccataactcaatcacatcccgttagaccccacctccagcattggaaatcacatttcaacatgagatttggaggggacaaatatccaaactacatccctcagtaactcaactcaggcaccagcctccacacagcctttcctgccaccacaggccgtaaagtacccatcctagctcttcctttgcccccataagagtaaaaatacaatatttaactctttttcctattttttgtgtttaacagacatttatggaggagatgactcgcaaacagcctgacgtggaccgggtcaccaagacatacaaaaggaaaaacatagagcctactcacgcgcctttcatagagaaatcccgcagcggaggcagtatgtttccagccccctgtgttaggatgcttcattcctgctaattgaggatgagcactttccaaatgcctatcaaaaaaaattatattccattttcaaaaaccgtgttggttttgaaccaaaatctctcatttttgaaactcacttttcttacattgacagacagtagctgtactccatattctttggtatgattggtatgaaattacgaggtggttaagcttattttttaacagtggcctttccattgttttggttatcagccctagctgtttacatttggcttgtactaatttaatcaacacaacagcttctacagaatatgttgcttttttagttgagttaacgtgtcatcagctcactaaggtaggacagaattgcttggagatatgtaggcagcaggtaagtatgtgctgggaggatcagtacttttggaattagtacacctccgtatctaaatattgccaagtcccgtatttcttttctcagttattgactggatattattataaagatcttctaggtttatacatacagctatttctctttgtatactaaccagctgttctaatcttgtgattatttttccttttagggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggaggtaatgccctgctgagtggccttccctgaaacaaagtgcttttttcaatcaaaacacagcccttctgaggctctcttaatgtgaaccttgtgtcttaatttactttttcacaatagaaacagacctataccaagccagtactcattctttgaggcccctgaatgagaaaagacacatgtgtaagaaaaccgtttgtgacagagtaggctaaagcttctaggtgtggaaagcaagaaaacagccagtccataatgagggccaggacctgatctgcctcagcatcttgctgtggttgggaatcaggaacagaactttggaaatttatctccagatatgtagcatagcacaaaaatgacccttgttgagcctttcatgtaaaaacagatgctacagaattatgaaataggagtaatttttaatgattttgttattagtcttcacttgatcatgagaagcaactctattttgaagtgtcattacccagtataaaaaa

SEQ ID NO: 53110 - DNA, 1073 bp, Homo sapiens
ttgaaatctcagaagatagtggtaaacacgagcctcctgatatgagccctatgtgtgattataatgcctttcaaaacaacataatcgaggagtgctaaggacctcccttctgggttagaatccatttccttgcatctaagagagtgatcctttgaaaagcccaaagggaaagcaaggctggcttcacccattctcattctgtgtgctccatattttccatggtgattcagttattgtttctcttgctattccattataccatagctcgtgtaaatagtcatggctttaagtgaaagagccagattgtgccttcacaaaagaagcaaacacatagatttcattgttgatggcccctggaagcatggctttactgaatgtctgaaagtttgggtatgctctgggcagcttttgagggcccaaaaaataaatcttattgacacttctgatttctgtgtagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccagtgagtctagtcatcattccaaacatgggtcacacctggattccttgcactttgtagaagctgtgatattctagctaaacagtctttctgaagctggccaggagcttggctcacacctgtaattccagcactttgggaggcaggtggcaaaggcatggtggcacacttgcagtcctagctacttgggaggctgaggtgaatcacctgagcctggggaggtcaaggcctgcagtaagctgtaatcgtgccagtgaactctagcctgggcaacagagtgagactctgtctcaaaaaaaaaaaaaaaaaagacagtggttaaccagaggttttcagctgggaaacaatatgatttggtctgtgttttagtaaatcactgtgactactataaatagtcacacttccctttgtatagcaatttgtttagaatctaagacaataatctaaacataggaa

SEQ ID NO: 53111 - DNA, 1015 bp, Homo sapiens
tcgcgcctgtaatcccagcactttgggaggccaagatgggtggatcacttgaggccaggagttcaagaccagcctggccaacatggcaaaacctcgtctctactaaaaatacaaaaaaaattagccgggcctggtgacaggcgcttgtattcccagctactctggaagctgaggcaggagaatcacttgaaccagggagacggaagttgcagtgagccgagattgcaccactgcactccagcctgggcgacagagcaagaccttgtctcaaaaaaaaaaaaaaaaaaaaaaaaaaatctataaccgccaaccgaacaagtacccctcttaatgtttcaaaatatgattccttttctccagagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggtaagggaaataattatattttgagtacacttctggctgtaggtttgtaatatcctgaatttggttgggttcagtgatcatattagcctttgacttgtctgttgggagataattatttggagttctattttgagatctctttttggatagcatttcaaagagtcccagaggatctctgacatctgagctctagctcaggctagatggattactcaagtgagtcatgtctgtgtggtgctctgaagtttacagagaacctttgcagggcagcatactcatcctggttcactcgtcctgtgtttgggatggactcatctcactcttgagcatgctgcctggaatctagggaaatggtctaccagtgtagcatttaagggttgaaatggactgggcatggtggcttacatctgtagctctagcactttgggaggccaacacgggaggatcactggagcccaggagttcgagaccagcctgggcaacatagtatgattctgtct

SEQ ID NO: 53112 - DNA, 1532 bp, Homo sapiens
attagttcacttagtaagaagaacatatactaatttggaacagacaataaatgtatatgtcaaaagcctgaaatgcctaaaaagtaaataatgagctgtgcgtggtggctcacgcctgtaatcccagcactttgggaggctgaggcaggcggatcacctgaggtcgggagttcaaggccagcctgaccaacatgaagaaaccccatctctactaaaaaaatacaaaaaattagctgggcctggtggtgcgtgcctataatcccagccacttggggggctgaggtaggagaattgtttgaaccaggaggcggaggttgtggtggagccgagatcgcaccattgccctccagcctgggcaacaagagcgaaactccatctcaaaaaaaaaaaaaaatgtaaataatgaatagcctccctgttaatgtataaaaatctttgtttctctgaataggaagttttgctctaccctttacactttcctttttgttcacacccaataggttacaagacaagtggctcagtgcaaatgtgcaaaaaggtttcaggtggagcagatcggagagaataaataccgggtaaggaagagaaaaagcagtcctttgttgtggtggtttctcatatgtggctgatcccaccttttcctcctgatgcttagaggcccagagcccatcggacttgagatgtggtcactctctgacctcatctctatagatgccaagtgtcaggtaccctgttacatctgaaaactagtcccatatctacctagatagtagtagtttgtatttaagttttaagataggagatatttcagagctgtcacttcacatctgacaaagttcctagggggatgaaggtacctttggaaacaattatatctattgactgaccacttgcccacaaagagatggtcattgtgagcctgagtggctcccaggctagagaggcctggggaaactgtgttgaagccccaacagacactgtgcctgctctgagctgggctacaaatggggcccaggagcactgaggagacatcaggctcagtggtcttccctggaaagccatgctaggtgtggccataactgacagtgaactatacttgtgttttagcttcttttgggaccagggtcagggacatagaaggatctgaaacaggtctcctaaaatatatcaacagctcgtcaagattctctaaagtcctaagaaaaatctatgattggcaaagaggatttagattgcactaagaaacacaggaaggtccatgtttcattagtatatccaaaatgtcctcaaagtacaccaaatctaccccatgctgcagtctcctgaggagtgctgggtgaatctgctttgaatataacctagggcatttagttaataaagctccatataatcttatgcctgcttgttggattttgttttcttgttttttgtttttaattatctatgagagaaatgaattaacaagaacaacatagcatggagagttagttcatagtttataaaaccacatccctggccgggcgtggtggctc

SEQ ID NO: 53113 - DNA, 1094 bp, Homo sapiens
ggccctcaaacatcccaggccttgcaagtcactatagaaatgttctaggcaagtgggaagaacaggggataagagaaaaaaactaaagatgagaacaaactggctttaaaaaaacatcattgcttgagagtgtccaatatgcctatttgctaatgactgtgtgtgaatgctagggtgcctttgaagagtcctgacaccctcttctactgctccattgatcaggagagggtcagatgacttctaatgttgagaacggaattatgaagttcattttatacacaggcaactgaggcctcaaagatcacatgcctactctcacacagctagtgtcagccactgcaagaacccaagtctctgtaagaggttttccttttaaaaggtggaaacaacagttactgacccttaggactcttatttgttctttgcctcactgacaaccttgtcctaccaggtgtgcacaggtctccatttttagagctgccataatccctcctaccacttgtgactctggcctcaacttccccagctacactggctgctggcttggtcaaacctcctttcccccatagcttagcagaaacaagttagaatctttcaaagagagctttagtgtgaaattaaggttgggggggacatgaaatatatggagtgataaattatagtacacagtattccaagaataaagtactcttgtggttccttcctgattcaccctggggtacacacaggtgcatactccctgcctctcacccatccagagaaaaccctttgcagtgactcaggtccaagagcactgctcttgggtggaatcctccatatctctcagaacctcccacagggcttctcattttcacttgtggggcccagcttctgagagggggctctcacagagcctggggggcagcttccttcccaggacaggacgtgtattctctttcaagtctgggttcagtgctgctgctaccacacagtgcttttgctgcagtcactttgtataaacatgtttaaattgtatcagatgaaaggtgtgggacttcttttattttcaaagtaaagggctgggagggaggatacagtatttttcaattgccttg

SEQ ID NO: 53114 - DNA, 2789 bp, Homo sapiens
atggcatgaacccaggaggcggagcttgcaatgagccaagatcgcgccactgcactccagcctaggcgacagaacgagactccatctcaaaaaaaagaaaaagaaaaagaaaatcctaccaactccatacccgaggaacccttgaattgaatgattttaggaattccatttctcctaccagatgtttgtttgttttggaaactctgcatacttctcttttgttgctccttacttcattttggaaagagggtaatttatgccatgagaaactccagatgtttagagctgggaagtaggaatgtttgggcaagaaaaaagggaaaacataaataatcagaaatatgcttgttttagcatctaaaatgattattggatactgttcataatcatcatgggagctacaatttttaattgcttcaactcaattttagtataaatatgacctaatcatttgttcagctgaagaaacttttctgctggtgacactgcaattagcaaatacttcgggttaattcctgaaaacctgatgcagaaaatcagattttcttctaagcttgtaatgatgctttgcaaaggtttccttaaggcttgaaatagtattcactattttccatttagctttaaagcatactgtattcagaagttgatatccacaatctttcttttaggaaaacaaattagcatgccaagaatatgaatttttaattgagcagaatctcttttaaaaaaataaagtgacctaacactttgtctgttttcctacctctccttttggtgcagaggcagtggtgtgaccattaaaagtgatttttatcccaatagaaagtatattggcccggcgcagtgtctcatgcctgtattcccagccctttgggaggccaagactggcggatcacgaggtcaggagttcaagacagcctggcaaacatgttgaaaccccgtctctactaacaatacaaaaattagctgggcgtgatggcacacgcctaataaacccagctactcgggaggctgaggcaggagaattgcttgaacctgggaggcagaggttacagtaagctgagatcacactgttgtactccagcctgggcaacaagagtgaaactctgtctcacaaagaaaaaagtatatcaagacaccagtctttagcttgatatttctgcttttctatttttaaaatccttttgtgaaatatataaaaatgcaaaattgtgagagttaacaattcttctgtagctatcaaattgtcattcctgtctgaatacagtctgctttgggagaaaaacatagatctgctttaagacatatatattaattaagtttcctttgattctacagtttggggattctcagcagttgcggctggtccgtattctgcgcagcaccgtgatggttcgcgttggtggaggatggatggccttggatgaatttttagtgaaaaatgatccctgccgaggtaaggaaccattctaagcatgaattacgtgttaggtatgcccccagcagtgatcttttatgcttacaggaagcattgatggtggggtctgtctgttttttattttgttaagctgcccaggtgtcatcccactagcacagattagaactcaggggtgccagcataggccagggagaaaaagctgaagaggttgatgctatttggggaggtaggtctagaggaatgcagtaatgagaattaagagtgtattggtgttactcgaatgtttgtttggggtattaaattaacactatcctagaaaggagcccagtgaagccctttaggttccctcttagtgcctcagatccctttgcctgtaattcctgtggctgatactcagggagagtgttaggcccttctcatacagggaagaactggtgagccccctggaccaggaggaaggataaagacacctacatgtgagcccattcacttctaagacaggtggccacctaagcaagaccatggggtgtctttctgctaaatgtgaaaaggctggcccaccagcccagaagcataaggagactgtcaatttaatatgagcatgagtggtggcatctgcagctagggggtgtgtggggactgcaacagggaagagatgaccggttccaattgctaaatcctcttcagctatgtccttgcctttttcctgttagcagagctgcatgtgggtgcacaggaggctcccccactgtctgccaatttgtctttcttgactagtttctgcgtttcctgccctgtctgtttctttctgtttacgtattttttattctagttcaccatcctgggagtaaaataaagcgctctgattccagctcttcgatttccagtcagtctcccataggttggcttttaagctttgtccctcttcctcacaccctagcccattgagaatggctttgcttcttaaactgtaacatctcttggttctgtgtatctgctgcattcatgaatgcttgaaatggccaaaccatagcttttctaactactcaagttgatggtgcataaaatactgttgagacagtgtccatggaatttgttttgagtttctatttaacaaatacttatatagttttatgtgccacacactattacaagtactttacaagtaacacatttatgcctcatatgaagtgtagatgctcttatctctgttttacagaataggaaattgaggcatagaaaacgtaaataatttgcccaaagacaaacaactagtaaatggcagagatgagattcaaattcagggcaatctgggtctggagtatgtgcccctagtcagcatgttatatct

SEQ ID NO: 53115 - DNA, 1896 bp, Homo sapiens
gcccaaggcaggaggattgttgaagctcagaagttcaagaccatctttagcaacatagtgaaaccccatctccacaaaaaaaaatttaaaaattagctaagcatggtggtacacacctgtgtagtcctaactactctggaggctgaggtgggagtattgcttgagcccaggagttcaaagctacagtgagccatgatcatgccactgcactccagcctgggcaacaaggcaagactcttgtctacaaaaaagtaattttgaaaacacttaaaaacttgaaagtatttagttttagaatttaaaagctgtcttttattgctttaatgagaaacaatatatgccattttaactttaactcagtaaaacaactttattcctttccaaatctatgaataaggtcctatttttcctgtcatgtatgatcagactaaataaaagagatattgcatgtggcattttggaatccttgattgcctgtttatttgctgcctgctctatttatgataacatcatgctgctggccaaggagaacactgcttgctttgtccttatcttagtatctaaaatttggaaccccaaggaaattggggagggccatctagaagctattttctatgaaagctagtaaccttttttagcatcccttggaacaagcaaggtaagactttcctgtgtctctccaggagtgctctcctggaactcagtaatcatctcaatccattgactgtggagagaactctccagaagttttaaatttcgtaactctgtcagtgatgggcaggatgagctatttttaatcaaataaaaaatggtgctaggcgatgaacacctaaggactaggatggattataataagttagaagggtatgaaggatgagaagagaacaaagttacttgaaactatattggaagttctataaggattaatgtggcttctggaaacagtgcttatggtaggttttgtactcatttatgttgcatatttccttgggtctctggaatgtagagaatgctatactgaggacagtacaagatgtgtgacaaggttcttaacaccagtgtgcactatcatttcttacctccttttacacagctattttaaaaggtagaagatatctcaaactgcatgtagcttttagtcatgtgtaaaaaaatgaaaatattttactagctagatttgccagtctcctggtactgccaaaatcagatatttcagtttctgaatgtatccgtggcacaggaaatcatgatgttttggatagagagaaaaaaagtgctcctgcctaaataatgggtatacttgtacctaaggtactgtgtatgtttttgatcattagacatattagctcccccagataagtgaacatctaggaaatttcatttatgaagatttaaaagacacattttgaaatagaactcattttttttttcagattgttatacagataaaatttaccatcctaaccatttttaagtacaggactaagtatatttgtgtcatactaccgtcaccaccgtccatccacagaactctcttcatcttgtaaaactgaaactctatacccattaaacaatagcttagaactgaattttaacatgcccgcatcagccagtttcaggtggccagcataactcccttagcaaagacagcctctttggtggtcaatgaactgaacttgaggtggctgccgtcatgtctggttctgtaggttcaatggtagatcttttctccagtgaaaagaatggtgagggggaaaatcctatcacagtagtcaaccaagtactaggaatcttctcttttttttaactttaggactataatacccaattttgggaaatatttgaatcaatgtaaatattaagagtacctttactactaaattcaagtgctagtac

SEQ ID NO: 53116 - DNA, 1090 bp, Homo sapiens
gcgtgggtgctgtctccttcagccaagcacagcaccagtgaacactgacctgaggctcacattctagcttctgaatttcttggcctaggcacttgagtttctgtagccttgatttgaatacacatgccagcaattaagcatgttcaagtgcagccattaaagtgcctgaacgcttttggaagagcagtgttttagaaataaaacatggactagtggcttgtctgatagtagtgcagtttgcattccagctcctaccaagaaacattggattcttgtgcctcaagacagtgttgccttcagtcttggaaagccttagccagggaaacaagggatgcacaagaagtcaatggctatgaatgagctgctgttttgaggttcatttcacttcaagctaaaactccagttcagaaatatatctggtttagaatatgatctggggacctactgccactaaactactagactcaccctgcttatcttgcttttcttctttccttaatggctccagtttcataaaaatctcagttctattttaaattttagatgtttaatgatgtacaaattctcatacagttctgataaatcagggcttttgttctgtcttaaggttttattttctgtttcatttcattttgaggcttcatctttccttacttattggtgttctgtagccaggccatctcctgacttggaattctagcccgggttctagctgtggtcttccagcagcagtgcgcaggaaccttagcttctgaaactggtgttcttcctcctatgtggccaggaaattttgtgcttgagtgttaatcactttctatcgcttatgctttttctttataaatttaagaagtacagcaaacaatgagatggattgcttttctcttctgtttgcataaacgtcttaaaggtcctggaaaacaatttacataattgatttcaaagaaaaattagaatggcatgctgtagcatgtggcataagtaatgttttgggggtttttttgtttgtttgtttgtttgttttttcattttttaaaaagcaaagtagagacaaggtcaaataatggatgtttaaaacatttaaggatcagcc

SEQ ID NO: 53117 - DNA, 1080 bp, Homo sapiens
gggaggctgaggcaggagatcacttgaacctgggaggcagaggttgcagtgagccaagattgtgccactgcactccagcctgggcaacagagtgagactgcctcaaaaaaaaaaaaaaaaaaaaaaaaccccacacagatttaaggctggacatggtggctcacccctgtaatcccaacactttgtgaggccgaggtgggcagatcacttgagcccaggagttcaagaccagcctgggcaacatggagaaaccctgtctctacaaaaaatacaaaaataagccagccactagggaggctgaggtgggaggattgcttgagcctgggaggtcgaggctgcaatgagccatgaagtatgccactgtgctccagtctgggtgatggagcaagactctgtctcaaaaaaaaaaaaaaaaaaaaaaaaaacacccacacatttaaaatactctttttcctccagttaagcctactatctaaaaaaccaaaaaaaatcactcaaataggaaacatagcacctattggtagcagtgataataatatgtagctcttttccagtttgggaaatgcttctattcatcatttattcatgcaagtttttattgagttcctcttctgtgctgtgcagaacacaggaagcaggggagagaatagaagtgtacaagcagtgttctgagtagtgagacaagacctctctactaaggtcatcctttcaatagagcccctgcagggaatgagggggtgagccacacgtgtatctggggtaggcttggggtgtggtgattgtgcaacaacagtccaggcaaaatgaacagcaaggggacaagactggtggaccctcactgggccattggtggaacagcaaggaagctagtgtggctgggatggactgatgaggagtgtggtagaaatgaagtcaaagaggcaggatttaatccctgatttcccaagagagaagcaaagacacaggtgttaatttcaatcagtcctggaacccagactcaaacccaggtctcctggttcttcatgcacagacttgttcctgatgtctcagtcccacagtcgtgtgcttctcatagtttat

SEQ ID NO: 53118 - DNA, 2224 bp, Homo sapiens
ctatccatcctgcccatggattagcccggctggcaggctcacccacctgtgctgaggtggttgagcaaccttgcttgcctccactttggggccatggaaggtgacagtgctgctgatagagtggctttctaatccccaggaggcagcttctcaagtagaatcacaaagccagaaaaggcttcagcaacttctgtatggatgaggaaactggggtgcagaaaggctgtgagatttgcttaagatcacacaggatcagaaccctagcttctgctcacttgttcttccaccccatgccatctctattaagtctgctgttttattcttgaattccagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaatattttgtatttcctgattttcttttcaactattaccttatctataaatgttaccctggggtataatcatgttgtaggtacttaaatgcattccgcaaatcaaaatatcttgatggataaattatagagcttaatagatcttgttttatttcatccttgttaattttgtttaatatggctgggcatggtggctcacgcccataatcccagcactatgggaggccaaggcaggaggatcacttgagttcaggagttggagaccagcctgggaaacatagtaagaccttgtatctactaaaactaaagaaacaattaggcatggtggcacatgcctatagccgcaactactagggaacttaaggtgggaggatcacttgagcctgggaagtcaaggctacagtgagccacgattgcaccactgcaccccagcctgggtgacacag

SEQ ID NO: 53119 - DNA, 1081 bp, Homo sapiens
tcctcgcccggaccaaccgccagccacgccgaggtcgcacctcggggtcgccccacccgcaacacctgccgccgcccggggctcctagcgggcgcggcctccgcgcccaggccccgcccccgcgcccccattggtcagtcccgggggtgggcgggcggcacagacggctgagccggggcaaggactcgcgggaatcgcgccgcccgggtcgctgccggagctcgccggtcgcccctgcgctgcgcggaccgcagccacagccggactggtgggaacggcggcgacagacggattggctgacagtcccagccctcagaacagccccggcctcgaagcgttggcgtctgcgtccgcgtcagcgtccgcttgtcccggagccggggcaggtgcgcgcggggggcgctccagggaccgcgctgaggccgcagacgccgcccgccgagccccgccccctgctcgccgaactcagctccccgttcgccgtcggggcgtccccgggcccaggggcggcggcggagctgatgtgcgcccgctgagcgcccccggcccgccatggccgcgcgccccggaccgctctggcttctgggcctgacgttgtgcgcgctgggcgggggcggccccggcctgcgacccccgcccggctgtccccagcgacgtctgggcgcgcgcgagcgccgggacgtgcagcgcgagatcctggcggtgctcgggctacccgggcggccccggccccgcgcgccacccgccgcctcccggctgcccgcgtccgcgccgctcttcatgctggacctgtaccacgccatggctggcgacgacgacgaggacggcgcgcccgcggagcagcgcctgggccgcgccgacctggtcatgagcttcgtcaacatgggtgagtgcggccgcccgcgcggggaccctcggagtaagctggctgcaggggaggggcgcgcatccgcgggcggtgccgggccctggccgaacggggaatcacagacggtggacgcgaaccacaggggagtgggaccgccgtggttagggaaggtctaagggtcatgggggccccctgggctgcggggtggtcagg

SEQ ID NO: 53120 - DNA, 1021 bp, Homo sapiens
ttgtttttttttccttgaaacacactctcattctgtcgcccagctggagtgtggtgacacaatcacacctcactgcagcctcaacctcccaggctcaagcagtcctcccacctcagcttcccgggaagttcaccaccatgcccagctcatttttgtttttatatttttgttgagacagggtctcactatgttgcccaggctggtctcaaatgcctaggttcaagcaatcctcccacctcggcctcccaaagtgctgggattacaagcgtgagccaccttgcctggcctcaaaagtttctttacttaattgcttttacaatagaaaggttattgaaatccaaacaagtacaggatgatacacagttttattggtgaggcttggcatctccagggttagttatcatgttttcagcggcatcctcagtctggaagcggctgtgggggacaatcccgtttacaggcttcactcctcctggggctgaggcccaagtcagatctctgtttcagccttttctttctttcttttctgtccataagcccagctcgtgcataagaactcgggctctggaatgagactgccgcaggctgcaacctgggctctgggacttggttcaatgtttctgctctgcctggcatctcccttgtgggcatcagggagacagttaatgccctgctcttgggctgtgcccagcagaacaagcactcgctcaacctggcagatgctaccacgagctgtctcggtgataagtttgacattcacaccccagaaagtgcgggacggaagacagaacacaggtctcggcgtccttggaccaaggtgggagcgctggttctcggagtcactggcagtaggactctgggtctcctgtgaagtaggagctgcagggtcactgtaaggacccaatgaggtgatccatgggaaaaatcttccaacttgtaaaacacttcacaaatgttattatttgtgacgcagctgtcactaataacaccgcctgcagctcactgagcaccccctcccacc

SEQ ID NO: 53121 - DNA, 1048 bp, Homo sapiens
actttgggagatggaggcaggaggatcacttgaagccaggagttcaagacccaacctgggcaatagtgaggccctgtttctacaaaataataattttttttttttttttgagacagagtcttgctttgttgcccaggctggagtgcagtggcacaatctcggcttgctgcagcctctgcctcctgggttccagtgattcccctgcctcaacctcctgggtagctgggattacaggcgcatgccaccatacctggctaatttttgtatttttagtagagacgggcttttgccatgttggccaggctgctctcgaactcttgacctcaggtgatctgccagcctcagcctcccaaagtgctgggattataggtgtgagccactgtgcctggccaaataataataatttttaaaaaagaaaatgattttaattcttattgccactgtaacaaattactacaaatttagtggcttaaaacaacacaaatttatcttacaattttagaggtcagaaacccaaaaggggtctcactgggctaaaatcaaggtgttgccagggctctgttgcttctgggggctccaaggagaatctgtttccttgcctttcccagcttctagaggctacccacattatttggctcttggccccttccacttcaaaaccagcaatggcgtctcaaatctttctcacactgcatcactttgaaactctctacttctcttttccatatttagatgactcttgtgattacattgggtccatctgaataatcccagataataattttattttaaggttaactagcaaccttacatctgcaaccttacatctgcaaccttaattctttcctgtcatataacataacatagtcacaggttctgagaaataggctgtggacatctttggagagccattctgcctaccacaaaacccttaaatgccccctgccccctgctttttatttttgtgattgatattcatgactaaatatgaaacaaggatgtcatttaatgctagcattccattttttttttaattactgggaataaa

SEQ ID NO: 53122 - DNA, 1112 bp, Homo sapiens
cttgaattcctgacctcgtgatccacccacctcggcctcccaaagtgctgggattacaggcatgagccactgcgcctggccctttgtttttttgagatgaggtctcactacattgctcaagctggtctcaacctcctgagctcaagcagccctcccacctcagccttccaaagtgctgggattacaggcacaagccatcacacccagccagggacaccttatttcttaagtagctggtctcattttgtaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggtgggtgtgctgtttggtcacagctcttgggaacctgccggctggcagtattctgcagtggttggggagagggatttttcgttattagagttctagaatgtcacaataaggacccttcaagtaaaaatgaaggacttacccatggtcacaaacacacacccacagtggcagtggtagcataaaacagtccccattagctgacccctcagctcttgaatagaaagaacatttaaataattagcttaggtcctggttagtgagatgagatgagatacttctctaggatgggttcagtccttaagggggtgtttgggtattcttctgtcttacaggctcagggaaggcctccatattatacacctaaccagttagcacagatgaggcctaatccacgctggcagcaaggtgggagacctcaaggtaggtggtggggaacagtaattgacagcccaggatatacctgtcctggtctcccctgcctttccttcttccccactctgaggcacagcctaggttctggtccacatcacttctcaatgatgtgcaatttttctcttcaccaggcttccaaggaatgccaagtgctata

SEQ ID NO: 53123 - DNA, 1065 bp, Homo sapiens
tgctcctggtctggggccacccttggggaaccactttcttagggaatatttgtgatatagaagtgtagttaacagtgatctttttccttcagggggtgaatctctacattaagaacttggatgacactattgatgatgagaaattaaggaaagaattttctccttttggatcaattaccagtgctaaggtattatactgcgatctggggattgaaagcagtggtattccattataggcttattggcatttgtcccattgaaggaatagcatttaaattatgttcatttctgaaagtagctactacgtttttctagcaaaatttctggatgcattctggagaatgacatttcattaggttaacattacactgtttcccaagcactggagtctggagaggaatttgacccagcccctccttgccaactcagagcacctgaatctttcccattccttgctgcctcgtgccggtgtggggacagatggtgctacagaatgagcagaggaaatccagacaggttgttttccatttgtcttggggcctgtctctacagctctgccacattttctccttgagaatgaaggtattttgaagattttggaggtgggcttgggaacttctaccctggtcttaaaaagagaggaaaggggagtggaaggtttttctatgtttcgtagtgtgcatcatttgcttgattttctttgataatcatatcaactaagttagcagggtaagtaggaacctcattttaaagataaggaattttagtccttgaacaagagaatgctgactacatggggatggtgtactgcttgtccttggcactttgggagcaggatggaaactggtgccatctgaacattttgagttatggccggatgcagacgccggtcttgctaaacaggtgtaccagatgccacaaaatcctttagttgatgagaagggaagccacgtgggctggtaagggcttagtggccctgccctggctcttagtggactttgctcccaacctgggaatgtggaaagcaatgttatcagttgtagtagggagttggccagaggccaa

SEQ ID NO: 53124 - DNA, 1321 bp, Homo sapiens
ttcctgggttccgcatgttaacttcatgtaggtgtttacaaagcacttggcacatacctgtcacctcagctatcagttgttgaaagaataggacagacgtttgttatgctgcaaaggtgagagaactaaagcccagtgagtgctgatttgataacagcacggcagctacttgtgggcaaagcattgtgccagaccctcaatatttatcacttaaatacccacaaaagcacctgcagaatttactggcagccggaatattatatcgccctaggctcatgtcagcacacttgtgtttatacacctgtactatttctatattatctggatcaataacccatttaaatattaacctcactttacagatgaggaagtttggatttgtgtgacagacttcagaggtggagtgaatttagtttttagtcctatagtagaaagaatattttttgggacttagacctccagaataagaccccatcgctgcaactttattttaaagacatatttttcctctctaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcaggtaaggtggtcttggcccagcctagcaatgggatttgctgtgaaatatttgcagaacacccctatgtttagcgggctttctttttgaggacttggagtgtgttcttcttcccattttacctaaaaagatgaggtttaaaaggatatatacctactacatatgactgattattatagaaccagaaacaagagatgggtttattcatcaagaagctctctattttggaagcctcagcctgttgcttttagccatgtaggttccttttacttaaatgagactcctttgtttggcatggcttcaagaagacccctgctggggtgggtgagtggtcaccagaacagctgtggggagaggtgacaaaaggtgagtgcactgatgatcctgtcagtttcagggcagtagtttcacaactttggacttgcatcagattcatcagcagagcttgttaaaacagatagctgggctccagccccagagtttttcttattcattgggtttggggtctggcctaagaatttcatttctttcttttttttttttttttcttgagacagtctcgctctgtcgcccaggttggagtgcagtggcacaatctcggctcactgcaaactccgcctcccgggttcgcaccattctcctgccttagcctcctgagtagctgggactac

SEQ ID NO: 53125 - DNA, 1159 bp, Homo sapiens
ctgagccgtggcagcccttttgactcgccaaggtgggcttcctgcccaagccatggcctgcctgccgcctctcccttaaaggcatctgtctgtgggttttgtgagcatcaacaactggggctggctggaaagcagctctaagctcactctgagtcggggtcttggccagcggcagagtggagagggccctggactgaccaggagctgtatactagcagtgtgaccttggctttcctgtgattcaggtctgtccatgggtccctcgctagtggttgatgccaaattgtccccgcggttctccattttctaacttatgactcagtgacctaatacaaggctggctccacagtaatacttggtgacaatgaaaaaatcccatccctttgcagaaaaacttcataacagaccttgttgctttgatgtggttgttactgtagaatgcagagagggggaacttaccaaagccatatggggagaagaagagacaataagtcttggctattacaagccaaaataatttttgtcctttgtgtcattcagtatgccagaggatgggttatctttataatgtctgtgtgtgcagtggttgatctacagatatcactaaaaagaaatacaaaaatgtcagtgcatggataaattttcttttaagtataacagaccaaaataaataaatttaaaaagcaaagggtgccccttcactccaacaatctcatatctaggattaaccactgttaacagtttggtttgtatccttccagaccttttctatgcatttacatagttgcacagaaatgaacattttaaaaacatggccatcaggtttcttcatgaaggcagtgtgatgtggtaggaatagccctggtctaagccaggagccctggggctggtcctcacaggatagtcctgcctttttctctttctgctggggacttggggtatctctgagcctccttggtggtggatggggatctcgtgttttaacctctcctgtcagtctttaacctgtattcctttgggtccctggacatcatgttttattcctctgggtaattactgttcttcatggtttcattttagatttgtgggcagattcaagtctcgcaaagagcgggaagctgagcttggagccaaagccaaggaattcaccaatgtttat

SEQ ID NO: 53126 - DNA, 4967 bp, Homo sapiens
tctcgcgtggccgccccgcctcgggcccccgggccgagtgggcgggcacgactgcgcccaggtcgcgaggcgcccttcgaccagcagcgcccggggcgggcgggtataaatggagcggtggctccctcggccgcctctctccgccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacggtgagtagaagctgtgcccacacgtgcgtgggagcccggaggaccccgggagtcgtcttctggcagggccctcctgccgaggagggcggcatcacgacagcatgttgccaccgaagctgggagcagggtgcggagattgagaacgcggacctggcatcagatgactcgagtttcaatcttgtttctaccacttgctaactgggtgaccttgggctacttattagtgttgctggtagtggggttggaaaccaaggagactgtaaaacaggattagagtgaagccactggcattccactgcgtgtggtccttgtcagtggggctgggctgttagagatccttgcttgtgcccctcacaggctggccaaaaaggcgggacgtttgaaacacaattccccgcgaaagttttacattgtaaagctcctgcccgctccgccacctttactaaccttgactacctgatgttgtgctgataaaggatcagtcagggcaggcaggaagcagggggaaggtttctgtgcgttaaactttcgcagagacttaggttagtgccacaaaagctgcgtgtgccaggccacctccttggtctgtgtgtttgccactggagtggagaagtgctttactctggacaaatggtatccaggctctgtgctgtagagtgtcgtggaggtagtttagggaagcgtcacttgaaaatctggtgtcatttgtcacctcagctgtaacagtgctttgcactagtcagagcccttttatttcatctaatctgaagaaaatgggactcctgagaaggagaacgaatgcaaaaagttggaagccaagttaggactcccagcacagtgctctgccacctcagattgtggccttagcgtggagcatggagagaggtatgctgcaggcgtggcaggagggaggccagaggaaacctgatcagaggctgcacgtgactccagattaaaagggaacaactgcagagatcattactgggagaaacaagccattctatggcaaagcatctccaggtccctagttttggggtcccccctttgttttctgtctgaggcccagagttactacctgcccaggttgcggctgagaccagagaattggacatgttgagagggactaggtattgctactgtcaatccagtgtgctccaagctgagttctgtccatggccataggagcgcaaaggtagctgagtgtggtctttttaagggataatgtaccacattagctgttgtctgccttactgacttttgaacaaaagtcgtgtcacttagagatagcagaagctattggtcagtgtgtctgccaacacatacttctgcaggacttctccctgctataaataagtgcagccagatttgtcagactaagccggcttgccttgtgcagtgctgtctggaaatagacgaggagctgttgttgaagtgggctcctttactgctaattaatgaaatagtttgcgatcccagctatctatctctgatagccatcacaagcaaagtcctctttccctggactgttcctgacttggatcggtcttgtcatctccccttttcccaactaccccccacacagatgaggcccaccttctgaagggggtggggaaagttgttggaaataatgagtgaaaataaattctcccggctaatgaaacagttgagcttgtggagcggcagagttggggaattttgtcccccctttaagtgagatgttgtcctgaggcaaggagcaggttccactgctctgaccctgtctaaatcccctcatggaggaggttctgggtgatgtcaccgttaggagatgccatcatagccttaaggaaaagtggccaccagatctgggcatccttgttgcgattagtgatgagaagtgttttggctggcaggtggtgttattttttagcttttggttctttttgttgttgtttgttttgagacactgtttcactcttgctgcccaggctggagtgcaatggcgcgatctcagctcactgcaacctctgactcctgggtccaaacaattttcctgcctcagtctcctgagtagctgggattacaggcacccgccaccatgcccagctaattgtgtatttttagtagagatggggttttcaccatgttggtcaggctggtctcgaactcctgacctcaggtaatccacccgccttggcctcccaaagtgctgggattacaggagtgagccaccatacccagcccagcctttggttctttaaattgtctctggtgtacacacggacttggttgggaagctaaggaagcattccaaggtgttggatggggaagttggttgagcacccagggtagctgaagtcctagaattctacagaacttccattaaggcttcaaaaggtgggtgcagggcctgccatctgcgcactgtctacttaggcagaaggtatggtggttttatccttgtgatagtacagagaacttttccatgtgtgatcagttgtgtccattttgatgactgatgcttttttgtttaagtcaatttctgttctcagaaattgaaaataaactggactgaattctgaattcagggatagcacctttttttttttttccagatcatttgctttacaggttttgtcacttgtctccataggtggattgcagactaaatgacttgataactttgatgcaatacctcactgaaaaataaatcagataatctagtattagtttcgtaattactagctagctgcacagcttagttaccctaaacataagtttgttcattttgtaaaatgtataatttcagctgtcccacctgagtcatggtgggtggtagtctgcaaagtctcttctaagtggtaaagcttagtcaaatgtgaggtattatcactggatcttggtgtcattaaggccatttagattatctttacttgtggcccctttatccaacaagggcacagacccagaagggtgtttagacttctgtcatgaagtagagtcattagctggaacttatgcttcccttactaacagtgcaggctggaggaatctgatgcccttttattttaatagagttgccttttatcaagagtgattaccttgaaaagtcctggagtaatctgttcttaggctgttggcctgtgggagctgacgttttctctccttattgaaatgtgtttctctcttacagctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtaaacattgattaaatgattttagcagaataattaattgattcttgaaaacaagataaataccaaacagagaactatcttggaattggggaacaagatatgggaattttcaaaatgctggacatggaatcctaaaagttcccataggtaatctcagggccatacccagcgtaaccagcacacgctttcatacccttgttctttactcagcctgaaatatccttcctattctttagctttggaaagcccacgtttttcttttgggatgggggaaagtagaggaccagagaagtgtctctagtcttgaggaaacttaatcactttagaagcataaattcactctattccttctacgtatctgttctatgctgagcactttaaaacttaaacggtggtggtgtatatgtttaatgccatactacactgaaaatctgt

SEQ ID NO: 53127 - DNA, 1114 bp, Homo sapiens
tatgcaccaaggcataggtcacgggtcctctgccttcctttatgctggtgagaacaagtcagtcatcccacagatgttcactaaaaccatcacaggaccagccatgaactagacctagtatctgccctcaagggactcccatggagcctctgatcttcaggcttcacctggaaagcttaggaagcatttcccaagagagaaaagaggaagaacaagtggtctggggataagatgatgagctagatcttgggcacattgagtctgaagttggattccctgaagagctggtttaagaggcattctgaggatggtggctaaagccatggaggtgacaagcctctctgcagggagcagcagaatgcgaagtgacacagaagggacagtactgtgttaagagacggcagatcaagaggcatggtgaaaggagagcccagaaacagtggtgtcgtgcaagtcaagggaggagtggtttcaggaaagatgatcggcagctgtacagtggacagatggtctgagaggagaactgaaaagaatgttctagatttggagaacttggccaaagcagaagcccatttgcaggcagcagtggagtgggaggaaggtgagaaaatcgagacagtgagtgctgatgacaccgcacagctacatggtcagctgcaggctccacccttctgtcttctgtacccgcagggctcttccaagctggagaaagccgaggtcttgcagatgacggtggatcacttgaaaatgctccatgccactggtgggacaggtacccatgctcttctctttcaggcgtcattcatacaacaaatattttgaggctgggccctggggatatgctggtgagcaaagtccacacgctgcccactctgaggagctcagtcaatggagggaacatttgcaaagcttctctctctcctttcagcatctccctctccactttcagtgtctccatttgtcgcaaccttttcctcagttcagctccctccagtcttagacctgggaggcgctttcttctgtaacagactgttcctatgggtcccactcttgtccaacccaggacctcattaagaattcacctgaatgagctaattctcactgggatcccaat

SEQ ID NO: 53128 - DNA, 1043 bp, Homo sapiens
tatgtgatgagtgtctcagctctgctcaggtatggatttgtgattatcaactgacagggaggaagctgaggtgcccctcttcacccctcctgatcagtccccctccttcactgaagagtttgccacaagggtcgtggtcttcctattcctgtgctaatggaggggagacagaatagggtagtgtcccttccttcaacctgtacatgggttcagggttctccagtcctacgggaacctgctggggcacttccccctgattctcagcatagtctctgacagttgcttcctgggcgtcccctcctctgagtactttgtgaatgttgtcattcttctgtatttctttcttggctcatggtttctctctcttctctcagctgaaacagtagcagtctatctctagttttatgcagcctctgttatgctgttgatcttcatggtctctttctagtcctgagcttcagatatttctgcctgcaagtctcatgggcagcttaagtttgcctaaaatggattctcccgcttctctaatcctgtcttcctgtgttctcaatcttggctaatttgccaccattcatccacacattgacccacgccagaaatttgaatgcaaatcagaactcataaagtggccatcacagtcagtggagtccccctggatcatcctgtatcctctgcttagtcttacctacttggagcacaatgcaaggcccaacatcttccactgtcttctgagcacttaggcctgagcaagagggctgcccccttgcttccatgtagttagccagtgtatatgcagggccaggcacagagggacgaggtggtacatggatgggtctgcctaactagaggacagtgggtgggctggaactggcatttgaagatactgagagttgtggatcatggaccagaaaagtgctgttctgtgactgtgaagcaagaggaggaagcagatgcatctgagggcaagcatgatgagataacacccccgtgtgtgaggctcaggttagccagtgctgagacctcctgtcgctgggcatccagct

SEQ ID NO: 53129 - DNA, 1051 bp, Homo sapiens
attgggaacaagccggctggccgcatccagatgctcctgcgttctgatgtcgtgcccatgacagcaggtgagcaggacgctgtggtcagaacggcgggacgctggtggctgagcagtgagcctttcccaggttcttactgcttcacttcttgtgtccttgatattgcttctgacctaagttgatttgaggcatctcagatcctgggatctagtaacagataagtcagagcaggtgtttttgaagctttataagtgctggcttactgttttttaatcgttttttaaaaatacaagtaaataatgtattcttttttttaaagaatagcatatacatatattccaataatatttaagacaataaattgaaaattcattttcccctctctacatccagtcctcaattctagaagtaactagtgcttttattgagtattctttgtaatttattaaatattgacttctattctctttttaatctaaattttattatctagacatataaagagtcaattcagtttcacaaagcttgttttgaaaaaacagtcgtcccctggtgctgtccctgtgccctgctgccaacaccatttgctgctcctcagaggagcggatttcaactcttaggtgttttggtttttatttccatgttgataacagttttatatttctacttcctgttttccattttaaacattatcttctgattttctacttcagagaacaaagaattagttttttaaaatccccttccctgccccctcatcttccctgtataggtaccataattttggttaggtcctaagttattttaacaatgtaagcatcatgtgataacctcctttcatgcacagcattttgttttgcctggaattgataattgccttgtttttgcatagttttctgtgtaatcattcctgattttctcccagaccatcctgctgggggttttgcatccaggtgtctgcatcttgttaaggggagatgagggcaaggctgaattcctcaacattcagtatataaactttcacataatctccatttgtcattatggtac

SEQ ID NO: 53130 - DNA, 1062 bp, Homo sapiens
aaaactttatcctcaagcatacgggaccaggtaggagccagttggcatgtggtgacgagggaggctgggcaagggtgggatggccaggcaggatggaaggacaggttgtagttctggctggcggacactaagagtctggaggagacccagccaccagacataggagaaccatgcagccttgctagggtggagttggcttgttgacattcaggtactgttcatcccccaaccgtgtccacaattcctattagccccgcttggattctgtggtctgctgttgcaggctcttatgctctcaaccccactgctctccctgccctcaccatcagatttactcagtaaaatctcggtggttagtcccccagcaactagagaaaaaacacagaattgtactgaacaatcccacttgaaatttataactatagttcttaaggggacccttgccaacctgaccagatttccctacttgatgctcagtcccaaccggagatgatgtgtccatgcccgtcttcacttctgaagccctcatatcatcaccttcccacctcatctaatgcttcacctcctgcatctctccactcgtgcatgctctttcttccaattacaggggatgagctgtctctcctaggccagcctctccacctgtggactggatcctgtccctctcctctacttaggaacatggcttctaaagttgtccccttcttgtaatccatttcccctgctctgctagatcagtccattagcatgaaagcatgcagttatcaacctttaaaaaaaatcttcatccggttgccgggtgcagtggcttagtcctgtaatcccagcattttgggaggcagaggcaggcggatcacctgaggtcaggagttggaggccagcctaactaacatggagaaaccccatctctactaaaaatataaaattagccgggcgtggtggcgcgtgcctgtaatcctagctgctcggaaggctgaggcaggagaatcacttgaacctgggaggcggaggttgtgatgagccaagatcgcaccattgcactccagcctgggcaacaagagc

SEQ ID NO: 53131 - DNA, 1052 bp, Homo sapiens
ccctccagatgctggtcagccaggcggttataaagaatctcatctgctgaaggcttttagcagggactgagtcctgtagctgttggacacctcctgtgggttgggtcactcagaccattcagaatccactgagctgagcttttgcatcttggattgagatctggatgagccaggaggcaggagaggctaggtggtcctcatgaccctaggatagctcttgctgagggatggtggcattctgccctacctctggctcccatgtgccgactggactttgtgagctccagctgctacagttgactgagttcaggctccatgtagctgggatatactacatggttacccctcacccctatggagcttccaaaagagaccctccctcaaagcacagccccttctctgagtgcaaataatggccatcagaggtcagtcacaggtgttaggcaggcatctatgaagctggggatgatagcactgacttcagtgcttggacgagaaccaggagagagtgtgtagaaaaagcacagccagcctcccataaaaggacagactcctgtgacaaccttgtcactctgttcctccctgatactctggggaggtggaggccagtgggcagttctgaaagctcagcaggtttggagccattgggtgtggactcctctcccagtgttcctcctgggtgttcacagatgttattgaatgcacactggaaccctgcacaggtaaactgaggctttattggcgtgactgccaaaggtcacacagggtggtttggcagagctgggattagaagcccagcctgtctctcttcagtagtaatggagtcctgggaggtttactaggctttagcctcaatctgtggcggcagggtccacagccctggggagtgacacagtcatggtccccatgattggccaggacctgtgtggagagacacaggagacaagaccctgctcttccaggccagaagggaggggagccccagagctgggcagtggcatgccccacagcctggccacctgcttcggctacgcaccatgcagcagctgcac

SEQ ID NO: 53132 - DNA, 1084 bp, Homo sapiens
aatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtggtggggatccagttcaggagggaggggtatgtttgtctcccagtctgggcaaaggagtgctatgcggaattctctgcatagcagaaaagctcccaccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcagaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaatttacaagagcctctttgatccttaaaaagatatacaagtccatgcctagtttatacacagtatgctctgttatcaatgtgatagctttttctcaaatttgacactttttgtagatcatgctgtctgttcatttatgtagcgggtgtttatttaacacgttatagtccttgaagacatctagagagggtcttttattggagatctattacttccaattgaagccctctttctggagtgacctgag

SEQ ID NO: 53133 - DNA, 1032 bp, Homo sapiens
gaaaatttcagagaatcagtaactgctcaggatctcaatttccttatctgacagatgaaatggctcaactaggtccatctccaaagcccctgctagcttttaggagcaatggcttatctgctgataccctcctgttcccagccaggactatcaacatggtatcttccaatcaattggcttcaaggaatttcacgagtacctgatcactgagggaaaatgcacactggagactagtaaccagcttctaaagaaaggtgtgaattcttccatctaatctagtcttggacatctttgggtggcagggtactctgctggtatggtctgagaaagagccaaggcttaaagcgtcccaaatagccttcagctcagaactgagatttttgtccaccaagtctgacattgcactgccgtggctgactttttcctgctgggctgggagggcctgcctctctgcagggtaaggagtgcttacctagatgttcttaaatctactgtatctttcaggtattgaggctctgaaacaagtaactaagagatatgcccggaaacaaaaccgatgggttaaaaaccgttttttgagcagtaagtctcatgtttttctttatcctatgggtctgttttcaatagaatatagatgtcctcagctcacccagaaaatgaattttagattctgggcctgttctaagattttggatctgacctaagggaagttctataacataaatgattatccagggatattttcttgggatgtcacaaaaaaaaaaaaaattatttgcattgaggagtctgccttctgccttgaacagatggatactggctgcaaacagctaagaagaacagcagcatcttttttggagagttggtgttcagggctgatttttagcttcagttttgtacctgaagagcagtcagatttctgtagggaagatttcctaattacagtgtttttggggggccagatgagttgtataaaaagacaccttcaccatttctcccagcgtctccacatggtgcttcagattgcttcaa

SEQ ID NO: 53134 - DNA, 1026 bp, Homo sapiens
aagcagtatgccttataattagcttgctagcctgatggtattttgttgctaaagtataattatgtccgtgatagtagtaacttattcatccagcaaacattcagtaagcattcaatgaagtgctgggtattctgtgtggtacttcggtttcagagttgaagagacagtgcctttccttaaggaattcccagtctagtgggacaacagacaaggagatagatactatctgtctgtctattatttatgtgataaatgctgggctagatatattttcagagtgctgtagggccacagagaagggatgacgaatattatcttggggggagtcagagaccagtttgcaaaggtagcctatgataggcctggaaagatgacatcattatgtggacaaacagtagagtgtagcactgaagagcacaggctcttgaggcagactgtctaatagcaaattcctgctccactagcttctagttatgtgaattgttaagacaaattagtttacctttctgtttcccaattctcctgtaaaatagagataatagtaataacacatatttcctagcttcatcaaggattagatgaattaatacatatatagtgctcagaatgtgcctgacacatgacgggtcctcaataaatgcaaactttctaggaaggttactgttgctgtaggccaataaatcacaatgatagagatgtagaagaacataattaaaatggtgacaatctgttgttaaattaatctgccataaattgataaaaaaggtaatttttcaataatgaaattttataaacaaaaacttttactctacaggcagcataaaataatggtatctgattcatagtaaagctgtttgtcacatctgaacaattacgacctctcactctttgctcctttgcttggctcagtagtttagaatgtatctaggatgtcttttttttttgtttgagacagagtctcgccctgttgcccaggctggaatgcagtggtgcgatctcggctcactgcaacctctgcctcccggg

SEQ ID NO: 53135 - DNA, 2003 bp, Homo sapiens
catctttcttcccaccctgccttagccgcttaagggttagtgggattctagtagaaaagaggtggtctgtctctatgcctgcagattggctggcaaggagaaatgtgtaaatgattatttacctggatattgaaagtcttttaaaaaaagttattttcggccaggcacgatggctatcgcctgtaacctcagcactttgggatgctgcagtggatggattgcttgagctcaggagttcaagatcagcctgggcaagtaacatcgtgaaaccttacctctacaaaaaatacaaaaattagccagatgtggtggcatgtgcttgtagtcccagctacttggtggcgggagctgaggtgggaggatgactcgagccctgggaggttgaggctgcagtgaactgttttcgcgccactacactccagtcttggtgacagagtgagaccctgtctcaaaaaaaaaaattattctcaggagcaaaggccgccttaaagcagataattatctgttcaacggagattctaaagagaaaaatttaaagtagcagagatgaaaaaacaatagtggctatagtaaattgagtgcttactattttttaggcattgtgataggggatttctatgaattgtcacatttaaggctcatggggatttttacaggtgagaaaactgaaactcagacaggctgagtaattgtccaagagctgaacctggaaattgaagtctatttatcttcagaacctgtgcatctcacttaatttggtcaagcctcaagtggcaaaatgtgatagtctctccatgatggtagagactgactaagtctaagaaccttagagaaaccagcttgtgttttgccttagaaggcaaagtcatgcaatggatgtcaccttgatggcctcctgagcagctgacacttggttctgtgagagtccttgggcttgtgcttattgaactgatttggaatactaataaaactttgacttttagcagcaagacctagaaagttctagaactggaaggaattaccactatgcatttgtctctggtttctgcaagtccctccagaactgattggacatgattctggaaatttgttggaaacactgagggctggtatcaacgcattttggttcccaccctttctcctctgctctgcagataaatgaatgtggtttcttgctaatggtgtccttccaaagtgagtcaggattctcttgatatcgtgatatctttcttaatgttcacattgaagatatatttgcccgagacaaaattcctattgttgtgggaggaaccaattattacattgaatctctgctctggaaagttcttgtcaataccaaggtaagtttagttcactcgtaactcactgaggaaatggattgctctttcttgctgtctaatttcagtgggagaaaggttgactcttgcctatttcttatacccagcaactataattttcctacttaatattctcaagcaaatgccacctccatgtgtgaagtgtgttcctccaggctggtctatgggaaggggctctgtgtgggaaaaatgttgctgtgtggattaattagcatctccatataaattaacagttcattaggccaggcgtggtggctcacacctgtaatcccagcactttgggaggccaaggtgggtggctcacctgaggtcaggagttcgagaccagcctggccaacatggtgaaaccccatctctactaaaccccgtctctactaaaaatacaaaaattagccaggcatggtggcacgcacctgtaatcccagctactagggaggctgaggtgggaggatcacttgaggcttgaggcggaggttgcagtgagctgagattgcgccactgtactccagcctgggcaacagagcgagaccctgtctcaaaaaaaaaaacagatgcgattcaagaaaaaaatatgtataattctttagaaaaattatattaaaaaaaacccagtacgttagccattagcctgattcagtatttcct

SEQ ID NO: 53136 - DNA, 1046 bp, Homo sapiens
gcagcccaagccaagagagaagttttctttctagtggcaatttcttctcagaaggggcacccaaggcctaaatactgatggatgccatccccatcagactatggactgaaagatacagtgtctttgtcacccaaattcttgtccttagactgtggcatcatcattctctgggaacttgttagaaatgctgattcttgggccccactccagacctactgaattagaatctgcattataacgggagtccccagtgatttatatacacattaaaatttgagaagcactgttttagtgataagaacaccaatttaagaatcagaaaatttgtgttacagtcctagaactgccttttttaccatgtgaattttactgggtaaagcatttccttaaccccactgagcttcggttttctatcctttaaatggagatacgaagttaatctataaatataatggagttatagttagaatttcaaaggggttgttagatgggagaggactggaaaatatagttctgggtaaaaccaagaaatttttgcaaaaagaataatataagggggattgcccttatgtcttaacatgcagactgcctttagtatctggattgctatatattaaaagattgaaaagtcataataattataatagcatggaacttatttagtactagatatatttgtggcacagaatagaaaacccagatatagattcaaatggaggtacgtgaatttttttttttttttttttttctcctagagacagtctcactctgttgcctaggttggagtgcagtggcaccgtcatggctcattgccaccttgacctcctgggctcaggtgatcctcccacctcagcgtcctaaatatctgggactacaggtgcttaccaccacacccagctgattattttcattttattattattattttttgagacggagtcttgctctgtcacccaggctagagtgcaatagcgcgatcttggctcactgcaatctccgcctcccaggtttaagtgattcccctgcctcatcctcctgagtagctg

SEQ ID NO: 53137 - DNA, 1029 bp, Homo sapiens
aaggtacagtgccgggccttcagtgactggatgaaacattgtactgagaaaattgaaggcccttgccaaacatgtacaatgatggcctggaaatacaaactaccaactatatgctaagagaaaagaaacaaagtgttctgttcgggtttatagagaggaagtgtctctaatgcctcagtttttcaagtcctgtggagaagcagtagccgtacataggagcacagttccttttgtgtttgtttaaacctacaagaggagaaacaaatgatttttggcagtctgactagtaagcaagcagaatatgtgtcatctcgtcatccaatagatgtggagctctttgttcttttttttttttttttttttttaatagaagcaccatgttgcccaggctgatcttgaacactcttggccccaagtgatcctcctgcattggcctcccaaagtgctaggattacaggcatgagctaccccacctggcctctgtattctttttgtttgctttgggacatactgtaggagcagtgtttgtaccaaaagactgtctgatcaagggagatatgggatgcttgggggagggatatgaaaggagagatgggatggtggatcacagtggcttaataaaatgtgaaataaaaggcttgaagacctgtttttttttttttttttttttttttgaagacccattaaccaggagaaaaggggtctatctggaaggtatttgccacaactgacaaaggcagtccttttttttttgttttttttttttgagatggagtcttgctgtgtcacccaggctggagtgcagtgactccatctcggcccactgcaacctaagcctcccaagttctagccattctcctgcctcagcctcctgagtagctgggactacaggcgcccgccaccacgcctggctaattttttgtatttttagtagagacagggtttcaccgtgttagccaggatggtctcaatctcctgacctcaggtgatccgccagcctcggcctctcaaagtgctgtgattacaagc

SEQ ID NO: 53138 - DNA, 1301 bp, Homo sapiens
aaatggatattatcacttcacagttaagaaaataggcctaaggtcttagaataagtagcagacctggagtctgaacatgaaagtgtctgctttccatccccagtggcatatctgctacacaaagccatttcctttaagatgaccaggggctgtggggttcaatcagtagggagttttttgtttgtttgtttgtttgtttgttttaagatggagtctcgctctgtcacccaggctcatgatcttggctcactgcaacctctgcctcccatgttcaagcgattctcctgcctcagcctcccgagtagctgggactataagcgtgtgccaccacgcctggctaattttttgtatttttaatagagacggggtttcactgtgttagctaggatggtctcgatctcttgacctcgggatccgccagcctcggcctcccaaaatgctgagattacaggcatgagccactgcgccaggccaggagtttttaacttgtatgccagttatccttcttaggagtgtgcaacattttgatcaggaaaaagatgtattttaggattcatattgtaaatcacagtgttaattcatagtgatatctgtcaagtggagtgttgagctgactggaagccacctgatgtactttggggataaaatttgctgcagctaagagatattaatagaatctaatgtcaagttcgtatcaaagacagatagtgtttattggaacaaagggtaaacttggacttgtggagagcctagacagaacagtaaacttctttgttgtaacacaccaaagggtgaccaaatagaaagtgtgatcatagaaagttttttcaagtttctaaattgggttttttaaaaccaatatttgcattttaataattccttttggtgtgctgctgaaaattttctattcagaagtgtaccagtaactcagaaactattgtacaacactatcttaaatgttaaattgtctcgtacttcatactgcttttgtcatccctttgtcctgctttaaaatgtagggtcatccaaggcaacacctacccaaggtcaaccctacagcacctacagggcagttcctatccagagaaagtatttgtttttgtaaacattgaataagtactttaagctttgaggtaaaactacaatggggttgttaaaggtattgtgtctatggtgatcatttcttcatgtagcctgatatgcagtgacttgcttctgtagccatctagcatctgaaggtactgcctgtcctctttcttcccagtgttcttttttctttttctttttttttctatgacaca

SEQ ID NO: 53139 - DNA, 1266 bp, Homo sapiens
aagagtgggtagtgggtgacattttgggtaaatctctgatggaggaactacagcagctatttgttgaggagaatttacagttatgagtcttcacagagtaaatgagatgttgaacatgaaatgcctggcactgaacatagcacctgatgagtactcagcaaagaagggcagttcctttccccaactcacccagaagccagtgggcatagtttctgctttcattagtttatgtggcatgacaagaccatcagcacacatgaaacgatcggataattcaaaaaataatttgtttgcagtctactttgtgccagcttcagaagacaatttacctcaaatcccagctgtcttttccaagatatgcagctatagcctaacctcttcatgcctttgtttcttcttctgtaaagtaggaagaataatatcaataacacaacattattgtgatgattaaatgagataaagtatgtgcagtacttaatacaatatatggcacataataagagctaaaaatacagcagctgctatcttctgcgaggccctactggagagacaaaatcataatttctgcccttgagttttagtccagctgaacataaaacaaggcagagctaataaatgtttggacagagatattaatggatttgcaagatgatgggaggagagagactacagatgctagattttatgacaagtattatagaatttctgagacaggagaaattatcgaaggctggcttagtatggaaagctctctgaaaaagggcttgaaaaataggtcaagtttggataggtaagaaagaagaaaaagcttattaaaggaaagaacatgaagctggtccaaaggtattgagttgtctcagttgattgttcacagtcagttacagatggaactcccttttctactctttggccctttctcactactgtacatgactagtcttaaaaaaaaaaaaggaacatgaatgaagatgaagatttagaaggtgaaatggccatagtgtgtaggtaggatagtaaaaggagactgttcaattgcagatatggaatgtgagatgagcaacatgatgaaggcagtgtgtaaggaacattcatttgtgagcagtacgtatggtacttggataaaaaatatccaagaatggtataatagtagatctgtggtctgatacctcagagacttaagtaataagagtttcagtaagatggagttacactgatgacacctaaggtccatgccaatatttatgttctatcatttctttcttcttt

SEQ ID NO: 53140 - DNA, 1029 bp, Homo sapiens
actgcactccagcccgggcgacagagggagaccccgtctccaaataagaagaaaaaaaaaaaaagacggcgggtagttgaggttctgacaccagttagttgactgcagtcacgtcgcctgggtcctgccgctccctcctccctaagcaacctcgctacaaagcctgagatccgcgcaggcgcatagacggttgccatggggacagctgctccggcgcaagcgcagactgccataagatggcgtccgtggcggctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtatggcagtgcggctggcccgggcgcctggggaccccggaggccgcgtggacaccctgtggcaaaggtcttaaagggtgaaccccgaggcttgtaggggcggagggggtaggtaaagggagcccatacttactaagcacccgccgcatgccagacacagtgccagatgtttcccttatcatcgtctcatcaacttctcacgacgttactatttggtagatactattatctccttttatggagaaaggaattggggcttagggaggtgaaacgattttttccatgtcacatagcgaataagtggaagacatggtatttgaacctacaaggtcgacagataggtatccagtaaatatcttttgaataaaaattattccagagcttttgttgtaactctaaccctaacccagcgagatcaggataaattggataccacctatggtgtctgctgggggagtggaatagggttgacagtcaggagacctggattctagtcctgaatctgccattggccatgtgacttcggatcaacaatgtcgtttatttggacgttattttatatatctgtgaagtgaggaaaatgtcacctaccgcacaaggttatagtgcttaataaatg

SEQ ID NO: 53141 - DNA, 1050 bp, Homo sapiens
aataggatttataacttgtgaaaagtaacaattccccaagtgcaggctgtgctgggcaggaacaaagggcagctctgcccacagacccctcatttacaattctgatggggcatgaaagagcccgactggggaagatctttatagctaaactttgtcccaggccggtagctctttctctccaacccctccgtgggggaggggagagcctttgcagactgggggctgttggcttgggtctgccttttgttcttatctaagccttgctgtgcaaaaggaaattggagaatattttccttcttgctaatgtcccctcctttccttcactgtgcccttaccacattacaaatgaatcagctttctgctcacctcgatttgtatatatctaaattggaaaaatgtctcctaccttcccaagcaccagcgtagacagctaaagctgtagggtctatgtttgtgtttctcatgggatgtgtttcttctcttgatctcttttctcggacagagaatgaagaaattgatgttgtgacagtagagaagaggcagtctctgggtattcggaagccggtcaccatcacggtgcgagcagaccccctggatccctgcatgaagcatttccacatctccatccatcagcaacagcacaactatgctgcccgttttcctccagaaagctgctcccaagaagaggcttcagagaggggtccccaagaagaggttctggagagagatgctgcaggggaaaaggaagatgaggaggatgaagagattgtgagtcccccacctgtagaaagtgaggctgcccagtcctgccaccccaaacctgtcagttctgatactgaggatgtgaccaagaggaagaatcacaacttcctggagcgcaagaggcggaatgacctgcgttcgcgattcttggcgctgagggaccaggtgcccaccctggccagctgctccaaggcccccaaagtagtgatcctaagcaaggccttggaatacttgcaagccctggtgggggctgagaagaggatggctacagagaaaagacagctccga

SEQ ID NO: 53142 - DNA, 1126 bp, Homo sapiens
actttgtggcaatctgtgggctacatgctggggtcaaggcagtagaactccaggccctcctctcccatccttgatgcaagtgcaacctcgctgagggcagactggggcatcctgtgccactaaactacattgttcttattctggcatcttagacctccacacccgtgagaaatcctggagagggtatttttgtagagtgtagactgtggctagtgacaaataaattaggaccaagaaagctcactgtagcttttaggaataacttttacacgaccatttgatagggaactggggaatggggtatggaagttttcctacacttgagagaaaaaataggataacaaaaattaaaagtcttttttttcctggtccactgtgttaaggtcatttttaaccagcttgctttctacaccaagagtttatgtttgtttaatggctggaaagagaatcttgagatcaaaaaaccaataaagatgtatctctacaacggctggtggagtggtagagtggaaagagcattgctttggaagttggacattttagtttgagatccagaacgttacaaaggtgatatgtggacttcgctgatctgggcctcagtttccccatttgcacacgatggggttggacttgattgtcctgctgatgacatttccttgtctggatagagtaagacactactctctgaaagggagaatggtgtcttaaattatttctttcttagatagaatcttcctgagccacgaggcttaacactgaaaattaaaggtttgggatgtagggaagcctgctgaatcattttctaacctaccctttaacctgaacctgtttgtgagcttctagttcactcacaggccacatggcctggaacaaaatgcaacagattgcaaacaatgaggcggggggtggggaaagtgattggcagcagagctcacccaataggggctaggggctgggtaagacagaagtccaaacacagcgtaatcagccaatcatgggctttggggccaggagggctgaatggtcaggtttattaatggagaaataatgcgattgtccacacaatggaagccttcctgacaaaggggctcaagcttcctgatatgcaaagaagctgagaacggag

SEQ ID NO: 53143 - DNA, 1050 bp, Homo sapiens
gacacctccttcgcccggccggcacccggtcagcacgtccccccttccctcccgcagggagcggacatggactacgactcgtaccagcactatttctacgactatgactgcggggaggatttctaccgctccacggcgcccagcgaggacatctggaagaaattcgagctggtgccatcgccccccacgtcgccgccctggggcttgggtcccggcgcaggggacccggcccccgggattggtcccccggagccgtggcccggagggtgcaccggagacgaagcggaatcccggggccactcgaaaggctggggcaggaactacgcctccatcatacgccgtgactgcatgtggagcggcttctcggcccgggaacggctggagagagctgtgagcgaccggctcgctcctggcgcgccccgggggaacccgcccaaggcgtccgccgccccggactgcactcccagcctcgaagccggcaacccggcgcccgccgccccctgtccgctgggcgaacccaagacccaggcctgctccgggtccgagagcccaagcgactcgggtaaggacctccccgagccatccaagagggggccaccccatgggtggccaaagctctgcccctgcctgaggtcaggcattggctcttctcaagctcttgggccatctccgcctctctttggctgaagctgcccgtgtagtccccaaccgtgtctgtctggcacgtgggtgtgttggtaaacagtttggaaaagtggcgtgggagccagcctccctttgatgattattggagccccaggggacaagggatttgaggtgagggttggcgcttagagaggacaatactggggttggactgtaagggattgaagggggtaccttaagagacactccaaacctgaagtttttttgctgctgcctctttccctaggaaactcacactcccctagggggagaagaagccgagagccttttgtgcaaagccaaaaccttcgtccttttaaaaacctaggtctccagttggctttactttaaaatgccaataataaa

SEQ ID NO: 53144 - DNA, 1048 bp, Homo sapiens
ctcttctgttctttccagagaggagcttagccagggacttctgcccttcctgggcccgggcctcgggggcgattccgggtaggtaaagcggaacgagggcgtggcctctcttgtgagcccgccctccccgtgtcgctcccgccttgagggcggggctctttcccaagtgccctctgtgagagccgggccgctctctccggggcgtggcgaagaggggcggagtcacgagcggggcggtgagacttcctgcccagtcgcgggccagcctagcgcttcagccggcggctcatttccggtgggggcgccgcgcccagtgagggcccggaagtgggtcgcgcggagattgctgggcggttcttgccggaagcggagagcggctgatcgcagtccggaggtgaggcggaactctgaggtgagggtgtgcagcttggtagggattggggtcccttccggggcccatcggcccctggtggtgttaatggcccttctggcctacgcgcgtgtcatgaaccctgccgagagggccggggctgaggccctcaggccgacccggactcttgggcgcggtctcttgaggtggggccggggtgagcagctgagtccgggtgccccggggaggcccctctgcccgatttcgcagcgctgcccatcagcttcagcggaggcctgattcctgaggtgctctgactggaaggaacctccgagatcggagagtcttccctgtctcctgttgatgctcccattgcactgataggtaaattgatccctagagaagaggctagtctgagatatatagcgagtgaggaaaagaatcggaatcatgatcctggtgccttagataaccagccccagttcttcccgtgttgctcggaacctctctaacttgggatggtcttccggtcggtgttgccccgcaggctgctgcaggttaaaggccagcgctgcgtggaacttttttttttctctcctcccaaattgagccgtttgaaatgcctagggagtttttaaaagaaaggcgggcacatccttgtatttacaggcagatatc

SEQ ID NO: 53145 - DNA, 1030 bp, Homo sapiens
ggttcaggaaaagcccttctgaagaagcagagtttttaagatgaattttgaaggataaataggaatgcgttcgaagagtggaatgagaacatttgagacaggttagcatcagaactgtgtcagttgaagctctttgtggggctctctcttcaagagaaaatccgggggcatatcagcacatttatcatttaccagacttttatttaatttatttatttgtatttttagtagagatggggtttcgccgtgaaggccaggctgctctcgaactcctaacctcaggtgatccccccacctcggcctcccaaagtgctgggattacgggcatgatccaccgtgcccggccccaccagacgtttattaagaccttaatatgtatgaggcacattttaatgagatagcctttgtggcaaagaatacagttcttctggagtttacagtgggagaggaaatagacaagtaaatgagggatggcttacagtgtcatagtgcatagcacagggctacaagagcacagtggagaaatacctgagccaggtgcccagggttccaggaggaaatgggaggctaactcttgaaatatttatttagctacatagggaatccggaaaagggatttccaggcagagactactacaggtgcaaggacctggagaaccggacagctgaaagaccatgacgagttcagtgtgactggaattctagtaatggctggggaagtggaggaagtgagatgtggtcaggtcagtcatatgtggaggacattgtaagtcatgctaaggaatttggatttttaccctgaaagctatggagatgctttgaagggttttatgcaggaaaatgatgtcgtcagatttatatttcagaaagttcattctgtcaagtaggaggggaccagccctgtggggaagtaaaacagtgtttggaagctcttgctgtagacatggcctgaactaagacagtggaaatgggaatggagaggaggcatcagatgtgagcaatattaagaagatagaatccatagaattgg

SEQ ID NO: 53146 - DNA, 1336 bp, Homo sapiens
caagagtaaagatacggaggcaggagagggcctaaattgttcagtgatactggggcctggagttttgcagaagaccagactgcaaaaaaggttagatgtcggccaagttgtgaagggctttttgtttgtttgtttgttttgagacggagtcttgctctgttgcccaggctggtgtgcagtggcacaatctcgggtcactgaaacctccacctcccaggttcaaggaattctcctgcctcagcctcctgagaaactgggattacaggcgtgcgccaccacgcccggctaatttttgtatttttagtagagacgggattttaccatgctggccaggctggtttcgaactcctgacctcgtgatccgcctgcctcgccctcccaaagtgttgtgattacaggtgtgagcctccgcacccggcgtgaagggcttttaatgccttgttgaatttgtttggatttgattttgtgggtggcagtttgctaattgatttgcccaggtccagcataaagaaatttctgggctgggcacagtgactcacgcctgtaatcctgacactttgggaggctgaggtgggcaaatcacttgagatcaggagttcaagaccatcctagccaacatggtgaaacaccatcactactaaaaatacaaaaattagctgggcgtggttgtgcatgcctgtagtcccagctacttgggaggctgaggcaggagactcgcttgaacccgggaggcggaggttgcagtgagctgagattgcactgctgcactccagcctgggtgatagtgagactctgtctcaaaaaaaaaagaaaagaaaaaagaaatttctcgctttttccagaaatacttcctcaattgggtaggcataattgatatctcagagaagtttaaataaaatggtagcagcaaaagtactttgtagaatacagcctgatgtgcaaaccaaaagtggtgatattgttaagattcagtgagtatatttttgctttggagtttagctattgagtctgtaaaatgttttgtttccaacctagggatgatcttttattctcaccctttttcctggttgcagttatttttttagcttttaaaaagtgactttcttgaggctgagttagagactagcctggtcaacatagtgagacccctgtctctaccagaaaaaaaaaaggtgacttcctcctttcagttttttgtgaagcattgtgaatcaaatttttttttacttaagcaaatgcaatgtgtcactggaagccgaacctctggtttgaaatttaatgctgagatttgaaatatgagagttctcgagcggtatcttacccaattttagtgatt

SEQ ID NO: 53147 - DNA, 1084 bp, Homo sapiens
tgtcgcccaggctggagtgcagtggcgcgatctcggctcactgcaaacctccgcctcctggattcaagagattcttgtgcctcagttctggcagaaggtggtgtttttacaagatgatttctaggattacaggcatgcaccaccatgcctggttaatttttgtatttttagtagagacgaggtttcgccattttagccaggctggtctcgaactcttgacctcaggttatctacccgcctcagcctccctaagtgctgagattacaggcctgagccactgcgccaggcctggttttttggtttcaaaccacaatagacattgctggagaatcaagctcatagtttctttttactctgcatgatatccctccaaaagcttgtctgttctcatgacttcatgacagttctttgccaatgatttgcaaacattatctccagtcttgattctttcctaggctttatttctaaatactcactagtcatttccacttagaagctttgtcttcttttcaaactcagcatatccaaaactgacctcatcttgttgccctaactagaacatgccacaacccatttctgcctataatgtcattattctcttaaggcccccatatttgcaaatcaggagtcatctttgcctcccttctctgaatgctgctgtgctcacagtcagtaccatacagttagtacttgttctcagtttaatgcacacttgtttcatatgacctcctagggcagaaccaagattcgtgggtggaagttgcagggaggcagatttgcctccatataaggaagaactttttaatactttgagctgtctgaatggaatggactgcctccagaagtctcgggttctccatcactgaaggtgtttgagcagaggctgcctgactaattgctaattgaaaggactgttctggcataagatggtgtttttacaagatgatttctagaatccctctaatcctgagagccagtgagtcgatagaaggtagctttgtctctcctgctagactcccttaggacagggagactattttacctttcttttatattctgtacagcacttaattcaggtgctggt

SEQ ID NO: 53148 - DNA, 1775 bp, Homo sapiens
tctctattcactggccgtgtgactagacaagtcatttagcttcactgaaactaagttttctatctctaagcgtgtagtaatcatccttctattcctgaatagttgtcgggaggctcaaactgagataatgtatgtgactatcctttgcaaattctaactttctacacacagtatcatagtaaatattgagtatttgaatgagtaagcatttactttagtgaacaccttttcctgagcagttctcttgcttaatgaggtcttttgattttgtaaatatgctacttttttatctgatatttttgtattgttccattttgcagatgatatctaattttattaaattattctgttcctgagaattggcatcctcttcatccacctggggatgaccaggaattttctgtttttttctctgtaggtgctatttaatatttaaataacaaatgacatttgatctgtttcagcaggtggtccattatggctgacatgcaaaatctggtagaaagattggagagggcagtgggccgcctggaggcagtatctcatacctctgacatgcaccgtgggtatgcagacagtccttcaaaaggtaagcagtccacagcccagcagaatgctttctttgagcgtcttggcctgaaaattttctattattctctcctttggcgctaacttcccaaaacttaatctagaaagtttaccttttgtaatttgtattgctgtgaacagataagagaggaaatgacttgtacagggaggcctgtggttaagttattttaacacaagaacttcctgcttgtgcaatatttcctgctctttctttagcagaatgactccaatgtaagtcaaatgacaagtgataataaaattcctctctccaaacaattggcaaattggacattttgcacatgcaccagttggaacatagaatgttagcactaaaaaaaaccttggaggatcattttgtttattttcattttatagataaagaaaattaagctcagagaggaaaaggaatttagtcagggtcacacaaccagttagtggtgatactggacctggaacccaggtttccttactcctgttctgtatcctgttgactgtattaccttgcctccccactttcatgtagaagcacgttttaaagaagcctccttctgatgcatggctgattctttgtggtgtgtttgtctttagcaggagcagctccatatgtgcaggcatttgactcgctgcttgctggtcctgtggcagagtacttgaagatcagtaaagagattgggggagacgtgcagaaacatgtaaggatgttttgcctttttccccttcttttaaggactaacagctttcttcagtcagccaaggtcctcatccttggtttaagagctccttgagaagttcctcttggtttggggcattacacatgttctttctcttttgcctgtactgaggagttcagtctagccacagaaacgattcctcatttttttctaggccccttgcttttatcacgtatttatacagaaagcttgcttggtacataaaatatggttctgttcatctttgtagtgaagaatatgcaccagtttgatcccaacatattacataatcaaacctacagtggcttatttaaaggagtcattatcatgacttagcatttataaaactatgcttgatagttattagttatgctaatgtgggttattttcacacttaacccacagcaagaatatgaagtaggcaatgacaggtgcctttcctcccaccttccttta

SEQ ID NO: 53149 - DNA, 1028 bp, Homo sapiens
taagtttgcttttggtcagggtgggcatattttgacataaggcattgtctcataaggcagttaagtttcttagtctttagagttccacagtgatacttaagagctctcctctctaccatggttttatgcacagaatgtctgcttttatcagttttacatattagattgtgtttaaggtctactttgaaaaaagtttcaataagcagcaagtggtcaaaagaaaaaaaaaagttttggtacttaaaacagtttgagaaacattgctatgagagatagagatagaatccagagtctctatcttagtggagtttggtctgattagggtaatagactaggttgtatatacatagaagctggtgatgatagaaaagctgccattgagcggagcctaagaaacaccacgggtaggagaatgtgagcccataggaaagaagggttctggagtcaccactgttatgtacccggatcacctgtgacaagttcttctttaatcctcccagggataagaagcatgtagactgggtcaaagcttatttaagtatatggacagagctgcaggcttacattaaggagttccataccaccggactggcctggagcaaaacggttagtgaatccttcctccctccctccctccctcccactttctctctccagcatggggtccacaggtttcttagacttcagcactaccaaagtctgtgagggaatgctagttttttcagtggaagggaggaagaaaaggaggagaaagaaagggtaaaaagagtagaggaagcaaggatcagaggagaaggaatattcagtggtattcaatttcaataaatatgttagggacagtgattggtgctggagcaggagacacacacaaatgagttacactatcccagcctttaaggagcttaaaaataagaatgcaaaaccccaatacaaatcaccaagccaaatgctataataaagatacagactagagtatgaggaagagaagagtgcttctcactagaagagattgtactttgaaggtatat

SEQ ID NO: 53150 - DNA, 1035 bp, Homo sapiens
tggatagtaacatctttcactgaaatagggacaaggggatgattgtacagggagaggagcggcaggaaatgatgaaatcagttttgaatctgttgaatcagaggtactggtaacacactaaggaagatgtcaagtagatttgtggaaatagtttttagagctggaatcaggtgagttcaaaggcaaaatgtgatggtcaagaaatagaactgagagctggatccttgggaaagggtgagaaggcataaagccaagttgggtatgggtaggacacattaatcattgcctcaaaggctgtggtggggaccccatgtgcactggcccatgtagggcactactgggaatggtacagaggggagcagagaggatgatgatgttacctgcacttattgttccaggggcctgtggcaaaagaactgagcggactgccatctggaccctctgccggatcatgtcctcctccccctccaccatgcccccctcctcccccagtctctaccatttcatgctcatatgagtctgcttcccgctcatcactgttcgcgcagattaatcagggggagagcattacacatggtgagtgagcacttggacacgaacagtaggtacaacaagttgtgtgggccagaccccaccaaccagaaccgtctgtaaactacaaccctggcttgtgtggtggagactcgtttggtgtgtcctgttcctttaagggacggcaaagctggcttaaatggaaattgaaaatgatgatcacagttggaggaagccatctgccccatgggaaagtgacttaatattaggtagcatatatagaggaccctcttgtgccaaggcacagagctggcggttttccccagagctttttccgtggcaccacatggcctctgggaaggcattgtgttagggagttaacttcctcagaagatgcatactggttacatggaaaatttgcatgagagtgacctaatgttggtataaagtagatacccttaacacagctggtggaagtctgagttgtccagccacttctaggaa

SEQ ID NO: 53151 - DNA, 1030 bp, Homo sapiens
aatttgttaacaatctgtatgattataaccaacaaaaccaaatatatgtagaaaacaatattgtagagttgcaaatgccaacactgactgaggaggtgggggaagtagggttagctgtggggagtgagggtatttttttcttttccttttaccaaattttctttactaccactcatttttctttattgctttaaaaattatatatttgtgcacatacatttgatatgtctttctagacatagaggataaggatttacatatccttatcctcacccacaatatacacacattccatgttgttgttaatggaaccatataatttaatcttggggagaagagaaatgataaaagtacttttccaaaactgcttgcaagagaacatctcaaaggctctggttttggctttgaattttctgttaaggatgtttaacatgacgatagcagctcaaaggtctggtatgaaggacaggaacaaggtagctgttgttcttacagccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggtgagttaaaaatacctagacaggggcaggtatttttattattttatttttttgagatggagtttcactttgtcgcccaggctggagtgcagtggcgcgatttcggcttaccgcaacctccgcctcccggggaaaaggagtaggaacaggaggttaaatggagcttagctagatgagggcagagttctggcttcaattgcaagaacaaaaagtttgggatagcctggttattttttgttcggtgtgtgctttgtgatgagaatcctgggatctctctctaacaggaaaatcaggaaaatgtttccaacctggtgattgaggacacagagctgaaacaggtggcttacata

SEQ ID NO: 53152 - DNA, 2717 bp, Homo sapiens
tgtatattactttcctttaaagttacacgttgacacactccctttcttctcctagataactgtaagaaacttggcctggtattcgatgacgtggtgggcattgtggagataatcaacagtaaggatgtcaaagttcaggtaactcgatattttggctccttctttttgtccctgaggaattaattcaaagagacatggtagacccacagatgttgctttggtgggaatctgattctacaaagtctgtaagctgagctgctttggacgtggcagaagaagggttggctcttcaagcaagttcttttcaggacccatcccaacccacccgagtatccagtgtcttgcgcatctgtgagcttttcatgtagttgctgagtcacgtgaaacaggaaaccttttcctgcgacttactgttgtccttcccaaccactgggactcagttctctttgtttactctgcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttgtaagtttcttgatctctttagtatgatgttaaaaacagaagggactgaagatttctggcattgaagaaagctattttatgaacattctgcactgagcaggtaaaaacccaataatgcacaccaaaagtacacagaaatgaggtagtcccatgtagtggagccccaaaggtaggtgctttctgcctaagtggagctcaaggtagcaaaaaataatggggatgagccatggcaccttgtcaggctggtgctataaagccatatgtactgttatttacaccccatagacttaatagtctgtccaagatcgctgaacactagaacatagcatggctctgtgggtttgtctcttgctacattgtaccgtgctcctggggttaagtggaagcaagcattgggagaaatgtgtgagatttagccccagctgttctttagctcagatttaaacctgctgtctcttctttatttgcagaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaaaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttgcttagttgtttacctgtgatattggctgtacagaaatgcaaaaaatactgaaaacaccaaggataagaaactactctttattttagacaacctcataaaattattttcacatcccccccaacttcttgctcttaatcctcatcttttagttgaagaataaggcttaagagagagaaaggaaaaaccataatggctaaacttagcagcaccaacacggttctttcatcaaggcgtagctcatcatttctccaaactgacatgctacagaaatgtcttccaaaaagcgttaagttttcacagagtggggactatgatttccatgctcaaatagtgtaggaaatggtagattacgttagttttgtttactgtaacaggaattctcaggagtccttagacactctaatgtgggttgatctccagaaggagaaagggagtgtgtagta

SEQ ID NO: 53153 - DNA, 1411 bp, Homo sapiens
gagaattcgcttgaacccgggaggcggaggttgcagtgagctgagatcatgccattgcactccagcctgggcaatgagcaaaactgtctcaaaagaacaaaacagaaaaaccatatccaaccgttaggtaacaaaccctggacactttcatattctggagttgaaaatgtcattacccatagcctagatgctggagaacaacctctggttgggaagataagcagttacgacagtgccagaatggtgcttctgccgtggccaacatcattttgagttttcacagtaaggaagttcttagctgtaatttctcaagcctttttttttttttttctcaaatcagattctagcttccctttttacctcaccacccaagttgaggcacccagtgcaaaagaaaagccaagccaagaggagacaaatgacctctgaaataacatggaggaattctagtagacggtgattggttcagatgtagtacttagcattttggagagtctgtctccaatataaaatccttagggctgggcgtggtggctcacacctgtaatcccagcactcttgaaggctgaggcaggtggatcacctgaggtcaggagttgaagaccagcctggccaacatggtgaaaccccgtctctactaacaaaacaaagtattaggcatggtggcgtgtgcctgtaatcccagctactagtgaggctgaggcaggataatcgcttgaacccaggaggtggaggctgcagtgagctgagatcacaccattgcactccagcctgggtgacaaagcaagactgtctcaaaaaaaaaaaaaaaaaaaaaaaaaaaaaaaaatccttaaagtgtagaaggccccagaactggaggtggcaaattactgcaacttctgcttaagatacaggacctactgctaaacaaaattcaaaactctagtcccactcaacctcctgcaggagcctcccttgtcagtgcgtaatttagaaacaggatttcacatctattaatgtttaaaagtaatgtcccttggccaggcgcactggctcacgcctgtaatcccagcactttgggaggctgaggtgggtggatcacctgaggtcaggagttcaagaccagcctggccaacatggtgaaactccatctctcctaaaaatacaaaaattagccaggtgtgatggcacacacctgtaatcccagctactaagggggctgaggcaggagaattgcttgaatctgggaggcaggggttgcagtgagccaagattgctccactgcactccagcctgggtgacagagcgagaccccgtctcaaagaaaaaaaaaggaatgcccctcatcatgcatggaggcttcctggatttgtagcagactgtacctcagccaaggcagctagttttaaaacctttttatcaaaagaag

SEQ ID NO: 53154 - DNA, 2986 bp, Homo sapiens
tgagtccatggttcggggtcatcgccccgtatctccagcgccgggagcctcgggactgcggccgtgtctgtggcagctggagacagagctgagggagcaagaggtgtcggaggtctcatctttgaactactgccggagcttctgccaggtgaggggctgactggctggctgagggcggcggggcggggaagtcagggaaggaggccctggatcctctgtaagcagccgggtccaaactgaaaggcgccacctccgtgactcgccgcgcccccgggccgggaaggcccagctcggaagctcgaccgctggcccccctgcgccactgcccgactttggccaccgctgggtcgttttgctctgagccttactgagatcccggagggccctggcgggtccctggaagggctgtgccctgtcgccgttgcctgtgtcctggccgggtggttggagcgccactgccccctgagggattgattgcttgtccctgccgggagatccttttttgagtggagtgcagatctccgaactggtaaacccgggtttttctgaataatccagagaggtgtgttggggccagagacttatttttggagttaacatcttctgggctcctaaaaggtatgacagttggcttcgaaaggcgtctagagctttctgattagggattgcggagccggttggttgtttggtttttgctttttttttttttacgtttaagccgttctttcgtcttttctgtatttctttgagaggattgtgctaccgagaataaggctgactctttgagtagaagaggatgggaagagggatgtagagtgtggcctcttttggcagtcgtatgatcatttctgtgccttggtgggtcctaacctatgattacatatttatgggtgtgtttagtttagtctccatgaccactccgagatttttctgtatgttttcaagtcttttacaaatacaaatattggccattattatttctgcttccaatgtttgttctgtcaggtttcagaggcacccatcagctccttatctgttgtaccttagaaaatgcaaaataatcgtggcatgttggtacttggagtctaataagtagtccagtatgctgaataaattgcggcgttctaaaataataattttggggggcaatttgctctgttggtccggagtagaataaaagttagcttgcttgattgcttttcttccctctctctgccgaggcagaagcacctcatctctctgaatggaattttgtccttactaatcttttccgtggattgtaccactccaatttttgtgtgtacaacctgcaacattgccctgtactattaaatgttaacgtgttgttgttctctgcttccttagtagtagtcatccctgtttagtaagctcatttattttacagatttttactgacttcataggatagtgccagggactttaccaagtgctggggaaacatgagtaagacagcacttagccttgatgaacttacagttggtgggaggtggtaggaatgacagtatttccagtgcggttttggtaatgatggaaaaggaggtgttgtagagacaatggtgaggagagagccttcatgggatatcctgatgggaaagacaattaactagaaaaataagtaaaaaggttaattataaattgtagtatgtgcttagaaagaagtaactgggagaggccactttagttagtaagaccctatgggctgcaaggatgaaaatgagtcacgtgaaggtctggggtggggaaagcatcccagtgccaaaggtagagattggtaaggacccagaatgctatgggaggaggggaaactaatggaaggagaggggtggtgcaggaaaacaactgtgggttttgggtaaggcttctaagcttgagttgtctccctggaaagatgacaagaatgaatgtaaccagtcacattgaagcttgtcaaaggatcacatatatatgtattctgctttatgtctagtgcttgcaactgcagttttgtttaaggtaatgttttaatgtcttgagtcttggtgacaccagagatgtgatggcccagaagaatttttaaaagaaagcatgtgtaatttgtcttttctatgaagttttttttaacctaaaattttcccaaaaaatgttttttagactaataaatgaaacaagaacaagtattcctgtaacactgtattgtaatagaaagcacatgggattgggagttaagttgggtcttgactgtgactttaccactgcttagctaataaccttgggtaaccatgtctgcaaaactatcttattttctgacctttatctccttataatgctttatacaatcagaatagaaaatttgtgtacaagtcttcacaaaatttatcatatttttgacacattttcccctgtagtccagataagatcaactgtgtccttgatgaccagatagagaaaaagtaaaaattgtatgaagaagcaggaaaattttcaccatcagtaaattttgttgaatagctcttggtttcacatttgaaaagaagaataagatatattcatttacttaaggaacactgattgtgtgacagttctgaaggtgggagcctagttaagacagttttctcggactctaggagaggagcacataatatataaagatagattgtaggcatttttacattataaaggtctgacccctgcttatgggatgcttaatactacaaatgtattttcatcagttatttagttagaaatgtcctagagacttagattgtaccaagtaatcccttttgcaacatcctgggaccatattctctccaactcttgcagcacttaaaagaaatggctctatctttgggattgcaccaaatcaagaaataaactaacatatgagtgaatagagaagcttgtctcattctgggcatattttcaattttcataagtttgtgaagatgataaaatgaaacactgaaagtaatacttactaagaaaatga

SEQ ID NO: 53155 - DNA, 1055 bp, Homo sapiens
ggagatgccaagatgggtataatcagtccccttaccttgaggttgatggccatgaaggctcttgagccttacctctttcatatatttcaagaagtttttaatgcattagcttctcttcttgcgctgccttctttttagcgatatctaaatagaaactacatgacaagtagttatcatagcaaaagctagctttgtaatgcacatgacaaaaacatagtataaatgtgacccgtgaagcagtgaaaactttgggtgctgtcatttactgtggtaccatcttgtctcttactgtgtactgtgacctctagtggtttctgtttcttccatggatcatactcttctgaatagtgttgacaaaaacttactgcaagactgcaaagactaaaacgtgttttattttcattcagatctagatacttgtcacctttcccagtgaccttccttgactgtcttatctaaaatagcacttccctattgcctttcacctctttaagtactgctttatttttcttcaaatcactactaatcttgtatgtccgtctccccaactgggatgtaagtgccatgaaggtgttggcttttatttacctagtgcctagtctctaaaacttaatgggtactcactaaatgcttgttgatcttgatctcctccctttcctgtatctcccacttgaatttttgagagtaataagcaagtcttaactgtctttatcaagaaatagggacatttggccagctgtgatggctcatgcctgtaatcccagccagcactttgggagaccaagacgagaggatcccctgagcccaggagttcaagaccagcctgggcaactctacaaaaaaaaaaaaattaaaaattagccaggtgtggtaatattagcacacctgtgatcccagctactcaggaggctgaggcaggaggatcacttgcgctcaggaggttgaggctgcagtaagccatattcgtgccactgtactccagcttgggcaacagagtgagaccttgtctcaataaataaataaatagaaagatactttttgtttgtttgtttgtt

SEQ ID NO: 53156 - DNA, 1138 bp, Homo sapiens
gcccgaggtgagcagatcacgaggtcaagagatcgagaccatcctggccaacatggtgaaacccccgtctctactaaaaatacaaaaaattagccaggcatggtggcgggcgcctgtaatcccagctacttaggaggctgaggcaggagagtctcttgaacctgggagggggaggttgcagtgagcgcagattgcgccactgcactccagcctggtgacagagggagactccgtctctaaaaaaaaagaaaagaaaagtaaaggaaaacccctcaagcttaatgtattgcctgttaatagtggtctgtttctgggtggtggtattatgggttattaaatttttatttttgcatatgtatgtaacaatgttatgttacttttatgacaagacagtaaaaggcatttttgaaaattgaaaatgaaataaaactagaaagcatagttaaatcctgtggcagaatcggtatctaaaaataatcttagtaggctgagattgatggactgaatccagtgaagtttaatcaggatggatgaaaaaagtatagacagatagataggtagatagatagatagatagatagatagatagatagatagagtaataagttagtcatatcactggctttaagaaaaccacctataaccaatatagaaaatgaggcagggggcatagtggcagcatatgttaaagacttagggggtttaatttactctagccacttaactttctggttgtaagcagccagctgttctctccccatttcatttcatctcactctcagcttagtctcttgatggcaaacctccatcaagaggtggtgcttcctcatgctgacatttaagtctcttcagcatttactctgatctgttctagccatctagttgtctattcatcttttctgacttttttcaagttctttctttggagtcctcctgttcccctcacttttgctcgtacttcagagatccatctcaagtgctgccctctcctggaagtctacctcttgtagtgcagtcacattttactgaaatgtataattctgggaatttcacatgctgagaaatttaaataaaagtttcttgctttatgtgcaaaatttgaaataatccaaacccctctctattagaaaacacataa

SEQ ID NO: 53157 - DNA, 1291 bp, Homo sapiens
ttgaaaactcattattgaattatagagatggcaactccagacctatagtgagaacaactagacattttatggctctactcttagaattattctgacatcaaaagagtagttctgccatttctttaactcagcagaaatcattcattaagtgatgaaaatagaagcttctaaacaaaccagagccttaaaaggcaaataaaaggtatatgcatctgttagaaaaaaaatgggagagctatgtggtgtgtttgaggacaaagacaatctgtttcattatttttatttgtaaataatttttaattttattttgtagaccttattgcaatatgcaagcaacaagaatgcatcagaacatattgtgtatcttctggaggtatatcgacttgccatccaaagctttgccagtgcacgtccatacttaactactgaatgtgaagatgtcctcttagtgcttggcagattagtactgtaagtttgagaacttaaatcactcttaaaattgagtaccattggtcgtgttgtttgcctggtttctctttacagtggcatcacatttattcttcagagcaccattagagtcataccattgaatgaaatttccttcctactcacgttcccaggagatatagtccaagtgaagctccagccaagcaacatcatctttaacttgcctctagagtctcttttcctattcaggcttggaatctgagaatgatatatttctatcccttaggtatagattgatttaaatgacagaatacctggaaactggtagtccttgaagaacatcttggcaaaaacaacatgaaattctgcaatttgattatatttgaactaagaataattttattagcaaaaaatatcagggtacagtataagattaccatcctaagaaagagatcatgatttagcgcgggcatggtggcgcacgcctgtaatcccagcactttgggaagaggctgaggcacgagaatcgcttgaacctgggaggtggaggttgcagtgagccaagatggcgccactgcactccagcctgggtggtggagtggagactgtctcaacaacaaaaaaaaaagaacgtgatttagctgttattttaatatttagctgcatagtagcagacaaaattacacctttattgtaattttcatctgcaaattgaaaagatacaacagccaatcagttttagctgggcatcaccttgttcaacttacagattgtttagtgagatgacttctagtctagatggtttattttattttttttctagcctcacctgttttccttccta

SEQ ID NO: 53158 - DNA, 1051 bp, Homo sapiens
ttgctcattattcaagttgtagtgcatttcttttttcaaaaaaatcttcctgttatttcttttctgtgtcttctggataatagtcagaaaaaggaaactcttttgcttggttttttttacaggtaaagaaacgactttgccagtcttcctgcttcctctgcaagtgacagaaacctatagataacagttacatatatttatcatttatcattttatcagctgaattgacagtagtatgagctcccatttttgtctactggaattagaattgtcctatatgggtgcctcttcacacccaaataaacaaaataaaactgcttggaatgtgatttctaaagagcttattatattcttaccaaatgtactaaagcaacaatgtaaatataaagccttgtggtctttctttttttcctcctttttaaattgaacagtcaatataacaactctgaagcaaattttgaagagtaaaaacatttaaaatagcctaaacaaatgtaaaatagatttttagtattgctgtcatactctacttaattattactataaccacctttatatacttactcatttttattgtaggagttgtttcgaattactgctttcagtgtctgaaagtgaactgccatgtgaagtctggctaccattccttcagtctctacaggtgagttgattttaactcagaaaagttttctgtatccaagacacctaattaattactcccagcaaactaaaattggaaccttagaacaaaaacaagtttattatatattgatattaggtcatgaaatgataaaaaggcccttcacatgaaggggatgtattaaaaatgggttttttaaatttggttttgtttgcctctacatagttagaaatcaacaaaaaagtttcattattcaaacataaagtttagacagcataaagctatcaaaatcatacatgattataaagtaacagtatttggatccttcatagcatacttattggtaaccttcaatatacaaaacactatttcattacatctaaggttcacctttttcttcctaacacttta

SEQ ID NO: 53159 - DNA, 1030 bp, Homo sapiens
aaaaaattttgtattgaaatgtttgaagaaatgagatacagaaaggattgtgattgggagtgagacatattgttttaaatattgaagcatatggtagatttcctttcaataaagaaattcaaagattgatatcttcaaatgatttgtaaaatacaagattgagccatatgttaaaattgatttagcagcagtttaactgtagttataattattgaataaaatagcttaccgcatagaaataatagctatgatttttagagtgcctgctatgtgttgggcactgtatttgtgctttcatatctcatgtaatccatgaaacaggtgagagattacacatacccaagaccatgtagttacaattgtggaggcagaatttgagcccaggtgaggtgacgttaaaatgtttttgattggagagtgatgacccttcagttgctaagtgcatggtttaattaaacatccgtaatatacaagcccttgtgcttagtgctgtagggaatacaaaggctaacaagacatgatatttgttcacaaattgctgacagtgtaataaaggagatatcagagacaatagtaagtactattaaacatttactccgtgtttggccttgtggtgagtcttatctgcatttctagtatttctttaatttgttcatccatgtgagatgggtataacctttttacagatgaagaaacttgagtctcagagaggtcagttaatttgtccaagggtctcacagctgtgtgtcagaatcaggtttcaacatcagatcagtgattctaaaacctgaaatgttaacgtttgtacactataatcccttatcactgttcttcgagaaaactaaatgtggggaaagaagtaaaatgctgtgggaatttgcaaggcgataggttgtgtaggtaatatgcctgttatcaggtatgttgcttcctgttggatttgcagaattgcttacaacctcatatggcaggtaaatagagcagaatctgatgttaggcaggcagaataggatataggggagacgtgaca

SEQ ID NO: 53160 - DNA, 1062 bp, Homo sapiens
agcactttgggaggccaaggcgggtggatcatgaggtcaggagatcgagaccatcctggctaacaacggtgaaaccccgtctctactaaaaatacaataaattagccgggcatggtggcgggcacctgtagtcccagctactcgggaggctgaggcaggagaatggcgtgaacccgggaggcggagcttgcagtgagccaagatcgcgccacggcactccagcctgggtgacagagcaagacttcatctcaaaaaaaaaaaaaaaaaaaaaatttgagggctcatccagagcactgtacagtcaatgccaagtgcctaatattcagtacagctcagaagtactgagcttcagtacttctgaagctttcagagtagcattttccaaagtgtgtactgaaccaggaacacatgttttacaggttactaatatgtataaaagggttctctggtcaaatcagtttaggaaacattgggtttttaaataaaagtgaacagttttctttattgcaggactgttcagagatttgaccaaggaatcctttttttttctaggactatctctcaggtcttttggtcggtggaacacactttgagaaatgcctggtttagaggaaagagcaccactggctttggaatccttggcaagttacctaacttctgtgaatattaattttcctaaccttagactggggataataatacttgccttggtggtggtgtgaagaataaatgagaggtatataaaaatatgcagcttaaaacttgatgtctcgtaagcattcagttgatagttgttaatattacataggttacttgcttcatttcttgcatttatgcttatagttcatttcactatttcttaattttcctctcatctctattagatgaatattgagaccagagtaaacttctcatttatataaactaaatttttattaactaaaaatcaaataaaaagatctcaaactttcatcttagcaagtctgacatgttatgtggtatgttgtcaaactgttttatttttcattttttctagtcaataaattgattgcacaagaagga

SEQ ID NO: 53161 - DNA, 1033 bp, Homo sapiens
cccgggttcaagtgattcttgtgcctcagcctcccaagtagctgggactaaaggcatgcgccaccatgcctggctactttttgtactttttagtagagacggggtttcaccatgttggccaagctggtcttgaactcctgacttcaactgatccacctgcttcagcttgtactactaaaagtacaaacattagccaggcatggtggtgggcgcctgtaatcccaggtactcaggaggctgaggcaggaaaatcgcttgaacccgggaggtggaggttgcagtgcatcgagatcgtgccactgcactccagcctgggtgacaagagtgagactccatctcaaaaaaacaacaactattttatgtatcagattgcatcctttaaaaaaaaaaaacctcaattattatgtttcttaaatttggagttagacttctctaatggtttttgacattatacagaaaaaaactagagattcttaagctttatttcatcatctacctttaatcctcttatctgccattcaattctgacatatggattcttactctgaactgaaattttttattagatgtagtagtcccaaggatctggttttatgctgtagtaattctgaaacttttacttgtaatatcttactctccaaatacaattgtctatctttctaccttactccctttaatatacagtctccaccaggatcaatcaagatctattgatcttgtcaccttttcattttcccttatcccccttatgtattcacttccctatttaactctgctttgtcattgtcagatcatcattatcactctcaaagagcgagaggtcctctctcttttttttttttttttttgacagagtctcgctctgttgcccaggctagagtgtagtggcgcgatctttgctcctgggttcaagcaattctcctgcctcagcctcccgagtagctgggattacagtcgcccaccaccacgcctggctaatttttttgtatttttgtagagatggggtttcaccatcttggccaggctggtcttg

SEQ ID NO: 53162 - DNA, 1021 bp, Homo sapiens
ctctgtcattgggtcttctctttttacacttaactaggcttatttccttcatctttggctttaaataccaactatggtctgactcccaaaagttttctctccagccctgttccctcctccaaactccagacccatatccaattgcctaattaccatctctacttacagatttaacatgtccgtaactaagctcttgatattcctgatatttggactttgcttttatgagggttttttttagtcctcactatgtgtttggcaccatgctaaatgctttatatactttgctacatttaatcagcacaatagctctgaggtagctccattttattgatgaggaaagtcaggctcagattaggttgtgtgcttcaaggttacaaagctaaagtggttaagctgggattcaaacctgagtttggtgtactaccagtaatattatattaaagacataggataaggaatattatccttgttggtatttaccttagagtttatatgccaaatgctgtgttaggcattggggttcaaagatgaatgcagaagtctctggactggcatacttggttttactgttggcctctacattttatcttgaaaatagccagaataatctctctaaaacttgtcgtgccatgccacttctctgcacacaattatctaatagctttccatcttactcagaatacattcagaattctttattctatgtgccatgggccctggctacttttctaacgttctctcaccttatcttgtaatcttagtgcccactactctccagccgccttgtctttgctgttctttgaacaagccaaggatgttcctgtcttagagctttgtgcttgctattccctctgacgagaattgccttccacaagataatttgaatggcttactcccttacctcatgtctgctctaaatgttctcatgtctgttcaatattaccatatcagagaggccttcctcgctgtctcatctaaaatattaccctagccccctactctgccctaaatatctgct

SEQ ID NO: 53163 - DNA, 1025 bp, Homo sapiens
ataaacctgtatgctaatttatttatttgcagtatcaggtagtgtaaggagatagattgcttacctctaatagcagctgcagtattttatgtttgggaaagttaatcagactgagatgtagtaatggttattctcagcacctgacacatgccaaaacaattcaaaagcagcagcaaaacactacattttgggtttgattcctcatcctgtaataataacaactttactctctcagcctttgcttaattaaaacccgttttgtttctaatgttgtattaggcattggcaaatacagcaaactgtatggcccagtttgtttgccaaaaatagttacagaaagagaagtactaagctcaatgattactgccctaaattcagtagaagtgtaaagatagagaattctgtgtttatagaaaaattgatccttgaattggagctttaagtaatggtggggtttggatgggtggaaagaatggtttggagatgactgaatggtagtaaagcacaggtactaatgagtactttgcagggatccactggagaataaataccctgcttagggcagagtggttattgaagtcttgtgagaaataagacctgttggggttggaaaagaagggcttggaaactccattgcattaatggttagatttgatgcagtagaaattaagaaggctttgcagttaggaagtgacatgtctgaagtggtgttttaggaagactagacagaaagaatatgtattatgtttaggacaagagattgtagccagcaagaggacaaaggacaggacttgctgaccgggcaaaaacagaggaggatgtacagagataccttcaagaggctcataaggcttctagcttgggagactggaagaatagtggtgctctgctgctaattagaagaaagaatgggtggagggacaagggagagtctgggaagatgataagctttgttttatacatgatctttcctggtttattaataacaatgtttggaaacaggatttttcctgattgtgttgagt

SEQ ID NO: 53164 - DNA, 1092 bp, Homo sapiens
attttccttctatgaaaaaatgatgttaatgtagcatttgtatttaaagcagttcctgaactggcctcctttagccccactgatattgaggataagccatatgttttactatctgtaaccagagtgacccagctgtggtcatagatactaggggaagacaggaacaggaaagaaaaaaaaacatagtaatacttcaggtaaaaataacctgagattattatatataatttgactcatctatatggtagcaatgttcgtaatttttttaaactgcaaaaatgtttttatctgtattgagactgtagtagaacttccttatagtgtctgttcccttctttaatattttcttatgtgaaatattcatgcaagaagactcattcattagcaggagaaaattatgtctctaatttttgcctcattaagaagtttcaccttatataacaaagtttactgaaaagtcaccattttctttttgacttagtcatctcatttttgatagattgcaaaggtcgactgcaaggaagtactagacatcatttgtaatctggaatctgaggggcaggataacacagcatttgttctttgtacgacttaccttacccagcagctccaaactgcaagtgtatattgttcttggtaagtatatttagttttacactctttatttgttagtacatagtatagcatttagggtttatgtaaaatgttaatttgtttctaatttaaaacctagcatgacctgtgaatagcttcttgcttccacacacaatcatttaattaaaaatatcattggtttaatctagtcaagaaaaggtaaaatgttcctcttgatcatcccataatgggttgtctgttaactccaatatatgtcttctaccttgaagataaaattttgtcaatatgaaacaaacctgtgttagttagattgtttttcttttcatttttttagtatcttctgggtagtcactccccattcttatttgggaacccacaaatgaaaaggatcaaattatctaggtttctaggtcaaactagcactaaaaaaggaaattcacttgaatagtaatctcttttgcaactttggaactatat

SEQ ID NO: 53165 - DNA, 1050 bp, Homo sapiens
agatcagagagaggtgctcactgtataccagagtattaaaggtgtcagggaggaagtaatatttgagatttaattctaagaatgggttggatttgcattatcttgattagaggagctctgagtatttcagaacctaaggatggcttaaaattggaaatgagcattttgtttataggaaaacctagtaaagccttttgtgtacttcagccctcattgatctccctctggatcgtctgtctatttttatagttttatggttaataccattgtatgttactatatttctttttgtttattattttatgtagaaattttgtgtactgtaatctcacccagtcctcataataatcattgcacaggtgaggcagtgggaggatcatagggaccagagaaaacttgtaattgtccatggtctcaaggctaaagtggtagagctgagattcaagcccaggttttagacttctaatccagtgcttttcttctgtatacttgttttcttggcataggccaaaattcaaattgtagttttttaccaccaaatccactatgccagagttatacctcctgtgagaaaggagatagtgggatagcgacttaaatataatttctttataatgaaaaaatatccaccattatagctaggttttcagtacgaataataaattaaatcatatatagaatgtgttatagattgtgtttaaaatttttctccccttcttcagtcagccaccattcactcttccagagctgttagtggctctaggattaatgctgttcttctgtagcaggaagagatgaatggagatttccctttgtggcctcctcaggagctataatgagtaaaggaaagaaaatcttagtcatttcacactttgttaaaaggagcttctttcaagcaattcaaggagcaattgcatcttttttttttttttttttttgagacgaagtcttgctctgtcacccaggttagagtgcagtggtgtgatcttggctcactgcaacctccgcctcccgagtagctgggattacaggtgcacactgccacgcccg

SEQ ID NO: 53166 - DNA, 5846 bp, Homo sapiens
cattttaaaccctgcccctctactcaacatcattctattttgaatcctccagtgaccttttttatcctgaatttctttggattcacatgcatttattgtttatgcattcggggtacagataaattccttggaagtaaggaactgctttaatacacagtgcctagtaaatgtacattgttcgtagttgtagcatctaatttagttctttgcatgttgagacaagaaatatctaaatgtaactttcatgaagaaagatttaagataaaatttaggaactctaaaagtttttacaagctaaaattccttatcagtgaaagttatataatctttctgtatgcaaaaaaataatttttttatcctcttttacttacaggcacaagatgctggtcttggggtgtcaattttactgtgtgtcagagctcttcaactcagatcaagtgaagatgaggaaatgaaggcatcagtttgtaaaacaattgcctgtcttttaccagaagatttagaagttagacgagcctgtcagcttacagaattcttaattgaacccagtttggatggatttaatatgttagaagaactatatttgcaaccagatcaaaaatttgatgaagaaaatgcaccggttccaaattctcttcgatgtgagctcttactagctttaaaagcccactggccttttgatcctgagttttgggactggaaaactttaaaacgacactgccaccaacttttaggacaagaagcctcagattctgatgatgatttaagtggctatgaaatgtccattaatgacacagatgttttagagtcatttctcagtgactatgatgagggtaaagaagataaacaatatagaagaagagatttgacagatcagcataaggagaaaagagacaaaaaacctattggctcttctgaaagatatcagaggtggcttcagtacaagtttttctgtttgttatgtaagcgggaatgtatagaggctagaattcttcatcattctaagatgcatatggaagatggaatttacacctgtccagtttgtattaaaaaatttaagagaaaagaaatgtttgttcctcatgtgatggagcatgttaaaatgccaccaagcagaagggaccgctctaaaaagaaattactgttaaaaggctctcaaaagggtatttgtcctaagagcccctctgcaatcccagagcaaaaccattcattgaatgaccaagccaaaggagagtctcatgaatatgtcacattcagcaaattagaagattgccacctgcaagacagagatttgtatccatgtcccggtacagactgttcccgtgtgtttaagcaatttaaatacttaagtgtgcatcttaaagctgaacaccaaaataatgatgaaaatgccaagcactacttggatatgaaaaatagaagagagaagtgtacttactgtcgacgacattttatgtctgcttttcaccttcgagagcacgaacaagtgcattgtgggcctcagccttatatgtgtgtatctatagattgctatgctaggtttggatcagtaaatgaactacttaaccataaacaaaagcatgacgatctgcgttacaaatgtgaattaaatggctgtaatattgttttcagtgacttgggacagctttaccaccatgaagcacaacactttagggatgcatcttacacatgcaacttccttggctgtaaaaagttctattactccaaaattgaataccagaatcacctctcaatgcataatgttgaaaattcaaatggagacataaagaaatcagtgaaacttgaggagtctgcaacaggtgaaaagcaagattgtattaatcagccccatctacttaaccaaactgataaatcacatttacctgaagatcttttctgtgcagaatcagctaattctcaaatagatacagaaactgcagaaaacctgaaagaaaacagtgacagtaattctagtgatcagttaagtcatagctcttcagcttcaatgaatgaagagctaattgacacactagatcactctgaaactatgcaggatgtattgttatctaatgagaaagtctttgggccctccagtttaaaagaaaaatgttccagtatggcagtttgttttgacgggactaagtttacctgtggttttgatggctgtggttccacatacaaaaatgcaagaggaatgcagaaacatttacggaaggttcatccataccatttcaagcccaaaaagataaagacgaaagatctgtttccctctttgggtaatgaacataatcagacaactgaaaagttggatgcagaacctaaaccctgctcagatacaaacagtgactccccagatgaaggtctagatcacaatattcacattaaatgtaaacgagaacatcaaggttattcctcagaatcctccatttgtgcttctaaaaggccctgtacagaggataccatgttggaacttctgttacgcttgaaacatttaagcttgaaaaactcaataacacatggatctttctcagggtcattgcaggggtacccatccagtggtgctaagtctcttcagtcagtttcatctatctcagaccttaattttcagaatcaagatgaaaacatgccaagtcagtaccttgcacagttggcggctaagccgtttttctgtgagcttcaaggatgcaaatatgaatttgtgaccagagaggctctgttaatgcattatcttaaaaagcataattattcaaaagaaaaagtccttcagttaaccatgttccaacatcggtattccccatttcagtgtcatatttgccaaaggtcatttacaagaaaaacacaccttaggattcattataaaaataaacatcaaattggcagtgacagagcaactcacaaactattagataatgaaaagtgtgatcatgaaggcccatgttcagtagataggttgaaaggtgattgttctgcagaacttggaggtgatcccagtagtaactctgagaaaccacactgtcatcctaaaaaggatgaatgtagttctgaaacagatttggaatcatcttgtgaagaaacagaaagtaaaacatctgacatttcatcaccaataggcagccatagagaagaacaagaaggaagagagggcagaggtagcaggcgaactgttgctaaaggaaatctgtgttatattttgaataaataccacaaaccattccattgtattcataaaacttgcaactcctcattcaccaatctaaaaggcttaattcgccattacagaactgtacatcagtacaacaaagaacagttatgtttggagaaagacaaagcaagaaccaaaagggaacttgtcaaatgtaaaaagatatttgcttgcaaatataaggaatgtaataaacgcttcctgtgttccaaagctcttgctaagcactgtagtgattctcataacctagaccatattgaagagcctaaagtactttccgaagctggatctgcagcaaggttttcttgtaaccagcctcagtgccctgctgttttttatacattcaacaagttgaagcaccacttgatggaacagcataatattgaaggggaaatacattcagattatgaaattcattgtgatcttaatggctgtggccagattttcacccatcgcagtaattactcacaacatgtatattaccgacataaagactattatgatgatttgtttagaagccagaaagtagcaaatgagagactactaaggagtgaaaaggtatgtcaaacagctgatactcaggggcatgaacatcagaccaccaggagatcatttaatgctaagtctaaaaaatgtggcttaatcaaagaaaagaaagccccaataagttttaaaaccagagctgaggccctccatatgtgtgtggagcactctgagcacacacagtacccctgcatggttcaaggatgcttatctgtggtgaagttggagagcagcattgtgaggcattacaaacgcactcatcagatgagtagtgcctatttagagcaacagatggagaatcttgttgtttgcgttaagtacggtaccaaaattaaggaggaacccccttctgaagcagatccctgtataaagaaagaagaaaatagaagctgtgaatcagagcgcacagaacacagccattccccgggtgacagtagtgcacccatccagaacactgattgctgtcattcaagtgaaagggatggaggtcagaaagggtgcatagaaagcagctcagtatttgatgcagatactctgctctacaggggaactttgaaatgtaatcatagttccaaaaccacttccctagaacagtgtaatatagttcagcctcctcctccttgtaaaatagaaaattccatacctaatcccaatgggactgaaagtgggacttatttcacaagtttccagctgcctttaccaaggatcaaagaatcagaaactaggcagcatagttcagggcaagaaaacactgtaaaaaatccaacccatgtcccaaaagagaattttaggaaacattcacagccccggtcatttgatttgaagacttacaaacctatgggatttgaatcttcatttctgaaatttattcaggaaagtgaagagaaagaagatgattttgatgattgggagccttcagagcacttaacattaagtaattcttcacagtccagtaatgatttaacagggaatgttgtggcaaataatatggtgaatgacagtgaacctgaagttgacatacctcattcttccagtgactctacaattcatgagaacctgactgcaatcccacctttaatagtagctgaaacaacaacagttccttccttggaaaacctgagggttgtattggacaaagcattaacagactgtggagagcttgccttaaaacagcttcattatcttcggccagtggtggttcttgaaagatctaagttttccacaccaattttagacttatttccaacaaaaaagacagatgagctttgtgtaggaagttcataagtagcaattttgttttagtaacagactggctccaacactgcaacatggggacatttgccaactcgaacaaaggctgagaagcagccacaccgttgtttagggtagaataggctgtgtatttacatgaatgtataatatctatgtcagcagtattggctgagtccattagctctccagttggtttaatgattgggtttatttttgtttgtttgtttattaaaaaaatggaactgtacacttgtttggtgctaattaatacatcaaaatatactggggcttcctttttcaaattaagtgtgcatgattgtatatggaacaaatactaaggtcccagggtgggagggctagggaaagggatatggagttcttacttgacttgaatgtgcacctgagggtgctttgtgtaatatattgtacactacagcatcttatattttttgagttgagtttcaataaattacaatttttcacccattcgttgtttactcataatgagctttcatgccacatgtaaactgaaattgcacttgtattttctgaaatatgccattcacattttaccccagtaatttttttatttattattagctaaatcattcagaacaaggttcttttttttttttttttttttaagacagagtttcgttcttgttgcccaagctggagtgcaatggtgcagtctcgactcactgcaacctcctcctcccaggttcaagttattctcctgccccggcctcccaaagtgctgggattacaggcatgagccaccgtgcccatcccagaacaaggttctttttatcttaaaatttttgttttt

SEQ ID NO: 53167 - DNA, 1047 bp, Homo sapiens
tataaggctgaggcccacaatgcacttgttcgtgctctcgaaggtgaaaagcagacataaaatgtcgtcgacagtaagtacacttctctcttctatttttcatatccaagtagtgcttggcattttcatcattattttggtgttcagctttaagatgcacacttaagtatttaaattgcttaaacacacgggaacagtctgtaccgggacatggatacaaatctctgtcttgcaggtggcaatcttctaatttgctgaatgtgacatattcatgagactctcctttggcttggtcattcaatgaatggttttgctctgggattgcagaggggctcttaggacaaatacccttttgagagccttttaacagtaatttctttttagagcggtcccttctgcttggtggcattttaacatgctccatcacatgaggaacaaacatttcttttctcttaaattttttaatacaaactggacaggtgtaaattccatcttccatatgcatcttagaatgatgaagaattctagcctctatacattcccgcttacataacaaacagaaaaacttgtactgaagccacctctgatatctttcagaagagccaataggttttttgtctcttttctccttatgctgatctgtcaaatctcttcttctatattgtttatcttctttaccctcatcatagtcactgagaaatgactctaaaacatctgtgtcattaatggacatttcatagccacttaaatcatcatcagaatctgaggcttcttgtcctaaaagttggtggcagtgtcgttttaaagttttccagtcccaaaactcaggatcaaaaggccagtgggcttttaaagctagtaagagctcacatcgaagagaatttggaaccggtgcattttcttcatcaaatttttgatctggttgcaaatatagttcttctaacatattaaatccatccaaactgggttcaattaagaattctgtaagctgacaggctcgtctaacttctaaatcttctggtaaaagacaggcaattgttttacaaa

SEQ ID NO: 53168 - DNA, 1126 bp, Homo sapiens
gcttggtcttgcttttgaggtagctctaactcagaggcacgatttttagagcctgggaagtcggctgctgttcagtccttcctagcctcctcaggcgggagccgcggcccactcagtcagttgcggcccactcagtcagttccggccccagccccgactacctgtcgccttgttgggggaaggaaggcagataccgcagcccagtcagggtaagccgctgacccagaggatggaactgcggctctggagattagaaagaggaggacttcgccgcgttcactagcccaggaggaaagccagaaccctaggccggaacccagcgtcaagacgtgggggaagaatgttgatgcaacacagctcagccgggcccggaactcggcgtttgggtccccgccctctttgggccggaagtgaggaaggtggggctggggcttttcctgtagaaactaggagggactagggagagtctgcaaggggaagagtgtgtctgtgacactgccagcagcgcgcagagggagggatgggggcgggtatcggcgtaggggccctcggaaagaacggatattgctgtgacaccgcggggacgctctgaagggacgagtgtcggtgtggcaccggtgcacgctgaaggagccggcggaaccgggtggccatggggatgtgggcatcgctggacgctttgtgggagatgccggccgagaagcgtatcttcggggccgtgctgctcttttcctggacagtgtatctttgggagaccttcctagcacagcggcaggtgagcctagacagggtccaacctgacccccatacccggccagccctggagtagccttggcttcgaccctgagactcttgattgcttcggtccccgcgccagtctcgtctttgtggtccctgctgagtctcgtaacttggcccgatggcggactgtggctttgaggagggtcttggtgcgtcaaggaagttttctgtaacgttatcatgggacccaatccctttagggcctggaggaaggcttgggctcttgtgccctccctgcagcttccttgggatccttgggcccagacttggcctcctttatctttggaataagcctttaaaaggatttagacacccaacttcctca

SEQ ID NO: 53169 - DNA, 1137 bp, Homo sapiens
gcgtgacccaccgtgcccggctgaaaattggtcttttctcacagacctgatatgtttccatctggtgatcctcaagtttctggcatttaggaccaaatttaatgagcagcctcagtatctgttcatactcacagttagcatgtgtgcttctcctttgcatgaatttgttttccgtattataggaggtatgtaatacccagaatgagtagtacatgtaacaaagttgtgatgttaacagctttggtttacatatacaaactgaagtgtgatgacaaccctgattatagttttaccagtcaggtcacctcaggttctcttgttctgcttttattttcctgcatcagtcgtttcatgtacttgatcaagtgcaatatttgtgtaggtataaagcaaattcaacagatataagtggcaagctataaaccattcgatgtttgatcataaatgactattgtaataaacaactatttcactaaagtgttttctttaaaatatttcagagaaggatatataaaacaacaactcatgtaccaccggagttaggacagatcatggattctgaaacatttgagaaatctcgactctatcaactggataaaagcactttcagcttctggtcaggactctattcagagactgaaggcactgtgagtaatttacttcttggagagacagtctgtctggttgttttcattttcatatttttgtaacacaaaagagggtaccacacttacaagtcccagaatgctttcttaacctttgttattgatagtaacggctgtggagcaaaaaagacagaaacataactgcttagtcagttgaaaactatagaatatgggaactattaccctgaagccaggtaggaaaaagatcctcttccattaggatccagctgagatgtcatgtcttctaagcaaccatttgaaactccctgcctgacgaatgtggatagggtagcattctatcattattcctgtcagagtacttatctcattatgttgaatttgcctggatttttttttttttcttctggcacagtcttgctctgtcacccaggctgaagtacagtggcgtgatcttggctcactgcaacctctgcttcctaggcgcaaatgatcctcccacctcagcctcccg

SEQ ID NO: 53170 - DNA, 1056 bp, Homo sapiens
tgggtttctttggacaagttacttcaacctctcagttaaagtaacctttcagttaaagagtttcagttgcctcatctattaaatagagatgattatacccttttccctgcctgtttttcaagactgtagtagtgaagccaggcatgatgactcaatcctgtaatcatagcacttcgagaggctcaggtgggaggatcacttgagcccaggagtttgagaccagcctgggaaacatagtgataccccatctttgcaaaaaaatttttaaaaaatcaactgagtgtggtgatgtgcacctgcagttctagctacttggaggctgaggtgggagggttgctggagcccaggagatggaggctgcagtgagctgtgatcacactgctgtacccccgcctggtgacagagtgagatcctgtctcaaaaaaaaaaaaaaaaaaaaaaagaatgtagtgaaataatatatgtcaaagcgctggaattattttttctgggatcattaattttgccatagaacaaccctgggagcatgcttagtgaaattgtcaacatagagacattgtacagttcaccatgctttgtttttcagtccccaaaagaaactaaacatgctttgtttttcagtccccaaaaggtttgcagtatcagttttcaaatgcatttatagatcattcagaattcatattaaaactacccttgatgcttatttaaatactggacttttaataatagttgctgtggcctttactaaaagcattataagtccttaattatacattatttattagtattgggaattggctgaaagaaataccatcccaggtcaattagatcaacaactacagcatatgtcagacagtggtaccaaagcatgtcttttgggaaaacaaggtttatgtctaagattgaattagttgtagtaaagtggaaatacctggaggtagtgttaggggagccttttgaaaagcaatttattggggctgagtgcagtagctcatgcctgtaatcccagcactttgggaggccacagtgagaggactgcttgaggccagcctgggc

SEQ ID NO: 53171 - DNA, 1053 bp, Homo sapiens
caaattccatttctatcactcattagctgttggatttcgaacaagttttttttttttttttttttttttttgagacagggtctcattctgtcacccaggctggagtgcaggcacgatcatggcccactgcagcctcgacatcccaggctcaagcaatccttctacctcagctcccccgagtagctgggaccacagaatcatgccaccataattggctcatttttgtatttcttgtagggacaggtttcaccatgttgtccaggctggtctcgaattcctgagcacaagcaatctgcctgccttggcctcccaaagtgctgggattacaggcatatgctaccatacccagctgtttaacctttctaagtttagtttgtgattttgttgtggtcttttgacaaaaggtttttttttgttttgttttagaacagctttattgagataattcatgtaccatacaattcatataccatacaattcatccatatatagtgtacagacaaaaatgttatattaaccacctaaatttagtatctcaatggttagtactcatctaaatgcataatttatgctaaatgtgaaataggtctattttttaaaaaaatattttattttgttattttattttattttattttattttattttattttattttattttatttgagacagggtctcagtttattgccttgctggagtgcagtgtcacaatcacggctcactggagccttgacttcccaggctcaggcaatcctgtcacctcagtcccccaagtagctgggtctacaggtacgcactatcaggcccagctaatttttaaattttttgtagagatggggtctcaactcaccttgttgcccaggctggtcttgaattcctggcctcaagcgatgcttctgtctcagtctcccaaagtgctgggattacaggcatgagccaccgtactggcctcttttgtttttttaatagagatgattattttgtcctttctttctttataccatgctttctcatatgatagtttctagtactgttcaactgtgatcaaagt

SEQ ID NO: 53172 - DNA, 1287 bp, Homo sapiens
gctcactgtagccacgaccttccagattcaagcaatcctcccacctcagcctgcctagtatctgggactatagatgaattatactacactgggttaatttttttattattatttttagtagtgacagggtctcactatgttgcccaggctggcctggaactactgggctcaagcaatcctcccatctaggccttccaaagtgctggaattacagttgtgagccactgcactcgtcctcagttaataaggtttaaatgaattttcagctgtaaaatgcaagacatttacccattgtcttaagctgcctaatgtcatataatatagtttcactgcatgttaattttaaaaattgctttaataatgtatcctttgtatttatttatcagttattttaaaaagcagaaccagtttctcagtttcttgtggtaatgttttctttttgcagactttggggttcttcatgaaagatgcaatcaagaaatttgttgtgactcagtgtattttgttgcctgtgtcttcacttctactttacattattaaaattgggggtgactatttttttatttatgcctggctgttcacattagttgtgtctctggtgagtaaaatctttatttcgttttcttttgcaaaagttccttggtgagattactgtaatcttcattggcatgtaaacagttcttaagaagcagctgaaatataaataggtgcttatatacatttcccccttggtttctgcttttgattgtagacacaggagtattgactgaccataaatttccttctccttatgctaactcttcaggtcatagaaactagttgttagtcacttttaatgattcagttgtcaggcagttttgggttgtgcatttgcgagttgccaccagaatgactaagtgtgataatttaatgactcctgactgacctccactgcctaaaatcatggttattttgaagagaaatgagatttaagagggacaagagaaagaaagcatatacttaactggctttcttctgcttcccttcccttgcctttcccttccacgttagacactctctcccttctttgccccatctgcttccccttccccttctatcttttacccattcttcttcctttccttctcctgtcttcccttttctccccaactgccacctattcctgcctctcttctcctttccttttccctctcactcttttccccctgatttttccctccctcacatctcctattcctcttctctttccatactctcaagtgcttcacaacacaaacactacaacgc

SEQ ID NO: 53173 - DNA, 1017 bp, Homo sapiens
ttaacttttatatgtgtttctggcctgtttgcttgggggagaataaggctcaatttataatttcctcaccctaggtcccctaaatattagtgatctttcttttgtcctgccattcctcttatcccaagccaaacttctctacagtctcagctcatggaacctttagtaacaacaaagaggtgggcagtggctaaaaccctttcattttctttttcaggttctttctttttgcctaacagtcctaagccgcagatttgagtttcaagctgatgcatttgccaagaaacttgggaaggctaaagacttatattctgctttaatcaaacttaacaaagataacttgggattccctgtttctgactggttgttctcaatgtggcattattctcatcctccactgctagagagacttcaagctttgaaaactatgaagcaacactgagatgtccaggatctgtgactgaagacatttctgattatttctgtcctggcagcatgttccagctcttgatgtttttaaacttttttttagaagaaaaattaagtacagaaaagcccagatttaaatacatttaatatgtcattttaaaaatgattttaataattcatttcttaaaacactgaatgaattttgaagcttaatgtttttaaaggcatagttttatctttgacatctaatttaccatcaagttgtaaaattatttggaaaaatacagaactcgttttatttgtatacttatatggaatctgcatgtgaggtgtttgagggcatatgtttgaaagagggagcatcaccacaggaatcctttctgtgaggtggaaacagtggtcctgaatcattgtgctcacacctaacttgaaatctggtcttactttcatgctgttatgatttcacctggtgaatcagtgttttaaataagaaaggtaatagttggtaaggccaatgttatttaaatgaaagtagttagaaaaatgctctcctattctaccaaatttttaatttctttcttccctttc

SEQ ID NO: 53174 - DNA, 1050 bp, Homo sapiens
ggaggagggttctcccttccctaggctggatccctcacttgctcctagtgcctggaaccttaggtttagagagccactctactccttgaagtctcttgatgcaccttacctggggccctttccttatccctctctgcagcattcccagagatggtccactggagggtttcagcaccacagagaggctgatgattcacaaatctcatgcagttacacctcattccttctgacagcaatttgaaggggctgaaagggggctaatccctaaggaccagtggttggtagcctacgtaagactccctggtgggtaaatttcactcagaccatttgctgtgatctacgaatctcctatatgcctttctaaactcaactctgtgcttagactctggtacattccactgcagccataccagcctatgctgtccctctaacacgtgtacaacacacaagccatgccctgtttggaatgttcttccccaaaatatcactgccagtgaccttgcttcaggtctttattcaaaaactgacctcatccttaccctgatattccagaataccattctgctttattatttgtcttccacacttagcactattcaacataaagcactagaatataagctccacgagggtggaaacttttgctcttatttgctgttctattctgcagcacatcaaacagtgcctggcacacagcaggtgctcaataaatatttattaaatgaatatgttcaggatgctcagaggaagatcccaccaatcatcaaaccaggaaggaagggatctggtctccacttgtgtgtggctgagatgtgttctgagatggcccagtgtccgagttttattccctcacctactgagaacagggacctgccctttgacagctgaatcttgggaggcaacagtctgatgcaaaaaaaaaaaaaaaaaaaaaaagtaggaactcaattcccctgtttacaattaggaaaagggggatttagaagcttaacagaaagggcattgcaccaagacagcccagcccctttgcaaaggttcaacaccacactg

SEQ ID NO: 53175 - DNA, 1063 bp, Homo sapiens
tctgggtggacatgcacccatccccagtccaggaaaccatctcccccaggaccttctgtctgggactcaggagtcctaaggaaaaggaattctaaaacatgggggaaggggaggtagagcactgatgggtgaaaaagtgaggccaacacacagggcaagtggtgtcgatggagtcgaagcgctgaaggaatagggcggctttccttccagcgagcatcattcggctgttaccaaaacaaacatcttaatctgcacctttctccactggccatcttgtccttgggtcagtgggacatgggcacctcgggaggcccgggccctgcccagctacagttccacccctcagcttgaggaccaatgactgaggtctatgccagttcctgatcccatctcactctctggacctaccaggtgactgctgctgggtgactcccctgaggcggctatacccttaagccagccccactacttccttccctgcctcccagctcagtatttaaacatcatctcccttctctttctcgcataactccccacccctttctccccgatccacccaggcctttctgtaaataaaagctcccaagttgggtacaaaccaggatattggagttactctatcctggagttaactaggatagaggagttgttgggcttctcttcttgtggatggggcagttgttgctgggcctccattgcccaggcaggaaggacagaggctctggagggggagggaaggatggggcgttttctctgggcacctgaattctgagcattaggatagcatggcagttttgaggaacatctgtgggaggaacctaggaatggaagcaggatgctgacctgctgtgtaactttgggtgaatcccttttgagcctttgtacaactgtggcaaggactcacctgtatcttgttcatgccagtatagcacacccagtgtctcgccggggtctgccacttggaaggtcctctgtgagtttcagcacccacggtgtgctggccctggggtaggagctggtagtgaaagattggaagaccttgttcttgccttccaggggtttc

SEQ ID NO: 53176 - DNA, 1352 bp, Homo sapiens
atgcgggcgccccaggggttcagggctaccctggtccccccggccctcgaggactggccgggaaccgaggcgtgccaggacagcccgggagacagggcgtggaggtgagtcgggccccggggtaggaggtgcttcttctaggtagatctgttctggggtgcggcttacccgccaaaggctagggattcccagagactcaccgacttccccgagactggttccaagccccagagcagacaggaaggctgtgagtgcagcctgagggattaccccgcgaccttcccaagtaagcccttggccctgcccaggtacaatctgttcctcagcttgggaattaatgactcaacaccagagtctcctccatggcggcctcacgctcagccaggtgggataggagcggtgggcccttgtagccaggggcttcttcctgaaaggcctctgctttcagggccgggatgccactgaccagcacatcgtggatgtggcgctgaagatgctgcaaggtgaggggcagcaacccctcctcacagtcagttcgagggcatcgccgccccctcaccccctcccggagcctccacgtgttcacttgtctgaaaatctggagtcctgggggctccttccagtccagtctctgaagggttttgggaccttgaataagtcactctgggcctttgacttccgcaaaacagagcccacggaaggtggtgcttttctgtctgcaaacctaggggccagggcccatcggaatgctctgcctcccctagtgttactgctgacacccatctcatagacttccctctccctccctccctccctccctccagagcaactggcagaggtcgccgtgagtgccaagcgggaagccctgggtgcggtgggcatgatgggtcctccaggacctcctgggccccctgggtacccaggcaagcagggcccccatgggcaccctggccctcggggcgttcctggcatcgtgggagccgtgggtcagatcggcaacacggggcccaagggtgagtgctcctctgcggtgggcatgggggccaggcagtgaggatttgtccaggccggccctttccccattcccttctcaggatgacatacagacccttccccggttcctcagccacatggtccaggagacactcctgggctctttcctagtagcaaacggatggcaatgaatgtactatgttatcactcggggtttctggggtttgtttttgaatgtgcttagtggtaccccataagcatctttccatgtcaatagagatggggcggcagaccagcagagcagtaaagcaggcaggctggagccacacacgggtgtgaatccagactcccctttctca

SEQ ID NO: 53177 - DNA, 2980 bp, Homo sapiens
tctctttggccattccagtcctccatgttggctaaatgggatctgaccatttctgcactatagcaccttccatggctccccaccgcctccaggaaaaagtcattcagtccagtccttcaataagtagttattgaggtcgggtgcagtggctcatgcctataatcccagcacttcaggaggctcagctgagtggatcacttgaggtcaggagttcaaaaccagcctggccaatgtggtgacaccccgtctctactaaaaatacaaaaattagctgggcgtggcggctcatgcctgtaatctcagctactcaggaggctgaggcaggagaattgcttgagcccaggaggcggaggttgcactgagccaagattacaccactgcactccagcctgggtaacagagcaagactccatctcaaaaaaaaaaaaaaaaaatagttattgagtatctgaggtatactaagtggcaggtaaacaattataaataggacagatgcaatctttgtcttcatggctcatcttaccattcaatgaccaccataatctgaccccaacctgcccctcctgccatatcagcaatggcccctctctgtcctttcccttctcaacaggccttggcttttctgcctccacacctttaggcctttgctggtccctctgtttgaaatgccctttctggtctctttgtgccttcttatcgttcagggccatctccattccatacctcctggagtccagtccatgggagcctgccctccctccctgtgggggtactgagtggccaaacctgtttctgtgcacacatgcagacttgtgttcctgcgtgcactcacatgggctcaggcacctgagagcacatatccatctcttccacgtagaccccaggtcctggaagacaggccattctctgtgccccactcctctgccaccactgtgggaatgtacagttaagttcatcatgccgtggctggaccttctgttgttcagctcccacaggtgggggaaatctggattggggatgggaagcaaagcagcaggtgcatggggctccctcatgccagggcagaaactgacttcaacttctttctgcagggtgtgccaggccagcctgggacaaaaggaggccctggagaccaggtgaggcgatcccaagctggggacagaattgagcaaggaagtctggggccaggaagacagcaaggcccaggcctcagccaagtctcagaggctcagccagaacataagccccttgggcctaaccacctccctcctgccacctcccacccatcatgcactcctcagcctgcctcagtgcagataggatggcatggcttaaaatccagaggagaaacaaacaggaaaatcaggagccaagaggattgaaccaagaataccctctcccccgtcccagctcatctggttccaggctctgtttaggcttcgttgggtttccctgaggccaagggcctgactgggccacccagactgacctgagaactgttttcctgcagggtgagccgggcccgcagggccttcctggattctctggtccccctgggaaagaggtaaatgccccctgcactgacacaagggttcctgctttagggtgaggccatggggtggagccctaacctagggagagctccgagttagtctggctctgccctgacccaatgattcagggaagctctttctcctccctgggcctgtttccctatgtacattgcagggagggtggggactggctctgttctggagtgtgactttcctagatggccaagttgatgggctgggaatccaacaggcagagttgttcgttcatttattcattgcataaacattcactaaacacttgcaactatgagtctcctcttcatatggagggtatagtttaatggaagaaatagacatgaaataaatgatcacgccgggcgcggtggctcacgcctgtaatcccagcattttgggaggctgaggcgggtggatcacgaggtcaggagatccagaccgcggtgaaaccccgtctctactaaaaatacaaaaaattagcctggggcggtggcaggcacctgtagtcccagctactctggaggctgaggcaggagaatggcatgaacccgggaggcggagcttgcagtgagcggagatcgcgccactgcattccagcctgggtgacagagcaagactccctctcaaaaaaaaaaaaaaaaaaaaaaaagaaagaaagaaatgatcacatgataagtaattcaaattgtgttgggtcctttgaaagaaaactacagggacccaaaaccatggaacaggtggtctgggaaaccttccctgatgaagcaaattagctgagacccagggtagggaggggctggccaggtgtggaagggtgggttccaccaggtcaaacgcttagccccaatttctccttcctccagggagagccagggcctcgaggagaaattggtccccagggcatcatgggacagaaggtaagtgcctggcacaatggcccctccccgggggcctctgcggcagctggcactgctggatacagcatctgctccgtgcagcccgtgagatgcctccccaggcagggcctaggtttgctttgctggtctgccaagtggagaaaggaccccctgccagtgacagcaggaatggagggcaccctgaccatgcggtgccaggcctcggtgcgggaggctacccctgctgagagctgctgaggttgtgaccttctctttccatttcagggtgaccaaggcgagaggggtccagtggggcaaccaggccctcagggaaggcaggtgagtgcaggccagctaaggtgggcagggcgtcatatccaggcccctcattccatttattcctttggtttcttttctcctcagggccctaagggggagcagggcccccccggaattccagggccccaaggcttgccaggcgtcaaaggagacaaggtgccagatggggctgggaaa

SEQ ID NO: 53178 - DNA, 1110 bp, Homo sapiens
ggaggtgcacacagctccactaaagagctggaagaggccgatggagtattcatgagacggctgatccaggaaggactgtggcatattaatatggaaaaggcctgtttgtttgtgcttggagaggaaggagccagaggagaggggagcaaggtgggcgggagctggggagagcctgcagcaagatctgcagagcccgaggtgctctcggcctgggccctggagaggacgtagggtaagtgatggggcacaggctgtgcgtcagggggaaggtgctggggcctgaaggtcccgaggggaacctcagacggccttatgccttctcacaaagaaactggaccatcatctccgacccgcaccccggtcgcccctcgaggacagagggtgggcgcaggaggctggaccgagcggggcggagctggatgcctggcgccggcctccctcccggcaaccccgccggtcctctcaggtgacagctcacgccggcccccgccccgccccccgcatattcaggagccccagcccaccctgcccgcgaacagccagcgctggaggagcgccgggagactctgccgtcggtgcgtgcgcggacacgcacccgtcccccttggtctcgccgccagccatggccgccgctacggcctccccccgcagcctccttgttctcctccaggtggtagtgctcgctctggcgcagattgtaagtttcgcagcccctccgctgccagggtccagggtgcggggtctggagtccgggatggaggagctctgcctgtgtcccgcgcctactgacacccctagcccgagaggccacctgaggacagcgccgcgggcaggtcccctcggtgggtgcatacatggtgcccatcgcggcaccgtgaatggaggtggctgagccggagagtcaaacgggacccgtccccagacgcgcggcccggcccgggacaggcagcgtggggcaggagctggcgcccggtcctggcagcccggggagcccaggtggcggggcatacaatggtgctcattcacccgctgcgcagcctccgcccccgccgcctcccagggggcgccggctccaaccagacgccgctgtcgccccgaggcggcctctcg

SEQ ID NO: 53179 - DNA, 1047 bp, Homo sapiens
aaaaaaagtcaatagaaacagagccacagacaattcaaatatcagaattcggaatcaaaaactttaaagtaaccatgacaaattgtccttaagagtctacaggaaaggatggttatattgggtttaaaaatgaagaatatcagccttacggccagaaacgccaccttccagtaattcgccaaaatgacaaacacaaagggaaagaggagaggcacccgatacatgttctctaggccttttagaaaacatggagttgttcctttggccatgtatatgcgaatctataagaaaggtgatattgtagacatcaagggaatgggtactgttcaaaaaggaatgtcccacaagtgttaccatggcaaaactggaagagtctacaatgttccccagcatgctgttggcattgttgtaaacaaacaagttaagggcaagattcttgccaagagaattaatgtgtgtattgagcacattaagcactctaaaagccgagatagcttcctgaaacgtgtgaaggaaaatgatcagaaaaagaaagaagccaaagagaaagttacctgggttcaacggaagcaccagcctgctccacccagagaagcacagtgtgtgagaaccaatgggaaggagcctgagctgctggaaactattccctatgaattcatggcataataggtgttaaaaaaaaatagaagacttccggactgtaaaaatgtttctcttcattgagtagaagtgtagtatcctctcccccaaagaaatatttaaaggaaattttaattgtgtcctaattcattatgcaatgtctttactgttcaaatttaatgtatttcttgctgaaagacatgaggtagcttattgtgcaacaaattactcaattggttagaaaatggccaggtattatgtatgaaatatttgtactggtttgaagacagggcctctaaatcatcaaggaagaaataaaataatttacaaaaataaaaaaatgaaagctatcaagagagacttgaaagtagtagaaaagaaccaaatgaaaatcctaaaaaggaaaaa

SEQ ID NO: 53180 - DNA, 1611 bp, Homo sapiens
ctctccccgctcaggaggtgcccctgggcgggggaccgggagtcctcaaccccggactgaggcaggggtctctgggggcgaggagggcgcgtcgccctctgcccccgccggcaccctggccatgacaggcaagtcggtgaaggacgtggatcggtaccaggctgtcctggccaacctgctgctggaggaggataacaagttttgtgcagattgccagtctaaaggtagcgcatcccacctggcgggccaggggtccagccgcgccggggtggtgggggtgggctgcgtgaagaggcggtttctgaagcttaggccgcccaactcggcttataagtggtaacgcgtgctgcgcttgcagtgagcctactgggctttctgcagctgggggattggtatgggtagagcttgcgagggcgagtctgtgtgtgtcggggagggtggaggtgatggtgcgggtggaagttgcctggcgtgttcaggtgagaatgtctgtatttgagggctctgaatgagttctgggccggctgtccagagagagctcccagcatgtcacttgcaaagctggggatgaactgcattgcgtgcgtgcgtgcgtgcgtgtgtgtgtgtgtgtgtgtgtgtgtgtgagagagagagagagagaatgacgaggaggaggaggagggaagtgagatggcggaaaggaaaactgcttaaatgatttttaaaggtggtgatttttgcttcctgctatttggttagcaactcctgtcattttgcagccttgctaagatctgacaagagtgcttaggtgactttattcttctggatgtgtgcagtgggaaactgccttatgcagtgacacagtgcggatttctaggcagtgtagccctggcttgtagagtgcgttggaggcctatgtatgagtggtggcagaaactagccgattatgcctgtagtgcaggatccgtttaatcagtggagagagaaagatgaattcgatgaattcattgcttccatggcgattacacttctaaaggtgaaatatgatcattgtaaattggcagaaccatttagtctttgttttctgtgccctagaagattcatgatttgatacaattaaaagtcagtacaataggaaatcttggttattagtgaaatgttggcacttgacatttatacaagcttctatgaatctttttttcctgtattttctaattcttttggcatataattggaggattgggaaaattattttccctttggttgggtcgaaatggatagttatattttgggggcgacaatttacttttgttcataatgcagtggatttgccatggttgtttgccgtacagcgtagtgggcatatactataaaacaaagattcagttatattcgtatttatctattttgagaaaggaaggacatatttaattgatgctttcacttaattaccttttatttttgaagaataaggttataaaaggagaacaggggagggatacatagacacctagtaatgtattttagtgacctctaccaacagataaatggaatgtgccattaggaaaacaaattcctagacttctttcctgaatttttgcattagcaataattcattttaaaaagtat

SEQ ID NO: 53181 - DNA, 1938 bp, Homo sapiens
ataaatattgcaggcatgaaacgcttcctgatcgctgaatagtaagaaaggtctgagcatggtgccgattaaattctccattgaaatgtacctttgtgggtacattaaattattttagcataagtctagtgaagtgccagcagtagatactatgttatttctggagctcttgatgttgatttttgaggctgaacatgctcttagcctcaagcaggtcatatttggaatacctgatgtgtgctcctggttgctcagtgcttaggatgcataaacaggtagctgcagtctcatctctcagtatatatacttttcagcaaatcttttttttctagataaattggaaaactaccttttttctgcatttttcatctgatgtcattatggtatgtaggtggcagctttcttgggcacagttgtctatataactgttcatcacatgagtcattgtctgtttctgttcttctgcctgaaaattccatcttggaaatcgtgtcatgcaatcggtgactgcgacattctacttgttatgtacactgccactggctttgtatgttatgttgatggactctacctgtgctacagtgaagggataaagtgacttattaaattgagtcagactcagttcctccaaatggtatttcctgtaaaaatgatgccaagcaagattctgcataaaacatgcatatgctttacactgtaagcatacagtgcctaccttttgttattgtgtctgcttaaatccttaccacagttgtactcctgtttgatcaagtggccagtttaactagatactagctttgaagaagttctgtattggcccctggaatgtgacagttcataccacattgaaaaggtaagaaccaagtctttgtagagtagaacaccttaaagttaatccacttttaccaaattcctctattgttaaagcaacagtcctatattggctaatttttaaaatcataatgtgccacactttacacatccctagaatgtaagctagggggcaggggcctatgcctgttttgttcactgtagtgttcccagcacctagaacagtgcttggcacagaccaggctctcagtaaatatttgtttgaatgcatgaattgattttatcatctgtaaatgttttgtttcatattagaagagaccttttctaggttatctgaataattgttttaattcttaggaaagctattaattttctgaaaaataagttttaaaatatgtttggaaggccctatgtcagtcaaggaccagtcagaggaacagaagccactgttggtcttataagcagagggaatttaaaatagggagtaggttacaaggctgctagaagagccaagaagctgaacaggggctggtgaggcacccattcgattagcaatgcctgggaactactatgcctgcaaggaaaatagtgcactggtgtcaccaagggctggaagtccgagtggtctggtgtgagcggaagcatggaaagaggagcagtctggtggcagctggaagtaggccgagtgagagagcgtattaccctggctgctccctgctcctgcctcttatcctcctcagtgcctcccattgatggaacttatcctgaaatcagttggcaaagggagcctgggagatgtagttccctgtgatcaagcggagcaagggagggatcccagcgcaaacaggcaaagacacaaaggcactgaattctccaagatgtaatttctttccccttatagtatttgaattattttggacaagagaacggaagggttttccggcagatataacattgcgtgcttctaaaggatcttgactgttgctgaaacaattattagtcccaggaagtaatgtaacaactcagtcatagtttatatacttagggggtatgactaggcaaattggctcctgtattgaatatgtatttgactgttggctgctgcca

SEQ ID NO: 53182 - DNA, 1118 bp, Homo sapiens
gtgagctacctaccctccttggcctcccaaagtgctgggattgcagatgtgagccaccaaggccgggcctcagctcagtgttttctttacagttaaggtaactgcagtgtggctgttttatcttgtgctgcatgttagtttaactagtcttattgatttgtttgttttaccccacaacttcagataagtttgcactgggtgagggaggcaagatcactgggtctgttttcttctaccctgacctgaaaaaaatattttgtcttgtaaggaatgttgctgctgctccatttaagggcagagctttccaagttgtggctacttgttttctacgtgattataaaagtgtctaatgagttatatgagacaagttcagccctttctagaagtgctttttttgtcaatcaggtcacctgcatttgggcccttgctatattaatggaattggtggaactaggccagcagagttttcagtgcagtgtgagtatgtttgcttttaggctgttacttcccacagaggccacagataaaggactctcgttgtttgagtgaagttaccaactgtaacaattgcataggtttccttgtttctttcttttctccaaaaaactcatttcctcttggcaggtgttactataattcacaggtgtaatgaaaatgtaatttgggatttgaaaaagcatatcagactgcttcccagagtaccagttcttttcagctggtccatttcaacttaagaggtccatctatgcatttttgaagcttcatatttaataaatataatatttcactgctgtgtttgactattccgtttcccacactttctccttccctaccccactcttctggatcctgtgtttccccacaggctttgtgaatgccggtccactgatggctgaactgcaggtctctccccagtggaaagccccagagatgagccagatctgcctcagctgtggccatccgtcagcgtaaggttgctctggtggtcgtcttcagtttgtccagctcttccccttatcccccatcctccctcatgtgtggctgaagcttgccctggaatcccacctttgtagcatgtcactcggtagtagtagaattttattattgttgcttttttt

SEQ ID NO: 53183 - DNA, 1102 bp, Homo sapiens
gtcgcccaagctggagtacagtggcacgatctcagctcactgcagcctctatcaggcttaagcagttcttctgtctcagccttcatagtagctgggactacaggtgcacaccaccacgtccagctaatttttgtatttttagtacagacagggttttgccatgttgcccaggctagtctcgaactcctgagctcacatcatctgcctgcctcggcctgccggagtgccaggattacaggcatcaaccaccatgcccggccttatttttcataattcttatcacccatttacttgagcttataccataatgattttatatcattcttttttgcttaacatttattataagcttatttcatgacattaaaaacgtgtaaatacctttattgtatcccagcattggaatatgtcattattatctcttgcccaattgttaatatttgaattttcaattttttaacaatacaaataaggaagtataaatttttgtgttgttgttagagtgatgggttatttatgtgttcagatttgagtagtcaagtgggccctctaatttaaaaagttaccaaggggattctctgggttgagcccacgtagagatggctttgctatgggcattatcattctgaactgcttcattgcagtagatgtctgctgaggcaaggaatggggaattcgggagaaccctggtttccccataagggacctaaggaacataagggacataaggaacagctttatgggtcataccacagcaagatgggccggcactttcacattgagaggtgacagcgtgctggcagccctcacagccctcgctcgctctcggtgcctcctcggccttggcacccactctggccgcacttgaggagcccttcagcccactgctgcactgtgggagccccttcctgggctggccgaggccggagctggctccctcggcttgcggggaggtgtggagggagccagctccgggaaccggggctgtgtgccgcacttgtgggccagctggagttccgggtgggcatgggcttggcgggccccgcacttggagcagccggccagccctgctggccctgggcaatgaggggcttagcacctg

SEQ ID NO: 53184 - DNA, 1048 bp, Homo sapiens
caagagcactgcatagctttcccaggaccaactggaaagaattcttttttacgacgatgtaattgacaatgaaaattgtatatgtttacagtatacaatgtggtgttttgatatatgtgtacattgatttttgtggcagtcaggaggtcctctagttggaacagagactcaccacacccaagagtccctctgtctgtatcccatccccaaatcagaaaaaggcctgtgcgtctctgtgggtagtattcactctctcagattcctctgtgagtcaggaacatgacaagtggcatctatatacacagttttaagaggaagtgatgtcactcttggtgtatagaagtgagaagaggagtaatgagaattaaagacccagatcacaggagaatttaagccatacttagaagtttggagttcagttgatggtggggggtccagtgacatagctttgaatggggtgatgacattatcaggacatatgttggcagaatgtccttttcaaagccaacaaagtccaaactaggatctcattctttccctcctgaagtcacctggggaattgaattgataataatgatacaggatgactgattgatagttctttattcccagaaacatcacctaagtatacactagttaccttccactgctgggagagacaacaaggaagagtcacagtaagtccctacctgttaataataaaccaatggccaggcccagtggctcatgcctgtaatcccagtactttgggaggccaaggtgggaagatcacttgagcccaagagttcaaaaccagcctgggcaacatagcaagacctcacctctacaaaataataataataataataataaaacagggcagtaagattaatgtggagccaaatttacctttccagagtagtttaatgaatttttgagatacagttactatcttttagaagagatatgtttgagataatctggttaaggtatattgacttgtctaaagtcacacaggaaattagtgctgtaatttagataattcgtatctttagctgtgtagataaga

SEQ ID NO: 53185 - DNA, 1113 bp, Homo sapiens
aacagctggaatgcatacatgaatcttgcatgctgttagcttggtgggcttggagtgagactcctaagttaatgagtctggctggcctaagagctgtaccttgatatagcttcattattttttattctcttcctacattgaaacgctttaatttcaattttttctttcttgggagtaaaagggaagccccccgccccccaaatccagttgctaaagttggtaatggaaatcagaggttacgcttaaccagaaaatggctttagaaattgctttagattgtatttatagatgtattaaaggtctaaaaaggtgagttacatttttcagttacacttcactctgttttatgaaggaaattatatgccatggagatagtcgggaatttggagatttaaaaagctcttgggatttatccctcacaagtgttaaggagtctacttaaaagcctaatgggaaacacatttattggaattgattaatagtataaactcagaatgataacactgatcattgcctgccaagtagacattttaattggtagctgtgtatctaagagtttcaaatgagatcttgatttattactgaattgaatgtatcttggtacacaaatatttcagtaaaaggaacctatggagtgggggaaagacagcttggggcaaatgattgggaaatcctagtaaggtagagggaatcatgaattggaaatcagaatacacaagtttaaatgttggttctgacactctctaggttggttcttcaattgtacagtagtggaattgggtgagaagtttttcagttctttcttgatctgacgttccatgtttctacattctctttggtcacagtgcatgcaagagatgggaaatggaaaggcaaaccgactttatgaagcctatcttcctgagacctttcggcgacctcagatagacccgtatcttttctggagcaacttagaaggctgagtggtattttgatgcttggggagagtcagacaagactccagtcctgtaatgtgactgggtcatctctatgtggattagtcagtgtccttgcttgtcctctgtcctgcaatcaaggtgcacaaaaagcacatgtatttgtgaatgtcggaat

SEQ ID NO: 53186 - DNA, 2105 bp, Homo sapiens
ccttgtgcaaacgagcaagcctgctcaagcgctttccctgacactgacagtaatagctgtgctgaagatgaggcgggagcactggggagggggctttcctttcagcttttaggattggccaggcaagttaacaataggccccttctatttaggatgagggactggaaaggaaaaagagaggaactcatgctgattttctgtcgactagatccagatgccaggatgccttctttccctccctgagctttagtctccgtcagcattgcactcccaaaaggtcattcacgtacgtggccttgaaatgatctgactgctaaggtccagggtttactgtccataacagagtttccctttgtctcattctccccatcctggcagagaaagggactctcaccctgccttttgcactaattggcggaatgcccacagcctggtctgaaagtctcctctctccctttcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgagtgtgtgtgtgtgtatgagtgtgtgttccgcctcccaccctctccccatctgctctgggtatttttgtttttgtttagttttaggtttacaacagagaggaattaatttatcagcagcctaaaactgttgtgtttttcttatggtttaaaaaacgccatgtcattgataactccctttctcccttcccttctcccggtctgctgatcactctttcatgcctgtgtatccagggtgctctgtttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaaggactgtttgcttggccattactgtgcgtcactcttggaggagggtgcgttacacttaggttttctgttttccaaaggcaattgtttcacttcctgtattttagaaaattctgtacttctcatacccaagggtgaggcccaggctccagcagtcagaaagggggcctctctccactggcatctagagctgtgagctgagagaactccagagatcagcaccttctagagtcacagagcatcagagcggcatgctttccccccacaggtggagaaactgagacacggagaaaggacatg

SEQ ID NO: 53187 - DNA, 1357 bp, Homo sapiens
cactgtgcaaactctgcaagaaattgctgcctttgcttgatgttgtagatgagttgccctccacctggctggagagatggcacatcattcagggccagaaggttgtccagcagtgtttctgcagtggctgcagggagatggaaaagaagagccctgcttccctgcctcctcctacctttctcttccactcctcagagttttcttctccagtatcctgacatgtaaagagattctttaaaatgctgcttcttctactggactgtctttcactgagtagtcagggaggagatgaaaatgtggacacatccccccgccttctccctcaaccttttcactcacgtcagaagaggttggggcaaaacaaaacaagcatgattgaagagcaggggaagcccacacaatcaggtgagccctgatgggggctggactggcctggtctggctgggaaaggattcttttaaaagcgtgcctgagcatctcagagcaatgtcagtgatgccaaagagagcaacttggcctccttgggcaccaactctgatggctgagttgcacaaacgtggctcagatgttggcatgcccgatggtgggaccttgttctctgataaagggcttaatctttccatgtagcaaagcaactttccctccctcccctccccccgaaccctgagcttgggcttgtgtgggcccagcatggctgtgcctgtgagggaagccacatcagtgagagaaagttgcattctctcaggggcctagattggcttggggcaggtgcttgttgaaaagcatgagtgtttctgctttgggaaacccttccagggctctggttggaaacttggccagtaaggacagggccttgggcctcccaaggagttcacaatgatgccaggaagggtccctgagcctgggttccagtcagcttggctaacagaatggggcttgggaattccaggggcaactgagcatccaccccattagccagtgatctggacagggacagctggctacagggaatcaaaggctgttctgtacagttttaccagaaactgtgaccttgggtaaggctcctcacttttctgggcctcaacttcctcatctgcaaaatcagagcattagctgctctccccatgattccctcccagttttaattaaaagtctctgatctggagcacatgagggttgcgagcctggtgcacctggttcctgtctccgtgggctggtttccttcagcccctgatgcccaggctgggtgcaggctctcatctggtccatgcccagatgctgcctcagacaagaactctgggaatcctaacagactctgctttcctctcttcgtggtttgtcctccctcttttattct

SEQ ID NO: 53188 - DNA, 2352 bp, Homo sapiens
ggcttgttataacaattgaaagaaagaatctaggtaaaatccataggatcgtatctaacacacctcaagtgctcagtaaattattgtgtgaaatcagtcttgagttctggctccctctgctccatctgtgccctgctgaaacgtgtaggttcctaggcctgctgcacagtcctggagtcagggaggtggctcactccctccctctcttcctcctggcaggtgatcgtctggggagactatggccgcatggaccacaagtgcttcatgggcatggcccagatcatgctggacgagctggacctcagcgccgcggtcaccggctggtacaaactcttccccacctcctcagtggcagactccacactcggatccctcaccaggcgcctgtcccagtcttccctggagagtgccaccagcccctcatgctcttaaggatgtcaggaagaggccaggatggtggtgtggggaggggtgcctgctggccccatgtcctcccctgtacatagtcttcgtgtctttctggaccccttgtcctgctgcatgcctgttggctactgggctcatcccagctggcagtggagactgtagtgtgtgcgtgtgtgcgtgcgtgtgtgtgtgtgtgtacgtgaccacgttctatctgttcatttgtctgggtatagtcactcctggtgatgatatgggctgaaatgtctccacgtctctttgtgtcttgttgaaaagaaacccaaaggagtgttgtgtggacatgactcaccctgaggagtctccagggatggaggtggggcatgcggccactggtcggtgctgcctggtcctggcctggggcagagcctgtgtgttcttcacctgtgcctgctcctggtggtctctgctttgttttctgtcttgtcttttgttccactcttgactctcccggctctgccactgttttctgagaaatgtagcatccgctgcagctggccacactgagggccctctgggaaccccaccccactggagccgctccggcagctcttcctgccactgaatgcgttctgcagcatgtagcatgcccacctagctccctggccagggccctggggaggcagagggtacccaggggactgagggcttagaaatgactttctctatgaggctggaacctcctccttcttccagtgaagcacgaggtcttggttccagggttcctggccaggtgcccccttagcatttgttcttcatctcctgtctcttcaagcctccccactccaccgtgccgaaggagctctgccagtgggcctgggcaggcagccacagagggcatgttatctgctaaagcaaacagtcctcctgaggccctgagggtggccctgaccccctcagggctcattcctggtgggcatgactcggtaaggaggttctgtgggtagggctgtttgctggaataaggagggctgaggctgagttgttccccgccactgttgaggatcccatctgacatttggggattcactgcatgaagttgttcatttggggctccagtttttgtgcatttccagaccagggtccctgtctgggagctcagacttagctgggctccagcagcctggctccggactctcgtctgccaccatcaccagctctgtctaagcaatacttacccctccgggcttccctgctttcctgtgccccactgctgccctctgcagagccatctgctccaggcacccacctgcctctgcttgctttctcacccatgtctggttggagcttctcacagccactcaaaccctgacttgatttgacaactgggccctgttggtggagaccagtgcctgaactggaccctgtgaaatctgtcccgtgggaatcctgaagtctgactcaggaatgcccagacctgtccctgtccctcctcagctctagggtgaaaggcgagaggttgcacaggacatggacagagcagcccttgggtttgtatctggtaggggagaaagcagcaggacagtggaggtgtgtggaaggcactctttccacctctctccaggcattatccccaggtgctgaaatggctgtggccccagcacctgaggcaggggtacgctacctggggtagcagtagaaaggtcttggggtctgaatgacttggggcctccattcataaccaaagttgtaggggcatggaggcagtggcgccttatggataggtcatctcagcccaaagggcctccttggctggcatggttctgtgttacgttgaagccagagtcttataacacctcccaagaaagataggggaagaagccagaaccccacctggcctgcccacaggacaagaagtgggtaagggcaggaaggaaatgaacggag

SEQ ID NO: 53189 - DNA, 1033 bp, Homo sapiens
ctttggcaggactcttagagaagccccattcataatctgaccttgttccctctctgtgcttggggttgggggggtcacagaaggggccaccaagaagctgcgcagcaacatccgccggagcacggagacaggcatcgcggtggagatgcggagccgggtcacacgccagggcagccgggagtccaccgatgggagcaccaacagcaacagctccgacggcacgtgcgtgcagccccgtgctgtggtcccctccctcctcctcggtcctccagtcacagagccactgggcagggtgggaaagcctccctgttttgtttccagctaaaatgtctgggtcctctgtgtctctgccttccttcatacccctcccctcaacactctgtgcctggacctcaggtcttccattgctcccattggaatatccagatacccaggagctatcagttccttctgtatgtttcaggaagggacccttacctcccacctcccacctcccaccacgcacacactgccctgctccagaggaaagggtggaaaggaaaatgtggccctaaaatccttttaaatctaaaaccattgttgtggcccagatgagtggaattttctcaaggaggcttgcttagagctgagggaaggagattggactagatcagtgtttttcaaaccatggatggtgactcatagacaggaaataaaataggtttagtgggtcaaaaccagcattagaaaaagaaatagacatatcttatgaagtaagaataaattgcctcgtgaacttttgtttccattttttatgtatagatgcacacaggtctgtcctgggtcatgatgttaaatctcctttcttacatgtaggttgcattaaaaaatctgaaagtcactggtttagatattcccacagatctcttctaagtctatgaaattatagttgtatgactaagattttctgcttctgcttcaaggcctagtgacttccaggcttaggattctgtggctccctcgtttgagattcagtgattgtgtgtctcactgc

SEQ ID NO: 53190 - DNA, 1041 bp, Homo sapiens
atactatgtgccaggcatgaagctgggtgcctttgcataccctatctcacttaattccctggataactctgcaaggcatgtatcattgccctcattctacaaacaaggcagcaggctcagagaggtgaagtaacttgccttagtcacccggctagtaaatgacaggggatggatctgaacttgaggtcgttctccaggaacatgctttctccccaggctctggatgcctcatcaataaaataagtacagcgtactagatgatctcaagggactctcctcactcacattcagcaattagctgattcacagagaccttcagttagaagggcatctgggcagttcccctagctccagtcctttagccatgcccttgcataccaaggagacaagggattcagaagccccatcatcattcatctcttctcaagatgaaaggtcttcctggtatctgctccaatccctgcctgcagcctgtaaagtcaaggcagaccactagaaggttctcccagtgactcaggtccccatcctggccttggaagactgtccccccaaatcactttgggcatgaagaagcctttgggtctgaagctgaatcagctggatttctgggcttggtcccctggagccagactcccggggtccaacacctccacgaccttctaatcttaatctcactccttagtcctatctcagccccttccttgtcccagcccaatttctagatccctaagtccccatctccctgactctctagtaccaggcctaaactgcatattcacagaggccatgcccactctagggctctgataacctcaagccccttccccacctataatagctttccccagcgagaaaccacatcacagcttgattgctggaaaagaccagcccacgtgctactgtcgacggctttgtataaatctattttaaggcctggaaaagtcccccacccccagccccaactgggagccttgatgagcattctccctggatcctccggagcccccgccccctcaccatcccatccagctgcctatttga

SEQ ID NO: 53191 - DNA, 1031 bp, Homo sapiens
agaatgtgtaccctggctggccctttcccacccataatctataccctgcaaggccccagagctcaagctctgtaaatctgactccagaaagcactttagtgacacgaggaggaatcaattaatcaataaaaaagcagttatcaagcagatagaagaacttttccctcttcacaaaacacacattggtggaaatgcctgttactttaatgtatgttttgaaaagaaaaatatgtggttttggtttttttctttattataacattaatacagtttcttaagtagtaactttagaaaacacagtatgtcacatggagaaaataaaaatgactcacagtgctataaatactgctaatttaatgttttaagttgccattcattcattctacaaatatttactgagtcctgctatatgccagacctgtgccaggtactaggggttcagggtgaagacgacgacaaggttcctatttttaaccagctcacagccagggggcggggtgtgggagacaagtacggaacaagttaggaacagcagtgtgttcattgcctagggaagctgcaataaagcgccacaaacagggtggcttaaaacaacagaaatgtagactctcacagttctgaaggctacaagtctaaaatcaggtgttggcaggattgcttccttctgtgtgctgtgagggaaaatctgttccgtgcccctcccctggcttctggtgacaggtggcaatccttggcgttccttggcgcattgacgcgtcactcccatttctgcctccgtcggcacatggcgctctccccgtgtctgtcttcacgtggccaccttcctataaggacactggttatattggatgagggacccacccttctccagcatgatctcatcttaacttgtcacatctgcaacgaccgtgtttccaaaccaagtcacattctgagggactggaggttagaacctcaacagtttttggggggacacaactcaacttataacacacagggacagtacaaagggagttatggggattaacctt

SEQ ID NO: 53192 - DNA, 1051 bp, Homo sapiens
tatctcagcctcccaagtagctgggattacaggtgcgtgccaccatgcccggctaatttttgtatttttagtttgaccatccagacggggtttgaccatatcggccaggctggccttgaactcctgacctcaagtgatctgcctgcctgagactcccaaagtattgggattacaggcgtgagccaccgtgcccagcctaggagtctgtagatttggcagaaatcattgaggtgacacacagtgttatgcacttaatgcaaaattgggaagtggtatggggatgtcggaaatgtgcactgttgacctagataattttgaaggtcccttccacctgcccaacaaatctaggggtctccccctgctgcgctggcctgctctcttctgctcaccttgaaccctggcttgggcttcttttggaggatcctgccatgatttccctgcagacaggagaatttgtgccattgttttcacaacctgcttgggaggggggctcatggagataaggtgtctggatgtggtaggatgccccctcatctctgaggccaggacttgagacctcctggggggagtaggggctgcataccctacagttcttctgcttcctatgtataacacaggcctcagggaggcctagggagcagtgaagctttgggagccacaggtaagggcaaggctgcccctggggcttcatgtcccagagcttggggctcagggacagtgaagcagaaggcttcggagtctcataggtccctcttcccctactccccgctttgtccaccgctttgtgctgactgcttgtccctgggacctcgcagcagaccccagggggcctcggaggacacagtggatttatcctcagggcccatgagcagggccaaagtagagaaggcagatggcaaggagggagggaagtcctgtctgccccctccctagtcccatgttcacagtgggaagggtggcctgggcaccaggaggatggagggcctgggtagagtgtggggtgtgtgcttgtgtgtccatggtgaatgtttgaggatctctgtgaaggcat

SEQ ID NO: 53193 - DNA, 1022 bp, Homo sapiens
tcctaggctcaaatgatcctcccaagaagttgggactacaggtgcacaccaccatgcctggctaattttttttttttttttttttttttgagacattgtcacattctgtcacccaggctggagtgcaatggctgggtcacggctcactgcagctttgaactcctgggctcaggtaatcctcccacctcagcctccctggtagctaggaccacaggctcatgccaccatgcccagctcagttttgtatttttttgtagagacagggtttcaccctgttgcccagattggtctccaactcctgggctcaagcaatcctcccatcttggcctctgaaagtgctgggattacaggtgtgattcacgacacccagtctgtcatctcattttacagacaaggaaactgcagtttaggcatttacaggctagattttaaagctcttcacctctcttaatctcggtgatttgctgatttgtctgcttgctgtttgggattgtgaaggtctcacgggcagatagcaggttaccatcctgcctctttccccactgcccagcaagggctgccaactgtggaacagatggatgcaggtagagtagaaaaggtgtctgggtggacgtcaagtctctgacgtgtggatctcccctgtgtagctagctctgtgactatggacacgtctcatcctttctgagcctcacatttctcattcagaaacggggaagataattcctgctctgaggctcatattagatggtggccgttatgacaatttgtgaataggaaaggaccaaggaatttctaaaagattgttattaccagaataggctgtagcaacagggcactagcggggcactgtgcccgaactcctgcaagaggtggacaagcctagagcttcccaatatgtggagtgggaccagggatgactttcagtgccatttcttaacattagctcacgtagtgagaaagttggttccctctcaacgatatcaagtccaagattgtccaagggagaacatgtcagtgtagtt

SEQ ID NO: 53194 - DNA, 1010 bp, Homo sapiens
accctccctctgccacatctgtgcaaagtctacatctcttactcgctgtctcccactgcactgggcttctccgacgtaggcacagtgattattttttcaggattgttcatctgcgtacctccggctcccagcttctctcttgtcttaattaggtctttgcttatatacagaaacccactcaaaccagcttcagtaataaagaagggcttattacaaggacagaagggattccctggaactaaggggaaggaaaaccattagcttcaggaaggcgggacctggagggccaagggaacttgaagcagccattctctgcaccctgcctttctgtatccacagactggatatctctgccttttcaggcaccaagccacctatagttcctgtattgtgtcccttggtttcagccacatggagagagagaacttggggcttggcagatccaatcccaaactcccaggagaggatctgattggctcagagtgaggcaggtgcccaccctggtccagtcatctgtagcctactgggaaggatcaaagagacatgcaaacagggttctcagtgccccgctcagagaagggggatcttcgttagcttccaaacacatctcctggaattcttagagtgccgatgtgggtgcaggcagttgggcctgagccccaaacttccatctggacagcagctggagaaaaaaggcctggaattgtgacttaaaggagagtcttttcctgggcagcagtgctcaggacaggctctgaagaacctgtcaaatgtcattcagaggcctgaggagagagagggagaagaaagcctgaattttctcaccttgctttggagtgaggagagagggaagaggaagccaggaacaggcagaagagtttttccccacgaaaatcttcatcctccaagatgtaactcttttcatcagtgaaaaaccaaaccatgtctacctcaccttccccctgtcactcattcttgacctgtattgattctgttctttgtgcttccct

SEQ ID NO: 53195 - DNA, 1033 bp, Homo sapiens
ccgggaggagtgaagaaaaaaggagaaagaatgcctggccctcttgcctctgtggcagaaggatgcattcagtccaccaggtacctctgatgtatcagactctatgagccaggcggcccctgccctcacggaggtgacattctagtggggacatgacccagagcaggtaattacacatggcatgtgtgtagaaaggagggacttgggctctggaacctatcactgaagttgctctcctgcagtctgtaatctgggaaaggttcctggaggtggcgacatcttagctgagtcatgaagggtgccaaggaattgtagaggcgaagaagggatgaggaaggggaactgtgtgtctgaggccctgttgatggtgagaacaggcttggcgtggtagagggagggcagtgtgggcaggcccaggacagcctggcccgatttcctagtctagcaggatactaaagacttgggaatttatcctcaggccaatggcaacccctaaagggttttaagcagaaaaggcaagatcagatttccccagaatgttagggtctatggccctcaggcagagccttcttgggagtgactttttgccctctcctacccttttccctgtgcagcagcctcggtcccagggaaccggttgtttatgtggctggccccaggagggaggacagccagtcccagtccctccagctccttctctctggtctaagctgtatcgtggccttgttgacaaagctcagcccttggggccaggttctcccaacctccctggggagccagagggcaagaggcagggttttgcaccaggctgctctgtgcccacatcccagctctgcagttcctgagctgggtaatctctgggaaggcatacccgtctctgaacttctgtgtcctcaactataaaatggagttgatgatatctctaggaaaacgataaagtgaaattccacatggaaaccataaaccctatctggatgtcagttggcatttttactctgttgtgtgggggctgacatcaactctgggccgggcc

SEQ ID NO: 53196 - DNA, 1032 bp, Homo sapiens
cgtgacaccgttgtggtgtccagaggaccccctccaccccataaaagaaaaggagtgctgcttactccagccctggggtgggaagagggggctttgggaagctgggaatgcagttggtcagcagcatggtgcagagcccagggttcagggaggcttggcaggacccttgatgggcaacttgggcatgctctcattcatagggaggagctcttccctgactggccgcctgggtacctggactccatgtccccatcacctctggacaactcagccctgaggagtgggtttcttcagtgtcctggtcctgaaggctcaggaaggatcctggaatggggtgggcaatggcatatcaaggctggagaacagggggcattggctggcactgccacttggggcctgtttcaatgtggtccttcagggcttggacacctgggtgaatatgtgtccaaccctagccccaggggtgttatcaggatgtagggaagaaggctgctgctcctttggtcctgtcctctatccatgatgacttcttaagtctgggttccttgggtttggggcctgaagtcatgggaggaggattgggcctggtcaacaaggggttaatgagccatctcccccaccccaccatagttgctgccagccaccaattagtctgtaatcaggcagctgccaactgtccctgggggcatgtgggtagcctaatggggcattcttggttgggaggcggggtgggtgggttggcagggatgtgctggggaggtgacccatgtgccctgtgcttaaaccaagcaccatgccctttgttgtttgtttagggcccacagaccccttccctgccttctgttcctgactgccttgcttagggacttccagccctggggttctacacttatccgaccctttgcagggtatgaagcccagagttggttaaacttggcttcaaacccaagctctgccactttctggctgtgtgatattgaggaaatcacttcccctctctgagactctttcagtaaaacaaacccagctgct

SEQ ID NO: 53197 - DNA, 1847 bp, Homo sapiens
caaattaaaaacacaaatacacacacacgcccctacttagttcctaaaactcaagggcacgcgcacacacctacttatttcctaaaattcaagctcgcaccaaggagatccacaaggataggcagggtggtggaggtcactgggcagcgcctccggatcccccgaaagggggcggggtcaaaactcagatctcgagctcccgaaagggggcggggttaaaactctcagatctcattccgcctccctctgtcgtcgccccttcccaattctcgcgagacctcaaggagcacagcttctgcgcaccgcacgatactgggagtccaggcgccaagggagggggaagggaaaaggggaaacggtgcaaacggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagaggtgtgtgagtgtgcgggagtttctgtgcgagggtgatagggaagcggcggcggggggaggggcagcgcttcccgccttcgccagagacctcacttcctcgcgcggccgctgctgtagctcggtccgtcctgcccgccgccatgttgtgctcttgcctggcccgctgctgtcgccgccgccgcgctcgtggggtccgtgtgcctcgtcggcccggcccgcgggctttctcccattggcggaaggcgacggcgggggggctcgctcgtgattggtcggtggcggggaggccgcggacctggcaccttattggacgcgccagctccggtctagggggtgatgaaggaatctgaggctgcggggatgcgcgcgtcttgggctagggcggctggggcaatgaccccctgcggcgcaggcgtggggttgcggcgagagggcgagcctagaggctttaagggggaagagagggtgatggcctggcaggtactttgggggtagcttaggccatggcctgggaatgggggacactcactttcagaggtgcttttcctggtacatgcatggcccaagattggggtgtgcaggccctcagggttccaggcttggaaacaccgaaacccaagtgacaggctgagagtcttcgagatccagggttgctaatgtgacccagtttggaagtggccctgaagtccacggtgtgagtgtatggtgtaggaagaaaggcatcagggctaggggcatagctgaacggtagaatcggatcagggattttgctggagagtgcaagcattcaaacactgaggttttggtggagccctggagtccagagtcaacggacctgggatgtgatgtgaggagcaagtaaaccgagagaggaatgctattgagaagtgtgctctgtccgagcctaggaagcacagcattaagtagtatcagatttaaagtgacaaaatctgatataggaagcattttaggggacattttcggacttgggaagtgtattaatagaacagttatacattattgagtctcaggaccatacaagtagttttgagatgttgtatatgaaatttgctgctctaggaaggatacaggtcatggctgagtttccaaagccacattagcaaatattaggtagttggtagttatttgttgagtaaatattgttaggttcccctttaagggaaagggagctagccagaaattttcggtcttggtttatttccttgtatatgtgcctaaaaagtatacccattcccatgtgtactttgaattttttgtttgttttttcaaataagcagctccaaaccaaaaaaaagcccatgc

SEQ ID NO: 53198 - DNA, 1004 bp, Homo sapiens
ttccactggatagcattgcctctcctgtggacgcattgacttgatggcagagatgactttaagtgacaggtttacttcattcaccggaatgagaatggcagaggacattactagggtcacaaatgaccttcttaaggtcaatcctggcctcaggcatacaaccaggaagaatattcctttgccagtaagttgttcttttccattctgtttcttgttctcagaggaaactggttgtgagttatctgatgtcttacagtctttcttttcattttgtttattcagtttttcatgcatgcactgtcacagtttaggaaggctacaaggtcattttagtgttttcctgcagagactcaaagcactcaatataatgtaagtagattaattgcaggaggaaatggatttttaaaactttggccaaaaagtgcctatgggagaggacagtattagttgctgattggagtcagaccaagggaagagttctgtctctgcagtgcatttaccctctgtgctggagcaggttcttaacttgtttcttcttctgtaaaataacgacaataatacctacctgtagggtaattatgagaaatgaatataatagcgtgtggtagatgcctatcacttagtggaccttaataagtgggagaacacattttcattttggaacagcatgaaatctgtcctttcagcccgttacagcttccttgatgaggaggggtgaggccttttgtaattgtctgctctgcaatatacagtaagatttccaaatgggagagcaaccacttgacatgaagtaacctaatttagttgtgctgttgtggtttaggagctgattttcagtggaccagtgtgaggtcagtcttacttttgaatgcacaaagtagtaggatcatttgtttcagggaaagattgtttcctgatctcttttgttcatccccaagtgttgagtggtaatgattgcgatgcgatgaaaacttcttcatatttgacaaatagcaatgatgatt

SEQ ID NO: 53199 - DNA, 1905 bp, Homo sapiens
gaatacccttcatttaaagccaatagtatatcctttgcctcccgggttcaagtgttaaagtcaattgtatattcttaataagattcaataattgtcctattcttaaatacattcatgagtatgaaccataaatagtgatcttgagcagtgtttcaaagtgttttaataagaggaatgagatgggccgggcgccgtggctcacacctgtaatcccagcactttgggaggctgaggcgggcagatcatgaggtcaggagtttaagaccagcctggccaacatggtgaaatcccatctctactaaagatacaaaaaattagctgggcgtggtggtgggcctctgtaaccccagctactcgggaggctgaggcaggagaatcgcttgaatccgggaggcagaggttgcagtgagccgagatcgcgcctctattgcactccagccttgacgacagggtgagactgtctccaaaaaaaaacaaaacaaaaccaaaaaaggaatgagatgactcataggaaatgatgttagagtatagaatattttgtatcatgtcattggcttaaatctgaagtactgaaggttttcacaatcccaaattactgttgcccttggcctccagagctgtaaactgtccagtaatctctatgaagttgagattctttgcccagtgttaagaagatatatccctttgacactggcatgatctgttccttttaaaagagaagagagaaggggctaataaagtacacattatctgcacagttgacatccttgtcattttaaactgttttaaaaattattactgtaccctgaaagtaagtagcatagaatttgctcattatgaaatgacgaagttggggccttttaagaagccaagaatgcttggttggcaatcacttaggaggcaaaggattgctatttatggtggtatttaatgtcattttcagtagtactaagttagaaaggaaaacgccataatgtgtgtaaaactctaaccattttggaaggttatcagaatacagttgcctatagtcttttcactccactaaaatttgtaagttggtttagagtagcatttcccaagctcttccactgaacattagttctgtgtagtgctaatcagtgtcctttggggataaaaagaggatccttgacaaaaaatggccaaagtgaaatgcctttctttactgcagaattattattcagagccttggtgcttatttgcctatgacccttcaagagggaagatacattacgcggtgttactcagacttacttggtcatggaccgctgtttgtgagaacacctaataaacgtttcatgctatgactggtgtgtagtggagcccagttgagcagttctggtgtagtctatgaataaaaaaatgaatcattttgtataagatagcttggtaatcgtgggaaaggacttttctgagaacaagatacatcttcaaggtaacgtagactcttaaggatgaatgtgatttcaaaggtcatctaatccaatgcccaataacaataataatagtagcaggtaccattttttgagtacatgctttttatcaagcacagtgttgttattctacatgccttattaaccactgggtcttagtgatttttgaatcttctttattttttattttactttaattaatttttttgagatggggtctcactttcttgcccacgctggagtgaggtggtgtgatcatagctcaatgcaacctcaaacttctgggttcaagtcatcctcttgcctcagcttcctgagtagctgggactacagggatgtagtaccatgcctgcccagctaatttttttattgttagtagtgaggaggtcttgctatgttgtccaggctagtcccaaattcttcagttcaagtgatcctcccaccttggcctccc

SEQ ID NO: 53200 - DNA, 2116 bp, Homo sapiens
caaggtaactttaaaacaggaagtgtacaaaagaggtaactgatgacgtgaacagccaatcgtggctttgtgttcttagccgataaagcagttcagccaatgggaccactgtggaggcaaggtttggtgtcaaatagcatgctagattgaatgcctttgactgttaaagtggaaggaggctgcagggcttcattggagcctcggagtttttcactgaggcaggggtcagctgaaagacaaagaaaaatggcgaatagtttgttggggggtgggaggacagctgttcgggttttcagtggagtggacattccagactcatgtttctgcatctcctgctgccttttgtttcctccgtcctttggggggtagggataggagtgacttaaattctcccagtcggtggaggtataaataactacatgtaaaattaatgcagttcccggtaagtttaattctttgttttgtgttgaaatgatagaaactgtttagcttcagagagtgtagacaagttgcactgttcagaaaatggccactttacattccatgcataccttttggtgcacctagaataccttgctgtgtttagattttgcatgtccttcaactaggatttctttcctagttgggtatcgacaagatcaggtacatggagaaaggctaatcatttttcaggggcacacagaagcaaaacacttttctctttgcattgggtaaacttaactgttttccaaataattttcctttgttcaagtgccctgaagctttcctacggaataagctgggttgttgtgagagtttttctatttccatgcactttgttgacatctgtgttttcagatatggaagcaacactgttgctgttagaaatttgtgtgaaaatacgatttgcactgctgcaggttctaatggtgaaggcccacatgccagtgtgaaattttcccataactttcttgatttaccagtctacctctagattctaataagtagtagttaatgtagtaacaatctttgtttttaatgcacattttagcttagaatgctggttagaaatatcttcacttatattgacagtgatgagcaaatatttttccacagatttcacacattttgtcaggtgttgatttagttctttaaaatgatgtgagcaaagtgctttccatttttccgtattaaatatttaaaatcctgcagtttgtgaataggaaagttaagagtataggcaccctatcttttgcccttgatatgtatatatttttctctttatggatataaagctaatgtaggttgctaatcagtaaccagccagttctcatgaacagtgaaatcttcaatcccacatactaagatctataatacacctgattttaaaatgcaattctttgttttctttttatttgcaaatatggaatgaaggtcattggaacatttctgcagcagactcagtgtggagccgtcagccagcagcacttagtctctgggtacggaaaaggagcaggccctattagaggagaagtttcgagggtgtcgatttgccttccctagcttcccctctaataaaggatttaccttagaggactgataggatttagattcggggctcttggagttgtaatgatatagcaagtcaaagttcctggatgcaggcctctgtcgttgcttgcaaaagtgaccttgaaaaactgctggggagttgaaagattgaaggacaaagtttgtttatacagatttggactgaaaagctctatttaagatgaaaagagactgtacttctgatattcaagtcgagtggttagtaggaatatgttatagattcagattaggaattttcagggaataagacaatagggctgcattcattctctctcccactctttttacttccctccccccagcaaaaaattctaaattcttttggtatgatagctgagtgaactgcctaacagattcagaattccttgcatgctaccttgtcttctttgtaatctagagggttcttagtgaaggggatagatagtattttaggagttcagagtagttgtatttgtgaaagttttggggaattagaatgcttataataagaaaatgttcattctgggaatttaagtcctaagatgaa

SEQ ID NO: 53201 - DNA, 1357 bp, Homo sapiens
tcaggtgccctaatccaagtctttcagctttttaggaacaggcttgtacaagtttggagatttgactcccactcaatttgttgcatgtttcttttattcctctaggttgttttcactttttatttttcatgtttcttttctttttgggacttctgtataggcttgctgtttgggtatagaaggaacagagaaaatgtgccatggaagaggttcagaagtctttacctgaagtgtgttggttagaaagtctgctgcagcagatttagtgtccctttgggatctgaagataccttgcctcagccagttagttgcttattcagaaagctgagaaccagctaggaagctaatggtgttcacctgtgaggtattccagaaagccaggttacttttatgcattatgaggaatttagggtatacaaacacatcacctgcaagccagttagtgttttttgttgttgtttttttgttattatatttcaagaacaagctaattcccaaaaaagtttggacctggctcttaaagtgagtccacaagctaacctgtatttaataaacaaagattccagggtcattttaagcatttgacaagactaaaataggaatcattgtttatagacacccaaaataatatcttaactgtgctgactttactgtttcccatcagcaaagtggtattatgtgtgtatgtgcttgtgtatgtttgagtagtatttgttctttatattctttgatagaccatgatatactttaacatttttaatttttctgaaggtgatgaccttcatatatttagacaaaagttatagtccattgaaagaatgagggcttgaacgatgtaagttatgtaatatttaagtcctaaagtgtactgactgaagattataatagacatagctggatagaatatatttcatgtctacatttcccagaagtttagttttctttccttttttttggagacaaggtcttgctctgtcacccaggctagagtgtagtggtgtaatcatagatcactgcaaccttaaactcctgggctcaagcagtcctcccacctcagcctccgagtaattgggactacagatgcacgctactaggcctggctaattaaaaaaaaattttgagggcagggcgtggtggctcacgcctgtaatcccagcactttgggaggccgaggcaggcagatcacgaggtcaggagatcaagaccatcctggctaacatggttaaacctcatctctactaaaaatacaaaaaattagccgggtgtggtggcgggcgcctgtagtcccagctactcggcaggctgaggcaggagaatggcatgaatccgggaggcggagcttgcagtgagccgacat

SEQ ID NO: 53202 - DNA, 2318 bp, Homo sapiens
agataaaatgaaattttcttctgtctacctaagctatatagttcttactttcaaggaaatgctaaagttggatgctttttacacttcctttcatcaattcaccacgcatgcatgtcttttttgtggagactttaaaaatgtatacaaataaaattttactctgagactgatgatgtttatcaagtattagaaactgatatggaaagaacaagcaaaatacacagaattcagaggaggggagacgttcgcttaggaatgaaggcaagctgtttaactgggtgtagactcagggaggtagggacaagggcattccagacattgggagcaacaagcaagatcatgattcaaaaagtacatcttgggttaaggagagcagtaaatggtcaactgcttagagcataaggagatgagttaaggacaggaaggagtggtaaaagaaagaagtatggagaagtagattgggtcagatgttgaagggccttgtttgctaggctaagaaatttgaacagtctctgcttgacgttggtgaccattgaaaatctggggtagtagagtgatgtggcattatgagagctgcacttttatatgatttattatacatcttaggttcacaacccttataggattattaggaggtttaaaataggtagtaacataaagggcttagaattgtacgtggcacacagtaactcctaatgaacattggctatcatcatcatcgtttttattacatggaggcaatgagggtctgaacagagatagtggtagtatgaagaaaggtcaggagatggacactgttggacactgttactatagaatttagcagctgattagaattgaggaacagaggagaaaaagtgcaaaatgatactgagatttctatccagtctgggtgactggaggatagaaacagaaatttaggaagagcaagtttggggggaaaagaagatagatttgatttggggcacgtggaatttcagttctgggtagctttctggttgtagatgtccagccaggcagcttgtacatgaaggactgaagctttggagaaatatcaaaattggtaatgtatatttggaatttaggatcatagagattatagctgaacctaggggacaaacaggagagaatcaagaaagagaattgacagaagactagtgctacatgtcaaacatggaagcccaaaaatgtctgactctaaagttgagaaatccagaaatgagcatggtagagtcctctaggtcagtgctctctaagctttttttggttgcacacccctgttttctgagtgtgcatttcccatgtaagaattaatattctttattccaaaaagttacttgcttggttttttagtattagtttactaaaaatagagaatatctgtaactccccttaatccaggcgtgtacaacaaggtaaaggtttcattgttagcctacatcttcctcgcagtccttggagcaccgtatgtaatacatggtcttctgacaagttcaactaaatgagggcatcattatcagctcataggttaaatatttgaaaagctaatattaacactttctgtgtgtgccttgataagtaaaagactagaaatacttccttagaatctggtgaccttcacttgctttaaagatgtacaaatatttccttgagattagtacatataccatatctccatttggtacaaagactaggttttattttttgagttgctttgggcataatcttactgattttagctttgtaaaatctcaaatggcagcatcctgcatgaagctgaccaaaaatacatatgtaggaatttggcagcatttgctgagcaagtaatttatagcccacatgatcattgtagcaccaatgagcagcacacacaattaattaccaggaatgagactagcctcatctgtaggatttagcagaatttttaatataagacacctatatttagtttctaggctatatatgttgtaattatcctcaatctaaaataaaggcaataagaaacttttcactagagaaatagtggtaaatttccagccattttacctcattatttataatctaaactccatgattattttcctcttggaaattcattggccagatgcccatgaagctccccttgaaggtggttaagcaatgtaatagaatgcagtgtttatatgaatagtactttatagttagtgaagtgatttcatactcattctcttatttggtatctacctaatgtaagtaggacagacgattatcatcccccattttgagggtgagaaaatagaaggcagagcctagtgacaaaggcttttgctctttatact

SEQ ID NO: 53203 - DNA, 1060 bp, Homo sapiens
ttcttgtccaggcatggtggctcacatctgtaatcccagcactttggcaggccaaagtgagaggatcacttgagcccaggagtttgagaccagcctgggcaagatagcaagaccctgtctttacaaaaaattttaaaaattagccaggtatggtggcaagcacctgtagtccccgctactcaggaggctgagcaggggaggatcacttgaacccaggaggttgaggcttcagtgagccatgattacgccactgcactccagcgtgggcaacagagcaagacactgttatttaaaaaaaatttttttttaagttcttgaggaacctgtgtttgttcattcagtagatgtgtattgaatccccactatgtgcaaggcatatttgccttgagggtgtatcagaaacaaaatgattatgtttgtcttacaaacgggggaaaaaataggagcatgaaaaatttaagcttaaaaaataatatgccccctaaaaaaagagaacatgttacacaagtctgaagcaagtgaatatgctaattagagaaatagatttgattgtgtgccaggaatggtttcttggggagaaaaaaaatttatcatcactgattagtgaatgtgtagacagtgtttaatttctttacatttgtactgtaaaggcaagcttcttatcaatgctattgcagaagagccttaaacattggtttcaacccatgagatagtctgagaaattccaactttccagaacatgtttccttcatgttcacttcaggatgttggatatagatggaagtgggtggagctctctttagagctccaaacagaatcttttgcttggatggtggggccaggttgagtggggagctgcctggactccaggtttcctctaccctctaacataaacaagattcctttcacaagacaaaacaggcacgtactcctagcttgtggaagtcttaggtatccaaggagatggtggtggttgtgggtttttttggggtttttttttgatacagggtctcactctgttgccaggctgaagtgcagtagtgcaatcatggctcattgc

SEQ ID NO: 53204 - DNA, 1076 bp, Homo sapiens
tctatttagttttagttacctcaaagagctgtattgtgggtttaggctactataaaagagtttggtatagagaatgaagtacatgccaaggaatagagagctgaactgaagtctaaaggtcctgagtttcagaaaccaggtcatattgcaataaaaccttagatttctttttatttatgaggttgataattttgatacatcctgttgttccatgcccaggcatatcactaagagaagatttggcaggcatggtacctggttgagagcaagagcttgaaagatttccaaacaattttaaaaggaacactctgattttgggatgttttgaaaacttctgaagtttcatttttttctttaagaatgataaagagtaactggatataagagtaacagctagattgcccactcatcagtggtctgatcaaatcatctcacttctgcatgattttccccttcttgctaatggatggccaggcagaggtatttatcttcctcctacttacccattgtcattaatatttcagactttgctaatctatcctggtcacttttctgaagaggttctgactttgaaaagatttacacttgagaatggtatgcatccacatttccagccttcaagtctgcctttcagcttccagcactgtcttagatgtttgtgtgtgtgtgtcctttctgtcatccccttttattttaaatccatttcagtaaatcagtttcaggtagatttctgattgcagtcttgctttaaagtcctggagctcatttagtctaagcttctggaatagcttgtgtaaccatttcctttggttaggcaattccaataagtatgtcagggccaagctttccaagattcgcccccccccccttttttttttttcctgaaaggccatacccagcatcagtcttgcacctcctcttaggggtaattagttatcagactgtgtgctggatactgtgagggatccagagagatgaatcatatgcagatcctaccctcaaggagcttgtatagcaggaggggaaataagacatacacattgatgtgtatgtcatacaaggtatcaaatacaatg

SEQ ID NO: 53205 - DNA, 1046 bp, Homo sapiens
tctttttgagatggagtctcgctctgtcgcccaggctgttgtgcagtggcattatcttgactcactgcaacctccgcttcccaggttccagtgaaactgttgcctcagcctcccaagtagctgggattataagcatgtgccaccatgctcggctaatgtattttgtgtttttagtagaaacagggttttgctatattagccaggctggtcttgaactcctgacctcaagtgatcctccacctcagcctcccaaagtgttgggattacaggtgtgagccacagcccctggccttaaaaaatcctttttttagagacagagtctcactgtgttgccaaggctggtctcaaactactggcctgaagtgattctcctgtctcagcctccggagttgttgggattacagacataagccacaacacccagcctcctcttacttttaaatacattctttcccttattatcctagaagatgaacccagaatattttccatgggcttgtagatgttgtaaatggactacttctgtagcaaaatcaatttatttgcaattaatgcattaaaataagaggtgattaactacggttgctttatttatttatttatttatttatttatttatttattttgagatggagtcttgctctgtcacccaggctggagtgcagtggcatgacctcggctcactgcaacctccacctcctgggtttgcagcctccacctccttggttcccgagtagctgggactacaggcatgtgccaccacagccagctaatttttgcatttttagtagagatgaggtttcaccatgttggccaggctggtctcgaactcctgacctcaggtgatccacccgccttggcctcccaaagtgctgggattacagacgtgaaccaccgtgcccggcctgctttatatatataatattaattgttgggtgtttttaaagctccatgcaaagaatggatctgctttaggaaaagccttttgaataaaagtactcactttttccaggaatttacattaacaatttatgttcttctaagag

SEQ ID NO: 53206 - DNA, 1579 bp, Homo sapiens
atttgataacttctgttttgtacctaacttccactactacagtatgtggctctgagccagccaaagattcatgatctgttgactacacagatgtttgcgggctgatcatgcctgcacatctgtagttgggacagttcaaaatttaaaagcagactgcacagatggttctagacgtgctttttgaattgtgtacctttgtaatgttttggggggatatcagaggacagccagaatttgttaccagacttttaaatcgtacaggtctttgtactccaactaaacctacccatccattagcaagtgtacagagatatcgtcctggcaattgtgcatctttctcctttgaccttagcagtttgcatggcagattgtgccaagatgaggcctgtccagggacccatgcaataaaaggttagattcttttaaagctttttgataattattattatttccagaaagatatttttgtttgccccatttaaaaaaggttaaattgagtcactgtcttcattttcatgagtaccttgtagaaaactattaataatgataaataactaaacttctctagattaccttaatttttttgttgttgttctcagtacatctaagagagtagcatataggccatgtgtatgtggtgataaatgaaaatgcaggggtcttacttggttatttaggacttaagattttatctagtcattttcaactgtgattgaacacttccctttaactcccttcagaaactccaagatcatattgtatcccaggtactagaatttctgttcagctgtttataggcctccaccacaagaaattggctccaaacctattcccattacatcatcacccactaatgtcattacaccagaatgaaatctgctttgaggcttgtattgttgttttccttccatttctttcccctcatcatttcctttagaaggaaaagggaaggaaaaaaaaagaaaaaaatcagagacctgtaaacatttaagagtgaattggacatccccacaggctaaacctagagttgtcagctttcattccattctgctgtgatagagtgttctgcccagtatgtatccacatggagcctggaaagtaacaagtctggtcatgtgacaactggctttggtgctttgctttcagcccctcagaattagttcctaatggctcacatagctccctgccagcatcccgtcactggcacgttaaaccttttcaaataattcctcagaatagagattcttaggagagcactaaatttctccattctttgtgtttaattaaactgttcttgcattttaatatttgccagataagcgcttaagacattacaatacaggttgagtatccttaatctgaaaatctgaaatccgaaactttttgagccctgacatgacgctcaaaggaaatgctcattttcgattttggattttcagatttgggatgctcaaccagtaagtataatgcaaacttattccaaaaaaaaaaaaaaaaaaaaaaaaggctgggcgcggtggctcacgcctgtaatcccagcactttgggaggacgaggcaggtggatcatctgaggtcag

SEQ ID NO: 53207 - DNA, 1023 bp, Homo sapiens
ccttgattaacattaggatttcagcttacatttctagcaacttttgatattctagttggaggtcttcagtagtctctatggtataagctagatagaaggaaaaactttcctaccaatgtttttaagatgtaagtctgtgttaaaatctttttagcgtaattatataccttatcaaactgaaagattgaatagattcataaaaacatccacaaatatacaaatgcctaatctggacagaaagtctgactttattgtttctaatgtgtcttatgtatgtgtttattttcagttgtcgagatgtccacagaaggaggatttggtggtactagcagcagtgatgcccagcaaagcctacagtcgttctggcctcgggtcatggaagaaatccggaatttaacagtggtgaggaagaatgagaaacttttattagaaacttttaaagagtataaagagctctgggaaattaaccaaaactcagactaaagcatttttaatttcaagcacatttacagaggcatggttcacccctgacctgtgggtaggaaaatgaaaacataatttgccttccgtgaggtaactgcaagagtcttttatatctcagtgttcttccataggcgtgtggtgtgcagtggatactttgacttggaggtagtttaatgtgaggcatatcctttaggacttacagaaaaacagagatctcatcttccttcagtagctgtagctcaattttttaggcctgatttagtggccctacgacatttctagaacttggtaaaaactattgggcaatttattcaacaacaaatctattgtgagtcaggaactctttctaggtgttaaaaagatatactttgatcgcagtttctcaacagctgcattattgacattttgggccagataattctttgttgtgaggggccgtcttatgcataacagcatgtttagcagcacccctagcctctactcactagatgccagtagcacccctccccgagttgtgacaaccagaaaatgtctccagac

SEQ ID NO: 53208 - DNA, 1017 bp, Homo sapiens
atattttcataatacagttgtcatgtccttaatgaagaatgttcattaaggtgtcattttagcacatactaaaggagctccccatgttggctgtgtcattcctgccctggaaatactagcatcctggcagagcagacactggattccttcctgatgtagaattaatgttgcaattgcttaaggttagtgacctttaacttctgacgttacaatgtcagtttattcattcactcaacaaatacttattatgtaccaactaaggctatgctagatactgtggatacagtaatgaaccagacagacaggatcattgcgctcatggaacatatattctgatgagacaggctaataaacaagtaattaatgaaatgaaataacttattatgataaatgcccactgacttcagggataaaaagtaattcatgttttggatatacctctgggtcatgtttgtttatatgaagagttttcagcagttgaacttggcttagcctttctcagactggcctgggttcagagtggatttccactgaaaagtcattgttcctcttctgcagtctaaggtagtagttatctaaactgtctcagatatgaaagagaagggaggaataaatgaaatgataaagtcaaaaggatggggtgttttgttcatattttagggggttaatctcatgattaagcttatcagcttttggtgctggggtcagcttggtgtaaaatgaatgctgtcctggggtgtggtgggactaggccaatcgagcaagtctgtgccgcagcttgagccgagaggcataaatccaggatcaggcaagtggccagataaactctggaggtttaagctcagcacttaacttttctgttttgttggactttgatttttttttttttttagttgtagtaaaaaaacacataaaatttcgccccttatccatttttaaatgtacagttcagaagtgttaagtataatcacattgttatggaacttaccttgagaattttttcatattgcagtactg

SEQ ID NO: 53209 - DNA, 1837 bp, Homo sapiens
tggtctcaaattcctggcctcaagcaatcctcttgccttggccctccaaagcactgggattacagacatgagccatcatgtctggcctatcctttttttttttttaaggcagaatcataccctgttgtatgtatataccacattttgtttatccgttcatctgttaatggacatttgggttggtttcacctcttggctattgtgaatagtgctgctgtgttacatgagtgtgcaaatacctcttcaagaccctgggctttgatttgtaacctacttggtttacaagtttgattgccaacaaagctgatcatgatgttgaccaaattttagtacctagacttagtctatcagaagttaaaagagaattactttgagggattcagttttggttcaagttttgtgggtgaagagaaagaaaagtaaagaggaagttgtctttaatccttcttgtattggtgactaattaaaattctcctcctatgtacttttgaaagggactcctagacctctgccatgctatgtcttttatatcaggtgcttagaacaatgtctggcatgtagtaggtgcacaataaatatttgaacaaattagactccacttcaggtttagtgcaaagcaacatcaattccatatttgagtaagaatgcaatccagtaaagtcagggtaatttttttcccttgtgtgactcttattttcccctcttctcaggagtgcaacacgtgatggcatctgcttctctgactgcgctgctgcctgtgtaacatgaccaaacattttagcatttaatctgtccctttccagaactcaacagtacttaaaaccagacttcctcagatgtgtcagagcctcttaggttgacacctcacaatatctaacagattaaaaagaaaaaaattccttatgtttaaactagccaatcataagtaaaacttacgagaatattcataaaatgtgatctcagactgggacacaatttgtttcaaaaagaagtaattgaagtttgctagatgatatatttcatgatgtgttggaaacactggcctcaagtccttttggtctgcgtcctgtaaaagcaatttatctttcattttagcttgttctcatgattcttaaaagctctgtagttgtctataaatccaggtggtgttcagctgggattgaaattagttaaaaaccatatcaagatgattgtgcaccagagtgattgtgtaaaaccctatattcccgcacagcagagctctgggaacagcaaataacagacttcttcgtgttgagttttgccccagtgggcctctttgaaaataggaaagagaaagctaactttgtctttatggaggtgagttgggggcaggtgggcaacaatgctgaatttcgaaaagaaaaatctaattctctacttactctttacatcccattcagccttcacttaactgtaattgagtgcctaggtcactttcttttaattggcagtttcatcttttcattcctcagtgcctcctgattgggtgatgacatttctaacattacaatcaaatcagataactgtttaaacaagaacttggtgatgaaggttggtggactgttacaaaacaggtcctgtgctgtgtgagccctttctgtagagcagtgcttctcaaactttattgtctgtatgaaccacgtgagggaggatcttcttaaaatattgatgctgatttagtaggttaggaacggaacctgggattctgtgtttcttttgagttcccaggtgataccattgctggtccaaggaccttactttgagtagcagggccgtaaaacagtagtccttaactctcacttggatcatagtcaca

SEQ ID NO: 53210 - DNA, 1945 bp, Homo sapiens
gtgggcctcaatctactgattgtagagggcctcccttttccaacaagcttatggtaaatccttacatgtaactagaaggctaggataggattatagaaaactgggtgattgtcaacagggatgaaccatacacacccctcaagatccacttttacacactgcttcttgagatctcaaggtttcaggaacatgaaaaaatagtttgtcacaaagaaaagctttgggaaggggattaaagcagagcttattataaatttctgcctcattttacatctctgcaaggcgggaatgatctcttgatccttgacttttgttgcttttgattaaagaagagaaattgaaggagtaatagtttactctttcaatttggggaaagaggtcttttttatcaactttgggctttagttaagtaatcatggaacgttcttgtacaaattatatttaaaaccaagccaaacaagagcacacttgcaagagagctaaatgtatgatcatcttgtgctgtatgtattagcctgggaggttttccaaaggaatgatcatccctagcattctctttggcatttctatgtagtgtcatcatcttctgtgatatgccacacaagaaggaagaccagtggttgatttctgggattaaacttttaaaaaaactctttaggatctggccccaacccagtatcctctttcctgcttttcccctctatactcaggtagtagatctaaaacttaaataggctgtgattttttgtctctctctctgtctttgttgttctgtctgaataacattctcatactttttcaacaggcaaattcccagcatcccttagacacaattcagatgtcatcccctttgtggaacatttcccaatccctcactctccctccagccccacattgctagctgtccctagcaatatgtccttctttgtgtccccgcaggggatccctcccctccagtattgggtaggggattataatgtttttatgtgactatctctgacaaaccacaagctcttcaaaggtaggagtagatgtgtattttttttctttcttttttaaatagtgatggggtctcactatgttgaccagactggtctcaaactcctggcctcaagcgattctcccatctcagccttccagagtgctgggattacaggcatgagccaccatgcctggcctacatgtgtattttttgcatagtagtaggtatcatacatttactattagttgagttgcttgaatcagtaaatgaaagagcaaggggaaaaacaagaatagaatgaacctgcgctactgtttccttttgttgaaattttaataaactgaacttctaagtctctgttactccagggttagttttagtagagggttcatggaaaatgttgatacctaatttggaaaaggaaaagatgaaaaattggtgtttgaagtttgtagagcagagtggtagccaagcagcttgttgggtttgcatggaaaaattagatgtcttggtgtacattttatcctaatagattctcttctttctataatcataaaataggttctgggaagactgttgatgtttttccaaaatacctttttttgacatatatttgagattttctgttggtcttgcaaaagaaagttcacttatgcttgttaattacatcaaatctgaaataatatatgctccttccataatgtgatgatgcaaattcccaggtgagcatattaggtttagtgagtcacatttcagaccacttatagaatcaatcatttgacacctagtcccagtagagattttgctgattttagctaatatctgcctttgcaccttcctcttcattgcagctctgaaactcaaaattgatttttttcctagaattgcatccatcattgggcatgtgtttaaataccagtagtttcaaaataaaacaaaaaagggcttaagtctcaaattatt

SEQ ID NO: 53211 - DNA, 1054 bp, Homo sapiens
ttgatctgaactcttaagaaatttttgataatgatattctacctgttctaaccttttgatctatgagtttcttttacatgaataatacttgtgagagggtttgcgtgggcttggccatttctgtattcctaggagtccatctccattacagatctcagagaaagaggaactctgtctctttaccactcaaaattaatagtcttttgtattttcacagaaagctaacaattgatagtaattttcccttttattagctcctttcttcctcacagtagccctgtgagatttgatataataagaattatcagttccattttacagacaatggaaatagacacaaagaggttaagtgactcacccagagtgataggaccaagatcccatttcccatctgctgcttctttaactccagagctctttctgtggctgtatcctgcacagactacctcaccaaaggtttagaaccttgtttgaccaagagcttcaactttgaaatcagacacatcaagaaagtttatatggcttgagcatttcctatatgccaagccctgggctgggtacatatattatctcatttgattgccacaataaaactgaaaggttatcctctttttcagtacatgaaaaagcccaaaaggatgggaagcctgcaattttatccaaatccattggctttcaagctcattctccttcctcatattgtttctccttggattagaacctaaaccctgccacttactggctctatggctgtgggcaagtcacttcatctctcttgacccctagtttctttgaaaggctattataagagtaagaaaacaccttgcacaaggtttggcgcatggtatgtgctagataagtattctttctccctgttacctgctttgttcccactcatggatttattttaccttggaatctcttgagtataccacctcattttttgacccttgccccatagtcccatgccaggcaatgaggcaagagacagactggtttgcatgacttgctggtgattgacagggagggcctgtgtctgttacagatgatcagt

SEQ ID NO: 53212 - DNA, 1846 bp, Homo sapiens
cagatttttatcacagagttgactcttcgagcctggattcacacagaagataacaagcgccggactctacaggtattattgcagacttagattaggaaaactggggtaagcagcagcctttgcctgttttcctgcgtggtgttggagaaagattgttctcctttaggaccaaagattgttctcctttaggaccaaagattgttctcctttaggcctctatcaagctgacgtgtcattggcatcaccactgttgggaggcagacataccttctagccatggtgattgtgtttctccaccaaaaatcttaatcaattctctcctggttttcacagcttagtgactgaactcttttcccttggtgagccctcactataaacagaggctcaagtgataagagtatttacctgtttccaaacgtaatcaacttctggttgggagccttgagagattccaggaagtatcatcagtctcactagcttcattaggctttttgttccttgtcagccttcctgggagtccttttctttttcttcttcttttttttttaattttaatttttaacctagcgaattcacattcatactgtatgcagagcccttggtcattgactctagaaaccctcaccctatagccaagccctggctcttagaggaaagatttcccagatacaagaagaagagtgtaacaagtataaaacagtggtggcagtattttaacaatgaagccaagaaagtaaattattttctcttcttgtttccctttacctacaaagtagaaaatgcatgtgtttattcatttattctaaaaatacttactgaacacccacaatgtgccgggcacttttctaggctctggggattaacgatacacacaacagacaaaaatccttatctgtgggaagcctgcattctagtacagcttgtcaatgcgtcataaagttaggatttgtgtacattactatatgaaagttttaaagcaaaaaaagcaaaaaatactgagctccaataaatgatatgcatgttgaagtcacaaaatttatgttgccttgaagttagtctgtggatccagagagatccagttaaagctcccttcaagatcaattcagattagaaaataaaataggcaaaacacttggacagaccttcagaaaaaaagataaacaaatgcccaataaacccatgagaagatatgcaacatcattagtcatcagggaaataaaaaactgcagtgagatactgttttacacccactagaatacctaaaataaaaaagactgacaataccacagttggtgaggaagtggagtgtctgaaactcatatattgctggtcagaatctaaagtggtcagtcagtttgaaaaaatattagacattttctgataaacatatccccctactctgtaacccagccatttcattcctaggtttgtacccaaaagaactgtagccattcttatataaaaatgctcttaacaaccttgtttatactacctcaaaactggaaacaactcaagtgtccatcaatataggaatatataaacaaattctgaggtattgatgaaatggattcctcctcagcaataaaaagaaacaaaccattgctccatacaacatggataaatctcaaagatactatgttaacaaaaggaaccagagggaaaaaattacatagtgcatgatacaatgcattattaccacctatagtgatagaaatcagagttgtggttgcccagatttaggggagtgtggggaaggatattgactggaaagggctagaaggaactttctatattccttttttattttttgagatagggtctcactctgtggcctaggctggagtgc

SEQ ID NO: 53213 - DNA, 2076 bp, Homo sapiens
acaaatggtaaagttaagctcatttcaagttatcttaggaagtctatcagagctcttcatctgggataggagaatattcccagaaagttatagattttagatttttaagaaacagcttctctatgtgcacagtggcatttggagtgaatggactatgttttctcttcctctatattgtggttcattatatctttatatagtaccctgactgcacactagaatcacctgttggggttttaaaaatatcagcgcccaggctctaacccacatcagctgaatcagaatctcatgatggagcccaggcatcagtaccttttaaaactccctggatgcttttaatgtgcagtcagatttgagaaccaccacttgagctgttttgcaagcaatcacaagaaagaatatgaacgtctgccttcccgtctcttctgcctgcccctctccaaaggtcacactagttgttttttcagcaccttgggtgcatatagctcttaattgtgattgtaatagacctctgtcctttagagctcattgttttaagcatgcagattgcatgattcactaggtgccacttgggaaattgtggcagaatctcacaggagcaaagctgtgccttgttctgcttgctttgttatataaaactttatttttaatgaattatttcatagtatattatccttagaagcagtcattcagtgacagccattctccccatcccagcctgtattaataaccagtcagagaaagtctaggagaagtgggcatcctaatgaacatttgtaattctgaccctgcatgagggcctttggattagcaagccctctgtcacctccttactagagtagggtgtgcctcactgcgtctccgttctttctgggcagtctttgctactgtaaacatccttgactggaagctgtaaggtgttcagaggagctttcagtcggatgtttacagcggcaggctgccacggtcgtccccagctacgcaccggctttgaaacattgcaggtttgtgcccacaggctcaattcctcctcttgggggtccttccctcctctctcagaagtcacaacaagaactcaggccatttatcttccttcagaacaaagagtatcatacacctgctttccttgttgaaattgttttctccttttgtctatcagaagccccctttaaaacaagattgtgagctctgtgatgaaatcaggccttgctcactctcattgtgctaactccttgttttctgtgggctgcctgctgaatacactggctggagagaagggtcacatcctgtcagttcctccaaattcctcagtgcttctgggtctctcggggtgtcatacagctccttattccatcttagccagactcaaaatgctatgatccatctgattttaaagtgtgtctagctgaaacagcttcttgttgcttggatttagttctttgtaggtgttcgaggcattgattggcatcgtattcgggacagctgctgcctggcctttgaaaggttgagattgctgaaagctggcctgaaattctaagatagcatttttaatcctctgtagacatgaagttttcccaggcttcaaattggctggcacctcctaaagtcctttaaaacgcctactctccaaaacccaccctttctgaaggaggcagcagttcactcttgctactaaagcgaatgtacttttttccagtcagggctggttgcacaacactgtagagatggccctaggatgtgatgctgctcttctctggcactgttcgtcagtctcagcttctggaaagattccaagagcaagccctgtagttggggaggccactgctaaagttgagcaagtgccccattctggattgatccagtcattaaagcattgttctgccacttggggcaacctcccactgctgggaaaaggaactagtcagaaatactgaattgtgagtccaaggccctgacttctcaaagatacttgagagtttcgcttgttcttcagagaagcaagtaaagattatttgaaggtaggaggtagttgaggcctgacttctgccccactaaagctattgagttgaaagttcc

SEQ ID NO: 53214 - DNA, 1819 bp, Homo sapiens
ggcacctaacatagtgtggggatggggtcaataccagctttgtaaatgttactttggggagttggaggcaatccacagggtctgtgtacatctaagaagtgtcttttcctcttttctggaacgtggcaaactttgccctgaataaggacatgagtaaatttagctaatatttttactcagccagcccaagtggttctgtgtttttattgtttttgttgtcccaggcaggggcaccatgtgtcacacaggtcactccggatcagacgccgttctgtgtcagtggtcaggggctgatcaaccctggaccctgtgggctataaccatgctgtagtgtgtgtaaacatcctacactctcagctgtgagctcaaggtggctgggagagggttgtttactccttctgccatggaaaacatcagctgaagaaggaacagtctccactccgcagatcggacagaatgcgacctccctaatcagccaaggcagtaccccagcggagagctgtccatcaggccccctgggttgcgcttctgtggctaagtacaaccagaaccagatgtgacactggatagacatgccctcagtgaccacagagctttcaacaagctgtgaaaagctgggtacttgcctaccagtgctctcgatcctgaaatttcagctcaggaaaagccctgtttcccattaacctgttctgtcccccttgaagtggtggggctaaaacgagaagagtgctgcctatttgggagattgggaccaggcctgagaggcatgatgtttgggtagcatcttcccaacacttgcaattagcactgttctcagatcacaggccttgacagcatttactgacaagcactgctggtgtgtggtttttagttacggtacttatttgcccgtttgcaacttatcatgcaatgggtgattatttcgtacttcagaaattggctgtatgttttgtgaagcctataggatctgttatttttagtttgatttagcataactggtctctttgaattccactttcctttggcttcaaatgtggagagctcagcattcagcaggcaactgcacatagcctgtttgggggaagagtggaaattcactgtggcggctgctgagttggttcttttcctcttacctgcctctctttccacccaacaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccaggtctgtgagctgctgaggatgcccatccagcaagacagtgccccttaggtttttggatgggcagagcttgatgagggcagagaggcagccagatcattatagagcactggatttaaagtctggaaactggaacttttccccagattcagctactggggtgagatgttaccctaatctctctggaccctgtttttctcaaaggtcaaatgaggaaagtgtactagacagtatgttctccaggatccctattagctcagaaattttagaagggaaaaaaaaatgtctgaaatgccttatgaagagtagaggtgctaaagtgaactccatgcctgctgtctgtgtgtctgtgtgagaagtggaatttgtgcccttaaagggagagattaggtatcattgccaagttgcatactccttctccccgtcatttctctgtcccatatttgtgttaagtgaccttctctttttacgatagtaatcagaggactcttt

SEQ ID NO: 53215 - DNA, 1250 bp, Homo sapiens
aggtgcggtggctcacacctataatcccatcactttgggaggccaaagcaggagggtcgcatgggcccgggagttggagaccagcctgggcaatatggcaagaccttgtctcaaaaacaaacacacagagaattaaaaataagtaattatggctgggcgtagtggctcacacctgtaatcccagtactttgggaggccgaggtgggcggatcacaaagccaggagttcaagaccagcctggccaatatggtgaaaccccatctctactaaaaatacaaaaattagccgggcgtggtggcgggcgcctatagtcccagctacccggggaggctgaggcaggagaatctcttgaacctgggaggcggatgttgcagtaagctgagatcgtgccactgcactccaatctgggtgacagagcgagactgtctcaaaaaaaaaaaaaggtaattatgattttaggatttattctctgctcattttacttatccatataacaaaaatgtattgagtgcttgttctatgccagacactgtgctaggcaggagggttcaaagataatggctgctcagtcactggctcaaggcctcgactgtatcatgatgcctaagggaccttctttggctaatgcttgtgcctctgcagtggtgaaaactttacctgccaaaggctttatccctttacagaatgaacttagagggagtctgccaagggcaggctctgattggctgatcatcctaagaagctcatggctgttgtgccctgacagcagggcacaccatacatgatttgacagctgccatgctaacacaagccctcattttcctgaaatgatttagaaataccttggaaatcctctcgggaaaattgggttgatacagtacagtgatgagttggcagcatgcatttctttttagtcagcgagaatttcatctgtgctcctctctgccaacccagacgtgctcagcttggagctgataaggcttgtgaggatggtgaagttggtccttcccagcatttcctggctgttgtttcaccatcctgctgcttcagggtggccttgtgctgtgtcacacctccctggacccgtagtgatggctatttcaagttgagtgcaaatatccttcgtaggacagaatacatatgtattaaagcagagttggaaagaatgcatattttggtaaaattaatcctgtgttttctgtcataaattgaaaacttatttctggaggttgggaataggctgagttgaa

SEQ ID NO: 53216 - DNA, 1015 bp, Homo sapiens
ctttcctttaatctaggttcaggttcaccacgattgggcggcttctctcgatttcccctcattctacctatgcagggaaatcattgtaaccactacccatgccaaggcccaaaggccctgtgaggcagtcctgtatttgattagcagaggataagagggaggcgtatagggaaggccataaatacacttgttgcatattcatgagtcagttcccagtggagcctgcagcaaagtgtatttttggctttcatataacttatctattcctttactgtggactgctgcttcctgtgtgccttgagggatttcatttcttagatttgttggcttttttatttgtactccttttgtaaaatgtgtccttgtcttaacacttgcagtctttacattggtcattttgaccccccaaaactggaaagtgagtgaaacagagcagtccttctattccctgccctttgccatttttgtcataaatgaaacgtaggcaggtatagaaactcacgtagacttggttaaccacttcctctgtgaaaataactctaaaagtatcctgagatcagtttaggaattgttcttcatctgaagttaacatagtaataggccaagagaaagcttaggaaagtggagtgtgtatgtctctttctctacctctctcacgtgtgcttacgatacccaggattgcagatgactgagctctgccttgcttcattgtttcagtcctcaaccccaagatttctgttgaatggttctcatttttgcaagcgaaggcaccaccacaggttcatttaagacagagaagagttccaccttgcagatactttaactctctggggcacagagctttagcccagaagatttgttgcagaattcactacttcatcttcactggctcaggcaccttctgtaggagtcttcatttccagactctttaggcagctcattggaatgttcctaatagtgatgagcttcaggaaggaaactttatttccctttcaaaaacccagagcttattttc

SEQ ID NO: 53217 - DNA, 1032 bp, Homo sapiens
agctatgagggtccccagacctgtcctgctgtagaggaatgagggacggatcatcaccaaatgtcttaacctaggccaaaaaggaaagcttcttgctttgttgaagagctgcttggaaccatttggctcacagcttttcagtcacatttgggtttctgcaaagagctcttcccagctagaaaattttaacatccctgtagctgtcagtataccttctcccactcctgggacaaggctttagtttttcatcttgtgatccctggctggagttctggggactcctggaactagccaccatcagtctctgtagatgaggttttccaaacttctgcccagctgccttcctccccacaagcaacttaacattgttgccaggaagctgcattataggatttaggtggggaattcaggcttggcaccacagcctcccagcagcttctcttggcatattctcaggaaagaaatgactgcaggtcctaatactcttgccctgtctcctttgaaccagatttttaatgggtttagattgggtgtccctccatcttgcctcaagtgggcaattctggaatggtctaccgtgaacttgagaggtcgttttttctcggtagttcaaattctgtgaggctggaagtctcagagaagcattttgattgaacactgcgtgcaggaatgcagcttcatcccattagcattttcctcatggaagagtcctgcagtgaagttagctcttgaaggccagagggaaatttgctccagagcagaggcaatacttgcctgttagccacaagaagcttccccttgcaacaaaggcaggctgggcagccagggcaggtggtttctggaccccgcagatagagacctagtctatccatgctcccagaacccctttcatttcctctaaattgagggtgtgaatgtctgcagtcctcctctgctgaccatcatctttgctgagctacagttctctgatgtggtaaccgccttggtcctcttttcatccccagctcaaaacactaatactttcatggtaca

SEQ ID NO: 53218 - DNA, 2330 bp, Homo sapiens
tctttacagatgggagcgaaagaggcccacacttaatgtacaggcattctgatgatgtcagtcagataaattcctaagataagctgtgatcatgtagctaagagctggcaaataatgagcatgcagccatgctgttctcacctttgtgacaggatcttctgggagttttttctgaagtccattcagggaatatattctcttctgtgctgtgtgacttgtgggatgtggatgttctgattttgcttgttttgacctctgtttaaaagggacttttttcagggcaggcttctttggagggcttgaggggtagggggcaatcaacatctctggtcatggaaagtttgcctgtttgagattatactcaatgtcttatggtctctttgtctctgcccctgccctaggtgcagctgaatgccggccagctgcagtatatccgcttagcccagcctgtatcaggcactcaagttgtgcagggacagatccagacacttgccaccaatgctcaacaggtatgtgccccagagacacaaggcctgtgttggagaccaggagcagatggcttctgacaggaaaggagcgctcagcacacagctgtcttgccacctcatccttcaaccagaagcaccacccccacaccctccatatccttctgcacccaagaggcatgggtggtaattggaacattagattcaaagtgttttctcttaccatcttgttctcaaggggcaaagaaatgcaagtcaggggaagcctcgaaggtgcctgaaagaaaccttacaggtgtgcacacccatcagacctgggaaatgttcgacagatcgcctgatcgtcaggctgtttccatctttaaacccaagtggctgttgtgttctggcacctcctgtgctctttggaaagcttacttagattttacccctacctcctcttgcatccctaaccagaaaaattgcccttctcctctcctctcgtgccctacaatattgatggctatgagtcacagatggtgagggggctgcctccctgggcttgggggtgttgagggacatgggtattacttgcagaagatggggggtgctggtcaaggggaggcattgttaatggattcttttgcctcagacccaaaaaaagcagcgatcgtttaagagctggacccgtctggcccagttgcatttctggtgatgtatctattgacagtggtgacagagctgagtttgtagagcaggtctccaaagatctcatttgggaaaatacgaggaatgagccaaaagcaaggcttctgagttccatatagtctctgggatcattaagggctgtttctgtgcccactccccggcttacctaaggacgcggcttttccgtagctgatactgactcacacccttcccccagcccctctttttaacctcataagattcttccctgggatccaaaaaacataacggcatgggagtgggaggaaatgagaaggaagcttcttggttcctcagaagtcagtttggggctgggcacagtgggtcacgcctgtaatcccagcactttgggagggaggctgaggcaggtgatcacatgaggtcgggagtttgagaccagcctggccaacatggcaaaaccgtttccactaaaaatacaaaattagctgggcgtggtggtgcatgcctgtcatcccagctacttgggaggctgagacacaagaatcacttgaacccaggaggtggaggttgcagtgagctgagattgtgccactgcactccagcctgggcgacagagtgagactctgtctcaaaaaataaaaattaaaaaaagtccgttttgggaacagaactaaagccaaaaaatgggagaggctggggagaagcaagaaagtggtagctgaaggcaatgaaaatctttgtaacaacaggttgtaattatgacaacctaatacttagtaggtgctcagtaaatgtttgttgaatgaagctgaatgaataatatgtaaataaaatgtaaaggtaaatgaaatctcagctaatatgaatggcaatcctgctggccacagagcagttaaccttcttatctatgtggaatattttccatttgtctcaggctcacttgtttattctgcaacatttctggaatactaactttgtatgggctcctgccctcaggcatcttataggctgttggaaggaaaaggaccaaaataaggaacaatagtaaaaaatagtcatgaagcctgtcatacctgttccctttcttgttcctcatagcctcatgggtaggcctgcaggggttgtttttggccatggtgaggacatttgagaggacagtccttgtcttgcaggctggct

SEQ ID NO: 53219 - DNA, 1051 bp, Homo sapiens
caagtccgcttggcgaagtctggggcccctggagtgggcgcccttttcctcttccccacccctgcctccctgtgtcccagacacaaagaggaacccttggctcccacacgcttctgtcacctgctccccagctctgagctatgaagggctcccctcaggggtgctcctctccagggcggccctcattcctacccctgcccagctgactgtgggtgtgtgggggtccctgtgggccccctgggccctgacactcgcatatgctgtgtccgacttgatctgtgtcttcgctcagtcttcccctccaccctcaacttcccagtggcaacggcggccgccctgcctgccctgccctaccctgccggcttggcccagctcgcctgccttgttggctggcagcaccaggcctggctctaggcaccaggggaaaaagaaagaggagaggggtaggtttggaaacactgacgctgctggggccccctcctccctctcaccaggctcctacaactttcaaaaacactgacccctcttgggtgtgaagagtgaattttggcagctcagagctcagtcttggggtacggcctggcccagccaggaacatgagaggccccgcagatatcagttgaagggctgggcctgacgctgggacgctcagaggtgcccagagagagacctctggtccctggaaaatgtgtggctattaatccctttttgctgccaccagagagggccctttggcgctggggtctcctgggtggcccacctgcctgcccacctgactgtctagcagccctcctgctggcctggctgtccctctgccagcctgagtttccacctgtgtgcgagttggccagtctgctcacccttccacctaactgtccgcagtccttctgcttgcctgtttccatccatctgtggcctgtgcagttatccgggtgcctgtctgtgcatctgcctatccacctgtccacctgactgtccactcttcctctacctgtcttttccacctgtctctgggtctgtccttcggcctgtttctcgggtgcttgctggc

SEQ ID NO: 53220 - DNA, 1717 bp, Homo sapiens
gtagcgggcgcctgtagtcccagctactcgggagactgaggcaggagaatggcgtgaacccgggaggcggagcttgcagtgagccaagacagcgccactgcagtccagcctgggcgaaagagcgagactccgtctcaaaaaaaaaaaaaaaaagaacttaaatagcctttctttcatctaagggacacttttgagcatctaccacataccaggcactgtgctaggcactgtgcacacatgccctcacttacccctcacaaagggtcagtgctgctgttctttaccttttacagatgaagaaactgaggctcagctgagagttgcaattcattccatcattagttcattcactcagcttttactaaaagcctgctctgggccaggctctgggccaagtgctgagaagaagaagatgaacaagtccttcaggagacgtgcccataaattaataacaactaagtacatgcttcaacagacaaggtgcagtgggaactagagggggagcaacaggctctcctgggggttatgggaatggacagctgacctcctgcggggaccctgcaccgctaaggtgcatgcgccctgtgtagctgtgcagtctcactttgatcaaggctttgctgtgtatttccaggaagcctcttccgccactgagcctcggtctctacctggaaagttaaaaggttgcgtaggcctgacatcctgcagctcttggggggcctaaaactctggccctcccaccccaccttctggtcagttcaagctctaccccagccaagtccgattccgaagccctgagggccagaccgaatccctccgaaagtgccaaataccccgccccagggcggtgctcagagcctggggcgtggccggagtcccaaggggcggggttccagtgggaggggcggggccaagacctagatgcaggcgtgcgcggcccgcccagaagcgtctcgcccagccaatgagcgtccgagggcggggaagccccgcctctgggtataagaatacgccgagcccagctacgcgacgcggaggtttcggagcactacaggttgcgggcctttgtgaccccaggctgcggccgcaaggtgcgcagtagtgggctgggccggggcaccagtcgggtttggttttgctccgcccggccgagctgcagggaccgcacggtgcccgggtctcccgccgcagagcagccgctggcccgggccgggggagccggcgctgaccaccgcgcgctgtccccgcaggcagccggcctgccgccatggccgaccacctgatgctcgccgagggctaccgcctggtgcagaggccgccgtccgccgcggccgcccatggccctcatgcgctccggactctgccgccgtacgcgggcccgggcctggacagtgggctgaggccgcggggggctccgctggggccgccgccgccccgccaacccggggccctggcgtacggggccttcgggccgccgtcctccttccagccctttccggccgtgcctccgccggccgcgggcatcgcgcacctgcagcctgtggcgacgccgtaccccggccgcgcggccgcgccccccaacgctccgggaggccccccgggcccgcagccggcgccaagcgccgcagccccgccgccgcccgcgcacgccctgggcggcatggacgccgaactcatcgacgaggaggcgctgacgtcgctggagctggagctcggg

SEQ ID NO: 53221 - DNA, 1007 bp, Homo sapiens
cgagtttacttgctaaacactcccaggattcttgcgttaaatgacttggtttaatcagcgtttctctgatttatatccataacaccctttttgagaatcccatgtgcattttgttgaaaccagggagcatgcttttggaaatgctgcagcagaggatgcaaagagcctttggagcggggaagacttctgagcattcttccttccctgccaagtgtgttctttcttgctctggggagggggtggggcgggggaatgcttcgagcacaactccttagttttcttgttccttagtttatttttatcataatttggcttcacatggaacgttcctgaggaggaaaatgtcctgaccatgccaaagtaagcattttctgctactttctaattgtgtttttcattttggtcacatttgggtttgctgaccaaatggacgatcctggacctctgaagctggggaccagtgataaatcctccgtggtgagcctgtcacggtctcctcacctcttgtcgatgctgttttcacctgcatcttgactctgctgcccttatatcttatttctcctttccctgccaccgtggcactgctttttggatttaatctcatctcccctctctttgagtcctctgcccgtcatgtgcttcagactggtttcttatctgatgtccctctcccccagtatttacagtctctcttcattgcatgcctgggagagatttctgacaaggagcaagttgttgttaaattatagaagagaactactttttctttttttttgaggtagtcttattctgtcgcgcacgctggagtgcagtggcatgatcccagctcactgcaacctctgtctcctgggttcaagcgattctcctgcctcagtctcctgagtaactgggactacaggcgtgcgccatcacagccggctaatttttgtatttttagtagagatgcggtttccccatattggccaggctggtctcgaactcctgacctcaagtgatcctcctggctc

SEQ ID NO: 53222 - DNA, 1052 bp, Homo sapiens
ccaaagtgctgggttttataggtgtgagccaccatgcccgactgccttttacttctttgttgttattgagaacctgtcaatggtgtgacatacagctgtggctgttacttcaaagattaattgcttaaaactgggagagatgttaaaacatacctcttaagttttaaaattctgcattcgtactcctactctctagcgttgaggtgaaaatatgcaagcattaaatgtcactagtgcagaaatcctcgtaacaaatggcatcaggaaaagatccatatacctgagtgatatttaatacagaattcttgagcagaggatgagttatctctctgagggagaaaatgagactttttttcctttcctgtgtttgagcttgtctcctattgtgatggtaggaatgaatcattctgggcaaaatttctagagtgaagtttcatggaatgaatgtgcaacaaaagaatggggtaaatatgtgcagtttcacaaagttgtttagaacaaaagcagagctcggaagctgatttttataatcagcacaagcttaatatgcatatatccaggttttgaatcaaatattgttatcatactttaaaccatattatgctcaattaggagacgtttctgaaggttctttttccctaagcagcagatgctgtatactactgtaaagtcctgtatgcacagcccactgggctgtcatttcttcccatcccatgctattttataactcttcttaagaatgagtttgttgacaggctagaagtatgaggttaccttttagagaatagctggtaatttttctttttgtgtgtcatatttagtcttctagaagtgaatttctgtgcttcctattacgtaattgcacaccttgttaatgagtgttttatttcaggattgcagttgtgccatggtataggtatttttcacttaacgtaaatggtttctctgttcactgcaggtgaggtttttgtgctggatgatggtggggaagtagaccttgacctgggtaactatgagcggttccttgacatccgcctcaccaaggacaataa

SEQ ID NO: 53223 - DNA, 1748 bp, Homo sapiens
ttgaagtgtgggagtgatgaattctgacttgaattttaaaagatcactttgacgccatgtgtggagtagataatgaatattcttctgcgtgaggcaaatgaatatccttgtgcatgaggcattgctgtaactggagtaacctggagttaaacagtaatcttcaccttttaggaacttgccatctgtgcccaacaactatgatttttgaagtgttgagcaattgctggcattctttgagcattgacatggcaggcactttaccgagcattttacaggtgctgtctcacaaaatttccacagcttaacaggtggggaaaacaagcttaaaatggttctataattggcccaaagatccacagctaacgagtcatgagactaaggtttgaatccagacattctgaccccgggtgctgtgcttctaaccactctgctgtgctgtgctggctcactgcagtggattgtctaccctttggtaaactggaaacatatggaacagggtcccagaagtctcttgttcctggaagtgcactgaagtgtaatgtgcctaccttcagctgtgagcaatagggttggctatactggtgtgtggccaaaagggtagactctgcacaggggcacgtgcgcctgtgtggctcaggacactgctgtcagccttgctctgttgcagggcttccagcaacaacttagacatctggctgcaggaagtgtgagctcagagatttgttgaggccagttaaagggggcctcaaaagtatttttatgaccctattgctactctctccaggcaaagagtgctgcagtttgttttcacagtaagtgcatttgtctcaatcaatgtagatggacaagcgtaagttccctgtttgttttctttttcccagttgtccctcatatcacagatgcaatccaggagtgggtgatgagacaggcgttaatacctgtagatgaagatggcctggaacctcaagtgtgtgttattgaggtttgtatgattcctgcacatgtgaacaagtgtactcatctccttagtcagccatcaataactgataagacagttcccagtggagcccttggccttcctatctctggtgcagtatgttgcaatgtggcaggtaagggcacagttaacagtcatgtggaatggccacgcaagggaaaaccgtagtttgcccagtgttccttttttgtagcatttatggtacaatcacttagtactgattgtccccatgagtagtgtgacacattttcatctgtctcttgagcaagtcagcagatcttttgctttcgtctggcaagagcattcgtctccgaatgagcttcatttggtttcagtatctgtactcctgctgtgctgatcctagctgttggatctcagtgttcctcagataacaggagactcaaaagttccagcagtttgtttataactaatactttttttttgagacagggtctcactctgtcacccaggctggagtccagtgcagcagtcatggctcactgcaaccttgacctcctgggctcaagcagttctcctaccttagcctcccaagtagctgggactacagtgcgcaccaccatgcccggctagtttttgtacttttttgggagaggcagggtttcgtcattttgcccaggatggtctctaactcctgaactcaagccatctgcctgccttggcctcccaaagtgttaggattacagatgtgagccaccgtgcccagccaactgatgctttttcagtacaaaaa

SEQ ID NO: 53224 - DNA, 2627 bp, Homo sapiens
agaaaattagaaggagataagctatatccgttaggtaagaactggatgctataagaaagaaacattgagagaacagaaaagaatccttggaaattaaaaattagatagcagaaatgaaaaagttaagagaaagtaagttgaggaaatacccaaggaagtacagcaaaaagaccaagagatagaaaataggagagaaaaggtaaaattagaggactggctcagaagttctaatgtccaaataataggagttccaaaaaataagaacacagaaatggaggtataatctgaaccccaggggtcagcaaatgatggcctatgggccacatgaacctacccccccgtatttggaaatcaagtttatggaaatacagctgtgtctgcttgtttatgtgctgtctgtggctgcttttgctctagaacagtagagttgaatacttgtggcagagactgtgtggcccacaaaacctaaaatacttactatcagggcctttacagaaaaaattttctgaccccttatctgaacaattcaaggaaatttctagacatcagtttctgggttgaaagggcccccttggtgcctatcatattggatgacagatgacctacaccaaggcatattattgtgaaggttcagactaatggggcagaagttctaaaaggctctgaagagaaaaatcaagaatcattgtgccactggaccccttagcaacaatactggaagctaaaagacattgatgctatttcattaaaaattctagtggaggctgagcatggtggctcacacctgttatctcagcagtttgggaggcagaggtgggaggactgcttgagcctatgagtttgagaccagcctgggcaatgtgacaagagcctgtctcgatttaaaaaaaaagaaaaagtccaacagaaaatgatttccatcctacaagtccatgtgtaacgtgtatctgttaagtgtgagagaagaataaagatgatttagtacagaaaggaaaagtgtggcacatggtttgggaacagtatttaaatacttaaaaagtatgtaaacccaaaagaggactgcaggcacaggaaagtgtctaatgggggcaggatcctcatttaacagggaaatcaatagaaaatgcctccaagtaaatgtggagaagtagcacaccagcaagatcagttaagagttgaagagcggttgtttctagggattggaaaggggagagtgggtgagggccgatactgcttacaagctcggttagaaccatttgattctaaaatgcatgcatgtgtaactttgacaaacataaaagctaaattacacaagtgaccaaatgatctatttccttattaaaagaggttcaaggaaaagtcatacttgaaaattccttatcagagggaaactaacttttttttttttttcttttgtgaaatagccaagttcaacaggggaacagaagactaaacctacccagaatagtgttcgggaacttagaggacttgggctttccccagatctggtaagatttcctgatagctggttgcagtgtaatcttttatgtctagttaagatcactctatcatgacagacaagacctttgtcttgttgggttgcttttgataattgatgatggagaaaataggattagttctttgaaccgggctgtagtttgcaagatgttcatacttagagcgtgttaggtcttgtactccccagaccttatttttcctctcagtctttttactctcatttttactcctacttgggaacactaatggaggaaaatcccagagctcttgtagttcattaatgtattcatttgtactgccattctcttatgtttctccagtttggcgtttacggattttagctttgaaacgagtcataatatttttatggattatgtgcctggtgctgagagttaacgttttcgttcatcttaacaatgtgatgtctgttttaatttcagtcaggagaaacccctacttctgtcattttttccttctgtctaagccatcttgttctctactgctaggttgtatgcaggtgctcaaatccacttgacacatcagtgaaggagaaaatatcaatgttctgccatgttgagcctgaacaagtgagtagaaattcccatctctaataagttgttttttgcttctaattgtcctaaagcctcttgatcagtttcgtgaggcttgttattttctaattagagatagtgggctgttccagaagaacccattgccatcggccattccctgcctctcctggttccccaaacaacacctgtgtccctcctgcctcttctccgtgcctcgttgtactttgtgcttcagccgggtggagtatctttcggttcccctagtaccctccactctccctatgattgtactttttcactggctaatttctgttaagaacccatgtccccctcttcctgttggcttggcagtctcctactcactctcatccttcaggttctagcgaagacatagtgttgtctgagaagctttaactgccaaacctcctggcccttggccttcagggttaactgcgtccttcactgggctcctgtgtggtgtcgcatgtatgctgctgatgggcccatctttctggtgtgtgtgtgtgtgtacatgtg

SEQ ID NO: 53225 - DNA, 1093 bp, Homo sapiens
gacggggttttgccaagttggccaggctggttgcgaactcctgacctcaggtgatctgcctgcctcggcctcccaaagtgctgggattacaggtgtgagccaccgcacctggccttcattttcttaatagtgtcttttagagcacagacacttttaaatttcgatgaagtccaatctgtttttttcttttatggattgtgctttcactgtcgtgtctaagaactccttgctcttaaccaaggtcatgaagattttcttgtaaaagttagttttaggtcttacatgatccattctaggttaacttttgtgtgtagtgtgaggtaagggttgaaatttttacatgtggatatctacttgcctcagccccatttgttgaaaagactatccttggatactattctgtactttttaaaaataaaggtacattatagatttactaatcttcataaagttgtttagacttatttatagctattcataatttttattactaccgtgtatttttaaaaattatattttctgattagataataccccatgtgtaggagaccctgctgacctctgtccattcatctacagcctagcaaccttactaaaattctattagtactgattgtttacctgtaaattcttttggtttttatggataagcagtgatattgtatgcattattcagtggcaaccgcttcttgttttctggttcatttttttttcttatctaatgataatggctaatatcttcagtacatcattgaatagaagtactgaaagtggccattctggccttgttctggactttaaatagtaaacattaatattaaaccatgtgatgtttactgtgggttttttatattgccaaattttccctaatcttaatttaccaataatttttattatgaatttggttttgaatttttatcaagtctacatctactgagggaattgttttcctccttaatctgttttctatttatgtggtgaattccactgttaaatttcctaacacagtagttctcaaacttgactgcacactggaatcacttggggagctttaaaaatactgatgcctgcctcctaccccacaagatcctaa

SEQ ID NO: 53226 - DNA, 1915 bp, Homo sapiens
ttgaccttcctattgagaggcagccaagaaaaatgctgatgaaatggaaagagatggctgacaggtttgcctgcaatgaggagctgggagtgctagcctcctttactcttttgtagggctggtgaagccgactctagccctagcacttttgtacttttgcacttctgccatccactcattagaagagcctttgtagtaagagatgttcagaaaggatcttagctgtcacgtagctgtggcacagatgaggagatcctgatagggccaggccaggtgccgggcctccagacaatgagttcgggttatgtcttaacacgcttgtctcttaccaactagatcagtgcagatgggcgtcctggtggcagcgggtgagtgtgcatatccaaagcccacacgaatggctgacagtggctggagcactcctgggtaccactccagagttctgagctgtgtttgggaatgtgtctcaccccacaccagaaagggatcacattaggacggggatgtgttgctgcctactccactacatccttttaaggctcggtgatgctgtcacattccttcagaaatcttcacttcgtgtcttagagcaatgggcaggccttatcttagttgcaagatcaatatgatggcctagaagcatttggagagggcatactcattccgttgctctgtgagaatcatttttcatttcaacattttcctttcagtctttgtctgcttacatatagctatcagaatggcagttttatcatcctttttcataaaacattataagcattttgctctgttattatattttacaatgaaaacttttaatgagtgtggacttttctattttgtgaatgtcccataatttgtttgacacttgccttcaccccattaattcttgtgaattgtctatgtctgttattttttttggtctttggtatgaaaaaaattttttgtaggcaaatttgtgtgagacgttgaaactctttgtaagtttcaaaacaaaaacaaaaaaaaaatttttctttacaaagcctgccatgttgatctgaaaattacttcctctttactggtctgtacacagaactcagataatagctattcccgttatattcttcccaggtgtgtttttgttgttttttgtgggggttttttgaggcagggtctcacactgttgcccaggctgtagtgcagtggtgcagtcagctcactgtaacctccaactcctgggctcaagatccccccgcctcagcctttcaaagtgctgggattataggattatgggcgtgagctcatcctggccagacgtggttttttttcccttgaaatagctattttggtctcatgatagcgtgtaccttctgagtaattgggtttttcttgacgtttatttgatagatatgatcgcttgctggagacctgctctattgcccttgtgggcaaatacacgaagttctcagactcctatgcctctgtcattaaggctctggagcattctgcactggccatcaaccacaaattggaaatcaaggtaaggagggtggcacaggtacagccaaaggatgagcagggaagcagtctgtagtctcgtaggtgctgtgtcatatctgctttctgtttggagctcagaattactttttaaggaattactttttaaggattaaaaagatttgtggttgcttcgtggctttgagaagacagtagagcattttcaggaattaatgaaggggagagatggctagaggagagggtgagagagacttgagttcttggctatgactatcaggtaaccaaataaaatgccctgtggaaatggggaccactgatggaccacaggcatgctgcacagttgatagctggaggctcttggagactttgttggcatgtgggctgcctttcctaacctgtgcttatcacttattgc

SEQ ID NO: 53227 - DNA, 1804 bp, Homo sapiens
aggctgtggagctcttaccttgctgccgggagtgtaaaatggcaccaccacactagaaaacagtctggtagtttcttatcaaggtagagacgtgtgatccaataagtccattcccagatactcacttgagagacttgaaaacgtccacaaaaaaagatttttattcaaatggacaaattattcgtaatagctgaaatctcgaaacaacccaaatatttatagcctgtcaatggatcaatttgtaatggtttatttatatagtagaaaccactcagcaatgaaaaggaagaaaccaggctgaacactgactggctcaagcccataatcccaacacttagggaggctctgctgtgggaggatcgcctaagaccagtagttcgagagcagcctggtcaacatagcgagacccccgtctctgcaaaaaaaagttaaaaaagaaaaggaacaaacaactgataaacacagcaacatggatgaacttcaaaaacactaagcaaaagaagccagacacaaaaggttatatactatttggctccatttatatgatgttctataagaggcaaaacgaatctgtgatgatagaaattggatctgaggttgtttggggtaggaggtagaggggcacattctgggaagatggtaacttatgttttgttttgttttgttttgttttgttttgttttgttttgtttgagatggagtctcgctctgtcacccaggctggagtgcagtggcatgatcccagttcactgcaacctctgccttccaggttcaagcagttctcctgcctcagcctcttgggtagctgggactacaggtgcatgccaccacacccagctattttttttttttttttgtatttttagtagagatggggtttcaccatgtttgccaggctagtctcgaactcctgacctcaagtgatccacccgcctcggccttccaaagtgctgggattataggtgtgagccaccacgcccggctcattctatatcttggtgtgtatgtttgacaaaactcttcaaagtatgcacttaaaatgcttgtattttattgtatgtgaattatgcttcaatatggtagaaagaaaaagaaaaaacccacaaaagctgggcggaagatgggctgaggaggctgtcattgaacagaaagccctctagagtctgctgcagaggcttagctgagacccgatcctgaacacagtagagtgcagaaagagagagatttgggaatttaatgattttgaaggaaactgttgtattttaaaacctcatatttaaaaaatgtttaagttattaaatatattaagttgatcactttaaagccagtattaagatgatcactttaaagccagaatcaagaaagacaactttgataaaatgataatattatttaaaaattaagaacgcacagcctggggtcacgagcctgcttttctcccctgtctgaataacatccagtacatagattctgcggacttggagcccatcacctcgcaagaagagcccgtgcgctaccacgaagcttggcagaagctctgtagtgctcagtgagtagagttcgctgccttgggtttccagagttcttttggtttgttttaatgaaaaagtcctcttgttttcatgtgccagtagtaggtaattgacttgttaaaatattttttaattgttgaaaagactacatgccatctgatttaatccttaaaaaatgcagcttgtcaatatcattggatctgaaaagctgctctgattttgatattgtttgccatatgcatctattgatgaggctcatttaaggatttttc

SEQ ID NO: 53228 - DNA, 1994 bp, Homo sapiens
caaaaacaacaaaaccagctgggtgtggtcccagctccttgggagatcaaggctgcagtgagctgtgatcacaccactgcactccagcctgggtaacagtgtgagaccctgtctcaagaaaaaaaaattgtgaacaactcagtaccaaagatagtgcagtggcagtattacaattatgtatactatctttttcacttgcaataagcatgttcttaagttactaagaaaagtccatagtttcatatgcagtttctaagttgatagtgtttacatacaattcattgtcacagtagcacaatgtatggggttaattcatggcttcagtgtcttggtaatggcccgttaggcgattattgcaagttggactggtagaaaaggggaattgcctttgtggtttgttcttttgtgcagtggagtgctggttccaggaggatttggtgttcgaggaacagaaggaaaaatccaagcaattgcctgggctcggaatcagaaaaagccttttttgggtaaggagctctgcagtgcagtcttcacttaagagtaggaaagagtggggaacggtgccacgtgggagcctatgaacaaagtggggggattactgaaacatgctgtctttgtggataggagctcaagtagaagccttcatgttttctctttagagacaaattcagtcttggaaagcttatttatgcttatgagctacatgtagatgtcgtggaattttgagagaatgaattgtgaattcctgtccatttaatgaacccagctgtttgtagcacacgtgaggttgagttttatatctgctcacttggcacaacagctgactgtaattggacaaaatgattttgcatgcctcctggtgctgtacattttagtaattttcaacttgaacaattataaataaaaacttaatgagagagggtaagaaaacttgaattttaaagtactgaggctaggcacggtggttcacacctgtaaacccaacacttgtggaggctgaggcaggagggttgctggatcccagaaatttgaggctgtagtgagccaagatctctccactgcactccagagtgggcaacagcaagaccctgtctggggggaaaaaagtactgaatagaatatcacttacttctaaaatcggataactttgcaaatctagaattttcatctactttacatgcagtttttgaaatctaatacaagtaaagtgtaacagcagagagtacttgttcatagcaggaagttatgagtttgcaattataattctccaaataaaggacacaaaggccattgcagaggctgctgggaaaagtaggagctgccttttcaatggagttttgtttgttttttccccccgactggaaggcgtgtgcttagggatgcagttggcagtggttgaattctcaagaaacgtgctgggatggcaaggtaagcgtgcattaagacactcattcaattcccgcttgtgtatttctggaggatatgaggcctgttgccgcctgggtgatcaggagctttggagaagggcaggcctgggttcctagcacctcatggtgtgccgtaagggagctgccttgcctcttgaggaacagcacggctcctccatgcaggaaggagggagcacagccagactccctcctttgccttctgcctctgtgttcctgttcttgagattctgtcactttgatcaccgtggccaccatcctgaagctggtgcctggtgtgaagtccttgtcctaagtgaggcttgggcagttattatgagaacctgggctctggagctattgaaactgggctcagattccaaccttaccgcttatgggtgattttaagcaatttacttagcctttatgggcctccgttttttctgtaaaatgggagtaataaaggtacgtacttcacatgattaagggagataatgtatgtaaatagtctctagtagtgcctggaaaatagggaaatgctcagataatatcagctcttcgcctagctgt

SEQ ID NO: 53229 - DNA, 1024 bp, Homo sapiens
gccagcatatggtttagggctgggtttcattcaccctttccctgagaggctgcttcacagtgacctggcggtgtggcttagtttggtagacagcatgcccttgagtgctggcttctgagtcctgagaggcactgtcttatcacccgccaccccagagctggctttctggtctccctggatccttcacagccccagacctctgcctctcacttaggttcccaaatgggtaggtgctttggtgatgagcttacacttcagttgagactggaccctggttcaggccaggaggagaacagtgcccagcgttcacatagtaccaggaacttggtcctttgccttttggtctttagtggttttgctttggttagacggtaagttcaatgaaggttagaaaggttgagttgaaatcagttcatttctgactgagctattgagtgaaacagttgagtagggctttgtattagctgctgaagatgaaagaagtatagaagaaatagtacttgtttatctcagagagacaagagtctgaaacattaagacaatataaaaacttggctgggcatggtggttcaggcctgtaatcccagcactttgggaggctgagttgggttaatcacttgaggccaggaggtcgagaccagcctggccaacatggaaaaaccccatctctactaaaaatacaaaaaataaccaggtgtggtggtgtgcgcctgtaatcccagctacttgggaggccaagacatgagaatcacttgaattctggaggtgtaggttgcagtgagccaagattgtgccactgcactccattctgggtgacatagtgagactcttgtcttaaaacacaaacaaacaatataagaactgtcacaggcggggcgcagtggctcacgcctgtaatcccagcactttgggaggccgaggcaggcagatcacctgaggtcaggagttcgagaccagcctgaccaacatggagaaaccccgtctctactaaaaatacaaagttagctgggcatggtggtgtata

SEQ ID NO: 53230 - DNA, 1139 bp, Homo sapiens
tcagaaggtgcctgggaacgctgggctgagaggtggactgggccatcagtgcatggcccacccagtcctcagatgcttgctaagctgcagggtgctagccctgcatcccttgcctttgagcagtcatcaggctagctggggcgatgacagacatgttatgacacatccagtccgtgtctgtgctactgtatcagtctttctaaggaagtgatgcttaccgtccacagtgctggggcgggactagcctgaggaggggctgctgtggtcctgtctgcagatcaggaggacaggctgaaggacggagcctccacccaaccgaggttacaaatgccaactgggaggcattttcttctgtgacaaaatgtctcataaggaaagcctggagaattagagcttacttacaagcctttgccacccactcagcgagggaggtttctctctagcggaagcagagttctgtagttggtgtctgttttctgaacatctccaggtcgtagacatgccagaacacaacccagggcagatgggcggaaccatgaggctgggcaagaggagaaccctgttccagaccaagaactcagtcatgagtaagagctgcctcacgctggcccagcctttggctctgcgtgcccaggacgcgtgtcttagggtgatgctgtggcttcgaggagcaggctggctttttttggtttcgttcttgcttttgaagttcattctttcctctcttattcatacccttttaggatgcactgtgatagccatagaagcagtgtgggtcttagaaaggacactggcagtgcagtcagactcctaggcatgggcgcctcaacagaatgaggcagtgaggttacattcatccttatcggttactttcctattaagaccagccatatcaattgctgatgtttggcaatttttgtcacacaaagatggcaatttcatatgattcagcctaagtagattctgttctaataaagtactaatagatgctgaaggtttagggtagttttcggaggaaaatagttaagaaaatgactattacacagatttccttcttgtctactgggaaaattctgcctttactgtattagcagaggcacccttgtgtctgtctgggcgttctgtagcagcatagctgg

SEQ ID NO: 53231 - DNA, 1022 bp, Homo sapiens
ccgtttcgtacatcctgatttgctttccaaggcagttttctagcagcaaagtgcccatactttgcaatcatgtgtttgagggtggtggtgagagtcttgtttctgttacagctttctgtagtgttgtcagaaagagtcaaaagcccaagaattagtctaaactgtgttgttaagagcaggtgaccttagcagattcatagaaatagccctcaaaagacctggctgtgtggatgatgaaaagtaaagcaggaaggaggatgtctttgtgaacgcatcatcctgtgagataaagttctttacatacagcccgtttgttttgccagggaaactctatggagacgcagactacttggaagagaggcaccgccaccgatttgaggtgaggattccagcttgctggtactctggaaagatagtgagctgagagaccagcagaattatttttcatgcctcaacaggtgaatccagtctggaaaaagtgtttggaagaacaaggcttgaagtttgttggccaagatgttgaaggagagagaatggaaattgtggagttagaaggtgattattcgggcagttttatttaatggaaaacttagtaaagttttcttggcatatgggaaaatataaaaatgttatcttgttgctcctgacctaacagaattaggaagcagcactgtctcatgagggaaggggtcttgataaacatggggtctggactctagaaacttctttctggtacatggccttcctcggggagccatttaacttctggccgcagtttctccttctccaaaatgcttggagttggtactaaagccacttcagccctctcctgaaccgcaagactcagtctacagaaatcctgggagccagggtcttgggcgggaccctggacaggaggccttcagccaggaggggacagcacaaaccgtgctgagaaagggtatcagatcactcatgctttgaggttccctttatctagattcaaatgagaaagtcattttcaaattattttagggcctatg

SEQ ID NO: 53232 - DNA, 1778 bp, Homo sapiens
gtttcccctcctgccttggttggttgaccccctgtcctggcatagcctaagtaggtggtgggtaggcatgagaagttagtatcaggaggagggcctgtgtgctaggtaagcgtttaacacggatggactcattaatcccctgaccagggagtttgctataggctgtttcacagtcttaaggagctgatacaacaagaactgttaccagtgaaggaggtagatatttggtcagttacatggaatttctgactgcctcgcaagtggagaattgcccgttagtgacactgttacgaggtgctgtggagaaagaatgcttgcattgggtggttgtagaagtcgatgtgtgaggtcttgaaaaggtctgattctgtaggaattataaatttagcgtctaattattcccagtaggctccttctactgctctgccatgaaaaacaggcttagtttcccatggcagctgactagaaattctaacttttctactttaatgtacatcatataattcccacttttttttttcttttaaacagggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcagaacaagagacatgctttgcttctcattctctttatgtcattggccagatgggaagcgtctgagcacgttgctggcttgcttgtgtgcagtcagctgaattgtcagtgccgggtgctcctgcaggtgagcagccttgactcagcagacaacctgagagtttgtttaaaaactaagaaatgaggctttctttttaataggaaccagaatttttcataaagcttcaaatacaggttctcagcatgtagagcgagatgaaaaggtgcatgggtgctattatggtgctatttatgactgagaaaggggagggataagcatgatttaggaaggtggtcctttcctctgccaggc

SEQ ID NO: 53233 - DNA, 1029 bp, Homo sapiens
aaaggtgtcttttccgaccttcctctacacaaacaagtcttgttcccacactgccttccctggtgtcttttcatcatagtcttaacagaatcacctccgataaaagcactgcttctagagaatgtgcccagggaagtgactgttcccccattctccttccccctttccctcatagatacttctgtacccaaatccgtattgcttatgtgacttgcaagcaggtcaaaaagatacctgaattttaaatactctgtgggggccagaccatctgatccctgcagccatttctatgatcccctggctgatccttttctatggagggaacttctcctcacctaacccatgctagattgctttctttcagtaccagagtctctgagaaaagaaaaaggcattctgacttgcagttagaatgttgcactgggagtctggactgggcatggtagagctggtccagacaaaggcaagttttaaatacctccagttaggcattcaggaactctgatctacatttcagacgtgaaagttaggcctacctgggattctgaaagaatggatgcatgaatgggggttagcacatccatgaatgtagctgctagtttaaaaagagatttctcaaagaaataggaactccgaattcttaaatggaatgccatcattaagaagtgagagaaacatactggtagcagcattcagagactggtaaggatgtacctcatgggcctgcagtcccaaaagtggtttgggaccggggcatgacctttcctgggaattctgccccaatttacatctctctgattcagccactagataagaggaagcaaactttagccagactcttcttgcctcaccaactaagagaaacaaagaccaaggtatcacattctgccattagctgctacctctcccttccccattttcagacagattgagcccactttttgtgtcctcctctgctcttaagctgtttctcatcgtgggtgctcagcaacttgtctgctctcactctagtttctatttgcttccctg

SEQ ID NO: 53234 - DNA, 1064 bp, Homo sapiens
gtaagcctgttctctttctaatcatactatttcctccttctttcctaccttctggtcattagtatgcaaatgttaaaaattcagagtaagataatgtttcctgctcatggcaaataggaaaaaccaatatttatttaatgttcctttacacacagattttcattttatcttctggtaactctgaacaaggtataattattttcagatacattttatttatgagaaaactgaagctcagataattaaatgacttggctctgttgatatctgagtctagagagtgaaaccatggagatcttttagtagagccacctgtcaggaccaatatatcactgaggcatattgttttcacacttgtctccctgatactcttcccattctcctttggcccttcttcaaagcttcatttgagaccctggattttggcttccaaatcctgataaaaaataggaaagaaaaagtatggtgtagtatcagagcactgaactgggttctagtcccagccaggccacaaacttggttacgtcattgagcaagtcattcttacatgtgagaggctgaactacatgatccctagtgggcacttttacctctgtaatactatctagtttaatgatcttgggaataggtagcaggtgactcctgtgcctctgtctcctacatgattttaggttcatcagctcacctatcacctatctctgcctttttgaagtaattcctgtgtgccagctgtctgctgcctctctttttctccttttctaagccaagtagtatcccttttagttgctaaactcctgtggccaagccaactctgatgggtagtaactaccaagcgtccaactaatccagagtacttggttataaaaggcagaagctttttacttttagcttattttttgtgacttaaaataaaactgaaacagatacatgctttagtttttaaatgtaaaaagcaaaatgaagaattcagtacatatggcatgactatgatgctaatcatacctttagccatcatgataatccacttgacttccccttgctctgatttcaggctgggaaagcca

SEQ ID NO: 53235 - DNA, 1092 bp, Homo sapiens
tacccctgatgctgccattattcttaagaccaaagtctctttggtgcttttagtcagaacttaagctaatataagcagttacccaggactgaccaaaactcttgatctgtgcttcctaatacagtaactattagctatgtgtggggatttaaatttaagttaattaaaatttaaaaaatttagtttcttacgtacccacatttcaagtatccaatagttatgtggctagtggctaccttattggctagcacagatacagaacattttagtcagcacagaaagttttattggacagtgctgctctagatgccagagttgaagattctcaatccagggaaatccaaaacttactatttgatttaatctttcatttgtaaggatggaataataaattgtaatgttttatttttctaacagcaaacaatgatgaaatgtattcagtccttgctttagggccctgtcaactagaagcaaactcttcattaaattctgataacgcctttaaaccttgacttcagaaaatagtcatctcatttgccctatggactaactgtctagtcatgttgattaatcatcagctagttcatgaaatagttcagaactgactgtgatttctggccaaatctatttggcttagttaagggtagtgggaaaggaaccagttataaaacagaagctataaaataaatagagtgtaaagtcttggcatcatctttggagtgatttagatttcttcattcagtgactcatttttattcccagcatctagtgctttttgcatggcccaaaggggctctgtgctgctccactacagaggaaacttcaagaaatgctggtttgctacagtgttttagcttgtgagattctctgggaccttccctgctccatcatggggtcacctctaggtgggtattagggggagactggtaattggtttaacctttaaataaagaacttgataatctttagtgatccaatgaggtctgtatcaaatgttcctgccttaagatgttttcccttcccccagcacagtgtcaccttgaagattgtttatctaggacagtgttcttcaaacttttagaggctgtaagg

SEQ ID NO: 53236 - DNA, 1030 bp, Homo sapiens
cgtggtatgcatcagagtttataaaaacacttttataagcattatttactaaatgagatggctttttctcatctgtaaagtcttagcttagacatttcctctgaagagtatctgtccatgactttactaagatagctcccagtctctatcacatcacctcattttattcccttcaagttcttttcacttactgccttgtttatttattgtttatgtgttagttgtgtctcatcatataccagcatgtaaatgagggcagggacccctgtcatattgcctggcacatagaggatagttaataagtatctgttgaatgaataattgaaaacattcaaattatactgtttgaatattttgaattataatgttggaataattgaaaacactcacattatatatgtttaaattataaaacattatacctatgttagttaataatattaatcttcgtaataatctctgagcccaaggatgaatgagattttcatgttctgcaatctcaagacaacctgtactacctcgtaaactttatcattatcataacagattatttgtgttatgtttattaatgtctctgtttatctctagactgaaagctccatgaattgagaaatcatgtcttaccttgttcccctaacatttaacacagttctttgtacttggagaagtttaaatatttattgaatgaagaatctatatacaatcttgtaagacagatattgtcttcatctttcacatgagtaaacttaggcttggaaggattaagtaatttacccaagatagttagctgtagaaacaagacttttaccaacatcttcagactcccaatattacattatttaaactacaccagtagtagttcttagtcacagatgttaatccaaattacctagggagccttggaaaatacatattctcaggccacacttggagcctactgaataagaacttctgaaggtgaggcccagaactttgtttaaagaaatgagactataagtatcacttgagagtcaatgatttataccagagg

SEQ ID NO: 53237 - DNA, 2051 bp, Homo sapiens
taaaggtgcctggcacttgataaatgatagttattttttattattctttaaaactttcctcaagctttttaaggtactgatgtgtggtagaaaaaacatggacataggagtcagacaatttgaaccaaggttcaaattcctattcccacttaccagttttgtgacttcaggcaaattacttaatctttctaagcctatttcctcatctttaaaatgggagtaaaacctactttgcaggttataatgaacacaggagataatggacgtagtctggcatggtacaggcaaatggaagacagtgatagctgctgttgtttttggttttgtcgctaatatgaatgataataacaattgtagctcagtgacagcttaaggcatattgtaaactgttgatggggagttgtgaaatgtgggtactcaatttaacatagagtatatcagttactaaaagatgttaaaatttgaaagtgtatttttcctagagcattggttgcataggcatatcctctgatgtaagttaatcctgcatatttcatttttaccatctagcataaggagcagctccaaatagcaaactgaaataaaattcagtagatctgtggaatctcaaagttggaaaagaccataaaataatctacccttgcccagcatttaaaactcaacattttgaattttttgtaaaatgtcttatcttgaactcctcaagtttttgaggacttagaacctcctcacgtaattcatttcatatttagacatatttattggtcaaaaatttgctctttttgtaatttctgttagtcatccctctgactttctggccatatgaaacagggttagcctatttttcacttactggccctgatttttagagagaagctctagggactgccttctcattgccactctgccgctttcatagttgaatctcacacctagattattaaaacagcttcctaactagtcttttttgcctccagccctatcaccctcctgcccattctttacactacagccagaatgacttcaccccaaacgcttgaagacttcctcttctcagtaatacagtatatttggctcgctaatgactgaacactgcctttatctgtaacctttttctaaactactttttctgtaaactccacccagcagccataccaaaagatctgcatttagaactgctttttctcatgtctgggcctttataatgcctttctttctgtctgaaacaaacaaaaagagtttcctttttctttgactcctgcttatccttttacactttagcttagaagcctagagctttctttggtaagtttccacaagcactctgggtgctcctgtagcaccctctgtctctccagtgtagcacttatcacattatcttagtggtgactgtttagtctctgtccctcactagattctctgtctgtcactagactgaagctctgtgaggttaaggatgatattttgattacagttatatgtccagcactcagcacagtgctttgacacacactataaatatttgttggatggatggggaatggctctgagacttcacttttttactcatgctaattgttcatgttccttcacctggtcctcaggtgatgtggttttgggtctgtttaccatcactaggtaatcatttaaactcagatttgctctctctcaaagtgtagttttcagaactatatcccaggtattattttattagtccaagaaagaataggaatattacttgtgtgcttcttttcattcactcagaaactcatattgagcctctattaaatttcaggcactgtgttaaacagtaaagattttaaaaatgaatataagcccccatccataaagagcttacataaataattatggtgatatgatgtgaacaggatgttataggagatagggagatggtaaaatttgtccagcccttttctgcaaagccttctgacagaaaatgtaaaatttttgctgagctttagtcactgagtgtgagtaacatgggcaaagatatgggaccaagaaagccatgagttttaggaaacactaag

SEQ ID NO: 53238 - DNA, 1727 bp, Homo sapiens
ccgctgccatcacaaatacagttacattctgcggtactgcggagtggggaccttagcatgaagttttggaggatacagttgagcccataactggggtgctgtttgtttttagtgttttaaataattgtgatcattccatgaatataatttttatccccatattttacctaataacataacataaccattttcccatttgttctttagccttttaaaaatttaacagcttcaaaatactttgtcaagtgtttgtattatcaaatcttaatcagtcttctattttgaacatttaggtgttcctttttttgttattgtaaacaatgccaaggctttttacataaaacctttttcttgtattttggagtatttttccttagcatagaatctcggaagtggattactttattaaaaactgttaatacatactgccaaattggaaaagtatttaatcttatactttctttccacatgactatttttctctccctctgcagtgatagactggagtgatgttagaaaacacaaatatggtcacctatcagagtctgcatcccaatatcaaggtaagggggaaaaaactccgtttggtgtggaaaaattttactcggcatcttttcccataaaaccttcgttgttagaggtctgagtttacaaataactcaattgttatatcagaagcaaatattgcagtttacagaggtattggtcataagcaatatactttgttttagctggaaataggaaacctagattctgagtataggtaatcccaaattagcttcatagttttaggcacggttgcttagcctctctgggttttctatagtttgtataagtttaggcttgggaataggcaaaattgggtggtgtgcttccacaatgactactaagaatctcagtgtcttttaggatgagataactgaactagacaaatactcgatttcctattttaccccagaatttcaccttccatcatgttggtatgtttgtcttaatgacttatgctccaacatttttttctttactagaagctgctgacatcctggatctaggtaagctatttttcttgtgtttctgttaaataaggggaattggtaaaccagggattagattataaccagttttaaccaacgaggaaaagaattccacgtgtctctgtctcagaaaccagtgaatcctgtgctcttgtctgcctaattatcccatgtacttcatctcagctgtcacatcaagtcctgcttatcagtaggccacagaccaagctaacaagaagggagggaaggtggttaattacatggggtataggggagaacaggaactgaaccaaactggaaataccatcttaatttactgaatccagaactaaaacaaacccctgccatccataaatcagtgtttggtgggatttttcccccaaaaaaattacttgtaagataaattgaactgaaactaaacctaaacattttctaactttattgacaaataaaaactgaaatattaaaatattatcaagtaagaagtcagaccaataattgcatttggttttcctccctggttagtgtatttcaggactaagatttgagtaataaaactagttctaatacttctcaatcagagttcctgcataaacatcagtcttaacattttagaatcctttaaaatccttttatatgttacatagattttgatatccagatacctgtatcaatttttgttcaagtattttg

SEQ ID NO: 53239 - DNA, 1031 bp, Homo sapiens
gccctgtctccaaatgtagtcacattgggggttagggctttaacgtatgaatttgggggagacacagttcagcccataacaccatgttaatgggtttttagtgtcttttgatattctggcttaacctggttagctggaaactaaatttagtatttgaatgggaccaaatgtagcaaatatctgtattctttatttctgtgaatatagaggcttaattaaattcaacctgtggtacttgctgtaaggtactttgcaactccaagatattctaatagcaaaaaatctgtatctaaatttcctacttttcttataatgtagcctaattgttaataattagagatctcagtactttacaggtaataaatgttcttctccttcctccccacctaccttttttacagatggagaaattagcatacaaagaaactgacttgtcagaagtcagagcaaggtattggtggatccagggataaatcccaaacttcttaacccctagaccggtttttagtccattgactatgcagcctaatggtaagtatctttttaccctatcgtggaggtaagagggattaagagacctagcaaggactggctttaaggaattcctcacgaataattagactactcgttatccttttctttatagccatgatgtcatttttgtcattggcatgaattttccagattgggagaggaggtctgaagttttgctttttaaatacttaaaaatatttctcggtggctcatgcctgtaattccaacactctgggaagccaaggtgggcggatcacctgaagtcaggagttcgagaccaacatggagaaaccccatttctactaaaaatacaaaactggtgggcatggtggcgcatgcctgtaatcccagctacttgggaggctgagacaggagaattgcttgaacccgggaggcggaggttgctgtaagccgagatctcaccattgcactccagcctgggcaacaagagcaaaactccatctcaaaaaaaaaaaaaaaatctgtaacaatttggc

SEQ ID NO: 53240 - DNA, 1082 bp, Homo sapiens
aataagtgtgaagtagtatatcattgtaggtattttttgcatttctttagtgattattgatgctgagcatcttttcatgtggttattggccatctgtatatcttctttggagaattgtcttttgcccatttttgaattgggttgtttaggtttttagttcttcttgttgttgaattataggggttccgtgtatattttggatatcgacagactacaaacatgatttgcaagtattgtctccgattctgtggactgtcttttcactctgatgataggatcttttgatgcacaacagtttttcattttggtgaagtccagtttatctgttttctgttttgttgcctgtgttttatctgtcatatcctatagtcattgccaaatctaaaatgttaaagattttcccctatgttttcttctaagagttttatagttttagctcttacatttatttaggtcattgataaattttgagttaatttttttgtatatggtataaggtaagtattcaacttcattctcctgcatctggatattcagttttcccagacctgtttgttgaagagtgtccttttcccattaaatggtcttgggacttttattgaaaattaactatttttgagctctctgttctattacattggtctgcttatctatccttatgccaatactgtactattttgattactgtagctttgtagtacattctggaattagaaagtgtaagttttctaactttgttctttttttcaagattgtttgagctatttggaatcctttaagattctttgtgaattttaggacaactttttctatttgtgcaaaaatgccgtttggattttgatagggattgcgttgaatctgtagattgctttggatagtattgccatcttaacaatattagtctttcagtccatgaacacagaacagagtatcttttcatttacttacatcttctttaatttctttctgcaatattttgtagttttcagtgtacaagtctttagccgtgttagttaaatttattcctaaatattttattctttttgatactatttaaatggaattattttcttaattttctt

SEQ ID NO: 53241 - DNA, 1280 bp, Homo sapiens
gaggtgatgccccgtcatgcttcggcttgccctccgtgggctgtatccactgtccaaccagtcccaatgagatgaaccagatacctcagttggaaatgcagaaatcacccgtattctgcatcgatcatgctgggagctgcagactggagctgttcctattcagccatcctgcagttcagtcatttttgtttcattttaagagattttccttaactgtttttctctcagaaatcaatttgtgggttgtaattataagccatccaagtataatgtattttcaattcagtaagtagccactattctggtcatataattttttagttttgtgccttttttccttactattaaattagcatatacccatttcattaataaatacctattgagtatctcctcttacaccaggcactattccaggtgctgggatataatgctgaatgaataacataaacaccccagtgagagagacaaataaatagatatggaaaatattaaatggtgctaactgctatgtggagaattaagagtggtatgatagaaagggtctaggtgactactttagtttgagtgatcagggaaggattctctgaggaggtgacatttaagctaagacctgaatgatgaaaagccagacatgtgaatattgaggtggaacattccagggagtgtaaaggccccaaggtcataaggaacttggcctccaacaggagctgagaagaccagtatagctggagcaaagcaaaaggtgagagccataggagatgaagtagaagaggtaagtaggggtcagatcatgcaggactatgtgggccaggataaggtacttggatttgatttgaagtgctatggggaggctttgggagattttaagctggagagtgatatgatctaacttaccttaacatatagtcaggacaggatcatatagggaagaaaataggtcaatactgagaacctgtaattcaaacacaggaaaaagattgcatttgctgctaaggcgtactaaatagcccagttttccttgaaaaatcctaagcctaagagacaagaaatttggccaaattccattgttttgattcccagctccaccatgtaccaactgtgtaaccttgggcaaattataagatatctctctgcactggtttctcatcattaaaatgaagataataatagtgcctgcagataataatagtgcctgccttatagactagtgaaaattgaacaacattgctgagaccagctcggtcggggagaccctaacccagcggcgctagaggaat

SEQ ID NO: 53242 - DNA, 1042 bp, Homo sapiens
gtgctcttgtgcagtaagttatattctgaatcactataccataagcataatcaggagaaagtgatgtttggatgccaagagaacaacggtaagtttcaaaaagaaaggaatagtcagcagtgtgaaaggccctaaagacatgaaatgggaatcctaaaaagagaagatcattggatatttttttaaaaatcattttgctgtaagttacagtaaggaataccgggatgatagagatatggatatctcagaatactagtgattcagtctatcagttctgtgggccagtgattataatttcatttaattatgaagaagatataatcagggactattaaaaatagatcatctccatatttaagtacttgatatattaacatgatcgaaagacttttgatcttctgctatctatagtcatagttactcttaggtaactatgattgatagtgacaattttgtttattcttctgtactttctggttttgataaagataaaacttagcttgctagtttagtggatttttcagaatgggatgatattctaaagaacagtagtagttcaatcccaaatatttcatagacaagaaggtgaaagagaccttataagctgcatggtatgtggaaagagttatatggcttatatatatatggcttatatatatatggcttatatatagggattaagagtcctgattcaagtcccagtttgccactcagtggttctgtgatttaggcaaggagttgccgtgaatgatttctaagatctcttctcactctcaagttctgtaactattaggtcatttattcagtaaagaaactgaggcctaaagaagggacttgtttgtcgagggtcaaaaactggaatctggttctcttgactcttggtcctggatatctgatggaagaatcatcaaacatttgaggggctgccacatagcagacatgtattaggtgctcgaaaaagcaaaaggcatgtgaaattgtttcagaattcatttatccaatttgtgaaagtaacaatcagcatcttctgtgtttgtttgtt

SEQ ID NO: 53243 - DNA, 2172 bp, Homo sapiens
tcttaaatggtaggtaggagtaagtgaggcaaacatgagcagaaagcgtccttcaaacagagaaaacagcttgagcaaaggcatcaatgtgagaaaaggaatggcttgcgtagagaaccacaaacagtttgggactgctaggaatataacaataagtgatgagttgtaaggctggaaatacagtcagaggccatgtcgtggtggaccttgtatgcataagtatcctaaaatcaattcagtaggtgttttttttttatttttatttaatcactggaaggtgtctatcagacatggttgaagtaacatttttaaaatgtggtcatagggatgaagagaaagaaatgaatctgagaaaatgtataaggctttaatgattgattgtatgtgcaggtgagagggtgaggagtcccgtgtgatgctcaggtttttgccttggatgactaaggaggatatgttggtaattttaactgagacaggaaacgatgatgagttcaattctggacttgaagattttcaatttcttgagttagatcagtgagcaaatatagtggaagtaagctgagaaaaaaaagaggtgtggtcagaaagtggaatatcggagttaagttgtctgatattgggactgttctaggtgacagcgaggtctctgtgtatgggtagctaaaatacagcagaggcgaaggtcagtaaagctgagtatgacaaggaatttggaggctagtgtattgaatgagtcatctgtgtagagagtgaagtgattgaggatgatgggatgtggggaagagagaaagatgtgacccaggtgcagtaaagataggggattaatcaggagggtggtagatgacagatgaggaggtggggtagagagttatatagccagatggtgcaaaccttgaaggaggaggggtttttaaacacaagagtgagaaggtaatagtttttttacttttccttcctggaagcagagttctgatctctatctttattcaggactcatattaatcattctgtttgctctgaagagtctgttcttagtcttggaaagtgggagggcacatacctcatattgaatcctttctgctaatacttaatgacaaagggcagtggaggttttttcctctgatgatcattagtgggtgggtagggaacaatcagataaagcagtgaggatatacccatggttttctagacagagtatagtggaaagagcctaggctttggagttagaaacaccaaaattcagatctagactctgtcacttactagctttatgactgtaaacaaattatttagcctctgtgagcttcagtgtccttatctgtaaaaaatttatacttcataggatatcacaaatattacatgaaaaaatatatacacacataccacataaaatcacaagcgattggtgattcatagatacaaagtaaatattagttcctttcttccttcatttaaggggcttatgctctgctagctgaaatgaaccttttacatgcttacctaagttataaaatagaacatagtgagtactctaagggaggtagtagcaaagtggtaaagcagttcagaggagggagctgtcatttctaagcatttggaaacaaggttgggcttcatttcaaaatgaattttacttgggccatgaacaaatttcaatagagtaaataatttaggtagatatataaaatagggaaagcatagggtatggtatctttgttaaaaatagctaccacaggtttgagtattgtatttgtaaaagctaatagtaggaaatatggctagagagatgggctggggcattggtattaaagatccgaaactgtgatgcagtttggagttgattctggatacattagggagccacacattggatgtcttctttctctacctcagtttactatctgtaaaatgtataggcatcaattcagaaacttcaaatttttgtttgcaataaacgaaataagaaattccacacttgaaaagaagttcctgtgtaggccaattttaggttaaaaaaatctaagatttgttttgtagttgtaggttaatctttgcagtaatcttatttgattgataggcttcgtgaggttaagaaacatacaagatctcactggtagaaagtgaccgaagaagctctaatttcaaattctgtcttttttattccgccatact

SEQ ID NO: 53244 - DNA, 1111 bp, Homo sapiens
ggacacatttggttataagttgaaagaaacagctggctcccatccttcctagttcttttcccttatgggaagctgttaagatatctgaagatagtaatcatgtcccctgagtcttcacttccactttcttcagttgtctctcatctgctgtggttctctaaactgtcctctggatgagctttagtttcccccatccccttaaaggagagtttcttaaaagtgatcctggagacaaaacgtagtaagtttctctaagaaacagccccaaggattgacctgcttaaatcaaaagtactctagattcccttcctcatttctgtactgtattttgaacttaaaaaaaaaaaaaaaagaaaacatttagtagtgtttgttcaaacaaactaaaagacatcttattttgtggaaatttgggggtttccttccttttaaaaaatgtctataaacactttatcaaatgttgctaactaatgtacatcaaaatgttttgttgaagtgtaatgtgccaggcaaatagaatagctctttttttttttttaaactctgaaaaggattgagacctagtttagtgccaaactgcaattttaatatttggttgcagagggaaatgctttattacattgaactctttgctctagttctaactgccagcaggaggcccaaaattactatgaaagagaacactttttgttgcttacttaccaacctcctaaactcttgcctaagcaactctgcaggttagtaatgttttaagcccagtagagatgagatggccttgtagataaaaggccaggctcttacatctgggatcctgtttaagtactaagcaaagtttcagtgtttttacaacttagacaagcacataccagcagtcagaattggttctttatttttgttcttaagccttcattttttaaattggtcaatagttttgaactttgtagcacatatgtcaagttttgattttaggtatgtttgtgcaaatgttgttcccttttatgtaagttgggtaaacatttgcatagcaccattctcaatggaactatacagatccagaggaaaggccctgattccttccttgcaaaggacttggagtgaaaggtagaggata

SEQ ID NO: 53245 - DNA, 1030 bp, Homo sapiens
acgttttataaagtctcctttgttccatgtagggttttcattttgattctatttaatctgatattaatatttctatggcttcattatattttgttagcatatattaatttctcattcttttttttttttttttttggagacggagtctcactatgtcacccaagctggagtgcaatggcgcagtcttgcctcactgcaacctccacctactgggttcaagcgattctcctgcctcagcctcctgagtagctgggattacaggtgtgcaccacaacacctggctaatttttgtatttttagtagagacagggtttcaccatgttggtcaggctggtcccaaactcttgacctcgtgatccgcctgccttggcctcccaaagtgtgtgagccaccacgctcggcctcatttttcattcttttaatcattttgtatcgtattgttttaaatgtgactttaaaaaatatctgcattgtgtgttgacctgagcatatacacatctacttatggatgttggtgagggttcttccctgattctgagagtctctgtagtttaataggagagttgaatccattaacttttattacaatctctgatatgtttgaatgattcctctgctttttgtttgattgatcaaattttctttatttctgtttttctctatttgttggcaaattatatatttgtatgacacacctattacactattacactaatagtatgcattatagtattttatttttctagcgtcttacattttaaatagagttatttaattgtttttcttccaatagtgtcttaaatctcctcctactgctcatactttgttgaaactttagttacaaatgttattttattttatccctatacttttaaaagaaatcatttcttaaacactgtatgaggttttatagatccattttcatgtattattcagattttagatatttactggtttctttcaaatttttgtaaccctatgaaattctgtttctcggatttcttttttgttttcctgcagtacctaatta

SEQ ID NO: 53246 - DNA, 1040 bp, Homo sapiens
tctcctccatccatccattcaaacttaccaattcattagactaatgggacagagcacctgactcagggaacttatgacttatgatgttaatgaccatatggaaatatagccatccccagggcaacagtgagcacatcacggtttgggagtagctgctgggcccaaaggaatatcctgaggcatctggcctgtgttcttctggggcaggctgggatgctctgcctgtccttcctagaacgctcctgtccacagagctgtgtggcctgtgaaatgttgtgcacctgttggggaactgaagctgttgctactgttccctgattccacagagctgctgcctccactcttcagcttgtgggctggacctacaacttggggcaaagtcagcctcccctctgagggctttgtaggcatggagcaggacagaggccttgcccaggccttccctgaaccaccctggtcctgtgtctgcactgtagattggcctggggaaactgaaggcccagaaatgggacttctctatggaaaccaagcttgggcccccagccttgtggctcctgagtccctggctagtagacttccctactctcaccttctgccctctcgccatgcctaatattaaatttgccctggtttctctacctacactttagaattctgccctgtgagctgccctagaggtgtcctcagccagaagggcatgctcagtcctcacccgtcatgccggtcaatgggagcctcccacgtcatcccacacttgagatggccaatagtcctgcctgatgagtgtcaccagctactagggccagacttaaatcagaagcaaaaaaaaaaaaaaaaacctattgcacttgagttgtcttttaatttcttttttgtttgttttttaaccagcatctcacttcctcattatactgtctgtcccctcacagccctcgcccaccccacctagctgctgtgcactgccctgaacagcagctgtggctacacttctgggcctgagcaccggggcagagggataccccagctcctgcccagccctg

SEQ ID NO: 53247 - DNA, 1050 bp, Homo sapiens
tggtacccactgtcacaggttggcttcctcagaaacagactcagagatgatggatctatgtgtaggaagttcactggggtgggagggacacagggtgggggagagggaaaagttgaactgtgatgcaattccaacaagggcctgagtccatgctacagagttctggagctgaaatggctctttagagttgtcccacattgcggcaaaggagccaggtctttgtccctgtgcgagtgatcagtcagtggataaagactgcttttgggaaaggtgtatggccttggtaacacagctcccttcagaattcctgggagagactcaagtgtgagctgtcagcagacaacattcccagcagccagaagaatgagtggctccatgctggaggggacctgggcagtaccgcagcatccaccatagcctgtcatcagggcaccaaagatgtattgcttgcaggtttctcccactgaaggacataaaaacacctttctcctgtcttatttttgccttgtttgaatattcatttattggtcacatacttgttgacatttactgacttccaacttatgggatgggcactgaaggggcagaaatgaattaggcaaatttcccatcttggagcttgcaggactttgtggagacacaagtagacagagagatagttagacatgtatttccatgtagctcttccagctgatgaattgtacaaaaatacttcttctgtgatggatatgatggtcacttcagcattcaaatctacggggtcaatgagaccttgacatgaagtgcatcacacctgaatatgttcaccttcattcaatgcacagagatcatggaagctgataaacccatttgattagctttttctgggaaaatgaaggagggaaattggaaagattgccttgtacatgcaaatgataataaaagtaactaatacttattgaatgcttatactgttctgaaaattacatacagatctttccgctttacaggtgaggaaattataagagaaagttaagaattcttgagctttttttttttaactgggaacat

SEQ ID NO: 53248 - DNA, 1037 bp, Homo sapiens
gtggggctgggatggctcctacagggccagaaggcaaagaaagggcagcagatgggcacagcagggacaagggtgtggtgaggaatctgactgctccagcccaagctggcatggcctctctgctctcgccttctgccctctttctgtaatctttcatctctgaggatgttgggccattcctgggtccctccttcttcctgcaattctctctacccttccaccctgttgccctctcccctccctcgcttcctattgtgtcctgcccactgccgattccatcctccttatctcatgtctatccatgattgacatgatggaaatggcacagtagagtccaatggtgataagcactctccgtgtttgcaggtaccagccatgaccaagagcccttcacatcatctggcaatccatccagaacccactgaatggaggacagcacagcgaggtctttctcattttgtaactgcaaaagctggaacaagagccagagaagccaaagaagcagtacaagtccaacagcttttagaataaccctgagaaaatggttgaattttgaccagttttgcaattggatactatgagaagagaccttccctcctgcactggatttcatcatcatacctggaggccattcctcatgggactttggccatctcatatccacctttaagcatgttattcccatttcagctgtggtagctctgggtatccttccctaggagaaaatattaatcttttctccctctgagttctggattaaactgtcttatctgaaactgggtcactttaggctagaagcaccactagacattcctgttctcagaagttgccaagttcatgtcatatctgtttcattgttaacgggatccacttctgcaagaggctgcctggccagatcagtgtgtctcctggtcagctccttgatgcccttctcctctcccctgcccaatcccagctgagacttgcactgtggtgactctgtcccctcctggtgctttgactggatgtgtgagagaaagtatggtctgtggcactga

SEQ ID NO: 53249 - DNA, 1467 bp, Homo sapiens
tcggcatggaggaccagaaggggaagccctaatttgccagttgcagactcttgagccttgtgactctaatgacgacaaaaattaggagattttctaggactccacgtttgcgattttgagagtagtgctgctggggttcctggtttgggttctattgattgtttcattgtttctgtgtgcaagttaccctctctaagcttagtttaattaatattatattaagtgaggtagttagattatatgaaccctaaggctccttttattcttaaccttaaaataaaaacattttgtaaacagtttttctttgtgtgtgtggtggccttttctgtgcctctgctttggatgaggttacagggctgagtgcgagtgagtcattagtggttcctttgatataagacaggtgatactattgaacactgttggtggtagaccagtggttctcaaagtgtggtctctggaccagcaatagctgggcttgggaacttgttagaaactctagctgtcagcctccaccccagacctactgattaaaaaaccgtaggagtgtaaccaaaactctgtgttttaacaaagtctacaaatgattctgatgcatgctaaagtttaggaaccactagagtagagtatgtgctttaagatttgggtctaccggccaggcgtggtgtctcatgcctgtaatcccagcactttaggaggccaaggtgggtggatcccaaggtcaggagtttgagaccagcctggccaacatggtgaaaccccatgtctactaaaaatacaaaaattagctgggcatggtggtgcatgcctgtagtcccagatactcgggagggtgaggcaggagaattgcttgaacccaggaggcagaggttgcagtgagccgagattgcgccattgcactccagcctgggcgacagggcaagacttggaaaaaaaaaaaaaaaagatttgggtctaccactgatggatccttacattccagtcactgtcatggtcacagcaagtagttgcatgtctgtgcaaatattgcaataagatgtttattcagcttggcttggtgaacagtcctgtgactctaaagcagaaaatgttcctggcctgtgctaggactggacccacactctcctccttggtattatgtcccatccactcctctaggtgagcatctgcatggaggaggggttagcaaggaggcaggctgcttccagaagttgtgacagagtgctgttggatgtgcttctggggagactgatgtaattggagaagtttgtgcatggttagtttccacacatttttaaagtatgaaactgtcttgggtttctaagtccttggtagatatatctgcgtgcatctgtcgtgaagatcagtggtgatgaaaggtctcaggtgccatagaataagcaatctggtgaccctgctgcacactgagtttagagttctgattcagtttggtttcccttatctaaatgt

SEQ ID NO: 53250 - DNA, 1051 bp, Homo sapiens
ctagaagtgaatgatattgagtagatataggtagtttagcctttaaatgcaaaagtatatcaggtactagggagttaattattctttcttagtaaattgagaaagctgatggatttttggccgattttcagttctacacattgacaattctactttaacaggttatttctcccgatacagcttttattccaaacctggaacagagtgagttaggattagagatggtctctttcctcttccacttactagatgcccagaaccactcacttttttctcttatggatgcctatttttttgttttgttttgttttgtttttgcttatttctgtcttgggccagagttgtaccctcctatctctccaatctccagtttttatagaattataggcttcaccacctggagaccagctctcttttggagaaataaagtgaaagcatctagttctccaatactatctctctcaatttccaacaaacaggacttggatggcagctggcatccccagctccccttccattgcccatgtgtctgagttgcgcttggctgaactcaacttccatgcctcttggccaagggactttataaactctctttgtccaagaggtttccgactgataactctgatgtggtttactgccaggccagcgggtcctgctgctcacttcttggtgtaacttctgcgcaagggacagttgggttgtcattgttctcttcccttcctgtgagcctactagtggtggggcacagcagatggacattctggctgccatgggcctcccgcaggcccaggggagggaaccgtgccagtctcacgttcttttcccattactgctgcttctttgccctgttaacctctctgttcacttctcatccagcgagaagtgaaccttcatatggttgcacctcatatgggtgctgtcttaggtagtcatgtgggcactggttggtgaagggttccctcttttaccatctttcccagagttcaaggtggtaagagctcaccttgctgctaccgcagagtagtagggcattggcttcctctgtcctctc

SEQ ID NO: 53251 - DNA, 1088 bp, Homo sapiens
atgcaggatcagactctcagctatagcagtcagttggagtccttggatagtagtggtggctgagacctgcaggcaagaaaaataaatctatacctggaatatttgccaattctaatcacgataaaatattgtccttttcagggtgggagtaaatcaacttgtcaccatcaagccagttggtctcctctaaggatggtgccatctcagggtctcagaattggcttttgtggctagcggtttgaatgtttagcagcatcaggagctagatcatcttcagaattcaggagctcctgctgttgggcctgtgggtagcgtctatctctgtcatcatggctgctccattcatgagccattgcataagccctggatagccaaggacagaggccggctgaagtctcctgtccagtggtagttaagcacctcttccatcatcagtgctcactggttggccttaacacacaacacagagctcatgtcacttggtgcccactcccacaggtccagccacatgcccttggacagacttccatttcctcagtcttctaatctagttttacccaagcccctgacccaccatccaagccttgcacgactgtccatgagtctgtatacatctgtctttaccacgggccacttttctcttcatgcaaagtgggtgaacagtcctgcttcctgaagctttgcccattgggaggcaagctgacctatctgtgagccaagccaagccttgggatttttccttttctgtcatccaggaatgggccatagttgtgatctaggagggaagaagggttgctgcaacagtggtgagtgacatagtgggggtgggcctggtcatctgcccctgcagcttgtgacccccggccctgctcatgtgaaacctggggtgtacctcttctactttatgaggattgttgctgggccttcttgaccttatgacttgctggatctgactgtacttagttcaagatttacagctctgcccatatggtcacttgctgtttcatgttcagatgttcagttttcaccaagtttcaataactaccaggagctgttttcagaatggtgtataatcctttacttacaat

SEQ ID NO: 53252 - DNA, 1007 bp, Homo sapiens
gctttgaggccaacatgaggaccacagaatcggtggaggatttgatagggatagaggccaatgggcaatgaccaggtggaaagaaggcagttgatggaggccagggcaggcaccatgtccccaaatgcctgagaaaccttagctagaaccctaacaagaagggtgatggtggtgtgatatcttgaattgatcaagttaagcttgaaatgattaattttacccagaagtaactgagtttacctggaaataacctagatttaacttctaactttgaagggaataggaggtcaatacagaaactaattctttttataaagagaaaatatatttgactttatacacgtgagtctagattttaaaatatttcactcagtgtatcaattttcacttctaatcccttgccctccacattatattggttttccagatactctgaaactctacattgtcaaaagaattgaaagaaagttgacttgtgttaatagaaatgtacacaggattctttttcaagatgacagactaagtacattcgtttgcctcccctgccttcttggaatcttctgaaatggtggctaaaggcatctagaaaaaaaaaatttgtgacaactctgaaaacagcaggcagtgctgtgggtagaaaagatatttcatcaagacaagctagatgggcttgcagtttgttatttcagtgggaaaccgtgtcctagaactaaatgaagaattgtgtcagaggagggagaccttgttcagacaggatccaagctaggaattagcacatatggaggacaagagtgagctttgaaacagtggtctgggctgagccttggaggtggggtgggatgaattaaagagcagggacatccctcctcttggtggttaactggaaagatgtccttgggacattttggttaagtagctctttcctttctaagatgtgtatagagcaatttgaattctaagaatggttttctgaacttatgaatgattttctaagggacagccaaagg

SEQ ID NO: 53253 - DNA, 1059 bp, Homo sapiens
cccatacaacatgcagaatttgcgggttccagagtgtccagcatcacggagccaagccaggacgtggggcctgaactctgcccctcacagtgccccactgtggatcgcctggctcccatatgccacgaacactgcctgtgagcaccactgggctggaccggggccagcacggggggcacagccaggaagcaggctgcagcctggcctcatgctctgggcttctctcttccaggatggaaatttctccttttctctggagtcagtgaagaagctcaaagacctccaggagccccaggagcccagggttgggaaactcaggaactttgcacccatccctggtgaacctgtggttcccatcctctgtagcaacccgaactttccagaagaactcaagcctctctgcaaggagcccaatgcccaggagatacttcagaggctgggtgagcagcctccttcctctctgattggtggggttcgggaatactgtggtggcacttgaggaagagatgtgctctgattggtgggatttggaggaagggctcagctctgactggtggaactagggagcttggctctgattggtgggtctgttccatgcccacttcaattccaagttgtaactgctgaggtttgggaactaagaccattcatctggtcttagtttcctctctttctggtggaatctctgctttgattggttggtttgagtggtctgtgtgccctggtttggggcgaaaagcccagtaggtcagagtacgggcctgctgagattctcctggggctgggtggtgacgtacaagctctgggccaagggcggcaggggcctcgcgaggaaatgctggttctcacgaggctccatctctgttgtgcagaggaaatcgctgaggacccgggcacatgtgaaatctgtgcctacgctgcctgtaccggatgctaggggggcttgcccactgcctgcctcccctccgcagcagggaagctcttttctcctgcagaaagggccacccatgatactccactcccagcagctcaacctaccctggtccagtcgggaggagc

SEQ ID NO: 53254 - DNA, 1602 bp, Homo sapiens
ttggcacttttctcgtgtcttccttactgcagcctggtataatggaaggagtgtggatcaagtgaactgacctcagatcctatctttgtcccctactggttgtgtgactttgggtaatttactcatcctcttaaaccgtatccccttacctataaaataaggatcataagagccactttttgaaggcttatggttgaattagtgagataatgtgtgcctggcatataggaagtacacagtaggggttagtttatttcttactttcttctctacccaagtcgctgctattattgcctctttccttccaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccgaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctggg

SEQ ID NO: 53255 - DNA, 1039 bp, Homo sapiens
catcagggaagtagagaaataggtggtgatgtagaaagagtccatgagtggctgggtgcggtggctcatgcctataatcccagcactttgggaggctgagacaggtggatcacttgaggtcaggagtttgagatcagcctggccaacatggtaaaaccccatctctactaaaaatacaaaaattagccaggcgtggtagtgcacgcctgtaatcccagctacttgggagggtgaggcaggagaatcgcccgaacccaggaggcagaagttgcagtgagccgagattgcgccactgcattctagcctgggtgacagagtgagaccctgtctcaaaaaagagagtccatgagttaggagatctggattgtagtcctagcactgtcaaactaatgtgtctttgggcaagtcaggttagcctttctgagtttcagttgcctcatctgtaaaatgggtgtaacaatccctgtcttaccctcctttggggcttagtgggagggtcagatgaagtaatggatacaaaaatacttttgaattgtaatgaggtatgtgatagcaacaataatagacataacttgcctaccagcgtacagttagtggcagcgctagcattagttcagtgtgttcacacccggcctggcaccctgttcaaaaggccaagaccacaattttagcatctgaaaggagtaatattttcttccccctttctccttattttacctgcttaatttactttcagagtaacaattctgttaagattttagtgctccatttgttttatttgtggtaacatgttttccctctttctgcttttaatctgattaggaaatttgtacatagattctaggcaaaatctccctccttcagtgatgccaccccctggttatcctcatatcccacaggcactcagcactccaggaacaacgatggcaggtaagagagagagagagagtgagtgtgtgtgtgtgtgtgtgtgtgtgtgtgagcactccaggaacaacgatggcaggtgagagagagagtgtgtgtgtgtgtgtcagtt

SEQ ID NO: 53256 - DNA, 1029 bp, Homo sapiens
agaattacgaagccataaaagagaagtggtaaaagattaattcccaataaaaatcagttttacattttcattatgacatgaactcgaaagatgtgtagagtgagagctaagattttgaaggacagagacagggaagttgtgggtatatgagtgaccctattactctgagtggtgtggcccttccagcttggtgcagtctttacaaagtacactaggcgtgcatgtgaagaccgatcagcatttggagacaggattccgccccacgtcactcgtaccagtattagagctgtagtttagtataacttttctcctcttttttctttctaaatcatcagtatggtcagtcagtcaaagaggtcagttctgactataaacttcactgataaaaggcatgttatcatgggaggcagggacagggggtcagaagtcttgaattctggtcctggttctgtctcatttcctctgtccctgtttccctatctgcatggacagaggtaaggtcagattagattatctctgaggccatctcaagcctggatagtctggctttccactggagggtaaagacttgtgagcagccaaatacagaatgccttaccttaatagaagtggaagattttttctactctttttagtttcctctgggaaaatgattactattttttagtttcattacaacattactagaattcaagtgtaatttacatgaaatagtagataaacttagggaagtagcctttccagaattccagatgttccttacaatgtgaaccgcttttataatcattcctcatgagttattggaggaggggtcatgtttgttctctcttttgcattgtgatgtaacgtagttgacattttggaggcgataacacttgatgtctcctgttaatgaaaatatattaagaaccttctgaagtaaaatttgaatgagatccatggtccccatcctcacattctaggataatactcccctcccctcccctcccctcccctcccctcccctcccctcccctcccctcccccacc

SEQ ID NO: 53257 - DNA, 1049 bp, Homo sapiens
ccaattgtaattagtagagaggctgaattagttgtgttttcttttaatgttaggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtgagttttcttaaaatcttttttataacaaagttttattggaaaaaggtttttaaattatttcacatggcagctgttatactcttaatcttagaatattatcatcacaataagaatcaggtaattgtattttgccctttgtgcctttactgtgttctatttatatcatagcacaaaaatggcagataaattttatgttgcatgcctacttacttgtttactagtggcatccaggaacactgtgttaaagaattctgacactgcatctataccatatgggaaacactactataattaattagtgatatctggcatatgaagtgtttgagtggtgaatgttgcaccacaagaatagatgtgccttgcttttgttctgactggtattagcaaaaagagataactatcggaatgtggtagcgccaaatttgtgattttgagtgtggcacttagaagtgaatacatcagctactagtaaacgctaggtcattgttgtacacgatatacttaagtcagattttaatattaaaagtgactttagttgagatacactgttgcatcttgaccaaatggtagattcttgctataatgtgttctcttcccattagctgctggtttaattttaatcagagggtaaaaatgtcacagtatcttttccccagagatgaattgtcagaaattgttgggaactctactgttgaagcatttcctaattacttgtttgtttggcacattaactatttacaccccatgttttattcctttcctgctgctgtgtcaaaataccttagaatgggtaatttataaacaacagaaatttattt

SEQ ID NO: 53258 - DNA, 1621 bp, Homo sapiens
acaaattagaacaaaatatctctcaggagagattggaaggtccttaccgagaagttctatacttgtttaaaaattcttggctctcacagttcccattgatagaatttgtgagccagcattttattgagtcaatttgtttcagaattgttaattacctctccagatatgtggttgaaaaaaagattgtcaaattctggggagttaacagaatctagtaaaataaataattggacagcctcatagagttcactgggatggtggtctacctattttcatgatattcaagtctaggaatatagccagaaatagtacatggttgtttgctacattttgatggttgagtcacaactttgtgatgggtcattatatacctagtgggatacaggtatatatctgtctcttctttataagacagtttcttaatcttacatctcaaaaccctaaaaagactctgggaggttcatgaatccagttttgttcatctgttttcttccctactagaccatgagtactccagagccatatatctctcacacttatgcttagattctctttcagtcttgttttcattttctccctctagctttcaccctctttttttctctccctctctctcattttcattcttccacttcatgcacacacataaatatgaacacatacacatacatcattgcactaatatggtactcctaggatccttttacttgtagaaagataatgattaaacagatgacagattataatcagagtgacatattcagatttctagttcagaaaggaaactggtagcctaggcatagaggaatgattcttcccacatggcagtctctggaataattacatcacagtcacttagagagagggtttatggggcagttggggggtggggggtggtggtagtggtggtaatcccaggattccattgcaattctgccaaatcagttactgtgtcatgaatagggcccagaaatacgtcctttaaaaaatgatctctaatggtgaccagctaggtgagaatttctggtgaagtggttgggttagaatcagaaatacctaatactgctctgtgctgtagtctaagtggtgatgaagacctaaacatagatgatagtgtggttactaggaaacaattaggaagtagtaatgatgggactttatgaccaaataatgtggatgtcaaaggagctgaagattttggttttctgcatccagatatgacagaatactggtattagattaacctttctgcctatctgtgtaaaataccagacatacatagccacacacccctccccacccacctccttgattgaaaaaaaagaagagggaggtattggaaactaagacaaccagggcttcaggggtcaggagcccagagaatagttaaacacattgagataagctttgtatattttcctttggtgcatttcccgattctcagtgcatggcataggggctacacagagagcagtagcctagagcagtcattcaaccagggagacaaaattggagtttggggttaccaaagagccaggggttgcagagccgagatcctgaggaatatcaggggtgaatccaactttttttttttttttttgagacaggatctcactgtgtc

SEQ ID NO: 53259 - DNA, 1010 bp, Homo sapiens
tacatattttaatccattaagagtaaatttcttaacactctaggcttaatttgatgatcaatgtatttaaaagtaataaaaacttgtatttgttcaaaaagggtatttcaaggacctaagcaggcattggaatagttgttatccacatgttcattcggtcaactagccagacaagcagactgcctttgagtacttactgtgtgttgtggtctcagtagctatttaacctattgtccaagctagaaacttctgagaatgaaagtggtgctattcttaactatgtttggggaacagttataaagcaggattgaaactccaagtatggttgctctagatctgtggtgcatgcaaatgctgtgcctgagcagttaccaggaacagcatcctaagaagttgggagaaaacaaggcaaacaaatcttttgaagttggattgccaaaataaactgggagaggttaaaaaaataaaagatgaaggcatggtataaagccaaagaagtcagggacaagaggaatccagctcctgagatgaatatgcattgaaagctaaggaagagcagagaattgtctatgatgattccctttaccaacgggcatatacttggcaatagtaatagatttcaccatttggaatgtttagctatttatgacagggactgctctccccaggagtctgaaattaatattagcatttttggtttatttgtacttaatcaggtaatggcttttttgttaggctattttcaacctaagataaatatgcagggtactttgtgttgacataaaattttagctagaaataaagttttggaatagttaaaatgcactttatttgaagtaataaatactttttaatgatgggaataacaacatttaagtttattgttgatctttgacacatcttcatttctgatgcattttcttttctttctttttttttttttgagacagagtctcactccatcacccaggctggagtgcagtggcatgatcttgtttcactgcacctct

SEQ ID NO: 53260 - DNA, 1051 bp, Homo sapiens
aggctggagtgcagtggtgcagtctcagctcactgcagcctccgtctcccgggtttaagcaattctcctgcctcagcctcctgagtagctgggactaccggtgtacatcatcatgcctggctaacttttgtatttttagtagagatggggtttcaccatcttggccaagctggtgtcaaactcctgacctcaagtgataggaccacctcggcctcccaaagtgctgggattacaggcgtgagctgccgcacctggccacaaagcgaggtttaaatacatttttctctttgattttggtcagacatagatgtaaatttggtcttataaaatacatttatgtgaataaagtcatttttatttttgatttcaaaatgagattttgttttttaagaaaacacaaaattccactgctttaaaaaagctttgaagacttcagctcaagcccatttcataaaagaagaaactaaggccagtagatgaggaacagcttgctcaggttcattgtggaattagaacccaggcatattcgccagacatacttgtcagtcacagaaactcaatacaaactaacttaaagggaaaagtacttaaggaagaactggagccaggttcttaaattatatcaccaggaatgtctcttcatccattagttgtgctaacttctctgatagcttcattttcagtccaattagtggcaagtatgtctttcagcagcttctggtttatattccaccagctgagtaacacttaacagagagagtaggcctggtgttcaccccgtcaccccccaaatcacctggaattacagaaaaagtcttagaatgaatgttgaacaagcaaagcacagttggtttcttagttcttagattagtactttttccatgatatcagtcttccttgagagggagaccaaaatgttagttaagttttggtacttatgaattgttgtttctttttgtattacagtgtttcctgacatttgaggagcttttccaaaaccaccctcaccacagtgggagaaaaccattgagcgaagttggggtgggagtag

SEQ ID NO: 53261 - DNA, 1070 bp, Homo sapiens
atttctttttaactgcttggatggtggccatctctttttcctgtgctctgccaaaggtgatttagttgtgtgtccagtttctcattgaatagccttgctcctcttaggaatgtggtttggttgccttgcaacctgagctctctgatgtggcttaaaaataggttttttttgtttattttttttaaagcttacctagggttttctctttgggagagagcatcattctttgtagctgtttacatcccaagcataagttttaaatttctgctttggtaatagatggtcttgaatttatattctgtagtcatcttttaaaaacgtttaaaattccaatattgtgcctgagggagataagttttattataggcattcttgttagactactgaattttatattaaacaataaagcagatattatgtcaaaatatgatcccagaaggtaccattctaagtaatggctaaatgcagttggacctcttctctcccaaatactagccatttgggaacaaaccaagataatttgagaatgggttttggagcatttaattgagaagaaatggactttggggcatattctgtaagaattggggtacagtcctacctattcatgaacaaatttctttttcacagactctgcaggtttccaagggcattttcctgctacccaccttgggtgttcttccctgctacaatgaagaatttagatgttcttcccagctccctgtagccagtatctttccatgtggttttcttttttacagattgtggtgagaacctaatagggttctatatgtttttttgtaatagagcagtgaatgtttttttaaagcattttttaaactaattaataagtggtaatacatgtgtcttgcagaccatttggactttgcagaaaagtaaagagaagaaaatagtcatcatctttaatttcatgtagagtaacttcttacattttgcattctggcttatttccaagaataaataaataaaataagtaccacaattaaagtcataatatgtatcataatatgccaattttatatttggaatttaatatttaacattacatt

SEQ ID NO: 53262 - DNA, 1035 bp, Homo sapiens
caatctaccttttcagctttattttttgtaccttcctttcatatacttctcgccattccagcctactagctgtccctgtaagtaagcacatctatttccttcttgcttttgtttttttcttatttctccttggaccttgtctcttttgcccccccgccgccttttttttttagttgatattgccctattatttcagctcatgtattatttctcatctccctatagaatcagtctcttgtgttaccatatgctttattaataacagtattataaacttagagtttttttgttcagaaatcttgtttcattagtttttgtttctgtacttagatactcaaataatagctgcttttattattttctgtctgccaggcactatactaagtgccatcattgtctctttaggccacacaatagccttatgaagtaggtactattattttccaaattttaaaggtgaaaaaactgagaattagagaagttaagtaactttgtagagtttctcagctagagaatgatagagtcaggatttggtaccagacttggtagatgtagagatttttttcaatgctcatgttcttaaccattacacaagatgcataattctgcaaaaactatattaaatacttaataaatttaattttccaggataaactcccctcaactggctgactcagtatgagaagtgattgttaacagtatattttgaataggagtctatcctaacagaatgtttcagtggaggatataccgaataaaacttgaatgaaacatgaatcaatgcatcattctaagcaagtagtagtggctctatttaagctgtgctttctggctttacccctgggtactgtagactttctttgtcaatatttagcctgagaaaaggctagaaaattttgataaacctgtgtggcaatgaacacacatggtggctagggagtagaaatggctaaaatttgagtatgtggcttagaaagcccaataagaattcatgggtctgtatcattgattgtaaacctaagtgcctgcagatgc

SEQ ID NO: 53263 - DNA, 1572 bp, Homo sapiens
ttccaatgtgaagtgtcaagccttgtttctatattcttatcttcaattcttagagcagctttctcccttttcgaggatatgtgttaacctggcagatttagttttctttctttgtgtggtaatggtctgaatttttcagctttggagagaaatacactacagaattcaaatcactggacgtttgcccaaacctgtcttttagtttttaatgcttcttttcttgctgaccatttatgtgatttaatgccttagattctgtactcccacaatttcagttagtttttgtaaacctgttccttgacttgttttttaaaaaaagtaactccctggtactgcctaatttaatttttctctcactcatcagtgtccttgactttgcattccttttttcggtcaactcccccagctagcttgtctccttgctattcttgtataccctgctttactcttcctaccgcctacctgcataaactctaccttctttccttcatgcagattcctatgccagtttctcagttacttctctgacctcttgcctccaccttactttttggtaatttgtttttatgactctcctaaaatttgtgtaaaagaaatgccagaggtacattttaagcttttaacggcttgtggtggtggtgagtaaaagagttgggctgcagctgggtttttcttaccaagatcctgttgccctcttaaagaaacaggcagtgatttttagaaagattggcatcggaaccactttgtttgtctatattctgtattttaaacaattttaaaaccaagtttgttatgttttggtgaggaaaaaattaagaaaaaagattggaatgttgatcccttaaatatttggtttgctcattaacatactcaatctttttcctccagatgtaactcaggctttccctcactttggaactcctagatttgtgaatattggatattttgagaagcaggggttctttccttgatattgactaaggagtctatttaccttcaggatgacatctgaactggagagcagcctaacgtctatggactggttaccacagctcaccatgagagcagccatccaaaaatctgatgctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaaggtaaggattttatttaaattattacttttatgaagtaagcaatgatgttgatttctactgaaaataaagctttgtgaatgctcatgtaattgaatatgaaattttgatctctagtgatttttaggatgtcaaaaagtttttagcttaggtgaataactttatttttggtagattattagtgtgttgaagcttgattatgttataggactgatgtagcataaagtaagagcggggataatgtagcgtt

SEQ ID NO: 53264 - DNA, 1043 bp, Homo sapiens
tcttcacttagctgaagacttgctaagttcttccttctttaccctcaaggctttagtccatgttgtttattccttttcctgaaccttcatagcacccacagctcagctgtgtacttttattcagttctttgttgtgtctgaacttctttattggattataagttcctggaggacaggtatgtgtgtatttttattttattttattttttactgtaacatagctctttacacatgtataatttatgcatccttgttaaatatataacacatagtaaatacctgtattactgagattcttataaagtctcattactggcactggtggaagggagcagaaggcaaagatggttctcagtagggagcacctgcaataacaattatattccaatttgtaatatgcttttgtatgaaaatgcatgtaactggctgctttgggaatttgaacaaaataaagctctactccatggagacttgattgaggtaaattggatgacagcatggtataaaatagccaatctttattgaatgaaatgtgaataataatataagcaactactcttattaccaatacgagtagttaacatttgttgaatacttattacttgcctggcactgttctgaatactttacatcagtgaggtgggaactatttaaattttttcatcttacagatgaggtatgtttagcaaaactaccagattgggtatcaggagatctgggctctggtttttgtactactgctaactacctgtgtgaaattggatgagctttaactgcagtttttcattactgaagggattcatctctgatctctagggtactttctctactgttttgacattgtgtgatctctaaattatcctatcttcttattctacaagtccctataacttcttgctgggaacaggcatttctggttgagattgtagagtaggatagtaagttttttttttttttttttttttttttttaagatctctgaagatgctatatggatgaatttaaagttcaggttcagaggaatgtgtacaatagagatggag

SEQ ID NO: 53265 - DNA, 2104 bp, Homo sapiens
ccttttttaaataaaaattaaagtggttttgtgtaaaagactcagtctaatttttctttgaaccttagtgcacttgaaattataacaagaaatctaaaggtagatagaatgtatttatgatcctctgaaaataactccaactcaggtaatcataatgagcagtatggaaggtctgtaatatttattatttcagacattttatattgttaaatagcttgtgtcagattgcgtatcagagaagacttataggtaattcagagattattttttggcctcttcagatgctgtgcatttcatgcaaagcctgacatgtgcatgagcagggaagatttttgtctttttaaatccacagcatagaactgaattgaattgtatttgtatatgttgtacactatggagacttttgacaaagggaaaataagcatgtctttttaaaagtgtttctaacaaaattgattataatatttttcatttattgaatgcttactatgtgccaagcattcactgtatgctaaatattccacatgtatcttgtcatttattcctcagagcacttctttgaggcttagaggtttatttgacttctttaaggatacatagttaataagtgggagagtaagaatttaagcctaggtatcacagtaacttcaaagtccttactctttctgttatatataagaaacacacatacataattatatatattaagaaacatattcatatataaatattgtatatactatattaagacacatgtctaaatataagaagagaccaaaagactgaagatcagtgttgcttatttttcgtcccttaaaaaattagtgcttaaagagcttttgtttatgtgggttatatctgtcaatatttattgtattacaaattaaaattaagaaaaatttaaaatattcacataaaaaataacaaaagtctccgtagtgtacagcatataacaaatataattgaattcagttctacattgtggatctttaaaaaaccctttgccaacatagataacaagttttatgtaaagtaactgtatgttccaaaacaaaatttagtgagaaaattggcattacattatatttttgcagatcttttaaatatctgacttaatagaagacagctggattctcatctctctctgcattaaatctgttgtgatatcacacaccacatagtatctgaaaagctctactatacactgtatgagaggataagagtgaaaaaaggcaaataatgttttatgaaaatagttttgactcttcagactgcctgaagggtctctggaccacactttgagaactgctgatccataaacaccacatatagcagcttaaactgtttctttagcattttctgtacatcatacttaacactaaaagacaagacaggatcactttccaccgtgttagccctctgccagcattgatgccatacttacttgtataatgccatggaagcagaagtagagaaaaaaactgatgaaagaatatccagtaaatgttggctggtgagctgaagtagtatggttgcaaacagaggtcaggataaccactttaatgaaacaaaattagtggacatatgttacttgaaggatgtgtgtgtgtgttctaaactggatataagaaacattctggagcagattctgagtttttaaattacggctgcaaagatgatgttgaatcttcttatgcgaaagactggttgtgttcatcaatctttacaactactcagagacatagacattttaatagggtgagatttaaatgcaaaatacaatatttacttgatgacagaataaacatttggttaatgttcaacagtctttattttttcctcccctaaattgtaaagtgaaatattttgaagatgagaattatagcataaaatatctttgaccatatatgatccttaggtttgtattctaagtggagttctatttttattttatttttttgtgacagggtctcattctgttgcccagggtggagtgcagtggtgtgatcacaattcactgcagtctcgacttccctgggctcaggtgatcctcccactcttagccttctgggtagctgggactacagggacacactaccacact

SEQ ID NO: 53266 - DNA, 1111 bp, Homo sapiens
tacaataaaacatgagaaatgtaaaaagtaggaactgttgtgttgtgtacaacacagtggtttcagatttttgaagtcaccagatgagttttgccaatcaattcatatgtgaagtcaaattagtaaagcagataaacatatgacttctttttgctggtttaagcttccatgttctaccttcacactggcccctgagggattgtcgtggttcccagagtgaaaaataatctaaacctaatctgctaattgaaatcttagaatatgaagtgttgatggcaggacctactagttacatgtggttgtgcagtcagccatatcatttattcatctagcatattgagcatctactgttgtcagatactattctaaatgttggggcatagcaatgagcataacatgtaaaaatcctgtaatcatggaatttatattttggtggagggacaattaataaacaaaatagtataagtatttgttagtgatatgataaagggctaaggagaaaaatagagaaggggaataggaaataataggagtatgtgttattttagacaggccagtcctaagggaaggcttcactgaaaaaggggacatttgaatgaagatcttaaagtatgatggagggagccatatattggataagtggtagtcgagcattctttaggcacagagggagtgcaggaaggtccaaggcaggaggctgccttgtatgtttgaggaggagtggaggaggtcagtgtggttggagcagcctagatgatgaagtgttacaattgcccagctttggagggcagaaggagagagaggacagatacaaaattgccagagccatgattgggaagtcagggaatccttaggcttgagagaaatcctgattttccagaatgccacacacacacacaaaatgaacaatgaagttacgtttgtagtttttacatatttgacttttcacaagtcaaggctgactatcctatttctcagtagaaaagcatttttttttttttttttgtaaaacgactgttgttatttctttagtgtccactttctaccgattagacttccttaagatattttagttgtgggaaatgctgaaacactcatatattaatgtaat

SEQ ID NO: 53267 - DNA, 1111 bp, Homo sapiens
cttatgtctaactttttgatgaactgccaaacattcccaaagtagcaacactattttacacttgtactagcaatgcatgaaagtttgaatttctccacgtcattgcaacacttgttactttgtgtctttttgattatagccatgttagtgggtatgaagtggtgtcttgttttaatttgtatttcccggctgagtgcagtggctcacgcctgtaatcctagcactttgggaggccgaggtgggcggatcacctgacgtcgggaatttgagaccagcttgaccaacatggtgaaaccctgtctctactaaaaatacaaaaaaaattagccagacatggtggtgcatgcctgtaatcccagctacttgggaggctgaggcaggagaatcgcttgaacctgggaggtggaggttgcagtgagccaagatcactccactgcactccagtctgggtgacaagagcgaaactccatctccaaaataaaaaattgtatttccctggtgattaatgatgctgaacatcttttcatgtatttattggacattcatatatcttctttgtagaaatgtctgttcagattcttgcccattattaaattggattattagtcttttggttattgagttgtaagagttgtttgtatattctggatacctaacttggtcttctaactgcagattggtcctaaattgcttagagataaagtgatggatacaaaagactgtattaagtaaagacctggtgagttgtcagatctcattttaagtttcttttttccccccaatttttgaagaatctggtttattcattcactgaataaatatgagtgctggctttatactaggttttgggaatataacagagaatgaaacatggagctcacattctgatgggggagaaataaaaatcatatcagatggtgatgagcttttcggttttctatttctatttatgaagaataaaataaggtaatagagataatgtgatgaaaattctaacattctctacctttcctgaattcttaatctataccttctgttcttacattttctacttaattttatttaatacaacttgtagctaaacttttatttttctttcactcctgattct

SEQ ID NO: 53268 - DNA, 1036 bp, Homo sapiens
atagtggtagtttccttgataattttttcaggtgtatgaaacttttttattggctgtacatgtatcttcattaaacgtgtttagtgaataaacaatatggtttaaaaatagtggaggccaccagaaaactattgaatggttcaaggagttatagatttgtaagtaattgttttttctagagttgttttctggtgagatagttacttttactcaccctttcctgttccagctttggggtttgggggtggatcctgtggcactagtgagagaagcagcaggaatgtgacagaataaaaacatttgtgtgtggtggttctgaacttattttttttcctaactgctttgttgagatataattcacataccatacagttcatctagttcagtgtaaaattcagtgttttttagtatattcacaggattgtgcaaccattgctacagtctaattttagaacgtttttctcctgccttgaaaagaaactccatacctaatagcagtcaatctctattctccatttactttttctcttactgctaaccctaagaaactgctatctaattactcacatgaatttgcctattttggacgtttgatgtaaatggaatcatacaatatgtaatcttttatgactggtttctttcacttagcataatgttgttaagggttatacatgttgtaacatttattcctttttattgtcaaacagttattccattatgtggatataacacatccattcatcagttgatgggcatttggattatttccactttttaaacaaaacaaaacaaaacaaaacagggtcttgctgtgtcgctgagctggaaagcagtgacacgatcacagctcactgcagcctccacctcttgggcccaattgatccttccacctcagcctcctgagtagccggaactacaggcaccagccaccatgtctagctaatttttgtatttttttagagatgggatcttgccatgttgcccagactggtcttgaattcctgggctcaagccatctgcctgcctcagcctccca

SEQ ID NO: 53269 - DNA, 1850 bp, Homo sapiens
ctgcatttggttgttatatttcttaaatctcctttaactgaaccatagccacttcccactctccccaccttttggataatttgacctctttggcccttcacgtctctatctgtaccaaattctgttccttttgaaatatctgctagattttttttttcttttatgacaattcagccatcattttgaagtattatgtgtagaacatgtgctaggcattatgggagataacaagttaattcgatattccagtggtagggacagatgtttacagaaacaacatgaaatggattatttgtcctccaatgcatcatgccttgatgataaagtctcccattttttttccctggaaaatgatgccaatggaatcttcctcatacatctctttaatcatatactgatcaggaacccacgtttggtttcctcttgagtcggttcatacttgactgtttttggcctgtcactcagttcttccactggctcccactgttatccaaagtggcgcaaaaatctttttatttactttatttaaaaaacccacgtttatgttatgtagaattttcatttctccaacaagattataaacatctggagagcaaaagtcatactgtcttctttttctttgtaatactgggtgcttaataagtacttttgaagagtcctggtacatacatcaggtctgttcttctgtttcctacctttctagagtcagctggagattctgccagttaaaagtaaataatccagacctggatctctaattacctcagaagtcttcttagaaacagtccattcagtggtctaactgaatcagggatgatagataaatgattttcatgttaccaattgctcatcaccatgtccttggcagactactaatttctgcttgtgtttagacattattttttcattgtagcacttcaggcagccactacctattgagcattattgacaaatgataggaaaccgttgtcctaaaccagtagttccggaatcagactacatcagaatcagctgagataacttttaattaatagatttcccaagtttcacctaaatcaggatttccaggaatgggatataaatgattataaagtcagcagtggtttgtttactgactttgggaatgaggcaggtaatttttattttgttaaacatctctggcagcggaggctttatagcttcctatcttttcagtttcagtacagcattttattcctctcacagccagtaagttctgttaggttcagtggacttttcagcaatatgggtaggatctgttgctttgaattccaccaggcaaagcacatgaatcaaatgcccaagataaagatacaggatccagggaagtggcgtcttggttttctaaatataactgagctcaaatttaaagcctcacagcctttagccctccaaaaactcattctttgtttagtgaatacctttaaatgttgcttaaaatgtaagagttcaacatttttgcagtagattagcttttgaatttttcatatttcatgtatattcaataaaggtgatttaaacatataatgtgatctaatttcatatacctttaaacatataatgtgatctaatatcgtatacctctaatttcatatacctttaaacatataatgtgatctaatttcatatactgtataatttcagtatttaaacatacggtgtgatctaatttcatatacctttttcaggttttctgtaaaaataaatgtgtaaattgggaaagggttctttattagaccacatgatacgattttgggaccaaatattaggtagttaagtttttgagcaaagtagagagactgaagcctcaggattatctagtgagttaatga

SEQ ID NO: 53270 - DNA, 1072 bp, Homo sapiens
gtatccccagcacttggaggagtggttggctaataattggtgcttaataaatatttgttgaatgaatgaatgaatggtcatatttgagaaataccgatcatcattttcttggacattaacaaagcattttaggatattgaacactttaagtcatttagagaaaaaaagtgtttatctcaatcttctttaattatggaatgtgcattaacaactcttgaaatcctctggaaaatattacactggtctgtatggtagaggtgaggtggaaggctagaaagtgttttcttctccaagctaaacacacccagtttcttcagtcattatacacttgacatttggtttctgatccctcactagtttgatatccctccttccaaggattctgtcctgtaagtgttcttaaaatgtggtgttcagaacagaacatgtttccctccataggtgatattttttaattctatattaaaacaaaacgaaaaaccctcagaatacaatactccagttgtgaactaagtagtgaggaatacatggtactgttaccctccttttctggatactgttcttctaatgaagcccaagtttgcattttgtttctttttagcagctgagtcactctcttggctcatattcagttctcatcttaatttacaacaagttctttgagtagattcagagagatttcctattagtagagctaactaatgaatgcccattttcttctgattgagtctaggctgttttctcagaagtactagtcatccttagcttcctgaaatctgagaaagaaaaaaattaattatccattggtattgttgagcaactaacaccaaacaactttaatccaactgcccttttgagtatacttagaaatatataaaatatgaagaatccccctttacccatcgagattcaacaaattaagataggtgccacatatgcctcaaataccttttttttaagtatttcaaagaaaatcatagacactgtcttttcacccctatgtcagtatgcatctttaagaaaatgtaaatattttcttatattacccatgccatcattgtatctaacaaaa

SEQ ID NO: 53271 - DNA, 1028 bp, Homo sapiens
cagtttgataaattattgattatcttatgggtcaagttgtgagtgtattaagtggtttgggtttttctttgcattagaagttggtcatttagctctgctgatcaagaaattaattttagtcccctggaagcaaccaagaccttaagtttacttacagtaattatttatcaataaatgatctagaaatagcactccaatttaaatcctgaaaactaacttaaggatctacttataagcttccattccttggcagatttctaataaaaaaccaaattgttagtgcttctttaaggtagtgtttttcatccaggtacattggactcatcatttctctcactcattcgcttgctcatctgttccctcttttgctgtgtcctgggcacagtactgaatactggggacacgactaaggcagggtccctgccagcaaagactacagcttttagtttgggagaaaaatcagagatgtccttggcatctggaagtatcctgtgatttcttctgttttcttcttttcgactagaaaggcagaatgagtagcttgttcaaagaacttaatggatttagggatatgaatagatggctttaagggaagctgatggcttcatagttatttctctgattgcaaaatactgaaaatttaaggaatttcctcatctaatgagcaattgttactgaggtagatgacctgggcattcaggtttgctttgggaacttaatcaaacaacattgtatcgattcttccaggatggagacagtgtctttttgactcttatcctctatacttaacactgtgtgtgatacataatagacattattatatagccattatacagtcatgtgccacataatgacattttggtcaactgtggggcatatatatacagtggtggtcccataaggttataatggagctgaaaaatttctattgcctagtgacctcaaagccatcataatcttgtagtgtaattaaaaaaaatttagtgtagtctgtgtgtacagtgtttataaagtctacagtagtgtac

SEQ ID NO: 53272 - DNA, 1065 bp, Homo sapiens
tttcacctggagtataaaacaaaaagttctaacggaattctcctacctagagtcctcctcagtggtatagtgtttactaaggaaataagattgatcttctgattgattggtagagtgtggtgccagtgtgaccttattaaaaaccttgtaaattggaatcatcttttttttttaagattgggacctgacctttgacaccactaataagccttgtttccaattagcactattgtgttgaaacagatttgtgagaggaatggataataaaggaaagactgctagaacttactaactgttgcaaattttgtttgcttacagagagaggggattcaatatgatggaagtaggttatcataaagactctagattttggctggtggtacatgggtgcttattaaattattaaaattaactttaaaaagtttctgtggcttggccatcaaattttgggtaattacagacacaacagtcaaacatgcagcaatcagggtcaggttggcctttctgaatgaggatggagcagactgttacggcaggaggtgaatgatacatggcgtctctttctgctaggatagttgggtctgtgagtctatgacaccttacttgtctaccctgtgtacagaactggtgatggtattgtcccactgtgtatacgtgggtagccgtcaccatcagaaatggcacctttgtgtatcagaggaagtcgtgttttatattattgtaggggatgtgtattttcaaaagatttccaccttacatttgaataatattttttcaaaagtgttttatctgatctgttggattttggagacttataacagccttgtgatatgtgttaatagtgatatgtgttaatagtgatattcctattggcaaatggagaagatgagatagaagctaggtaggactcagtgccactcagttatttagtggtggaacagatgctggaacccagaccctgcattctccttgtttcttactcttagtatgaaactgacaaagttttggtgaggaacttgctctggatttttgaggtaaaaatggaaggttatagaccccaaagga

SEQ ID NO: 53273 - DNA, 1847 bp, Homo sapiens
aggatttgaacccttgtagtctattttcagaactctgtggctcttaatcactacactgttctgtttactgtgttacgaattaatagaggataatatttcaagtaagggcatgatagaatatgaagatttgattttgaatgtagttggggaaacagttaaacagcaattttaacttgacatcgcatccgcatttcttttaaaagtggacttaacactacagtgtacaaagatacatattgtttagacatttttttgtttgtccctgctcaaaacttctcagctcagaaattacattattttcactgatcttcactgttggctttgttagtcacttagctttccacattgccactattcagaaaccttggcttgagacagctaaagctcacttttacctctctcctcagccttcctttaactgtgaatttttgttttccattttgaacagttagcctttcagtcctagagggggttattctttacctcttccactccaaaacccagaaaacaccacagtggcgttttataacaactgtcacaaaatttgaccatcttaattggcataacatgattttagtgcacaaataagaaccaaagcatagtgttttggttaaagagattgacttactctgaaattggaaaaggcatctgctgtacaggatttttgatttaatagaatttgttataaccagatcagcagagcattattactgtgggccatctgttggaatatggaaatagctttgttatatggaaccagatgttgtttttatatttataacaatgacattctacttattttaagtaaccttttgtagttaggtacctttggctgcgattctatttgacatgtatatcaactgataacctgagaatgtgatgtctttcaaagtggctattattctgtgggatcaggacaacacagatgaaacaaaaaggaaatgagactcatacagtgtcaaactttagtgctataacaagataaaatataggaaaaatgacctggtgtggtggctcacgcctgtaaacctagcatcttgggaggccgaggcaggcggatcacttgaggtcaggagtttgagaccagcctggtccacatagtgaaatctcgtctctactaaaaatacaaaaataagctgggcatggttgtgggttcctgcagtcccagctatttgggaagctgaggcaggagaatcgcttgaacctgggaggccgaggttgcaatgccgctgcattctagtctgggcaagggagtaagacattgtctcaaaaaaaaaaaaaaaaaaaaataggataagtatgaatatgtgatatgagataattaggaccatattaaataagagctctgaccttgagactattaataaaggcctcgtttctaataattactaagccacttggttgctctaagaatttttaccctaaatctaaagtgatttgattttgatgtaattggacctacattaataccacactgtctgaccattgtttcccatcatcaattgatgaaatagtctgtaacaagactcatacttgtagagtgggactcaaacttagagtgcaataagaggaactgtttttagaacacagacttagagaactctgttctgaattgaacgctaataatttgaagatgactgggtctttgggtaggaatttttatttttttgagacaagatcttgctgtgtcacccaggctggagtatagtgactccatgagagctcattgcaacctcccaactgcagggctcaagcgatcctcctgccttagcgccacaagtggctgggactagaggtgcgtaccaccacacctggctaatttatttatttttaattcagacaagatc

SEQ ID NO: 53274 - DNA, 1828 bp, Homo sapiens
tgccggcagggcgggctgtacctcacgccttggagtggccctttggggagaggaggcccatgcgagggtgcttgcgttcccgcccatcctgtgtctgtgtcctttgctgggattagggcaaaggcagccgttccatgcggacgtgttgctgtcctgtgtgtgttgcatcctgcccacgtggtagagtgtctcccgccccccctcccagctccatttttgcagctggtgaggagggaggttaacgggatggtttttcctctgtgatttcctccgggtggcgtggaaggtgttagggtcagtttgctttgccgaggccggctgttggttagatgaagaatcgagagttgtactctgaaattgaggccagtaggggacataacagggcttagtttcattaacatcttttttcctcttccattagctgctcttattcttttctctgttgcttaattatagagaataagcgcttgctaccgatgcattcaggtgtatagttttcatttctctgttttactttttgtgtgtctggttagcaaaggttttactattccgtgttggtgcattccacgtctgtgttgtccctggttggattcctgaatgagttagagccattcactctaattcctgaaggagttagagattggtgggcacctttttggtctttttctgagatttatttgtgtgtgttttcttccttctattttgtttcccagtgaaaaagcgtgatgtcataggagcgttatatgcatagctctttttctcacaaggcagcactagtttcacctagtcacttattttgtagaagctcttttacttcacttttcctcttactctgttgagtacccattgcacactctttttttgaaactggtttgaaacatggtttgagtagtttttttcttaatgtctcttccagattagggtttccatcttctgttttgctgttttgagaccacagattgttcccgcaataacagtgagagaagcctattcctcctggtccctagcaaatatttatagaaaagcagtaactcctctctttttctgagtggtatatattatatagacgtgattaagttttttagtttcttagataaataggaggatttctctttttgcttttgtgtctcagaattgaggtgaatcttcttggttttgtgctgccgaggacaaaactgggaagtttctcatgctttcattagattttttttggatgaggctagaacgtgtttattttggctcttttttgttcattagtttgggtaaaataaaaaaacttaatgtttcaaagtcacttactagattccaaagtggcctgcattctcactttttcacattgtacattctttgagtatatttttgacatttttttccttttatctggtacagttcgtatattccctttccttctatgtagaatgaaaatatttaaatatagattttagattatattttttcattatgctaagtatgggtggggcagtggaaaatggagaatgttgttctgatacatactgaggctttttgtttttttttggtaagtcagcatttgtgtacttctgtaaagtaccgagttatctatgtgtgaagtctgtatgaagagacgaataagatacgtggtctcttggaaagcttcaacttatatcgaaagaacagagtttctttttctgttcgggaaacatgtacatcattcagaattatcaaactgcatcaaacttctccttgggataacagtacaaccaaggtcaaaagtgtaagggacatttgagaaagatacaaatttccaaagggaaagaggtgtatttcaggagagtgaaggggcctgtgc

SEQ ID NO: 53275 - DNA, 1029 bp, Homo sapiens
tctccaggaaagcggacgccttttccgacctggcacaccgcggattccgggacccccaacaaaggcgccttggaccttcaggacacccctcttttcagaacttcatgagtcccaggtgctagactcatgtctgcggaggcctttcccgtgcctggtctttctttctttcttaaaggagttggacctctaaaggcccttctaattctcaaggtagctacccaggttatggtactactatcagtaggtggagcgtttagaagggtagtttggtcgacgagtgaactttggaatttacttctacgtcagtcttcactgattctttctctaaactattagcactgataatctgccctataatttcacacttaattacattccagtgtagtatttgctgttgcttcattcgcgttagtcacatattcccctgcagcgccaaacacgcttttgaactcacaatgggtggctcaatatttggagacttagatatttgttagatgaatactaggctgattggatgagaggaaaaggagaggcatgagtgaattggccctgggtacttttttgacatagtctcaaagggttcagataaagacctccagcagatctgagcacacaattccttcagtaaacattgaacacctgccgtttggtcaagcatttctaggcactggagattcaaagtattcacatattccttttctttataagactagcaagattctgaagattcatgtactcattcactcaacaaatatttgccaatcactactaaggttgccagacactattttagtgcttgggatgtatcagtaaacagaagagagagagaaaacaaatacccttccctgttggagctttcattctaatataaggagaaagatgataaatgtaagagaattatgtaatatgttagaaggcatatggggaaaaaaaaatacaccagggtaaggggtatgaggaaaactggaggaagggggtttgcaatttttttttaagagggaatcctgctctcccgcccaggctggagtg

SEQ ID NO: 53276 - DNA, 1001 bp, Homo sapiens
gtaccttacatttaatctacaacaatgactatcagatgcaaccggtaccctctctctatccttgatttattaaaactgtcacagttaatgtagaactagatttctgaacagggaatctgcagatgtgaattcctattacagctttacagttaacaagtatcttggctttgctttgggcaaaccacttttgtctttgaatctcgggattcttatttatagaaactaggggttaaggttcctctcactttatgtgtttcaggatcatatttaaattgtataatctgttgtatttcaccgacctagattaagtagttaacatgtacatctttctacccaggatgaactttttgcttatttattttacagtttgtaaagatgtctcttttttgagatacagtagccaaattccacatcacatttagtttgtagaaccgtcacaaattctgtaagagcaagaaaatgctctgtatctaaaacctcattttaaagaatcagtcctaaaaaaaagataaaattaaatgctagtgccacaggaaacactcagacccttttgtttagtgtcttaaatgttaatagaattcatgtgtgaaaataccttaatctattcacaaaccaggagttcttttttttgttttttttgagacagagttttgggtcttgttgcccagtctggaatgcaatggcgccatcttggctcatgcagcctccacctcctgggttcaagcaattctcctgtctcagcctcctgagtagctgggattacaggcatgtgccactacttttttttttaatttttattttatttatttatttatttatttatttattttagtagagacagagtttcaccatgttggtcaggctggtctcaaactcctgacctgaggtgatccatccgcctcgacctcctaaagtgctgggattacaggcgtgagccaccgcgtccggcctgttctttttaactacaggaaaatgtacacagctatttgcctggtcgatgg

SEQ ID NO: 53277 - DNA, 1035 bp, Homo sapiens
gtcatgtccctctctgcacaggcctggatagccagcatgcacaagacctgtctaactgcttagtagagccttttgggctatactttaacccattccattcttcatttattaaaggcttcagttggaatgagccaggcccaaagatttacctttggagaagagagatgaagtcctggtaagacttcctaggtctatgtgaatctgctcgttgaggctgagttgtctctgtccacttgtggttggtatttccagaaatgattgaattcttttcttcccatttagaagtttaactgtttgtctgtggtctcatgttgggatttgaaagccagacgtttttgctgcttctcgtttctctaggtcatgtttctgttgtaaagctgtttttcttgtgaggtggtaaaaatctccataagttgtcctactttgcttagtagaatgtcttctgtgtagtaataatgccagtgccttacatatgtatagcattttatagttttcaaagcattttcacatatattatctcactgtgtaatgttgtcctgggtgttctgtatttactatcttaagcaacttgaatatttttcttttttctccaaccacttttgaggctactacacatgggttacttttacctttcgcattatttcccccaagggctgtaagtgtcaaaggaatttttcaaagaacagtaaaagcatctgtaagtgatactgttttctgatggcaaagtgaagataacttggatgctgtttataaccctgagaattaggttccagttccttggactcacatgatcagcggaagtacaaaaaacagtttattgtaatgattgttcctacccctcccctttttaatcagtgaaatatctcctagaatgggggaaagtgtgcaattcagggccatgtagtagttttgtgggtgttttgtttttcatctttgtgcctagagcttttatattgatattattcatcacctggtggagaaattgtaacttcattagcacccttttccccctagaattatgtggttatgcagtat

SEQ ID NO: 53278 - DNA, 1057 bp, Homo sapiens
tggcacagaaagggtattaaatatgcatatatatatttcacaattgagatataattcacatatcataaaatttacccttttaaagaacaattaaggccagacacagtgtctcacgcctgtattcccagcactttgggaggtcgaggtgggtggatcacctgatgtcaggggtttgagaccagcctggcaaacatggtgaaaccctgtctctactaaaaatacaaaattagtggggcgtggtggtgcatgcttgcagtcccagctacttggaaggctgaggcatgagaatcacttgaacctgaaggcagaggttgtagtgagccgagatcgcgccactacactccagtctgggcaacaaagtgagactccctcaaaaaaacaacaacaacaacaaaaaaaggacaatccagtggttggttttagcacattctgaaggttgtgcaacaatcaccatgatctatttccacaacattttcatcacccctaaaagaaagcctgtaattgtcagcagttactccctcttagtgcctcccttgcattggaccccctgttagtgcctcccttgcattggactccccctgtcgcctggccaccactagtctactttccgtctctatggatttgcctattctggacatttcatataaatggaatcatacaatatgtggcctttggtgtctggtttctttcacttagtatagtgttttcaaagttcatccacattatagcaggtagcactacttcattccttcttatgactgagtaatattccactcatggagatggagatggagatggagatggagatgcctccttttgttcatccactcatcagctgatggacatttacattgtttctgttttttttttttttactcttccaaataggctgctgtgaacattcctgtatgagtttttctgtgtcaataaatacttgagtcaatgaatacatgagtgaatgggtaatgactcatatttcctcatgtgttctttggcctggatatgaattataaccttcttttctgcttttgggcaggtctgggccgaatcgttcagg

SEQ ID NO: 53279 - DNA, 1048 bp, Homo sapiens
attcaagagagacaaggtgatagaattgaggtgagagaatttgttaacggctagatcaagcagagcctcatgggttgctttagaaatttgatctttatttagaggagtgatgggtcacatttttgtatgcaaaccacattggagggaggccagagatgatgtggggagaccagttagtaggcagtggtctagatgagagatgatgagacttgggctagggtgacttttccagaatcccatagctagccagtgtcagaggtaaacagaacctgggctgtattttcttgtccagtgcttttctcattactttggaggaaagacagtctggaatggggtgtcagacctgggcagggtgagcagggcattcctgcaggcaaacagcctgttatggggagttggaacccacacaagtgaggagggatccatgcagcagaggcagcctggaatggggagtcagggcccatggagcgggaagaggtatctataaggtggaaaggacggagttagagagcggggattgattcatacaggggaactcattaatatgtaaataaaccaatgaaagtgaaagctgtcagcaaagggagttgcaattaaggaatggaagtaaatcagattgaaccctatggtgctgtattagatctggatcaaacagtatagactagtggtcatagagatattgatgtagatatatagatacaggccagacacggtggctcatacctgtaatcccagcactttgggaagctgaagcaggtggatcacttgaggacaggagttcaagatcacaaacatggtgaaaccccgtctctactacaaatacaaaaatgagccaggcgtggtggcacacacctgttgtcccagctactcgggaggctgaggcaggagaattgcttgaaccagggaggtggaggctgcagtgagctcagattgcgccactgcactctagcctgggtgacagagtgagactcggtctcaaaaaaaaaaaaaagatatatagatatagaaataaatacagatgtaatgtgtgtatacgtacacccattat

SEQ ID NO: 53280 - DNA, 1029 bp, Homo sapiens
aaacatgtggctcacaagctacttaattgtgagccctgattgaaagcatttatccattcctactttatccctgaccctgtgttaggtgttacaggtgggacagatcaataagcagggagcccgcaaatatataaataaagctcactttatttagaaaggcaagatatgttagtggctctcagtggaacaaaagttcaggcatctaagttaacatttccattgcttacaagccccacttgataaattccctgtggaactcagctatatcctggctaagtgcttttattgatctgtttataataattctctacctccccaaaaacattttaaatggtttctgtcatttctttggtagcagtcacaacttgtaaagaatatactttaattgcatttctattgtccaagaaggtggcaatattgtccaagaaggtgcttgaacatggctatatattgtctgtggctgcttttgtgctacaacagcagagttgagtagttgcaacagagatcctatagctctcaagcctaaaatatttatctgaccctttacagaaaagcttttctgatccctcctctagattattgttacctgttttgaaatatgtataaatggaatcaaacagttaacttacatttaagtgaaaatgtgtaataagcaatagaaatgcaaaaacccatgactatgcatctaacaacagagcctcaaaatacatgcagcaaaaacagacagaactggggagaaaaatagacaatttaataataatggttgaagacttcaatatcctaccttcagtgatgaacagaacaactagatgaaagatccagtatcccactctcagtaatgaatagaacaactagatagaagatcaaatatcccactttcagtaatgcatagaacaattagacagatcagcaaggaaatataagacttgaatcacgctataaaccaactagacctaacaggtatctgtagaacaccattcaataacatgagaatgcctattcttctctagtgcgtatagaacattattc

SEQ ID NO: 53281 - DNA, 1034 bp, Homo sapiens
accttcctggcagtagagttcaccactttggcggactatttgcatctgttgcaggctgcggcccaggcactcaatccgctaggtgcgtgccctaggagtaccccttttgcctggaagcacagcctttctttccagccacttatccccttacctcctgcttacccacggatctcagctggggaacccgagttgagaaggagctgatcctatatcgtacctcgccgatttgttaacaccttgtgtttctctttgcaggcccttctgcgatgttttacctggctgcggctgtgtcagatttctatgttcctgtctctgaaatgcctgaacacaagatccagtcatctgggggcccactgcaggtgatgggcgcttctcttccagagatctaatcccatataaccaatcttgggttaatttcctcttgatctggagatggcctttctgcatctgtattcgctaggcacaggggatacagagatgaataagacaccgccctccctcatggacctcacaatctagtgagggagctggacacagacataattacaatacagagtgataaatgctctagtggaggtatgtacaaagtgcagtcagatcatggggcgagtgaatcctgggggagtcgatgaagcttcttggaggagatgaattgaactgggttttaaaagatgagcagaaccgagcgcggtggctcacgcctgtaatcccagcactttgggaggccaaggagggcagatcgcctgaggtcaggagttcgagaccagcctggccaacatggtgaaaccccgtctctactaaaaaaatacaaaaattagccgggcgtggtggcaggcgcctgtaatcccagctactcgggaggctgaggcagaagaatcgcttgaaaccaggaggcggaggttgcagtgagctgagatctcgccattgcactccagcccgggcgacgagagcgatactccgtcgcaaaaaaaaaaaaaaacaccaaaaatcaaaacaaaatgagcagagggtgtacgaagtgggaaaggtcattc

SEQ ID NO: 53282 - DNA, 1051 bp, Homo sapiens
atgtttgccacatgcattggataaaaactatttttaaatttttctttacaaattgactgcatagttacataagatagtttgtcttatagaatgaaacttcccccaaactgttacacaagtaaattttcaaatttgtctctgaatatctgaacatattaactgttccccctaaaaatcaacctttcccagaaagatgattacttattatctgggtttgtttttgtttttgtttttttgcgtgtgttcaccatttcagaggtgattttaaacatggatttccaacatactttgtgttcatcatttttcaaaataactgctctgaagggtgtaaagctgaccaggaaggtaacctgaaaataaatacatgtgtttctagtaaaacttctttcaagtataaggatttgggtcaatacataatgtcctctgactgcctcagtacttgttgtacacccctactacagagctgataactttacagggtaacttatctgcttgcatatctgtgctttcccactgtgacaatctactaggataggaccacaggggtatttgtaacacagaaagatgtgatcaagcaactttagtttagatgttgggagcacactttggaaacagtctgcctgggttcacatcctagctcttatcaactacattgtgaccttgaacacattacttagctctctgtccttaacttccttacctgtaaaatgagaataataatgtccctaggactcagcaaagaatgaaggcatattttgtactcagtaatcattgagtgaattaatgagtaaacatacaaacaaatcaataagaagaaaggtgattttatttaacaggataacattttctttagaattactgaaggaaactattgtacacatgtaacactacagtttttaaaaggtcaaatttttcaaacaaaacataaagaaaagcagactgaatctcttatgcaaatctcactaacctcccattcttccttcccacattctaggaaaaagattaatgatgttgagtattgctccttcctgtggtgtctgggaaggagggt

SEQ ID NO: 53283 - DNA, 1039 bp, Homo sapiens
gctataacataatacaatagactgggtagattaaacaacaaatatttatttctctcagttctagaggctgggaaatcaaagatcaagatgttggcatatctggcatattcagtgtctggtgagggcattcttcctgatttgcagacagctatcttctcattgtatcttcacatggccaacagcaaagagagagagagagtgcaagctttttcctgtctcttctcaaaagggcactactacaatcatgagggctgcacccttgtgcattagttacttgccaatgtgtcctcctaataccatcccattgagggtaaggctttcaacatatgaactttgagtcaacacaaacatgcagtgcataacaagaccattgattttgaagaatgtctcttaatttggatttgtctgatgttttctcacgatgtaattcagattacccacactacagagataatgttgtatccttctcagtgtattttatcaggagacatgacatttttgttctattcctcatgatattaacttggatcatttggttaaggtactgtctgctagatttctacactacaaagttattacttttgcctttgcaatagatacatatcttgtggggagatactttgagactatgtgttatgtttcccatcaaacttttactcattaaaagtttctgttttgaatctttgatttttaagttatattctagtttttcttcagaatatagagtgctttagacttaaagatagtcttgctaaagaagctgtatgtatttgctgaagcccacattttacaggctgtcatttttgtttgggttacaacatctagactcatacagaattttagagctgaaatgagtatgatcatgtagaccaactccttcagtttacacataagaacaccaaggcccagggatattagactgctgccaagttacatggtgattctcagcctatgctctttctaccctagcctaaggcctcaatcagaaagtggaaccataagcttaattcttatgctacttaaacatggctgattatta

SEQ ID NO: 53284 - DNA, 1008 bp, Homo sapiens
tcttgcccttcagctaacatggccggggaaacttactgcaggtatatttggtttccatcaggcgaacagtggtccaagtacaaatggctgtcagttctttatcacctgctctaagtgcgattggctggatgggaagcatgtggtgtttggtaagtcctactcctgtctcatggtccaggccccattcaccctggatggaacctccagaggagttagttctcaaactcttaccaagaaagctcaacctgtgtaactgcttaggtggtaatagagaaaacagaaatggtggggaggtggggaacatgtgtggctagagaactagagggaaggacaaaaggaccatttgatatagtatggaaccacttagggagaaaacccagttgctagcaccaaagaaatgccatagaggcagcatgatacggtgagactttggagtcactcaggtataagtttgagccctaactctacttattacctatgaccttgagcaagtcatttcacctctaccgcatcttaatttcctaaagttagtatgagggtttaatgagaaaatagctaagaatgggctttggaagctggaaaatgctatgtaaacaagaataaagtccagctcatgctcttcctacaggaaaaatcatcgatggacttctagtgatgagaaagattgaggtaagtactgctttgatttttctgtttctctgccattgtggtctggtactgtctgactagcgtgcaggagctagagaagggggaatgagctccagtttgttaggctgtcttcattgccccaggaaaagggaagagaaccacctaagttagcctgtctggccaacactgaggtttggcctctgatgatcctgttgcctacttgataaaattctactcctcagcattgcgttcaaggtccttcatgattagtccctgtctacctctccatggccccttcttctgccattgcctcttccatgttccagtcacatcaggctactagctcttctctaaatctgc

SEQ ID NO: 53285 - DNA, 1037 bp, Homo sapiens
gtccactgtgctcctgagattctcaaaaggggcactgaccctccaaaaaagaatcaggccaatatgaaccacttaaggattttcagcagaatactgtagatgaattttcatgttcagaagatgattctagcagcattgtggaggatgggctggaggccagtgaggagtctactgcagtagtagtccaggcaagagaaaagaggttttacatgaaaatatgggtctggggaacactggagatttggcagcaaatatttatgtgcctgctgggcatgtgacactgtatgttccctgtcctgaaactcagaagctctgccagctgaaaaggccaggagtggagagaatgtctggctccagtccattccagtccagtacaaaggcaaagctgcttgcattgcagccaagtcttacacacgtagaggttccattctcttcagtggaatactatacagccttaacaaaataaagaggtagatctggatgtgttggcaagatttctaaggtaagttaagtgacagtcaagatgtagtaatttatgtaagcatgttactgtttattttgaatgactttcaggaatctctgcagtgatatatagcagactgtggataatacttctgcagagtagagatagcaaagagacttttcagttgccttatttaagcttgaattttctaccttgaacatgtatcttgtaatagaaatacatactgtttatatgtagtgttaactaatcctaaatcctcccagcacttcccaggagcctgcccacagctgtggctaacatcaggtgtgaatccattgctgatccctccacctcctcttccaggtctaagcccagacagtgggtgctcccacagcacttggttcatctctccactgtggcatttaatatactgtatcacaaatatgtaagtctgtttttctctggactgagaacttgttgaagcaaggatcatgctgactaacatagtgcctggtatgacagagcttaggtcctggcacaccatgcagcttacaaagtacatttatacattttc

SEQ ID NO: 53286 - DNA, 4394 bp, Homo sapiens
cccttccctcacgtgctctccgtccgcggcctgcgcacacacccatcctggggcccgcgccccgggcctgccctggagcgccccgcgcttcagactcacccacgtgtgcggcggcggcggcgactgcgtggccccgcacccgggcggtggagagaaagggctgtcaggtggccgcggcggccggcgtgcgagggaccggatgcccaagccgggcggatttggaaaaggatagctggtaatcgtggcttgttttgctttgttttcttttccagcaacgaaggttttgggaacagtaaaatggttcaatgtaaggaacggatatggtttcatcaacaggtgagctgccgggctctgaagcctccatcccaccttcttgcttgcttcctgctctgtcggcttctcggggcttgggaagccccaatccacagctctgttctgaaaggcgtttactacctctggtgtattagtatgattttttgttgttgttgttttccttgattagggattagtggatctagagaatgcctttgttttgcagctaaatattaatttgaagctaacttaaaaggcttcgtcacagtacaaagcaattcaaaaggcaagcggagtgaatgagccattccttaacagggtaaacgggaaactacggtccagtacatttttatccttgtcatctttttctactttattgaactcggtatttgagaatgtgatccactgacatcggatatttatacattgttaacgttttagggtaagaggatttgactatatgaggttttgtcatctttaccgagaggttgtattgcctttgtttcacgtttcattttaatacctgagataaattttgtcttagcacagctttgaccagagagaactgtttttatttgctcatccagtaaataatatatttacaagaaagtggttttttttccttcttccgttcttatttttcattcttccttgtcctagaatcataactggttaagtcgatttctgttagatccctggctgtagcttattagagtggccatagtcactggtaacttgacatttttcttcctgtttgaaggcaaagctgcagacacgtctttaggacttacccttcgggttgtttgtaggagtggtggtggtaacgtgcagtagacgcactgtattccatgggctcccttgtaagccgggcatcattttcaagatggctgccaaggctagtagtgctagttacatgggtgcagagcactgggtatgccagtagcaatcttggcctcacaggtatggtacttagtgccatctcagcattgtcttgcttgcttactgtagaagacctaagcagatgattaaaagaacaatgtggaatggacaacaaatgggcaaaatcaagcttaaggacagaatcattgcctgatgaaaaactgttcattaatcaatcatagagtattgtggaaacactcagagtaagagataagcatttggtgatctattctctacttttgcaattgtgggaaaatattttgtttcttccaaaatcttaggattttccatcttgttatatactgtttgctttcctggctggccgaaactacgtttttcattaattttttgataatggcttactagcaagaaggaagggaatgcttatatataattggcatactgatagctttttaactgatctctctgaactttctagtgttttagtttgtatttctgtcttactctgattatcgttactagtctaacccttaaaccagtggttttcaaatttaagtgtgcttaccttgggagggtgtgatgtaagtggtgagttcctccttctgagccttggattcattaggtctgggtacatttttaacaggaatgataatggtcttcgggccataccttcaaaatcactgcttttaacccttgacccaatgtaatggtaactctggtgtgcaaatttgcagccttttcagcggatagattgcaggttttgtatgtgttgaagaagttttagcatgtgccttgtttcgctgcattttttttaagtaggcataggttatgacattttttgaaatcaacagttttgtccagaataagagtaatatctttacattttttaagtatttagtccatgagatactgttcattgaatatctctattctgaattggaatcaactcaattggtcatcctccagggcaagttatgaattggcttttgatggtcctttgtttggactatcctaacctcaattattttgtcaaattaactggttaaaatgttctttatgcttctgaactggttttaatgattctgggacttttttaataagatgctgtaaaatctgactccaattaaatacagggaagatttgctttaattaaggaaaatgtatgtgataaaagaaatcactttggaagctagcagttggttctatatgtagttcgtgtagtggaacaaatagacttggctggaggcacctgtctcttatgagggagggagacagactgacacataacgtgctgttttctgtataaaggagagggtgcagtgttcgggatgactattgtgacgacttttaattggggtttttggatgcgctggattatatatgctaggattgtaaggaatttttataattacaatattgtatgtaaattttctgcctttaaagacataatttcattgtaaatgtgtttattccagcctgaattaccacctgatgaattgttacaaccttgttagaattaattcatgaaagggcttctccctgatggttatattgtgaagaaggtgctaagtaacatgagcatagagcttttaaaaatagcagaagttttggctttattttgttagactgtgtaatctagaaattctaagaaattcattgagttattcttttgtgaactgtgtctacaaaacataatcggagaatgtgactagaggggtttattagctccccccagattactgttgaattttgttagtggttgagtattgatccatattcaccaaagattaccatgaattggcaacagtttatagtgaccagaataggaatatttttctgtttccagagtacttaaaatgtttaaattaataattcttaatgttttgaggtgaaagaatttggagcagaggtcacaaatttgtgaccttctggctaaaactactcccagatgctttgattagacagtacagtattttttaaaggaattgggattaattactaacatttataattcaggagataacaccaagtaatccagattattatatttttaagatctgaactttagctggctttgggggcctgtatttccacataagtaaaaaccacctggccatattgtcaccacatttaggtggggtatactttttttacgacagccttcacgcctggcctctgtgtatgcatttgagtttattacccatggtctaggaagatgtaataaaccaagccagggaaaggtttggctatctctctttagtcacgcctatcaggtttagtctccctttggggtgggggctcccttgtggggattccatatgtacataactgataggtgacttccaacacatgttggtgaaaatagatacagctaacaagtatttatactagggtctatagtaagtgcttaaaatgagccaatttacttaatctttaaaaacctttgaggcgtaggtactgtcattctgaggcacaaaggagttgttacttgtccccataagcataggtgataagtggcaggattggaactgttttttgactctggagttagtgttcaccaactgctcttatgctgtctctgaaatagaccctagccattttcaatttggttgttgtccacatagttacagataatttcttagggtgattatttttagccgttgaaagactcttaaatgatccaagtatgtcactggggctcttgtctgctgacttgctaggtcctggatttgaaaagttttctgcctttcactatctactttgtgaagtttgggattgttaaaagttctagtttagcatgtaggtcagctatacaaataaaaggacttgcttaattcctgatactgggaggtgaagaattaaaggagagaatgttgcaccttatctcccttaatcttttttttttgtatggcctgcaaggtaagactgaatattgcctttttaaagggtgatttttcttgagatggagtttcactcttgtcacccaggctggagtgcaatggcacgatcttggctcactgcaactccgcctcccaggttcaagcgattctcctgcctcagcctcccgagtagctgggattacaggcgcccgccaccacacaggctaattttgtatttttagtggaaacagggtttctccatgttggccaggctggtctcaagctcctgacctcaggtgatcc

SEQ ID NO: 53287 - DNA, 1062 bp, Homo sapiens
ttgtaacctttgttccctttgtcattaaacgctagagctactactgagctttttctcactctgacctgacggagtaaagagggtgaggcaggccactgcaggcctggaaatccgtttccttctccagtggtgattcttgctcctcgtgttatcaccttaatcccaatatccaggctaaaaagtgagattattctctaccccctcgcttctgacatccagtcatccacaaagtttctcattttgcctcaaaaagagatctcaaatgtctttttatacatggctccgtggtctaaaccttcatcagtccttgtctggacttgtggagtagcttttataactgggcttttcttacattcaaacataccttatcacccaaaggtcacagttcccattaggtttcactctttgcgttatacattctgttggtggggaggggggttctcatttttatgatctcaaggaaagttggtagttgggagatgcaggataaggtgagaatgtaactactacttctgttggtaaccatgctctagaggtaagaggagggtgtgctagaacagttaatgtttaataggataaggaggggcagaatatattttgctagtcattgctaccctcttaattatggctcagtaggtcacactttaatttcttagacttttttttttttttgcctatcttacgggtaatgaggctacaactgtttgcaactgctgaagtcttgaaagcagagagcatggtggcttgtgttttttgatttttgccaaatttcctggtacctaattggcagccagagagtctctgggaaaattaatctttgacaacatgagatttatttcattttctaacttgttcaacttggttctgtcttgcaggaatgacaccaaggaagatgtatttgtacaccaggtgagtgcttgtgtagatatttgcacttctgattcaaggattgtaagaagaaaaggttagatatgttctcagcttttgttccttataaaaggttaagtccaaccaccagtttatttacttacgacaggagtagtagcatgcttaaaaatgtat

SEQ ID NO: 53288 - DNA, 3988 bp, Homo sapiens
tcactgcattaaatatttatacctaatttcagatgaacagattattccatgattctaaagttgaacaaataatgttgctataaatacacagaaactttggcaagaagttttcaaaggcttttaggtgtacctgtagggacaaatctccataatcaagggtaaataagacagacctgcaaaacatagtaattgaagtgagtacttgaaaagtagcataaagagccttctgcttactttaaatcactttgaatgggtattgggttttttttttttttaaacctttggagagttttggctggcttggaaaatgaaaaaatttcactagtttaaggttaagtggggggaagtgtgacaaggttggcagctgctcattaaataatttttagattggcttccagtgatttgggaagagaaaactgttaacataggatgagtactgatgagtactgcatagtgaactttctccctaagtatcatttagggaaaatgtttgcacattcaggaattaagattattactaatgtaaaccactgccaagtgtatgttaatacttcaaatttagatatgctgtaggctacattgaatgtacttatcctcacagatacgaaatgagtaggaaaaaatatgtttgtgctatcagttttctcactaaggcttttgaaatattgtcaacttgtattaaaattagagaccataactacttttttgtactataatccagaaatcaaaagacctaaaagttaatatccatactcacatttaattagatactagcttttatggcagcatgtttcataggaagggctgtcataggttggtgctttgtagctcactgaagtgtcctacacagtatttgatgacaaggaggaagctatatcaatttctagtacacccaaacccaatcaggtagttcagggtcaaatgtaattatggaatcatttaaattctaaatgtaaataaatacaggactacttcagacaaaatgttgttttaaagtagatgttttataaaattggtattcttgtttggaagaacacagctcaactgttccttactccccttctgcatgttcaaaagaatgtgtagacttaggaacaagagacagcaaagtttctcggtcttgttgcctgttggcaacccttaagggttggggttggggcaggggtggagatgttgataaaaataaagagttgggattttaattatccataattctgctatcccctatgactgcaggtaattgatagttggctatatctgaaaggtatgaaaactatgtgacagtttagatgacagatgagatcaattatttgactcaactcacccagttgtactgattcacaaggtgccaccaatatgctttcatttttttggaagtggtttcaacatgtagttgtttcttgggactttggctgctcaggtcttagtggtgtatcagggagactgcagttctgggcagcttcacttaattggcctcagattcgttgattgtcctgtctcctctgcaatggaaatgcatgagtgatcctgtaatggatatagctgagatttggagtgaacatgggatttggagacccaatacctgggtttagaaagtctccttactaactgtgtgaccttgggcaagtcacctaactttaaagcctgttacattatctgtgtaatgggattaacaatactttcacatgtcctgtctcataatgagattgaatagatagtaagtgaaagaatgttgcaaaaaaatttcatagaaacgtgagatgttactcttcctcccttctcttaacagtctggagaaagtagaagcaacaagtctctaatacaagatttattgaattctggggaggtgataactaacaattccatgcagtcagatcatataaagaatgacatagttaatacacatgaattgcatttccactgatgtattatcagattggaagggattttggttgacatttgtaattgagtttgatacggtaacacaggggcaaagttggtttggtcagctttgaagcatgcaaaaccaaactcgcctgtcatctaaactgacgcagtgtggggccaccttctcctattaagtgcagtcctcaggggatagatggatatcctcatttgttaaaagttatatataatgcttttgcaaaaagcagtttttaaaatgatgtgtctgtcttgagtgttaaattacttgttttagttttgtaaatagtggtacaatgctggggccttgtatgattggagtgtttttgttgaagttggggatagtgtggtccccgctttcctaaatttattgatggtttggtcttatttaaagcaaatcttaagtgtatatccaagctaaaataatattgactctggtacattttaaatgaaaaagcacattattctcccctgttaatctatttttggaatgtgatattactagactgccataaagaagaataaccccaggaagtaccttcgcagtgtaggagatggagagactgtggagtttgatgttgttgaaggagaaaaggtgaggatgctttttgtgtaaaggtttgacttcagtatggaaatattttggaggtctcatccattaggatggtggctctaatgtggatggatgtgttcaggtgacctcatgaacacaggtgcatcaagcctaatgttctggctgcagttagagggcaatctcttcagaacagtgaggaactgatatttagtcatttctgtgcacccctggtcacgcagttgcgcccccccccccttttttttccttaactttgttgttttttgctttgtttgaaaatgttctgatttccttttgaaagtgttgaaagtgttctgatttcctttgtcactatcaatatgtaatggcttttgtagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggaggtaagtttcaccatcaacaacagcaatgtgataagttctggtaggactgtttagagctgttaattatatggaaagcaacttggattcctagtaagaaccaaaaggattaatttataatgtagtcacaattactagatggtctgttttgtttgttttttaactcttggatttatctggttgggtttttttattatattactgacccagtaggcttaatttccattgtctttttcagggtgctgacaaccagggtgcaggagaacaaggtagaccagtgaggcagaatatgtatcggggatatagaccacgattccgcaggtatggtccacgtaaacatgtttctattaaaatttcctcaaacccgtgttaggactcagcaatatcatgcctctcctgcagactcatttttctgttaacacttcacgttttctttcatcagatgcctaagaggtgaacctattaaaaacagcttgtatagatgaggtctgctttatacataaatttttttagaaaatgatgagggtttggaatttcaaattttctgtccttgaacaggtaagataatattttaaaccacaccttttaaacctgcctccttggtagggagaaaggaaagcattaggagtatctgaattgtaccatggcattagtgaagaatcaacagtgttatcacttgaaatggcatacattatcttccactaaacacttctcagtttagatatgtacccccttttttttggagttgggagttgtcagctcaaagttgcaaaatgaaattgctccaccaagaatttacattctgcggggggaaatc

SEQ ID NO: 53289 - DNA, 2430 bp, Homo sapiens
gcactctttgggaggccaaggagggaggatagcttgaggtcaggaattcaagaccagccttggaaacatagcaacacatcgctactaaaaatcagacattaatgagacgtggggggcttgcctatagtcccagttactcaggagtctgaggtgggaagatcacttgagcctgggagattgaggccacagtgagctgtcatcattccatggcactttagtctgggcaacaaagcaagactcttccccctactcagcatccccccccccccaaaaaaaaaaacccatctctttacacaaattgcctacagaccacttgatacagaatgggccagacatggtgagttagttgtgaaccaactggttacactggtgggtgtgttgaagagagaaggttttatcattcttaagtttgacaccgttcattgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccgggtaagcaagcttggatggccatccatttatggcagtcgtgagtggtgaccatttcgttttattaatgcaagagtagaaaaacctcagttccatcagataatgaaagccatgttatttataatgtgttctgccctattcttaattacctaatatttcattttaggaatattgaatatcagagtcatatttggccacccttcagctagttctcaattctgacactggagacctgtattttcatgagtattttgaactattagtgctttctatcaacttttctgaatgaattttatgatttcactagtaaacagaggaaagttttgctagctgtattctgagaaatatgttaattacattattatttatgcattatttcaaaaaggaagtggggatagctgttagaattaacctagatggtgacaaatagagtctgtttggagaaagtggcaacattaatataatcttttaatcatttctaattgttttttttttttgttggtttatgttgttcccggaaaaagacgagagtgtttcgtgtctaaaaaactcctagaatgacacgtggtttatcatggtttatttaaactgcctgtagattaataataataattctctggcagaccacatgatacaattacgttcttgttactttagctcattagctcacttgtttttattacccttaattccaaaattaagggattctttttcatttcgctttttacatgatatcgagaggtacgtgattgttgttccctccaaaattagcattcaaccagtggtgcttttggttttttcccgtttactatttgctggatggcaagagatctgttaatgtctcccaatacacaagtaatgtaaactagggcatgtactacactaaatgaagatcaccatgaattctacatgatcatctttatttttttctttacagtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgtaaatttgtctagttttgctttagtttgtaagtatttagctatttataggacccttagcttgacccagtctacaaatagatgatgctcactggtaattccctcaggtaaaatgtctcaaaatctctaatcctttaagtggcatgcctgtgggcccatactaaaaattagaaaatacatactctgataacctggccatttttcattgaaggatttagctcatttgtaagaaagacttgagtgtagattttgggtgggtccctttggctgtgaggcattgtttaaaagggcattgctctagcctagaccgaccagactctcatcctgctccacttagttttgtcaccttgggagaatttgtttcagtgtgtcaattgaagatgccaattgaagtgttaggacaacctgtcacactgcctggtgtg

SEQ ID NO: 53290 - DNA, 1034 bp, Homo sapiens
cgtcatgtccaggttgttgtttactgtcctagccttaaggctaaaggactggggagagacccaggaaggtagggctcagactcaaaaggcatgattctaaggcttttgccttattctaaagcattgtgtattactaaacagagtcgtcctgttccccgccccccccaccccagaaggaaattggcaggccataaaatatgattgtaggaggaatacacccatgtactcagccccagggccaaggagcacagaaacagaagatgttcagcaaaaaggagtgaacctgagcccctggagaagctgatcaggaaaatatgctattgcttgggaagaggctcaaaaactgtgcagctgagaatagagcgtatggactgactactagattatcaaggagttattgttaattttgtgttacaaatattgttagttttgtgtgataatgatactttttttttgtttcttattattcttatctggtaggggtgcatgctgaaatgatataatggttgcatttgctttcaaataacaaagaaaaagttcagaggcagtgaaagttataaaataagatgggtgaaccccagtggtacttaggggttctccttatgtatgtttgtaaattaaaaaaataaaaggtttaaaaatacctctaaggtttgctggttgtatcatataatataatcctcctgaccagggaagtaaggatgatggacactccagagatttgctactcaaagcacagccctcagatggcagcaacgcatcacctggaaacattagaaatgcagattcacaggccccgccccagaccctgtgactcagacgtggcatttttaacaagatctccaggtgattcagacacacagtgaagtttgagaaacaccagtgaagctggtgagagctgtgtggtgcttctcctttttgaggggagaatttcaattgaccttgtcctgttttcctccgtcatttgcatattaggtatattgaaagtggttcattttatgatttttgtctacagctggcaaattatgaggagc

SEQ ID NO: 53291 - DNA, 1046 bp, Homo sapiens
acattatactggcatcaaacatataaggtagatgctgtttgacagatgagaacattttaattaattaaaattaacctcagggaggttaagtaacttgccaaggtcacacagctaatcaatggaggatctaggagtcaaagtcagttcttcctcgttcccgagctcatgttttaggattgtgtttctgatgtttcctcaagagtgtgtcatggcccaaaagccagcagctatttggtcatggagctgggactgggaatctcatctttcagctctatgttctgtcctctggactattctacctttgaaaatgacctagcgggagattttgctggtgaaaaggaaacagctggaatttctatttgtgacgaggaggcaatatccaatggagagtctttggtctagctgctgctagatttagctagagttttgtcattgctttgcaggtggccccctgctgtatgaaggcatcagtctcaccatgaactccaaactcctgaatggttcccagcgggtggtgatggacggcgtaatctctgaccacgagtgtcaggagctgcagagactgaccaatgtaagggaagcccagtgactgcaccttcccccaagggtccagcatccccccaccaagtgccccttgggtggtagccttcgccttcctcttcctggccacagttgaccacctcttctcaagccctcagctgccctggctaacatcaccttgtgttttgggccttgtaggtggcagcaacctcaggagatggctaccggggtcagacctccccacatactcccaatgaaaagttctatggtgtcactgtcttcaaagccctcaaggtaagatcaacactgggcattctagagtgtggagaaaggggtggggaagggggaagctcaggctttgaggaagagttggggctggtggcaggaaaggtgaagagggtccacctgccaacattcttgttgccaggaagcgaggatgagttatgttgcgtgaggttcacttttgaatcctgttagaccgagtgtaatcaaaacaaagtgagcag

SEQ ID NO: 53292 - DNA, 1050 bp, Homo sapiens
aacccaggaggtggaggttgcagtgagctgagattgtgccactgcagtccagcctgggcaacagagtgagactctgtctcaaaaaaagaaaaaaagagctaaatgtttttaaatttccagagctaaatattttgtaaagaccatttacaaaaggccttcattttatagtggtacccaggtcacccctttccatccataacctgaggaacaggaaattaggacccctgtgaaggtggctgagggcaaggagagagggttcctcctctgtggcctgcatttgagtgctccttcttcccagtagcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacaggtgcgtgcagttcagagccagaccttcagccaggcctcctgggactctaaggtcaccatctgataatataaatggggactcttcaccctcattcctcaatttattaaatctgagaagctgatgaaaaattgcttccatttgaatttgttcatcttaaccagaatttgagttctaaagagtgacctcatagttattccttctgtttgattcctttcagatcattacatccaggtcctcaactgtaagcagaactgtgtcacggagcttgcttcccacccaagtcgagagaagccctttgaagacttcctcccatcgcattataattatctgcagtttgcctactataacagtaaggcctactttccttcctctttctctgctggctaactaagaagctaaaggcaaggtgggcagggattacagccacttacttcctcaaggtgtttggcttatttcagtagctatgggaggcaccatgccaagtgatccctgggtagtttgttataaacaactggcctaggaagccaataccagcaacccaaaaagctgggggagggag

SEQ ID NO: 53293 - DNA, 1048 bp, Homo sapiens
tcgtgggcatgcgccgcccggcttggaaggtggggcttcgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaaggtgcagacctgcctggaaccaggcggccggggtccttctggggagaggagtgttgcaggggacctgaggagcttgggggatcggggaagtgtccgcagggaggggaaagtggcctcctggctggggagctctcctcggagccggggagagctgctccctggcaggagaccttcctcgcccagttcgcatgggcagatgctaaccccaaaggtccagcctggggttagggcacaggccaagcaaaactcatggccattttgttccctgggaaatctcctggaaggaattaaagcggcagtttgggtctcccattctgatgtcattgtaagtgtccgagtgagaagctagtagcggtctacaatatctcccttccggttggttttccagtggtgcttttcctgctgtttgattcagcagctctctttcaggatgtgaggttgccacgtcgccagcaggggctgc

SEQ ID NO: 53294 - DNA, 1021 bp, Homo sapiens
ggccggagtcctacccccggcgaaggcccgcccccgggcgaagccccaccttccaagccgggcggcgcatgcccacgaggcttgcaccgcctcttttcctttcagtcagcccggatccccccaccggccctcagcgaatcccggcgcgtcagccggagccccgcctccgagctcaggccttgctcagtcgaactgacgcccagtagacaagaaagacggaagctccgcccacgcgcctttatgcgcaggctcttcctactcgcacagcccagggagtggggaggataaggcgctgtcatggaggacgccgccgcgccggggcggaccgagggggtccttgaaaggcaaggagcgccgccagctgcaggccagggaggtatgcggggcgggagtcagcagggggaagtcagctcccgcgaggcagccggtctcggggctccgcgggaggccgacggcgggagctcacggcttgtgttcctgggtgtgtgtcgcaggagccctggtggagctcaccccgacccccggcggcctggccctggtgagcccctaccacacccaccgggccggggaccccttagacctcgtggcgctcgcagagcaggtgcagaaggtgaggaggcgcggccggggcagcgaataaccatcttcgttcacgttgtactctgcgtctttcggctcagacctcactaccacctatggtgggggtggcatttgctcttgtctccattttacagacgagtaaagccgactgtcattgtgagtcggtggcctgattcgaatgaccttctgggaccaaaggttcctctaactgcaacttgagtgcccataatcttccttcgtgggaaggtttacacaacactttagtgttcattatttcatttgcaccttaggacagccttgtgaggtaggcagtacagagttattcttcccatttgacacaaagaaaagttcttcgggaagtttcaaggtccgcttattttaagctgcttcccataagatctttgttacctgagagtttaaa

SEQ ID NO: 53295 - DNA, 1055 bp, Homo sapiens
gggcaaggactccaagtttagtcctcattaaacacagtattcccaagcccagtgtttatatatggatggccaaaataagtcaaataaggaggaaatgtgaaataatggaaaaaacactggaagtttggacacatgagtattaatcccacttttgatactaacttgcagtgcgacttaaggcagattacttctctctggacctcaactattttatctgtgaagtgaaaggtttgaagtagtagagctccaagatctaaagttttgtcattattcaatgaaaaaccagattccttcttatctcttatcaagacttccagttgtacaccctcttcagtgtccacagatggagggtcctgctgttttaaagattatcatggccccttatccctgtatacactatcagatttggccttgattatgttccagggtctttgctttgcccaaaattatttaatgtgctcaaattccctcacatctctttttttttcaatgatcctagaaatccttcgaatccttttttttttaaaattaagaaaaattcagatacgcagaaagctcctttaattcaaaacttggctttcttctttttgaagagctggggagcaaagtgcaacttttatttattaagagaatatgcatctagttaatcagattactcttattgggagggaggttggcagggacagaatcttgtgcacacaacgtattcatgtgctattgaatgactatcgtgtttattacgatggcctgaacagatggaagaaagaacacagtttttgtctttcatcctataatcttatgaaatacagaggatgcattattatgctgcctctgtttccccaatacaatctgtatttgagaagctgaagaaaaaaaaaactttagagacaaacaaattgaatcaaacatattaactatctaaaatgtactttttggccaggtgccgtggctcacacttgtaatcccagcactttgggaggccaaggtgggtggatcatttgaagtcaggagttcgagaccagtctggccaacatggtgaaaccccgtctctacta

SEQ ID NO: 53296 - DNA, 1034 bp, Homo sapiens
gcccagacatgactctaaaaaatatacctgtgcttaaattatttcactcattttcttcattaagggagggatctgatgtgtaaggtaactgcgttccaaaggttgttctgactagtatgaagtgaaaagccaaaaaagagattgtggcatgattaggaaatgagctcagtttgtttacaacccacgctgatgggaactgcctcctttgccttctctaggaatgggggacaagttgtccacatgacttccttggtgcctacaaactacagcatgacttgtcctggactccgtatgaggacattgagaagcaagatgctaaaatcagcatgatggacacgttgctaagccagtcagtggccctgcctccgtgcactgaacccaacttccagggactgactcactgagagtgggctttgacaaacagctctcacaggacctggctgtcaacctccttgttgcccccactgttgccttgagaattgaagacatgtaggtgactcacaaacttcttggaaagagaccctgtgtgaatgtaaatgctgtcattatgacttttaattgggatgggaataatcattgagacagagtcactgtctttcgggatcctctttggaccacagatacccaagtcagtcagtttcagagtattggccagtgtactttccttcttcctctccatcacttcttcccttaagttaaagtgttagagaagaccttcttcccataaaaaggttggtggatcgttttccagagagaactgttttcagtcttttatatatatatatatatatatataactggtagtatttaacattggggttgaggctgtctcacagttggtgcaactccagtttaaaattcatctgggaacgagaatgttgagtaatggagggtgatttaaaaaacaacaacaacaacaaaaaaaaaaacacttggcttggctggaccagagagtgtgtgattctgggatttctgtgctgttgatgaggtttgtcttgccccttttgctctctctgccttgctagagtgacaga

SEQ ID NO: 53297 - DNA, 1010 bp, Homo sapiens
ttttgagacagagtctcgctgtattgccaggcctgagtacagtggctcaatctcagcttaccgcaacctccgcctcctggttcaagtgattctcctgcctcagcctcctcagtagctgagattacaggcgcacgccaccatgcccagctaatttttttatttttagtagagacagggtttcaccatgttggccaggagggtctctatctcttgacctcatgatccacctgcctcagcctcccacagtgctggcgtttgagccaccatacctggcctgttggcagaatttcaattccacaagggttgctggcttccggggttccactagctgactgttggctggaggttgccctcacttccttgccacacgagcctctataacatggcagctttcttaagcaaagtaaacaaggattagagtctgctagccagatggaagttacagtctcatgtagtctgatcacagaagtgacatttcatcacctttgccgtaatcttttggttggaagcaagtcactaggctagcccatattcaagggagggagttatacaaaggcatgtataccagaaggcagacatcattgaatcattgaacagatcctagaatctatctgccacagtgctcagttgagaagaagaaaggaaaattctaggtaaaaaaggcaatattactaagtggttaagtgtgatgatgtcaaagtcacagatctgcacttgactgtcaactctgacaagacagcctcccagctggcatccctgcttccccctctgtcccctctccaatccattctgcatgcagtcatcagcttgatcatttgaaaatgccaaatctccctcactcttgacatttcctaacctaaagagtgggagagtagtgattgaaaagagagaaactgccttctgttcagtaagatgtactccctgcactgaccaccaaggggtgtcattgctctttcctggttaagccagttaccacacttgggaagggctagtggcaatgtgaggtgatt

SEQ ID NO: 53298 - DNA, 1004 bp, Homo sapiens
cacggacacgattggggatgggcggggccaggtggtttctccaccaatcagaggcgcattgttgggcccgacgaggggcgggctccaagactccaccaatcacaccctggcggttccaggcgctggcccttggggacgacctgggcgcctgcttgccaggcgatgcggtttactctggagggggtgacggtgacttgtgtatcgctgggcatccctggggacgtagctcacccgggttcctatcccgcgtaaggtgacgtctacggtttctgacgaaaaggggtaaatagataacgggactgttctccaggccaccatcttttcccagcagtgcttagttgtttcactgacagtgttatgagatctttcatttgaaatcttaggcgcaaaatctcctctccctggaagccttctggatcaggttttcccgggaacactacatcggcttgtatttcctccatcaaagcgctctccacgctgtaccggaattgagtgtctttccaccacattgggggcgggggcggggacgagggcgggggttgggggggtagggcagctgccgcaggaacaggactgagccattccttggtccccacttcccaccacagactctggtcaggattattgaatgaatgaagtagaatttagaagccaagaagttctgaaatctgaattcttacagtgcaattttaggtagacgatctgacaattcaggatgtatttaataatagggaaaggatatcattcttttctgtcaactacatttttaatgacccctttttcattctgtgatttttatttcataagtctcctacagttctggtccgtctgtccattgcaattgctgggcctactgctggccactcatcacctctcccaggatcactgcaactgccttctcactgatctctgtgcttcctgcttcctcctcattctccacactgcaatcgatgatcttcctaaaattcaaatctagttatgtctctctcctacttaaaaacctt

SEQ ID NO: 53299 - DNA, 7512 bp, Homo sapiens
ccccttggagcctggcctccatcagatgcctgctgacttgggacaggttgtgacagggcaggggaaaagatggctagaggctgagcacccacagcaatgggaaggaaggcaccaggaggcaggcccagcatatttgaataggtgggcatttctgggactgcaggctttggtttggcaagtgtgcctgcccacaccttcttcttctgctagacctcagtgggttggaagggatagggaggaccaacagcagtgatggaggctgcagaggctgcataccgctgtgtgtgcatgaacctgtggcatgcacacacacggaggggtgttgggatgggttgggttcacatggaattgagtttgagctgtaagtggtaggggatgaggggcatgtgagtttgtgactggctaaagcaggaatatttagattctatgagcacgggtatgtgtgtgtgatggtatacgtgcataagaagccgtttctgggtaactagggcctgcactctgctatacgtgtggctgggtgggtctggccagtcccatggcactgagagtgtggtgagtgtgctcaggcagaacgggtgctgcctgcctaccacatccgtgggagctggccagggtgggggcagggctggtgggcagggctgccctaggacgggcgtttccagttcctggaactgcttccttgtgtggaacctttccccatacctcctagctgggcccttgggagaggggaggaggccgtgggtccttcaagggggtgctcgcaggccagacacaagggagctaggcctggggaacagaaagccacagcgtgagtctttcaagcacttctgaagggtgacatgtgtgagtttgtcacaccaggccctcagtgcggtcagggagtctgtacttcctggatggcggaacctgtctgtcaagccctgcttcctccccagcaaggggttggggggagggcctgatggcaggagatgggcccctggggctttgagacatggtgaggagaaaaggggcaagtgggaagacccttttccttctgtatttctctttttttttttttttttttgagacatagagtctcactctgtcactcaggctgaagtgcagtggcacagtcttggctcactgcaaactccgtgtcctgggtttaagcaattctgccttagcctcccgtgtagctgggattacatgcttgcgccaccacgtccagctaattttttttttatttttagtagagatagggtttcaccatgttggtctggctggtctcgaactcctgatctccagtgatctgcttgccttgatctcccaaagtgctgggattacaggcgtgagccaccacacctggtcttgtacctctctgttctatgcctgaacttccaccactgatcacttgccatcatcccagcaagtcacactgagcctgtgaaaccacagggcactggaaaccacacgttaggggaagtgggagagttggcggggctctcagatgaactccaaccccttgtttctcgcctggggaaagtgaggcccacaaaaatagagggacttggctcaagaacatgcagtgaatctgtggcagagccaggccctggccctctcttagggaggggtgcaaggggaaaggaaaaggaagactgggtcctggcccctggcttgctcacccaggctgcatctccccctgcaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggtaagtaggagaggtcctggcactgcccttggagggcccatgccctcctgcccagggagtcccagatggggtgggaggtaggggagacttatctgcctgttccagggtattacctctgacccagcccctcggagcccaaggaatgtgggcactggcctgacctgtgaccccgtccccaggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtaagctggggcaggatctacctgcctggcacggcccctgcccacagcttcagtggctctcggatctgtgcccagcagggcagagtttctcttccgcccagcccccacagccttgcagaggacaactatggtacacaggtccagagaacacagcaccatggcctcccagttgacagcaagatgacttgactcttctcagtccctttcttctcactctaggcttccaaccacagggcccgccttcccccaacatgccgcaggctgttatgcacagtaccctctctccaggaggcttccccttccctgtccccaaaaccctcttgtggcagagtagcagcccccattctctgtgctggacacatctgtggccttgtcatttgtcctcccagcaacactgtggggtaggtcctacttttcccatgtgaccgatgaggaaactgagaaacagggctcatgctagtggcagagcctctagaactggggcccttccctgaagcagcagctgacacaaagtagggaaggccactctggcaggacggggtgggaaagggggtcagggcagaggcgctcacggcccctgcttcccccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtggtacgggcatggccctgccctcctccccactccctgagccctggccttcttcccactctgagccaccctcaccttccctccggtccccccagtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtgagtgcccccacccacccttcctgtgccccagccaagccctctggtcaagtgtgcatggtgaacaagtcccaaacttgaaacaacagatacgcctctgccgaagaagtttccctttagaccccaagcccgtaaggtcactgcagtgcagtgtcccttctgcctgagtatttgtccccttcattctttactcatcctgggtcccacatccactgctacagaggcagggaagggccacaatgtccaggtaggccccaacagtttctcttgtctggcaggtcttctattactccacgagcatcttcgagaaggcgggggtgcagcagcctgtgtatgccaccattggctccggtatcgtcaacacggccttcactgtcgtgtcggtgagtctttgcttactggcccccccagccaaaccccagggaggaggcagtgccatcttccccactggtctttgcagtgccctgtgactttctcagctcttgaggcaaggcctctgggtgggtgggttcagaagggcactaggcaggggtggcactgacactgtctctgcccacagctgtttgtggtggagcgagcaggccggcggaccctgcacctcataggcctcgctggcatggcgggttgtgccatactcatgaccatcgcgctagcactgctggtgagttgctaggttctggagagtgagggatgcgggagagtttgcctgggcttcatatcccaaaatgcctgtctcagccccaggctggcaggccttttggtggctgcattctccctggctgtgggtctgactttctggctcctgaagttgtctccttccaaaccacacacatcctctcttgaacttgctcctccctgcttgatggattctcagcgcagcacctctggtcccagaccccaaactctcacctccttaaggaattgctttgcctaatattaaccctttccaatcttcatctgtagcctcaattcatcttcacagcaaccccgggaagtagtgctgtcctccccatagaggcgcagaaacatgccttgcctcattcagttcacacgactggaggtgtagttcagttcttcccattttatgggggaggaagcttaagtcccagtgaggttagtaacttgtcagataaaggatgaagccaggaatcaacctcagtcccaggcctgtgactgtgaccgctgtgctaaccctgtgcctggcactcacacacaggcactcgtttatttagcctctgggcaaggaaagcaccatgactgtcattttacagctcaacctgggcttggaaagtttggtggttgccgaaaggccagacaggcagcaagtggaaagcccataaattttctaccctggcctcctcaagaatggttatatgcagaaccgtatgcttagcgcttactctgtgccagcctgagctgggcacctcacacgccttagaacctgaatccaccccacccccaggaatgttctgcatcctgccacaggcggactgtgctgcaggcacagacaggggaccatggggcctcttagcaccgtccacatgcacaccacattaccactcccagcgggtggactcaacacttgcagccaccctgcaggacttaaatcattttgttcggatgaggaaacttaggcccaatgctggatacacaacaaatccaggaccatccccaggcttcctgccttctcgcatagctctgctctggcctctgtagcttctgtttcccctgaggatccatcacaacccagtctaacttttccccctctccgtcatcctcaacaggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggaggtgagaacccccactgtctctatactcacccgcacgcatgaccccacagtgctgtgcaaagtgctggcccagcattctcattaggaatcatgctgaggaggaaactgagggtaggaagcccaggtcacatgaccaagaatgctgacctcaactccagggttctccccttagccttgaatggtgctcctggagcctgttacattctaggtacaagcgtggtctcagttaattatgatagcatccctgggtaggtggatgttcccttttcagctcaaaggcccaaaggtaaagtgacttatccaaagtcctacagccaggatgtagggtcatgactccaaccaagtgtgtctgtgtgtctttcagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaacatggttttgaaatgcttgtggattgagggtaggaggtttggatgggagtgagacagaagtaagtggggttgcaaccactgcaacggcttagacttcgactcaggatccagtcccttacacgtacctctcatcagtgtcctcttgctcaaaaatctgtttgatccctgttacccagagaatatatacattctttatcttgacattcaaggcatttctatcacatatttgatagttggtgttcaaaaaaacactagttttgtgccagccgtgatgctcaggcttgaaatgcattattttgaatgtgaagtaaatactgtacctttattggacaggctcaaagaggttatgtgcctgaagtcgcacagtgaataagctaaaacacctgcttttaacaatggtaccatacaaccactactccattaactccacccacctcctgcacccctccccacacacacaaaatgaaccacgttctttgtatgggcccaatgagctgtcaagctgccctgtgttcatttcatttggaattgccccctctggttcctctgtatactactgcttcatctctaaagacagctcatcctcctccttcacccctgaatttccagagcacttcatctgctccttcatcacaagtccagttttctgccactagtctgaatttcatgagaagatgccgatttggttcctgtgggtcctcagcactattcagtacagtgcttgatgcacagcaggcactcagaaaatactggaggaaataaaacaccaaagatatt

SEQ ID NO: 53300 - DNA, 5135 bp, Homo sapiens
gccactgagaaaccatgaagtcctggcccaagggacagtgtcaggcatgtctgagaataaggcatcctcagaatccagagtttgggccagaaaggcctcagttgtttgacaaacaacactccttgtttgacaaaggaggaacctggtctgcagaggaggtgaggtctgcccaggatgacccagcttggtgagtgaaagagctggaggcaacacccgcctcccaacccaagccctgtgtcccgtcaggctgaactgggcttcgtgctctaggcagcctctccttctctctcctatatccaaagagttctagtcctctctccccttcacccgtcaccactaccataaacccttactgcttacttatagcttgcccaggcattgttatacatactctagaaatagtaattcagttgttcttcaaaataaccccattaggcagacaccataattttccctgctctataagaaactggggcacaggaatgttaagcaattaaagcaaggacacacagctagtaagtggcaaggctgcaatgtaactccggggagtctggccctagtctgtgcccttgaccattgtggaagatggacacagtcccagatgggcacctaaacaccctttcactcacctacaactgccacctagctggcagtgtgtggtctcactttggagctgagtcaagctcagtcatgtaccaacatctcaggtttcccacacacagttgcacaatctcttacaccatcacaccctgtcatatcacatcacccctcaagcccttcagttagattcatggcttgttggtcatttagtgtcaactctgcacctccaccaccgtgctgggcaccagcaacatggatgcatcagacagaccatctccgtgctgaggtttactgtacagggagcacacggtaccttacagttagtcttctaaaggcgatgatggaaatgcgagcaagcacagtgggagcagggaaggaagagggagagggtgcttcgcccttagagcagggtttctcagcttggcactgtgatgtttctgctggtgttgtagaggcctgtcccatgcattggaggatgtttatcagcatccttggcttctgccctctagataccagtagccagtgtggcaaccaaaaatgtctctgggcattggcagatgtcctatggggtaccaaagccgtctctgtttgagaaccagttgcagtggagtgggaggggtggttctcgggaggaaggctttccagaggagtatctgtgcatgttctgaaaggtgattaggcccaagcaaaggtgtgaggtgtctaggtcgtatgagggagtcactgcgtgtgccttgtgagtcatagttggggtagaggagacactttattgcaagagctgagaagggcttcgggtgtggccacggcagtgggatgattcctctgtctaccgggaggcctggcctggcctggccttggtttggaggctagccatgtcagggctgttccagggaagcagcctgggtggtccagccctctgcaggggggttggggcccagctctagccccaacctgggcctcttcccccaggccccaaagtgaggccccaggggacccagtgggcagggttatctgtccagccccacctggaacatctggctccaatctcccagctcaccctggggtgtggctgagagttgctgtggagatgaaggccctgggctgagagcttgtgggaagggcagtgtggggccagccccaactggaagacaggggcaggcaaggaacaggggtgaaggccaggctgagaggctaagccggagaagctggccctttcctccttgtaactggcgctgaaagcttggctggcagtttagccccttcttccccacaatagcatcccgtagagcacagggagagttgagaccgagcctaaacctggcccagggatccctgctggggatgacctaactgacctagtcctcctggggtaaaggaatgtctagagggaaggatggtgagaccagccagaggttccaaaacgcatacccctcctggcagtggtctagaatcctagatcaagggttggcaggagggccacatccagccagcagcctgtttttgtgcaacccatgagctaacaatggtttttacatttttacaaggttgagaaaaaaagaacaatgagtgacagaggccatatgtggctcacagaccctacctaatggattctagctagccttttacataaaatgtttaccccagtccggctctggagcactttgacttgcatgctccctacttacagggaactcaccacctgtaaggtgggcagcctcataccctgaagtctataaagctcttccttcccctgagctggagtctggccctggcacctctgccctctggggctacagagtgctgggttcctctgccaggagcagccgagcagggtctggagactagctttattccctgaggcaggcccgtagttccttcaggttcctccttactcttacattcttagggtaatgatttctggcaatttcaaaatggaaaaccttgtccctaaggctcctccgaaagtggtgacttcttttcttgagagagcaacagtgacagcagtaacagcttacccatgtgccaggcagtgttcgccgcctcatgcccctctacaaaggggaagtgagaagttccttggcagatgggcagacatgtagtctcacccacagttgcctcgactggcgggaggtggtgtggggattcccaggtgtccttaggcttgggcaggcctccccctcaccccaggagagccaccgggtgaggaatagcttcgcgtaccagaagccatccggttcaaaggatctcagctgcccagagtcaacctgcttctccagggtggtctccatggtgggtgtcctctaggctcagtgaggcacctggacagagatctgtagtagcccctcagctctaggctggccgacaccatggcagtccccccaggaactaaccagaaccgctcctccctcctcaacacgcttgccgccacccagactccacagctgggtgaagagactgggctgggaagggagcagagaagcgggtggatggccgagcctggcacatttggtgtgcaggactccgactgcattctgaggggtggttcactgtgggaaatggggtctgactttggtggataggaagagtcgggagcagaatccagatgagacccagggcaggctgcctgggtagagaagtaggacagactcggaggcagaatcgagaggacctggtgatggatggatgtggggtggtggcagcatcaagtgtttaaatcctaagcttgggacgggcatgtgaggtgggagcgttcagaacaggcacgtgccaggtctcacctcacacatgacccagggttgcggaggctgctgggagccggcgggattgggcctgtgggatcctgtcagggcataataagtagactcttctttcctgaggtgcacccagacacttctagggaggatgtgaccccagagcttttccccatgtagggttcttctcattctccagcatccccctgcctttcctgggccaagagtcagcgtggaaccccatacgaatccccagggaggagagggcacagagcaccggaaccagcagtaggaattggaaaaccaggcgtggcttcttcccagaaatctcaggcatcaagaggcagaaacccactccccagcctcagcttggccaggaagtgctgctgtgggctggagaggatgggtctaggccaaggtgaacatgcagagagctggctgctcacccttcctccaccccataaagtggtctgagtaacagagcagctaggcagcgtccaggagccagccctggacaaggttgggtccctttgactgtgtgaccacaggcaggagacgtaactcagggtggagctctggtcacacctcacttacacacagccctcttgtcagttgccccaacatctcaagagatcttcaagcttatttaggtagtttcaagccttacttagcacctatttactctttctttgtatacaattcaaacaaattccatttgctgacttcttggcaaatttcaaaagaggtgtggagagttgtacaagacaagcctctgaaccacagagggttgggggaataccttagaactatggaatgcagaaatttagccatcaggagccagtctgcacagggacaaacacctctccttgcccctggagagagccccaagggcagacaccattgccctgcagccctgcttgtaggtctggttgctcaggagagcaaagtgaaatctcttcacattttcaccccataatgggtcaggaaagattggaccctcagaagggcaagcgccatttatctggaccgttcccatatccaccctcattcagagcagcctgttcttggtggagcctgataaacggggcattaccgttcccaaccagtcctcctctggggttagtttcgtccacagaagaacactttgcattttgttactctgttttttgtcaaaatctgccttctgtctgcccccagcagaatcaaggggttctaagaggagagcctaacacctttggttcgattcctccatttcctcaccaggtatccctggcactggctctgggacagaccatggtgtgaatcaactgtcttcctcagggaagacaaactcctggagtcagggaaacctggatctcgaaaggtttcagcaataaggccaggggtaccttccaggcaggagtagtagcatctcaaaggcgtagaggggtgggagatggtgtgtagtgagtgcaaaggtgtggtaggtagggagattggattgatacctggcaggagccccgattttgagttacgggttgaaggcttggggagactctgttagtggtctgcacagccttcaggccaccagtgtgcagtggggtgattttagggatgatgacaccaagcactgtttcactgattccctgcagcactgtgaagcagctcctgctaatgtctgcactttagaaatggggccatggaaactcacagatgaaataacttgctcatggtcacactggaaataaggggtggagctaggacctgaatttagttgtgtccagaatcagagttcaggtttctatt

SEQ ID NO: 53301 - DNA, 2013 bp, Homo sapiens
attgctagaaaaagaccctaagtagaagaacaagagctggtatctctaaaaccaggagaggataccctcccaagacagagggataatgtaagccatcgaagggccagggtatttgtctggtttgtccacggccgtgtccttagtgcctagaacggtgcctgtcatagtaatagacactggtggatagtgagtggaggaaggccatcgggtaccccaggggttgaactgggcaagcctctccacattgctgaatgcagaagaggcgatggtggccttgtggccactcgggctgactgggtggcacagcgtggatagaagcctcactacgattgggtgaagagtgagaggcagatgagaaagggtggagacggctcttccaaaagagttggtgggagagggagaaaagaggaggtttggaatgatggtatggctaggaatttatttatttattttaatgaaggttatttttaaacatgttggaaggaatcagcaggagagggtgaagataaggaagtgagggcggaggtcttccaggagggagggtggtgtcggagcagaagggaggggctgcctttggccaggagggactgagatacctttttttttttttttttttttgagacggagtcttgctctgctgcccaggccagagtacagtggcatgatcttggctcactgcaacctccgcttcctgggttcaagtggttctcgtgcctcagctttccaagtagctgggctactggtacaggtgtgtaccaccacgcccagctaatttttgtgtttttagtagagatggggtttcaccaggttggtgaggctggtctcaaactcctgacctcaggcgatccacctgccttggcctcccaaagtgctgggattacaggtatgagccaccatgcccagccagggactgagagacttctgaagatgtagacaaatctgagatgaacttctgtgatccccggggcctcccatctaatcagaaataggcaagaggttataactgtcatggaatatgggcagaacctctgaccagggcatcacggggctggtcagcagcacagagggcccagatgagcctgtaaactgcattcataggaccatgtatggtcacctgtccaaaggtcacttcaggaaccagccccagcagaccgaagctggagatgtgagtggccagaactgagaacgctgaaatctagcggtgtttcttgggcaagcacccagacacttggtctgttgacttttgtactttacaaacacttctcacaaggctggctgtagtttttccaaccaggagccagattagaagtgatacatgtaacatgtgaagagaggacagaaggacccaagaagaagaaatgaaagtgaggctcagagcccatgtgtagtaacagggcagagagactcctgtgcccgcgtaggctgaaggcctgccctagggcgacacagagattccatctggccaaccctttcattcagccaggacttcctgagcatccacgctgtgccagatgcggtcctagacagtaaggagagagaagtatagctgtgaacacagcaggcacatgctggccctcagggagctgcctgagacacagtctgagccaggccctgtctccacagcagtgggagagaccccttggagaaagccagagtgtcactaacagagggcttcaaggtgctgtgagagcaaacggggcaactaatgctggggctggggtgacaggggagattaaaaaaagggcttcacgaaggacttggcagccatgctcgaccttgaagggttagttgacctcatagggcaggaggggcaggtgtctgggcagtgagaggggcttctgcagaggtgcaggggtgtgaaatgttctgctgatgcggaattgctaactgcctgcagtgggcacactgacttcccttgtctgtttagaagaacctctcttaggaaacagcattgggttggccacagtttgcctactcttgagaagagactttgccccacaagtggtgaggatg

SEQ ID NO: 53302 - DNA, 1042 bp, Homo sapiens
agctgcaggggaggtgacaggacttttccaagtttgctgggcatggagaccgtgggcccatgcttggaccagccccaagccctgcatttgctaagtgctcttgacagctcttgccaaagtgtgtgcttcagaactggctccctttgggaatccttacagatggaaagtctgtaagacaggctgggaggaaacagagggaggttgagctctccacttggttgcacattggggtttccagaacgcccccagattctgatttaattggtctgggatgctgtttgggcattcaattaaaagcttcccaaccaattcgaatgtgcagccaaggttgacagctactggatttaatgatgtcttgactgtgatctcatagtgagttaatgacagaactaggactctaaggccaggacagaggaggtgttttccagaaacagaacagggttggggtgagcagggggccttcaaagcaaaatgcccagaagacagaaagcctggcattcagtaaagcgtgagtagtttagtgtgtcactagagtgaacaggaggaggggaaaggttggggaggtcaacaaggtaaggtaggcaagagccagaccacaaagggccttgtgagtatggcacggcacagtcagaaggggcggatgggcaccagcacgggggcccagctagggagcatggacttcaggatgaggacaatagggacccactgcccagggcagacgtgatcagacttgcattgtagggaaatgactcaggcgtctggtatggaggggcggacttaagaatgtgagactagagacgggaaaccatcaagaaagttgccgttggactagtgacataaaagcaaaccctcagaggaagaatggacaggatttggtcatcaattccgtgcgagggcaacagagaagggtttaaaaatggtttctaggtttctggcatgggtgatgtgtggtttgaagaaggagcaggtgtgccaggagctgagaggtggccgtgggatgtgcaggaatggaggcgtggggtgacacagctggagatgtgca

SEQ ID NO: 53303 - DNA, 2283 bp, Homo sapiens
ctaatgggaaggaaggatgcagcgcacacacagagggggctctgagctgcacactcctcctgggccgaagccttcttcctctttcgcagcctctgatgtgagagccttggcttttgcagtcgttgccctgactgacgctttcagagaatgaaaagaccatactgggaatatgcctggtaacagctatgcccagggctatctgtgatgatcttgaagtaaaggctgcttctgggttctgtggaaaccaaggcccagagacccacagccaggccatggccagctccacccacttccagggcccagcttggtatagtgtgcgtagtgaatgccagtcgtttctttggcatgcctcccgcagccctgttctcccacaatcagttaaaggcctgcctaatgtcacatttcctgacttcctcatttttatagctgaaaagagcacttttcttcagcagggctgacaccctgctggcctctcagtcacctgtggctaagcagggctcttcacctgctggcctctgcccttcctgctgccttaggtcctcggcttccaatggacagaagcaaactgctctttttctctcccatccctttgcccattggaaacaccttagccccacactcttactcaccttgtgcacttttccaaagtgcattcccgcctagcatgtcgtctatgtccatataaccttgggaggcttatggtttggggattattgccgtgaggagcactgggtaaggagtccggagccctgagctctgctgcaggctcctgagtgatctggaacttgcctcaccctctcagggctcagtttcctgccctgtgaacagcaggaagggtagggcaaggtgggatcacatctccaatgtgacaaacgaagctgttgccattttgctgacaagcaaatggaggataggggagaggtggtacatgggggacttagcctgctggaattcacagagcaaacaggcagatgggctggaatcagaagccagcggcttcagctccaaatccagggtgcttctcctatctatatctgtgctattcctaccaagtaatttgggccccctcgcataggagggctggttcctgggcctcccagtcagagagtctagaaccaccagaccctaggcatggctccaccagggaaatgagacccccaagaatccaaagcctctccctctctgagacctggctacagagagagaagatcatacttcccctctctccccaggaaatggcccggccagcccagtatcttgaagtcagctaggctggtttgggcacctaaggtcaggaattggccaagtttcctgggagaaagactggtgtggtgccaagagtcaggcaagatatctgaacacagaaacttgccagtccaggccctgccctgtagtaacctgctcccagacacgcctataacagtgtggtttgtttctccgcagaagctgacgggtcgcctcatgctggccgtgggaggagcagtgcttggctccctgcagtttggctacaacactggagtcatcaatgccccccagaaggtgagtactgtgccatcgttggcttatggacaccagcctgctctgttgcacatcacacatgcccacagtctcacgccaccacctgaattagagtcatttatatgaacgcactgtactgtctgcctctccagccagttttctggccctgatcatgtcagagactcttctcttgctttggaatcagggtggcagaattctagaatctcaggtcccacagaatcctggggtcttgtataggccctcttgaccaaccccccacccaactcagtcatttaataatatgtttgatgatataataaactcaaagcaaagctcaatacaataatgctgcatttccgtggcattctggggctgcagagggttttcatgggcttgtctcacttgatgctcactgcagcactgtcaggaggcagcaggcaccactcccagcctgcaggtgtgggaaacggccagagagaggaaacccgcccaatatcacccagctaagtcagagacagagctggtatccaacacctgcctgccaggtggtccttgagcctgcactcatacccatccacaggcagcacacttcctttatttgtaggttgaaaccgcgtcctctccctgaaggccctgtggcagtcaaagcagaaatggcgtcttgccctagggagccacagggggtgaaggtctgtgctggcttcctcctccctgccgtgcatcctagatctgtcctcacttgtttacttgaatgtcaggatggga

SEQ ID NO: 53304 - DNA, 1049 bp, Homo sapiens
tgtgtgtaattttagtagagacctggtttcaccatattgcccaggcaggtcttgaactcctgagctcaaatgatccgcccaccttggcctcccaaagttctgggatcaccgcgtcctgcccctggttctattcttaaggagttcccaaactgagtggcagatgggtaataagctagagactgcagaggacatagcaagagcaaaggcctggaagagaatggaatgttctagaaagtagtctcatccccagggagtgctgatgggctgctggggatcccagactctgggctgtacattgctccccaccagtaaaaaaggctcccacaagaaaatcacaagctctatggggctagtacccttctctaagtcatcaccaactgttcatcagcttgacaccagaataaataaatacacgttgagtgaatggacttcattgccatgttccagttctagccactggctggtgggggcagatggtgctgaggctgcccgatcgagggtagcttgctattcttcaccgatccagcaaacacttgtggagggaattctgccaggcttcatgatggatactgatagaaaacgtaacagcaaccctttaaggaaggaactttcatccccgttttctaggtgaggaaaccaaggcccagagcagggctgccttgtatccaactccaaggtgaaaggaggcagcttgctgcatttaaacgtgggtctgcttccaagcccagcaatgatcaagccggctatagtgggcgcagcagagtggcagcatgaatctgagattggtcgcagtgtcttgtgcctactgaggagcaggggccatgtccctccccctacacctagcactgagccacactgagcacgctgtttcttaatctgactggtccccatttcttctccttgcacatactgttctgtccacctggaatgtagccttgccactgctttcccacttggcagactctctgtgtgtccttcacagcccagctccaatgtcacctcctgggaactcatctttttttgtacccaggcaaaactggaaatctttc

SEQ ID NO: 53305 - DNA, 2275 bp, Homo sapiens
actcgctgatcgactgcatcagcctctacgggaatctcctccagccaagcgctaggctgagtgtgggcctgagtggcccggcagccagctatgtcatcagcactgtgggggacacagtgctgcctagaagcccgggctatttgtgggcttgatcctgatcctcattttcactgcatggtctcattctctccacaaagtagcctttgagcccaccagccacagaatgtgatataaagatcacccctgcttattccagaatgaacagcctgagacacatatcccttcagtagttggtcttgtgaatgcagtgtcctagtgcaaatgcccatcatctgttgaccccatccttgcccctgcctgccccatgctgtggatatctgggccccctcatcacccatcctggccccctgaccagtgaggatgccccctcccatctagggtactctgcgtctaaggatgaattccagtgtaattttctctcttctgtaggtttatttatggaagattggacctgttcatacatctgtggggcagccctccatctcccagctatataaagtctctaaccacagtgttgcattgtggggttaccatgtggtctgacacttccttgcatgaactaccctcactccagccctggacagtccagggcctagcaggcagtgtgtggggcctaccaggtcctggcatccaagctgtgtccaataaagttcttagatgtgactggaaaaaaaattggattaaaaaaaagcttcagaagttacagagccaactacagagaagcataataaatgaaagagtgtcttctagttttgacagtttggtgtttaccctaaagacttctctttgtgcatgtgtagatacatgcctataaatagaatatttgtgtagttggatcccactttctgcatagttctttgcaacccattctgttcaccaaaccaacccttagaggtaaatactggcagtgtttctctctgcacatacaaccaagtgccactatacaagttcactaactccctgttccttacacaatatgtacatcctattgctttttttcccccctgaacaatctaccctggtactcttcataacacatacatgttatgtgaaacacagatgtgtttcattctttccaatagctgcataatacttcattacaggcatgtcccaccatgattaagaaatagcagccccatcaccttcttcataccactcaccacctgatgtattacatgtatttattttctgccccagccttcaactaacctatcaagttccataggcagggatttggtatagttttatcgctgaatttccattgactagaagagtgttgggagcatgcattcaggcataatctttccttagcaatatcatttattcatagaagatcctctcttatggagaattaactgaagcttagaggaagagacttttttttgagacggagtttcactcttgttgcccaagctggagtgcaatggcgcgatctcggctcactgcaacctctgcctcccgggttcaagtgattctcctgcctcagcctcccgagtagttgggattacaggcgcgcgccccccacgcccagctaatttttcgtatttttagtagagacggggtttcaccatgttggtcaggctggtcttgaactcctgacctcaggtgatccgcccacctcagcctcccaaagtgctggaattacaggcgtgagccaccatgcccagccaggaaaggacttttttaaggtcacacaagtggaggagctgggacttaaatgtgtctgctgagagtgacagtgaactttgcatgtgcccaatcttaccaaattaatgttctcttagttgaattattgcccatctcaccaccaaatgtgtatcttctcaggggtgtcagtttccccagggtccagatcctggccccacacccacacatggccaaggagccatttacatttaacattccataataggatgcataccttttcggttatttagggaggatgtggttttgcctggaaggctttgagaatgctgggcagctagctcaggggacgtggggcttaaagcagaggccgatcaacttttttctaaagggccagatagagcgtaaatattgtcagctttgttggacatgtagttctcggcctgccactcagctttgctgttgcagtacaaaagcagctgtagacaaatgagtgtggctgtgttccaataaaactttattcatggtcactgaaatgtgaatttaatataattcttacatatcacaaaat

SEQ ID NO: 53306 - DNA, 1873 bp, Homo sapiens
aaaagaatgtacgtctctgtccccatagatgctccataaatatttcttgcttccttggactcccatgatgccttacctgggctgtgggtgacttgtacctgggccttggcctttatccaaaagctggcattctggcagtatgagcttttggggagtcaggatgctggcccatgggtattaagtcaggtaaatcattaaagctcccactaacccattcttcctagtaggggcttgttgggaagtgagtaggcatggcacatgggtgagagtgccaggccagggagggtcagctcatgtgagtgccctgcgctgctttgggcttctttgctttgcttttttgccttaggcttcctgcctacctttctgaatttgggtcacccttgggatagtttgaaagggacattcatgtccattaactccaagggtcctcacaactgccctgtgatacaagttacagtgacctcatggtccaataaaaaatgactttgccaagatcacacactgagcctcccaccccaagacatgctgccagcctttccaggatgacattagagggtggaaggaacccagagcaggaggggccttccagccatggcccagccctccatttgacaaatggggaaattgagtccagagaagggaagagatttgtccgagataaggctatcacaaaagatttgaggcgttctatggagctgtgttttgttttgatttttgagacggagtttcgctcttgttgcccaggctggagtgccatgacacaatctcagctcaccacaaccttcgcctcccaggttctagtggttctcctgcctcagcctcccgagtagctgggattacaggcatgtgccaccatgcccggctaatttttttgtatttttttttagtagagatggggtttcttcatgttggtcaagctggtctcgaactccagacctcaggtgatccgcccacctcggcctcccaaagtgctgggattacaggtgtgagccaccgcgcctggcctagctgtgttttttttttaaagatgctttcttctccacatgcctgtctgtgccatcctccacccaccccaaatgagcaggaatccccagacacaggacttgccatgccataggagcctgaaagttggattagacgtaacttgacaactgaaactctactgtgaatggaaacaaaacactagatgttcccactaaactctgaccttgaagaagtggctttccttggagccttggtttccttctcagtaaatagagacttggctacccccagtggatgtggtgagactggccccgtgccctaaattagagaagtggctattttaagtggaaagaccctttgtaaggccagtctgggtgtacaaatgatgtaaacagccccaagatgatccttgtctagtaccgagccatccagggattcgaccctatttgccccggagctgggccagcctcaaatcccccgtaatcagcttgtgacttcaaggagctcagctttgcccagtgcctcctggtcacggggtgtcggcccagagctctgctcaagtaccaagggtacagccatccagctccctgcttccccaagactggcaaagctggggaggcctggaacaaagaggaaagtgtgcagtgttggcttggggcctgcaacctcaccccttcccccacctcactcctgggcataaaggtgataaagccgctcactcagtctgcagtctggtaaccgacgtccccatgatggcggaggctgggaggcctcctgaccagattcatgggctcagagaggctgtgtccaggcctgcaggcccagccctggctaccctaacaagcctccaattgttacctctctccacgggaggggtggactggagcct

SEQ ID NO: 53307 - DNA, 1136 bp, Homo sapiens
cctttgcgaggagtgcaggccccaaagctttggcccagtctcgcggagatgtgttccgcggaggcaggtttaccctcggggccaggcggggagcgcaaccggaggggcgggggatctgggggccaggaaagagccccaggctgaagtctagcgggaagcgcgcacgccacggggttggggaatgagggatggggactctggggaccaacaactccctagataggatttctttttttctgtgtaagtgggcttgtcctgcagggcatctttgtagcgtccgcagagcgatttcttttcaacaaattgtttgtggagcccctcctgtgtgtagggcattgtttctttccacctcctttcctccccctagtctacaatattttcaagtcccctttttcttttgaaacggtccctctttatctattatactttgatttttccatctcgtcagctgggagggcacctggatggcccttgttttcttagctgggacgcgggggtagcactgaattttgaactgcccttcctactggctgtggaggtgtcccgctgagactgagcggggtggcgctgggccgcaccctcggcaggaaaaggccttccgccccacacctgttgaatccataaatccagacgacttggttcacccttcctgggccctcgcttgaggtgagaccccggggaagttcccggggaaggctcccaggatcttaggtgagccgtaagggtgggatataactaaacaaaagttcagtgagaagctcttctagctagtggcaaggaagtccaaatatctcagggctcttgcaggccacttaacttctgggcctcagtttttccatctgaaagagatcacttttgtcacttcctctagggaaggaactatctattcagcatactatgccagacatgggtatttatttgttgagtggataagggaatactacgtggagacagaaaagtggaggagaaaatcagcaggttcttagccaaactactttaagcgtcacggaccttatagccctgctggttactcactagcctggagctcagagaagggaaataagtttgccaaagtcacacagctagtaagtggttgaactggatttgaacccaggcccatcagatttaatttcatt

SEQ ID NO: 53308 - DNA, 1238 bp, Homo sapiens
ctttccatgcagtagacgctgttctaaacactttacaaatattaactcacttggtctttctacaaccctacgaggtggtactgttactatccctagtgcaccgaagtcacccagcggccgagtgagaactccagtccagctttccacccgctactccgcgcatcccagcttgccttacagccgggtaccggctccaccattttgctagagaaggccgcggaggctcagagaggtgcgcacacttgccctgagtcacacagcgaatgccctccgcggtcccaacgcagagagaacgagccgatcggcagcctgagcgaggcagtggttagggggggccccggccccggccactcccctcaccccctccccgcagagcgccgcccaggacaggctgggccccaggccccgccccgaggtcctgcccacacacccctgacacaccggcgtcgccagccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaaggtgagtcgcgcgcccgcgggccctcccgccaggaacaaaggcgcagactcctgcccgccttacgccggccagggcctcccccgccgccccgctgcgctgtgcgcccggggcgggccgcgcgcctctccgagcctggctcggtgcgggtcccgagcgcagcgccccgccgggccgctggccgcagtggggatgggcttcggatctagcgggccggagggcgccgcgtgcgtagttggcgccggcactgagcacatggcctccttccgggggcgccgcgccgtccacgcggccctgctggggctggggacacagggcccgggagcggcacgtcgcacacgacctcggcagcagcagcccagcctcggcccctcccggtgcgggggagggggcccgagcgcggcgcccattggctgagcgggccgagcccccggcccggccccggccccggcgcgcggaggagtcaggagccgcccccgctctccgtctgctcccctagcccggac

SEQ ID NO: 53309 - DNA, 1036 bp, Homo sapiens
cccctgctatcccctcttgtaccaattgtagctgactcagcaaaacctttcctcctggctgccagggacgcttgcctttaaaggcaacagagtcttttcccagcccgccttactcactcctaactctggagctgctaggacccgccctgcacggccctgccaccaccaccatcaccaccaccacccctcccccacccacttgcgtgctctgaggcacacactaggctccagcatccgcctggcacctgacacctccctgctagccagtcccagagagctcttttcctccagactagctggggctggaactgcttagaatcggacccagaagaggccgagttccgtccaggactaaaggcagcctccagggaataaagctgtcagtgtgggcgcagactagggaaggggcactaggtcgttcaagctgaatgctggggttccacagcctcctcacaccccctttagtgcctcaggtagagtaggcttgtggggacactgaggtttcctcaggtcctttccctgctcaataactctccatggctcgccactacccactgcataaagccctaactcctatacctggcatttgggagcctctgtgattccacttcttcagtctcttctcctccctaagcccccatgccccagccacaggggctacttaggtgcccctcctgctcccctttccccttgcacccaaaccttctctgctcatgtgctatttcctggggccttctctagggctcattccctagttggagttaaattctgcttccaaggaatcagccacccaaataacaaaccagtccacctgagaatctagtctgtgatgcagcgtcaatagcttctgatgaatttgcttctgaccagtagcctccaggggtcataaaacattcacagagaggaacacagagaaggtaatgggggtctgtgtgtgggcaggtggggtggggtgggtgaaggaaaagcttttttttggccactgtgctttttcctcaagcaccgccctaccatgggatggggatttgactgaact

SEQ ID NO: 53310 - DNA, 1024 bp, Homo sapiens
tctctgaatgtctgcatgtgtatgtgttcacatgcatgtgtgtgcacgcaggtgtgtgtgcgtgtgtgtgtgtgtgtcaatgggagaagacaaggggtggcatcttctttctctgttaagtagaaggtggtgtcatctctaagaataacggcagaggggtacaggtttgaggagtggtgaagttttttaagatgccaatggatagtggttgattactgagcagtgtccaaggcccattcgaagtgagggtcctggagctatggggaagcctctggctgtggtgggactgtctcagcagcatttggcttgccagggacaggcatgggaggatgcagaagggggggagtttgcttgaccagtgagatgaagacacagggaagagaactcatagcattgaaaagaccgttactgagacactgcacctccacgctgagctgtgataaggaaggacatgaggaagaagagggtgatgggctggaagaaagtagagggccagtggctggaggggcctgtgtcgtcagagagcacaagcggagggattcatgcagttggtgagtgggaagaggagaggctgtgggcagctggcgaggtgtgggagttagagttttagagctggagtggttctggctgtcagcagggtccacggtgatgctgtgggaggtgactgatgaccaatgggagaatgagtgaatcgatttgtgtggtcacctgagccattttctttctccagttagcccagcagcctgtctgtttctcatcctttggtttacagcaactttgcccccaactccacgacttcctcagtcttcttgtttttttgagacagggtctcagctggagtgcagtggtgtgaatatggctcactgcagcctcgatctcctgggctccagcgatcctcccacctcagcctcccaagcagctggggccacaggcacacaacactacgcttggttaattttctaattttttgacggggtctcactttgttgttcaggcagttcccgaactcatgggctcaagcgat

SEQ ID NO: 53311 - DNA, 1036 bp, Homo sapiens
ccctttccttcttcctttagcccaacaggaaggagttgttgctgtttgcttcaggaagcagctcatacaaagagacagttccacaccttaccacggcccctcctttcccctcccttccacatagtgaaagtaggaggaataatgattaatcaggacagtacttcctgagtgtttattattatgtgctaaggacttttcataggttgctccccaagtgaatcttcacaacagcctttaaggttggcagctactgttgttcctattctacagaagagactgaggttcagaatggatgagtagtttacttaaagtcttacagagaaggggaactaaactggactccagtctgtctgattaaagagcccttgatcttaatcattatcacagactgcaaagtaaatgttagtaccagggacaccgtgggcagagggacctggaatgatatggcttcaggaggagtgtagttggagggaagaaagagtacggaagtcacatctgagatgtggttctgggttgtgtcttgtccctggtttcctgtatgactttgggcagattatttcacctctctgtgccttgagagacttcgtttgtgcaacagggatgaggctaagaggccccacagccaactctgggccatgcgaagtgtgaggatggcagcaggaggaaaataggcaggagggtaggggctctgagtactgagggagctctcaggacccacctgggccctgctgctagttctatggccttaactctctgttaagagcatttatctaaagggaaggtcatctctaccaaagttgcaataaaaacaactctgagggaaaaaagtatatatgaaatatttattttttctttttctttttcagatggggtctcactctgtcacctgggctggagggcagtggtgcagtcttggctgactgcagccttgacctcctcagctcaagcaatcctcccacctcaacctcctgagtagctgggattacaggtgcacatcaccacgcccagctattttttgtatttttagtagagacag

SEQ ID NO: 53312 - DNA, 1055 bp, Homo sapiens
gcccctctgggcctgcctggttctccaggtttccaggtccaggcctcggtgaggacacatggatggaggcccaggtgggcagaggacgggaaaggggcacaatgccaccggacagactgctcccaccctggcccctaggtccccccggccctactccaagtggcgtgggggcctggcctgagatcagaggtccacccgcgtcagcccggcccctgctcgcgtcaggaggcgccttctcagtgcagaacaatgccggctctttgaagggctgggcagcaggggatgggtgtttctccaaacacagggcctcctttgcaaaacaggctttgattcccaggcccggaggccccaggtgcctgttgggcggcaggcggaggctgggggctttgtttggcaggaagaggggcctcgaagactcaggaacaaagcctgggacagagctggacaaggctacagcccagccttgggcaggcgggtcagggctgagatgccagtgggggcgcggctccgcatgtatcagcccccaccccctcctcagtctggcccactcagggtggccctggactcctctctccgtggatcctggctctctcacttatgcagcaggaactgttggatttccaggctgtcatgatggtccacaggctccacaaatccctgcttggggatgaagtgaataaaactggagtccaggactttggatccaggcggcagggaggaaggaggcctgaacgagaatccaccagcctgtgctctgggcttaggtcactaagaggaatgaaggctgccactttctgccaaataccatgctcattactttacacacacgtgtctctgatttaatcctcattttcccaggcaacaatgatctgcagggcaccctaggtcctttctggactcatctcatatactctcccctttactcactgctgtcagccaccccggcctcctcacagcaaagactcaagtttgcggaaagactgaggcagcctcaacactgcaacatagaaactctgcgtgagttgtgcacctgctggcttgccctgtcgccttca

SEQ ID NO: 53313 - DNA, 1566 bp, Homo sapiens
ataggtgagctagatgagtttgtctagagaggctgtagcataggattgtggggccaaggatgagattctgggttacagacgtgcctaaggggctttgcttatagaaaggaaactgagagcattgctgggccatcaggttcatcaggctttacagtgctgtagtgatgtctaggaccattcttttccaggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaatgtaagtgagcccaggtgcccgggtgaggagcaggctcagcctcccctcccactcccaaccctgccctctcccttcagttctgttcgtcctcaccctggggcagaaggcaagctgctatgtgaccagatgtggtatgtctttttctgtagaagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacacatacctttggttaaatagtctagactaaaagattgagaagttactttccattgctatctattgataatttagacattgagttcaaattgccttcattttatgataaataatgatttaactgacaccttctcatttcctttgtctcatccttctaaatagttatattacgatcaatccctgtaaagctcaatgcccatattttacaggtgtgagccaccgtgattttctttgtggtacagcttttggtttttcctccagttaaccttcaccttacattcttctgcttgcctaattttccttctatattcttagttctttccagatgctttgtcattttacccactttataatttttctcctacaacctagttatgccacacaactgtcaccttttttctagaccgtttaagttggcaccattatttccagaatcccatgttttcccatcttagcatatgccttcttttgctgtgtaccattttttggtatcttactaagaaagggaagatgagaggtaaactttttatctccttgcatttctgaaattgcctttaatttgggctgataggaatttcctccttagaattttagaatttcgcaggcactgtttttaagttttatttcagttctacttttggggggagatatatttttgttttttaaaatctttttttttttttttttttttttttgagacacagtctcactccatcgcccaggctggagtgcagtgatacaatcttggctcactgcaacctccacttcccaggttcaagtgattctgcctaagcctcctgagtagctgggattacaggcgtgcgccaccacacccagctaatttttgtatttttagtagagacagggtttcaccacgttgg

SEQ ID NO: 53314 - DNA, 1261 bp, Homo sapiens
ttcatctatgaagaatatacctagatctgagaatatacttagagtccctaacacagtttttggcacgtagtaaatgtcagagggtagtggtattaatcatggtgttgctattaagacaatgtagacactggagtaatggtatggaatggctgtaacggtccttgtgttcatatcacaggtgcaaacggaggttcttcagaagaggcagcaggagaaagcccatatgatgaatgctattaagaaatatcagaaaggttggtacatctctaataggggaacgagggtagcaggtactttagagttgatttgaacacttagtgctttggagccttcttggttgatgtggacctgtcggatcaaagttttgggaatggtgttggagagcaggatgtgactcttaaaatcagtgtagcaaataacagcctcatatggtggtttaaacttttattcttaaaatacaatggtgctgatcaaaactacttcttcacttacaggcttctctgataaactggatttccttgagggagatcagaaacctctggcacagcgcaagaaggcaggagccaaaggccagcagatgaggaaggggtgagaagggttttggcatggtttctttggttctgtgaggtgcgatggggccacaggtcacgagtatggcagacatagcacctccaccggcgcagccatagagtccagagagtgcagctgctgcctggggccaggacccctatgactgtgtgatgggcccttttagccatgtcagtctttgaagagtaaaagaaggcactttttaaacttcttttttttttggacagtctcattctgtcactcaggctacagtgcactggtacagtcttggctcactgcaacctctgccacctgggctcaagtaattctgtgcctcagcctcctgagtagctggaactacaggtgcctgccatcacacccagctaatttttgtatttgtagtagagacagggtttcaccatgttggccaggctggttgtgaactcctggcctcaagtgattcactcacctcagcctcccaaagtgctgggattataggtgtgaaccactgcacccatcctaagaaggtacttttaagtatgtggcaccctttaagtgaatgctgagtaaagttgattccccatcacacagtgcgatggttgagagttcagacctagggttcagatcccgactctaccactcagtaggagggcagttttgaacgagttaccatgcctttctaaatgctaattgc

SEQ ID NO: 53315 - DNA, 1076 bp, Homo sapiens
cacagtagagttcgcactcctatgagaatttaacgccaccaccaatctgacaggaggtggagctcaggtggtaatgcttgcttgcctgtcactcactttctgctgtgcggcctggttcctaacaggccacagattcatagtgggttcgtagcggtctgtggcctgggagttgaggtcctctgactttaaaggatactggaggcgagtgtaggttatatgcaaatgctgcaccatttttatataaaggacttgagcatctgtggattttgatatctgtagtgggtcctagaactaatcctctatggatactgagggataagtatatttaaatagtaccctggggtctcaagctggattttagggagcttttgtcgtggtagtagttcaccttcttactgtgaactctgtacaaattctcactgacaacttctcatcctttaactaaaatgtgtatgtttgactgaaaaggctaggcacctggtatctgcctgggtttttattgtgtatgtggtatactagaaaaggacactgaggccgcatactggtttccagcctcagtctactgacagtagaaatggggagaagtttgtcttctttcctgggctacaaataggcagtttgtataatgaaacagacagcacactgggagcgggaaggtgactttcaatctctggcttcactctggcacttttggtaaagtgctcagcctgtgggccccattgtcctcaggggttggaactgatgatttataagttccgcagtttaaagaacagggaatatctgttccctgctctagcgaatcctaagtagtggtcattccagattcaaatgacatgaactgacagcattttgtgttgtagattcgacagaagctgcagactaaacaggctgccatggagaggtctgaaaaagctaagcaactgcgagcacttaggaaatacgggaagaaggtgagaagaaaagtgtgcagggaacaggaagaggcggagtgtgtgttagatgagattgccgtggtctgacttggtcccctgaactgaacggaactgtgtgttgatcatgtatttaccgtctctcag

SEQ ID NO: 53316 - DNA, 1104 bp, Homo sapiens
cctcagggagcttagagtctgatggacagggagctctggcagggagtcagtctggtagggagtcagtccagcagggagccagtccagcaaggagctcactgccagccagccatagtggaaagggcagcagcccagagaatgtgggagcccagaggatgcccctgggcagactgagcaggtcagagaagggtctggaagcaggtgtgatctgagattagatatgaaggacaaaagagagataactgaggaaagaacaagagcaaagacccagggattggggactcaggtttgggtgccaggacagtggagtaggggacccagggattggggactcaggtttgggtgccaggacagtggagtaggggacccagggattggggactcaggtttgggtgccaggacagtggggtaggggacccagggattggggactcaggtttgggtaccaggacagtggagtgggggactggggaaatggtcagaagaggtcaaatcgtggggcctttgaatgaaggccaaagagtttgcacttcatatgatggggcaagagggaattgttaaaaaggaacaaggtagtcagatccgtgttggagaaaggacccctagctgctggccggggagcgggagcaggagaccctcgaggactctgtacctagggaccagaaatgatgaggcctgagctagtgtgctggctgggaggatggtgaggggtctgctggcaggtattagacggtatcgggaagtggggaggtggttaggaagtagactttgcagctgatgggatgtggggctgggacgctggaggagtcatgcgggcctttgctggttttcaggctggagggactgggtagatacctccactgagaaacagaacacggatgaggggcgctttggtggtcacgtgtctgcccctgtgggagctccaggatgagtgtcctttctccccagaccggatcccccagatcctcaacatggcctcagaactggagttcaacttagagacgatgccccggatcaactgtgcagctgcagggaaccccttccccgtgcggggcagcatagagctacgcaagccagacggcactgtgctcctggtcagccccc

SEQ ID NO: 53317 - DNA, 1067 bp, Homo sapiens
ctggggagcctggtcagactgtcttctctttctccgccccaggcaaatccagttccaaggttcagaccactcctagcaaacctggcggtgaccgctatatcccccatcgcagtgctgcccagatggaggtggccagcttcctcctgagcaaggagaaccagcctgaaaacagccagacgcccaccaagaaggtatgtgtcccagaggggcttaaggcacgggacctgactgttctttggataataccatcttgctccttcactaccctttatgccaggaacatcagaaagcctgggctttgaacctgaacggttttgatgtagaggaagccaagatccttcggctcagtggaaaaccacaaaatgcgccagagggtaagacccgaagttcctggttcctggagggaggtgtcagttcatctccagggctgagcacagatatctgtctcctcttcctatctaagattgagggcaagggaggtgttgattttcccagcgtctagactcactccgttgccacaggttatcagaacagactgaaagtactctacagccaaaaggccactcctggctccagccggaagacctgccgttacattccttccctgccagaccgtatcctggatgcgcctgaaatccgaaatgactattgtaagtgcatccttatcctcgcctcatgcatggagaaagagggcctgggaccacacaaacaaggaagctcatgctcttctctccacctctgacagacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcaggtgagacgtgtccagtgctgtcattctcaccagtcccaatgggcttgcacagctggaggatattaatgccaagtcccaatctctgatcctagtgggcttctctctctagctatgggatgtgcagc

SEQ ID NO: 53318 - DNA, 2595 bp, Homo sapiens
aggtgagtagggttgggctgaagcctctgcagaccctcacctataatctggggactgttaaggggagaagggatggtaggattggactgggttaatctgtgacccctagagctccttgtctggctctagtacctgctgaccccacctttattccatctaggccgtagcatggtgtccctggcagtccaatgtcctggcaacaggagggggcaccagtgatcgacacattcgcatctggaatgtgtgctctggggcctgtctgagtgccgtggatgcccattcccaggtaatcttttgcctgttcctgcctctcccacatgcattcttaccgggcaactacattcactccaatggcttcaccaactctatgccctggtgattcccaaacttctaactcagctctcactcatgagcttcatttccaacagtctgtggctatctccaatcctatgtcctataggcaccaccaccttgatctgtcccaaattaaccttgtcacttccccttgcctccctgaaatgtgttccttcctgtctcacattgctttggaatggcagaacctgctcagaaatctgagaaacctcctagaatttttcatcctcctcaccaggatctatcagttttacctcaaaatatcattgacatctgtcccctcccctcagcctcatccttccaagtggaggcccactacaatggcttcctcactggtgtcaagcattctttgttatctcctgcaatgcatcctccatgctgtggtctgttatactgtactgtccttaaacctgtgatggcttcccatcacttatggcatataatccaaatccattagaaagatacttgaggctctctccttccactccccccacattcagccttcactgtagatatggactctagagccagatggcccaagttaaaattctggctctgtcatctactaaacttgaatgtgacctttggcaacctattgaacttccttctgattgattcctcatctatccaatggataatacagatgctccctgatttaagtcccagtaaacccactgtaaaggtaaaaaatggttacatcagcgagtgtctataatttgcctctcaaggaacttttgtatggactatgatcattcaactctgagtctggagcatgtggcagggtgcctaacactagaatgggctcagttctgatttaagtagccttggctatatgtcatgcccacaccagctcctctccacaggtgtgctccatcctctggtctccccattacaaggagctcatctcaggccatggctttgcacagaaccagctagttatttggaagtacccaaccatggccaaggtggctgaactcaaaggtaagtggctaggtgaaaagccggacataaaaggccacataatgtatgactgaaatgtccagaataagcaaatccagagaaaaaacacattaatggttgccaggggctgagagagggtaatgggaaatgttgaaaatgtcttagaattagttttaacagttgtacaattttgtgaatatactaaaaatcactaaactgtacactttaaaaggatgcattttatggtgtgtgaattatatctcagtaacaccattgaaaaaaaagggaggaggccaggcacggtggctcacgcctgtaatcccagcactttgggaggctgaggcgggcagatcatgaggtcaggagatagagacaatcctggctaacatggtgaagccctgtctctactaaaaaacacaaaaaattagccaggcgtggtggcaagcacctgtagtcccagctactcgggaggctgaggcaggaaaatggcatgaacccaggaggcggagcttgcagtgagccaagattgcgccactgcactccagcctgggtgacagagcaagtctcaaaaaaaacaaaaaggtaggtgggtggcccagtgcctcctttatggctatggctgcatcagcattcgtatgtactgttctcatttgctccaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaatctgtttcagctaatgcctttcttctttcatgacctatgtcccagcagccttcctaggggctctactctactgggatcagagagctagatatgtcctgtgggagcctggaccatccatccctcttgtttgtggacagggctaagcgtgttgtgttcccccacctcctctgttcacatacgtatacacacagcctccgtggtttcctctgtcacttttaattaagacacaagttgagtaagcagcctccacaggctgtattcccaggcccccgcccaccctgacctttggcccagaagctactgcttcagtgtgtggggtggaggagtgagactgggtccacagtgacatta

SEQ ID NO: 53319 - DNA, 1506 bp, Homo sapiens
caccagaggctggactctgctgaccctgtcttattgtccactcacaggaggaatgggctctttccatgccatgataaactcttccgtgcatgtcataatgtacctgtactacggattatctgcctttggccctgtggcacaaccctacctttggtggaaaaagcacatgacagccattcagctggtgaggggcttggcctgacttacctataaccatccccccacattcctagcctggatcctgcctttatccagtctgtctcacctttgaccccatctctccctactcaacgtttgtctctttctctaccccctcttcccctctagtcctctcactattccctctgaccctggtctttctctatcctagatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaaccacggaggctgtgtgtatacgtatgtgaacagaggaggtgggggaacacaacacgcttagccctgtccacaaacaagagggatggatggtccaggctcccacaggacatatctagctctctgatcccagtagagtagagcccctaggaaggctgctgggacataggtcatgaaagaagaaaggcattagctgaaacagatttaaaaaaaaaacatgaagggagacatgactttattagaaaaataaaaaacaactgaggtgatgggttggtcttcagcggatgccttggtggatgaggctgcttttggctgcactggccttctcccgctcccgccgccgcgcagggtccaactcaaaacagcgccatagcctcagggtctcatctgctgctgcggatgcca

SEQ ID NO: 53320 - DNA, 1008 bp, Homo sapiens
ggaacagctcttcccaggcaagcaggatgtgtggggagcagatgcctcaaccaaactgcctcctccccctagttcccagtaattccttcctttcactgttctgtcctttctgcaatgaggcattgcaggtgtcttgtctggttctgtgtcttatctctgtgggatgggggtgtgcagtgggatctgtctgacatccgccctctgtacctccccagagtccttagccaggatggaggctgttgtgaacttgtaccaagaggtgatgaagcacgcaggtaagacgctatccaccagccctttccttccttctttcccgggatccctggatctacggctgtcttctaatggagagttcctatgaaacccttgatcctgtgacctgacctcatgtctgtagacccttcaaatgaagacccttcgaaccctgtgactcttcctgattcctttgacccttattcatagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgaggtgggcccctgggatgccgggctttaatttctgtcagcaggataaggagcaggccatagagccagagcatggcatttctcctttccagagaggttcagatccatgtcctcagctagcgaaggggagggatggctgggaagggagaactctggtggtctaatccacatcccttcccagttcctgatgtcgggctggctgagcacctatacctggcgctgtgaccctgtggactattccaacagccctgaggcacttagggtaagtaggggctggggctaggtcataagcaacctggtagatatgaccagtttggggcctgtgctcaaggcccagtttagggaggctcttagaatag

SEQ ID NO: 53321 - DNA, 1066 bp, Homo sapiens
ctgccattccactgctttccctaattctcaccctaatttccctagtttgtggtcattttgattcttcatcttttcttgcccacattccctacgtagatatcctttgttcatttttttttttttttttgagacagggtctcactctgtcatccaggcttgagtgcagtggcacaatcacctctcactgtgatcctgcaactcaggtggtcctctaggctcaagtgatcctcccacctctcagcctcccaagtagctgggaccacaggcatgtgccaccatgcccagctaatttttaaattattattatttttaatggagacagggtctctatgttgccctggctggtctcaaactcctgagctcaagcgatcctcccacctcagcctcccaaagtgctgggattacaggtgtgagccaccacacccagtctatccttcattctttttgccagtttctctgggctacatttcatggccttagatagtgccattttagtgtctcttccatgttaaaagatccttcttaaccctacatcccctctcactgactcactcgcgccatgctcttgaaacaaagtgcttagaatcactgtttcttttacctcccattcacttttcaacccctgtgtttgggcttctacttccaccactcctcagaaactcagagatcactgttgacctaatggctaaatccagagttttttcaatcctcatagtaatgtatctgcagcatttaatgctgaccatttcctttagtctctttctcccccatggcttctatggcacatgctctccttgttcatcctcctctctggccattccttctctgcagcttttggacttttatacttcttcctgcttcttaaatgttattctctaggacttgtccttaacccccttttcttcttcttctacctgctttctgtgaccaccacttttatgtgcataatttaagcgagttttattttcagctcagacctctttgctgagctgcagattcctgatggatatctctacctgtatgatccacagctggttgaatgtccaaatccagttattctagccta

SEQ ID NO: 53322 - DNA, 1053 bp, Homo sapiens
ggtatccacaaagctcactgaccacaatacatagcagtaggggagtctggtcaccagctctaaggcaatgccagacctttcccccacttaaactgttccggctcatcagcccactcaggtgttatcttctcacctcttcccttcccactggaaatgtcagtattaactggcatattgggtagagtttgagctgtgcttctctgaaattcctggagcatcttttggtgactattgtcctttactccaccaaaagattccctcctattgaatggcaccaaccccaagtttttttgtgtcccaggcaaatactgacttcatccccaccatactattaaaatggattccttgtcatccaagaatggaaatatcctcttgccccaacaggaacatatgcaggatgtcacctacatcttgttcccctaagcaaacactccttcctctagagggactcctctacattcatcaccgtaggagcacatgctgtcgtttttatcccccatcctcaaatcatctggagtacacaaatctcagtagtgtctcccactttggggtccatacagcctattaaatgcctcaatagagagtatgtatctcccacccctaacatactcattccctcaggagggaatacatatacagttttcctttgaagaaggggacatgacctatttactggctcagatttaggatttgcaaaaggtgactattggcctactctggtaacattcctctgtttttgactgtcctgttttgcttggagatcgtgctttctcctattcttgggtcccctggagaaagagattaggccattgtctcctaggtttgtgtctaggatggagaaagaagcagcagctgtgaaacgtcaagagcttactacaggacagagttcatcctgctgaaggcggaagcttatccaatcaatgtcagcataaggcccattgcctaggatctctccctctccagctctgccctgagcctgggattcagtcattgctgaacctctcttttgctcattgtgccagtcaccccattctgttccccttctggtgttta

SEQ ID NO: 53323 - DNA, 2054 bp, Homo sapiens
ttaggtagagaaatcagcagtcagatcttaagaccatttggtaggtgcatcaggaattgacacgcaggccagttttccagtcctacatgtattcttttctctgtatcctgcctctcttgctcttggcttcctgccttctctcctactcatttttagaacagtctagatgcaggcagctagaagagttatttcctccaagctgtctaggaaaagggacaattaaagagagattctgcacttattatgatataaaaaaagaaaaacaatgagagaacatagtactcttttacctgtgacgttaaatgggagtcacacaggtttagctatctgttctaggagtggatgaacagactattctcccatgtcacttctttcctcctggacaccttcagggagacagctgggtgaagaatcatacttctgacctctgtcaaacagggtcagatgccgcagaggttctgagatgataaaggaagtgacagagggaacctgaggtaccacatttctgatttgtcatgaaagtcttaccttgcttaagatgacttttttaatgttcctttcagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctacagatccttctccccaccaccctccacagtccttgatccagaacttaccctaatctgatactgcctcacgtcaatggtgagctgatggacacaagatcaaataaggctatgcttattttgtgctgccagaaactgtagcaacctctgtgttcttagaggcacactgtttttgcaggccctcctgcctgggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttgagtcagcagaagtggaccaaaggattcctctgaataaagttatttaaattgatgttcactggctcagggttgtctgacagtaatttatgagagcactacatagggatcagaggggcagtttcaagagtgctgcaaggcagttctaatttgttctccataaaaaagtttccgtatctttaattagctttgatctaaaaatcctgaaacttccctcctgctcataccttccagctgccttttttctgttctgtcacacactggtactttggcatttgttcagtgccaaacaaagttctgccaggctgtggcagcaaaggactggaaaagtggtcccagatgtcacatctgttacc

SEQ ID NO: 53324 - DNA, 2110 bp, Homo sapiens
gtgggggtggagcttgcctgacaggagacagtcgggctaaatccggagggaggaggcagcacctgtttgcttggcgtgggaaaggattaggttgtaatacggggaggctgagatgcagtccaaggaagacggctcaagaaggtggtgggttggctcaggccctgtcctaagctgctggatggaggctgttggttgccgatatagcaggggatctaattggaaagaagcccaagcagtgagggaattgtgggccgcgatggctgaaagctaagcagcttataatcagaggccatggtggaacccgggatcaagtttctgtcaggcaggtttgcaagacagttttgcatccctcttcccagcctgtgccctatagttgttaagggtgaagaaatggagtaaaacaggagaccaccgatgggaaggaaatgctttgcagacccccagcattttaatttgtttgtccagtgcttagaagcatgtgtggtttttgtttttcatttgtcacttagtttcttgcagctggtagtctcaataaatgttaatgggttgactgagcttgtgaaagaggcacgggaatattgacacagagatagatgattgcatattaattcagcaaggagaaggttgaaacaaaatgatgagagcagatggaaagctggagtcgttggttgggggagggaaaggggagagcaggactggtgttcagagaagtcttcatgagtaggcagatttcccagagactgacaagacagccaggctcacagatgctaggatggaggaagctggagtgcatgtgctacagaggtgcacatgagagaatgatctcctggcattaggtctgtcgaaaatgtctcagtgagggagtgtagggtgtacctaacacagagaaaaaccaggcatagattaggaggtgatggggaaaaggaatcagttggtggaaggacttggggtcaggcaaacaggttggaaggtctcagggttgatgctgtctataacccaaataccaaagatagaaaacaacctggctatcctatgccaatgagatcctgtgttacctgactggtgttgcacaccatctccttggctttccagccctcctttctatgtgtcatactcgtttatctgggtgaccaacctgttcctattggtgcagagagaggagaagcagcttgaggcatcattagatgcactgctgagtcaagtggctgatctgaagaactctctggggagtttcatttgcaagttggagaacgagtatggccggctgacctggtaagagttaccagggcaagctaggaagggcttatgggtgggggggcctagcctcctgatgaataggacatttctaatgatgtaaccatttatcagtttgcaaacatcttttgatttggaaagagctgggtttcctaacatttagcaagtggattccatggcaaggaagtagagaaatgctcagtttcctaacccaagttctttctagctttcaattcttaccctttgacttctctggtgaggaggtcctcccactacagctctattcgtgctggatctcttgccacagatgtggctgagtcttttagagccaacctactctgaagtgtggatcttatttccaggctggaaaggaggcttttacccggtttctgaagttttagttataacagtgtagccctggttcctattttgccactgttcctcaccccattcaaacaatgaactgggttttttctacgtctgtttcataaactgaaactatgtccctctttcatagccctgtcatccctgttagtctgttcccacttaggctagtcatagggctatgagacttttggaggtgaatccaagtgttcctagcctgaaggaactaggactattttactaagaaccacccagggaaggggtacaacattcttacaccttgttaccaccaccaggccatctgtcctggacagctttgccttgctttctggacagctgaacactctgaacaaggtcttgaagcatgaaaaaacaccgctgttccgtaaccaggtcatcattcctctggtgttgtctccagaccgagatgaagatctcatggtaagaggagaaaaagaatacaacttgggaa

SEQ ID NO: 53325 - DNA, 1006 bp, Homo sapiens
ataagtgctgtaaaggagtgaattagggtgtttaacagtggttctcaacctaccttgttaagaaatggggaggcaaggggttgtgaataggaagactcagaagaatgacatttaagctgaagcctgaagaataggtagaagttttctaaaagaagaggcagagagcattgcaggcaaagggaatagtgaagatcttcaggtgagaaggagcccagtggagccttcagagaactaagaggaagcaactccttgtgtggatgcagtttgacaatgagaatagctagcacttactgaatgcttactgagtatcatctgatactcaaaaattatctgaaaataagcacttttattatctgtgtttcacagatgagctaactgaggcatagagagtgtaagtctctgccaaaactatatagttaataatcagcagagcaagcatttgatcctaagtgctctaacactggaatacatgcttttaactgcgtggggattggtgagagataaggctggagaagatgcagcttgaggccatgctagaggctcaggactttgatgtatagtggtaagaagattttagccagttcaagaggggaaataatccacattattttgtgggaatgtgttaacaaaagacagcacaagggttagaaaaggctgaacaaatcagaccttaatcacaaagggacaggcacaaaaagacaaagcaacaaattaatgagatggaccatgcttcattcttcctggtatacatggtatgcagcacagtgcctggtaatgttttattcatcttggtataaatggtatgtagacctcaataaatattccaaagaatgatagccttcctctcctgtttaattgcaacgacatccctatgaagatattcttatccacatactatcaataaagaaaccgaggcttggaaaaattaagtaacttgtccaaggtcacctatatagcaaatgatagaatcagatttgaatccaggtccctgaccccgaaactctac

SEQ ID NO: 53326 - DNA, 3010 bp, Homo sapiens
aaacacagattctttcagggaaaaaatgtgaaatccatttgtttgcatttttttttagccccagatctcctccagtggatctgagaaggtgattatgcgtggctttgacctctagttagcattttgtacaatcagggataaagctgcctaggcccactagacttccctgtctcatcactttgggtaccccagaagtagccaggcaaatggcagtcctgtgtgcctgatgactggtcatgtaatttgattgaggtataaaatatttcataacagtgatggaaaaatgtggaaaggggcccttcttggcaaaagatggagaagccctacttcagtacagtctgaagcttcatctgatgccgaactcccttcacctctgaggttcagtatctgagcacacacagggaggaagcacagtcaagactcagccgcatagtaggggaattgaggttctcacaggattcggcctgtctggcctgagaagtgctgggctataaattctggctttgctatggatggggcagcaatgccatctgccccattctgtcttttctgtaacttggggcaggcagaagaccagtccccagactcaggggacctactgggccggaaggtaggcgtctccatggtgacagctgatcttgggctggtcagtatgattcgtcagggcatcttggcactgcagttactaccctcgaactctagtgcaggtcagtagaaggaatattggtgggactggggaagcagggatacaggaagggtggggctgactgctaacaaagatagcagttccagggaatcagtgggccccagggaagaggatctgtttccttgtttgcaaaatgtaagtctgtattagtgtgtatcaggaaccctcgactctgacaaccatcagagaccctagaaggagtagagctccaaggatatcacttaggggaggttatgatctggcattcaagaggaagaagcaggagggtaagggagaaggaaaggtgtttgaagtttataaaacttcacagtttatgaaactgccgacattggtgggaagacactgagccgttcaggaccctgtcagttgggtgcctccctgtgagtttggtctggccagtgtctccaggtctgatctggtgtttcctgctccagggattatcgtgatcacggatggggtgaccagtgtacctgatgttgctgtctgtgagacactgctgaaccagcttcgcagtggcactgtggcttgttcctttgtccaggtgaggactttttaggaaggacgagagagatatggaatatctcacacaaagttgggatggctgattactttcttacaggcagtgatttcccagataaagtcaattacttagttacatggggggaaggagtcatatctagaaggtaggtagcatcgtgggagaggactcttatttttttcctctttccttaggattttggaaatagctgttaaagcaaaaagaatgcagaatttgaaatctgacagtcatttccagtcccacctccccttgtagattagtcattattgttttgagtgcaagggtcagaaaaccccgctcaaactagcttaaccaaagggggaaaaggcatagccagggactgcagctaatttggattgatggactgtagggaaggaggtaaaaagctatgggaaacaaggctgaaggggtaggcacaggccagaacatgaaaatctggttctgctttattaatgaggttaagcatgattctgtgggtgatgcagatagatagaaggaaagtcattagttgggtttatgttttataaaggtcactcttgctgctgggtgaaggacgggggaagtcggggaggctactaattgcagtgagagaggatcagggcttaaattaggggtaagaggattgagaaaaatgaagaggcagagtcaacctgacttcatgattagcaagatgggggtaaggagatgagagagaagcgggcttaaagttgtctccaagtttttgactccagtgatgactgggtagcagcagagcaaaaggaagagaagcagttgtggtagagtgaggataagatgatgaatgcaagtttgtgtatgttgtgttcgaggtgcctgtggttcaacacagacagttaagaacatcacctttggagttaggcatgctggtctaaatcctgactgcacttactaactgtgtgacattgggcacatcacttcacctctaggtcagattcatttgtaaatggagattgtaaaagtacttatctcactgggaggtgagatgcatttaaagtatgtagcattgtacgtaatcacttaagaaatggctgctatttgtagcaggtagcagttgaatacacagatcctgatattcaggagacaaacactgcttgagaggtagagatttaagatttatcagggtacagatggtaattgagaacagaagagggtcctggaagaactttggggaacaccagtgttcaaggtctttcataggaagagggcccagcaaggaatgaagaatcagccaggaaccagaagattgtgatgtcagagaaggtcagaatttttggaagaaaattttactggatctttctgctgcttctcacaatggtaactacactgtgagaagtagcaaaaagatcaagtaaaatgaggaatgaaaagtgccctttggatttggtgattaggaggtcacggggatctttttcagagccattttagtgaagaggtggtgaggggattgaagagtggatagaaggaaggaaatagggacaagtgttgacaaaagaaatttggctgttgagataaacagcagagcaagagagagaatggtaaccagagggaagtacagggtaaaggagtgttgtgttttgtttttaaagctagagacttaagcatgtttctaaggatctgtagtgaagaagagtttgaaaataaaggaaggaaaaaggaggctggtggagtaaagtccctaaattgacaggagggcattgtcttaagaaacagattgagggattcttttg

SEQ ID NO: 53327 - DNA, 1050 bp, Homo sapiens
tcagggtatatgtagtttgctaatttcccacctacagctattgtattcaaaatgtagtccacagaccagcagaaagcttgtttgaaatgcagaatctcaggccccaccccagacctactgcattttaacaaaatccccaggtgtttttcatacaccctaaagtttgagaagtgttggtaagctgaagtctctcaggatgatgacaggaagtcagtgaaccagttgccaaaatctttagtgaaggaggtggtgggcctttaggtatcgaggaggaagcaaagaggatgctgtggccggttagcatgggcatcagacagaagggcttaaggaaggaaagacacagacagtggtctgtcctgggaaaacactggcctacttcccactctgtggtccagggaatgggagcagccacctagcccagtctctttctctcctgttcttccttctcctatgcctctgtcagagctaggtcttcagttgctcactttttccaggtgggaggagtttactcttatgactgcagttttggccatgtgcccaatgtggaattaatgaagttcatcgcaatggcaacatttgggtcctacctgtccacttgtcctgagccggagccaggcaacctgggtctgactgtctaccaccgggcatttctcctctattccttcctgcgcagtggggaagcactgaaccctgaatattactgcggtgagaggcacactgaggtgggtgtgggaaggagggaatatagaatgggcccagagatgatggggccctggaggactgaaagtgtaactggggctggctctgctggcactgttacctcacagtcatttcagcatagccccttccccctacagatctgtcagttggcagataaccagtttctccttccccatctccactggtcttccaggctctcagcaccgcctatttaatgagcacctggtctctgcaagcagcaaccctgccctggccttgcgccggaagaagcacactgagaaggaggtgccagccgacttggtcagcactgtgtccgtacggcttcgagag

SEQ ID NO: 53328 - DNA, 1118 bp, Homo sapiens
cggagtccacccatggttttgtttgctctttggagtttgtaccctggtcctctgcaaatgctcctatagtgctgtccttcctgtcctcaggtgctctccctccagcccagtggttctgactcatcccatgcccagtttgctgcctactggaagccagtgctgtccatggatgcaaattcctggcagcgatggctgcacatgcatcgcctggtgctaatcctggagcatgacacgtgggtgcccttagggctgggccatagttggggtggagtatcggggtcagggggatagggaatgatgggaaggggagcagcagatgagctcttaccaactgtggccaaggaaaaactatagccttttccttgcctccctgctcttcagtccccataacctcaggcaaggcctagaagagagtgatagtagtctattccttttctccaagcctggggcctggaggtctaacctcagtccacacccctcttcctagaccaatccccaagcacttgcacaccccgggcagcaatgggcgctacagcactatccagtgcaggatctcccactcctccctgacctctctgctgcgggactggagcagcttcgtactagtcgagggctattcttatgttaagctgctctccaggtgggcaaagtgatgtcccttcaccccccgcccccccacccccccgccacctcatcccatgtctccctctaaccccagacctcactgctacttcctgccaaccttgggctgctcactgactcccatttctccccagtgccccagaccagccccccaattccttctacatggtccgtatcatttccaaggccccatgcatggttcttcgcctgggttttcccattggcacaccagcaccggcccggcacaaggtaagctgggccctgactgactctgaccaaggagccctagggtgtaggatagctccctctccccaaaccccacagggccaggtctaatagagggaggagcccccagaccaaggaagacctggagaagagggctgtgtctcactttgtctgtgagccccttctcccagacctgtaggagatgggagtaagaggatgtgaccacattttcccctcagattgtgtcaggc

SEQ ID NO: 53329 - DNA, 1010 bp, Homo sapiens
gtcaggccgctcagcctcttctagcctggcgtcactgtcccgctacctctaccatcagcgctggctttggagtgtcccgtcaggactggcccctgcgctgcctctcagtgccattgcccagctcctctccatcctcactgagtatgtcatccaagcctgccaggtcactcggggcaaggagagagcaagtgtagactgggacactagcaaaaagcctatagcacacacttctcctctctaattcccagtctgaagtatagagcagcatctgctactgccctccctgtctcctcccatcacccgatttgttttgtcctctctcatcctcactggatttgttataccctgagggaccgccagtctaagcagggccagcagcagacttggctccttgaggactgctgggaggtgggtgtatgtggggagagcttgtagtctcagtgtctcttcttcccttatcctggccttgccccggcctttatggggcttcagagtccgactttctgaaggattccacttcgcctgcagtggggaaggaatcatcaacatggttctggagcttccaattcaggtacgtgccatcccccatgacacctccctgccaaggtctgtcataatcccagggacactcacctctgagctgggttgggactgctggaaactgcctcacagggaccctgtggccagaggatgctcaaggtctgaggctgcagtcataggacaatttggtgagggaactgaaattctgagggccagagctaggccaggccagatctctgccttggctgggatttgcccaagatctcccattttgcccacagaatgaaccaccagggcaggctgcagctgaagagaagcacacctgtgttgtccagtacatcctcttccccccacactctacctccaccaaagacaggtgagacaggccatctgtgagggccgcctctgcagagtcagccttctccccaccatcccctagaggtctggctcccatatcctgagatgatctt

SEQ ID NO: 53330 - DNA, 1011 bp, Homo sapiens
ctgaagagctggaacccagggtatcctgggctaagaggggttgactcctgacctctgatgttcttcctgtagctccacccacgggatgctgcctgcataggctccatgctgagctttgaatacctgatacagctgtgtcagagcaaggaatggggtcctctgcccccagagccgagggtctctgatggtgagtggggcaggcggcccactggtggagcaggggagtgggtagggtaatctgcgtctcactgtgtcctgtccttcctccctcgtaggattggatcagggaggagacacctgcgtccatgagatccctttccattttgacctaatgggattgctgccacagtgccagcagctccagatgttcttcctcttgcttgccagaggtaggtgaacctggtaccctttcaccccacacctaaagggccagcaagcctggaagtattagaaaataacaaacagatgggtcagcaagtgagcagatgagtggtgggggcaggaggagcccatgaggctgaaggaggggccagctggtcagggctgagccgggggcaccgggcagcaggaggctcttggtgctgagcagagtgtgtgtcgggcagagccagagggtgtccctttcgccgaggggtcctgtcctgccaacgacatggtgctgtgcctgctgcacagctgcctggggcaggagctgagtgaccgggagatcccactgacccccgttgaccaggctgccttcttgagtgaggtgctgcggcggacctgccacgttccaggtgagttccccacatcctcctgacaccagaccctggcccagcccttttcccccaccctcacagggtgatttctgtctttgagttttggctttccccttcctccccctttcttcaacccagagtcccgcctctctgctggccctgccctctttcacccatctctacccccattgtaggtgccgaggggccactgctgggggttcatgggatcccgaaggagcaagcagtcggcagc

SEQ ID NO: 53331 - DNA, 1042 bp, Homo sapiens
ggagggtgctgaacctcgggaacgagctatcctagcttctgaatccaggttaggattatacttgaatgatggataagggggtacacagaccaagtccctataaacaaggaccttccagtccaggggaatgactgtgcaaggtagtatctaagcacctgagaagcagtagtgctttgtcgccggctcacggactcccatgcagccttcctcaccaatttggcacaggcagcagtctccctcccaggctctccccatctcccctgctttggtgttgagtgatgagctgagtcagggatagggagtcccctggtgctaaccgtgaacgtagagacttgttctgaggacatccacacaatagtaggaatctccccaaccaatctgtgaatttcatgggggccaaaactgtattttgctcactgctaagtccccagctcaccttaggggctcagcaggtccctgttgaagggaggaaggggaggagagaaggagaaaggcaagcaggcagacagctatgggtctagcatctgcagtgtgttagcgttggggaaacagaagaactagaaggatggatatgctgatgactcctagattggaactccggtccggttctttctctggagctctagatactcactttttgtgccccccaaatgaatgcattttcttcccactaacccttgatttttcttcattcatggtgaaaaatatcaccctcaatctagtgatccaagtcagaaaactgggagttatcgctactctgtttcatagaaatccccatccatcaagaaatatgaaagttaaggctgtaatatgaaatattacagtcactcactcctgtaatcccaacactttgggaggctgaggcgggaggatcacttgagcccaggagttcaagaccagcctgagcaaccaggggagaccttgtttctacaaaagaatttaaaaattagctgggcgtggtggcatatgcctgtggtcccagctactcagaaggcaagtggtgatggcgccactgcactcctacctcagcaacagagtaaga

SEQ ID NO: 53332 - DNA, 1034 bp, Homo sapiens
ttccgcacagtgccttccaatccccactacttcttctattgccctccatccagcaggcgagaagtgagtggctctcttccttacctctctcgtgccctcaacccagaggcccacccagaccctcttgagtcttggttccctgaggcctggatgtggctcttgtcttgccttagatcaagctgtctaaggcaagacaagtgtaatcccacttgcctaggatgaggcaagtgggattcttgcctcatcatcttgcttcattcttttgcctaggatgaggggcctcgggacacagtagacagaaaaatcagtgacctggagttttcagaggctgagcttatgggagaagaaggtatgtgggcaagtgagtcaaggtggggaaggctggctgcttcacgccgagattcaagggttccactgccagcctctctcattgaccatgtgacatgcactactaggagacacatctgcctgctgtgtggtcactgagagtgacccagagctagaggtagaataccgggagagccgtgaatcagacctggggcctgctgggctagactctgcctcgctgtcagacgtagacactgtgaatcctgatgaagactccttcagtatcttggggggcgactcacccactgggcctgagagcttccttcatgacctgccaccgctcttcctgcacctcacgtgctccgtgcggctacgtgggcagcacagctcagtacctgtgtgcagcctgcctacctgcctgggtgagtttgaggcagcccgagggaaagccaaaggtcctggaacagcctgcctaagtgggagtggaggggagcctagggttatgtcttttaacacatagatcttggaatctgtgcttgtcttagagccctcagcaactgctaactttccccctctcccaggccaggtgctttccagtctggagggccccccagttggaggccgagttcccttgagggacctcagtgtgactctggatgtcttcatgctgactttgcccctggaagtggagctccccacggcctcgg

SEQ ID NO: 53333 - DNA, 1241 bp, Homo sapiens
tccgctggttgttggaagatgagatggtgggggcactccgaagagggggcatcccacagagtcctgccctgcaccgcgcagctgcccatatccatagttctcctggacgctccacctgccttcgccaaactctgccactgagttttgtatttgggccagagcgttccctcacacaattcaaggaggtaagttgccctccaaacactgcagggtcaccttggggcccgtccttccctgggccccaggcacaggactggaaggccctctgttagttcgaactcatagagttatccctcctgtctccctgctcaccacatcatctgccctaacccctgtgcttggcagcccaactcactggaaagaaacccagctcccaacctggtcactgctcctgttgaaccttaggcaagtcactgaatcttttcttacctcagcagtggggatgccagcatctgctttaccaggtagttaggagcgtctcatgaggaagtgtagctcaccatgtgtagggaggactgccctgcctaaactgtgatcttggctcctgctctctaggagttccgccgcctccatctccctggccatgttcttcttgaagaccctgacagtggcttcttctttgtggcagctggccaacagccaggtgggtcccatggggagccttcttcagcggcctgggcttggcacagtcatgaggacagggctgaaggcatcgaaggggaggtgagtctcacctgggaatggaggggggtggtgggtgtgtggggcctatacctcagtcctgacttcctattcctcagaccctgacagccagcccccaagcacctgggtccccagaggattctgagggtgtccccctcatcagcctgccccgcgtgccacagggaggtaagagaggacttgggcagcagtctggaggccaggaccagatccctgaccatgcttccatttttggagggaggccctagacaggattgagagaggctccaggcattttccttctctatccagggagtcagcctgggcccagccggggattaagtctcatgtccagtcagggcagtgtggactcagaccacctaggtaagctggggggacggggtgaaggactctaagctgatgggaggtgggcttagggctgtactgggaaaggtctggacaggagacatcagaagggactaatctgaagtgcatcaagccagatgcacctggaggatcagatgagtcaggcccagcttcgg

SEQ ID NO: 53334 - DNA, 1023 bp, Homo sapiens
ccagattatgctgctgatgagagctgtgcgccccgtgggtacctggcagccacaatgcagtttgtccctggccatttctcctgtgacgttgtgtggggaactgtgatccgagtccattcacgcctcaaaatggggcccagcatgggggtctctcggggtatgtgattggcatgagagggcaggtgagcattggaaggatctggaaaaggcagtttcctgagcccatgttattcccccagccatccaggccctgcgctctgtgctcaatgccttctctgtggtgaaccggaaaaacatgtttgtttaccaggagcgagcaacaaaggctgtgtactatcttcggtatgtggcccttggaaggtgggtagggcatgaattaaggatggcctgggaggaggcatgtccaaagacatgctgctctttcccaggctcctagagacatcctgcagtgaccggccatggaaaggggatgcgctgcccccttccctcgctctgtcccgaagccaagagcccatctactctgaggaagcctcggcatgtatcactcccactctctgatgcccctgtgttcctcttgcactttgctctctggaaccggggccctgaccacagttttccctgtagggtcctcgttctcccttagacatggtctctagccgcagttcagatgctgctcgtcctgtgggccaagtggacagacatatccagctgctggtccatggtgttgggcaggcaggtaaggtctgaggagggggtaggggagtcgccacatgaggttccagaatcctctgggacttctcttagaaccttgcaagcattacactagaagttatgtaacagtctcagcccaagacctgacacatgttaagtgagccataaatactagctggaggctccagaccctctgggacttctcttagaacctcctattactctgccctgggtccctcctctagttcctgctgtgctcgggtctttcctcaagcaggagctgcatgggaagggactggcttctgccatgtt

SEQ ID NO: 53335 - DNA, 1101 bp, Homo sapiens
gggtccgagggcaaaggctatgaacccattgcaatgctccatctctcaggagccaaacccattcctgctgccgaccatggaagtggagaccctcatccggagtgcaagtcccccgctgagccgtgagcagggccgactgagtgggtcctctcgtggtgggggtcctcttcccctggacacattcccctttgacgaggccctaagggatatcacggctgcccgccccagctccgtacttggtcctgtgcccagacctcctgatcctgtcacctaccatggacaacagttcctagagatcaagatggcagagcgcagaggtgagggtactgggccaggcagcagggacaggaaatctgtggagtctgggaggaagggagtgacaatgcctggggctactactaatgccctcaaccctcagagctggagcgccagatgaagatggaaaacctgtttgtaacctggcagcagcgttctaccccagccaccatgcccatcagtgtgagtgaccccagcttgcatcttccttgagtatctgtgatcctgccccgtcactgctccatgctcactgccctgtttccccaggctggagagctggagaccctgaagcagtcatcccgcctggtgcattactgtgcaacagccatgctcttcgacccagctgcctggctgcatgggcccccagagacctctggaccccctgacgggcaggtaaggctgactcccagacttctagcagacctttgcttaccccacagtgacccccctcctccatccccagcaggatggttgacagtggggagagtcttccttgatctttactctcatagcggcgccatcgccctgagtcagggtctgggagccgagaggcccccacaagctgtgaatccttggatgtgtcgcccccgggagcccgtgaggagccttggctgaaggagctgagcttggctttcctgcagcaatatgtgcagtatctgcagagcataggttttgtgctggtaccactgcggcccccctcacccgcccgcaggtgagcccgtccctgttttcccttctgtcttctcctcctgcactgcaagtgaggccccacaggcccttcctctc

SEQ ID NO: 53336 - DNA, 1078 bp, Homo sapiens
tcagatactttcacacagccctcatgcgtgtcctgcagaccttgtatgctttatggaactcatgatgacactcatacaaaactgtgtccattttcacaaagctcatgcccacacacatcttgtacacttacacacttgcatacatccccacatgtgaatttttttggagatggaatctcactgtgtcgcctaggctggagtgcagtggcgcgatctcggctcactgcaacctccacctcctgggttcgagcaattcttgtgcctcagtctcccaagtagctgggattacaggtgcacgccaccctgcttggctaattttttgtattttagtagagatggggtatcaccatgttgcctagactggtcttgaactcctcaactcaggtagtccgcccacctcagcctcccaaagtgctaggattataggtgtgagccatcacgcccggcctgcacatgtgaatcttgtacatgctcctaagcctctggatctaggacttaatgattcctgtccttatcatcccactgacctctcctgagatttgatgtagttctcggcccagggaagtccttttctcaccaaggacctctgtgctaggcctacttgcatcactgtccttggcctgttcttggtcatgttcacccactggccagtactgacaggtctgagtcttgggaagtaggcagcccgtctgttgccacctccatctcccctgagctcagggacaactctgcagccaccttttcatccactgtcaaatctcagattcccgtgtttgtggcccctgctctatgttcctctccagattctgtgttctctgccctttcccagtggctgtatgcgaaaaatgagctgttcaccttacacatagctactttcgtgtctccagatttgtgagtttatcaaggcatgttctccctcctctctgttttcagttagaaccttttcaagccagtagtccagaaatgccagttccaactctctcatgtttctgtgaccagctccccactccccaggtttccctctcttccaggcattaggaagagaaggcgtgcctgcccctcctgtgatcccatctca

SEQ ID NO: 53337 - DNA, 1021 bp, Homo sapiens
aggctccttctcctgccctaaaaccaagactgatgggagccccaaggtaacttgtcatataatggtaaagttactgatgctaaattactttcccacggcctgaggtcattgaccctgagtgatgtaccgaggtcactgatcccagactgacaccattaaagtcagggtccaagggacttccaccctactgattcgaggctggtgagcccccaaaccttgcccccttttttgtttcttcagagcactagctctccggtaaccacctaccacctgcagcgggcactgcctgggggcatcatcctcatggaactggcattccaggtaagcaggaggagcactgagtggagacagccagacccacctgtctctcgccttcctgatctcatcttcaccttccctccagggctgttacttctgtgtcaaacagtttgccctggaatgttcccgaatcccaatggggcaggctgtcaactcacaggtatgtgaatgagctgcgggcacagtcagtgcaccccagtgtgctgtgggcagcatggctccatgtcccatttgctgggcagtagagtaatgcagtaggcgggctggcccagtgattgattcactgctatggcctggctaggtcagtgctcattctggtgccatgactgcactcactacaaggctgaccccatcggtcatccaaagcgtgttcagctgtagccctgaggcagcacagtgcctggtctggcctgtagtcatctagagtctgtggcagaccctgatggaatctgggatagagcaaaatggcccagtttctgaaaatggccctagtttcatggagatagttacaatacagtatgaaaaagggaggctagaatggggaggccttcccacagaaaccattctggcagagggcgttccactaggccacagcagcaggggaaatcttgtgcttcttcccacggaaggagggaaatgtgttttgggcagccagtgcagccataccttaaccctgtctcctgctgctgcctccccagctgtc

SEQ ID NO: 53338 - DNA, 1154 bp, Homo sapiens
gccattgcgaatggcccggccagggggcccagaacacaacgagtatgccctggtgtcggcatggcacaggtaaggctgagaggggcatccagcatgcacgctgcaggagctggggttgggacatacttgcagtagggagaccaatgttttcttgggcaggggtgaggtttgttttattagaaccccagagttgacatctccccaacccgtcctgcacagttctggctcctacctggactctgagggacttcgacaccaggatgactttgatgtgtctctgcttgtctgtcactgtgctgcaccctttgaggagcaaggagaggctgagcggcacgttctgcggtcagcagatcccctaccttgaacatgcccatttcccagcctgccccaccctgccctgtgtgtctcttgctacaaccaccactctcctgccctgctccccaccccaggctacagttcttcgtggtgctcaccagccagcgagagctcttccccaggctcactgctgacatgcgccgcttccggaagccacccagactgccccctgagccagaggctcctgggagttcagctggcagccctggggaggcctcagggcttattctagcgcctggaccggctcctctgttcccaccactggctgcagaggtgggcatggcacgagcacggctggctcagctggtgcggctggctggagggcactgccgtcgggacaccctttggaagcgcctcttcttgctggagccaccggggcctgatcgactgcggctaggggggcgcctggccctggcagagctggaggaactcctagaagcagtccatgccaaatccattggggacatcgacccccagctggtaaggaactgtgggctcccgaaagagctgggataggtgccaggaattccactggcagccagggcagagggcacaggaatctgaggtgactggcacagaagactcaggcctgtggctcctccctcaggactgcttcctatccatgacggtctcctggtaccagagcctgatcaaagttctcctaagccgcttcccccagagctgtcgccatttccaaagcccagacttgggaactcagtacctggtaagtccccttgagcttcctctgaaaagggaaacacagcagaaatcctcaccaa

SEQ ID NO: 53339 - DNA, 1074 bp, Homo sapiens
aagggctttggactcaatattgggtttagggcaaggtgtgggctcagtatcaggttcagatctgtatggggaggaaatggggtcctagagtggtattaggttcatgctagggctgggagccactagaaggatctggatgtagtatcagagtttggtctgtctatgttcattattggggttcgggttcaatattgaggttccggtcggtttcgacttggcgttgggttgtggcctgtctgggcctcagcggctccgcggctctacgagcgagagtgcacgaggggaggggcgccgccgggggcgcgcacggcaggggcaggggcgcgggcgcgagcgcgaggggagcgcgcggctggagctggcgcgggagcggcgggagcggtggcggcggcagaggcggcggctccagcttcggctccggctcgggctcgggctccggctccggctccggctccggctccagctcgggtggcggtggcgggagcgggaccaggtggaggcggcggcggcagaggagtgggagcagcggccctagcggcttgcggggggacatgcggaccgacggcccctggataggcggtgagtgaccccccggccccccaccagccccctccgctcccgtcccttccccgctctccttgccctccccgctagtccacccggcggagctgggggcggtcccgggggggacgagggcgccgctgaggccgggccgcgcccccacctgccgcgcccgcagcctcggcgaagccccccctccacgccccagcctggcggctcctccccgctcaccccgcggcagacgcgcccccagcgctgctggctggctcgctccccgccgcccctcgccgcctccctccctctccaccgcaccttagccgcagcccgccccccccacccagcgcaaagtttcccgtttgcgttcttgctccccctcatcggtcccgcctcgtccccccttctagcgcggacgcgctccgggggcggccctcagaccccccagccccgggctccgggcgggtccaggccgcgcccccgcccccgccgcacaggcgccccctcccagccggcggg

SEQ ID NO: 53340 - DNA, 1238 bp, Homo sapiens
tatagtttccttttccagctgctcttcctcttccctctttctttcctttaacaagaaaattgttttaacataattccttccttccttcctccctttcttccttcttcttgcaactactgatacctcccctttatccagctttgtgtgccctgggcgggttggcttggtgtacaaggctgccaagagaggagggggtggttgggtgttggtgaaggaatttggcggggcagagttagactgcagcaaacggaaactagctacacatcttttactgggaagtgtatggatacgcagcaaaatactagccctggcagtttgggcacagtccacccttttttccatcagcctgaactatgggagtctagctttgagggtcctccctgggggcggggaggaggggacccagacctcctgcagtagaggggttgtgatacacaccacggctcctccactttccagcttcaggcctcaaagaggcccctttctccctgagtctcaatttcactccctgtaaaatggggtagctaatccaacccggactgggtcccagggctgttgtaagaatccaagggaactgtgtggcagtgcatcgtcagcagtggcagtcacttcccttgtgactgacactgctgtgtgcttggttccagcttgcagtcagggccctaccctcgagaagctcgtggtccttgggggagcaggttgcaccatgggattgcaaaagcaattcagttacctgtcattgattgctgactgtgtgccagaccccggggtaggcgctttcggccccggctgcctttcttcctttgggactaacagctatgtagaagaggcagcccacccctaaggttcaggcatctgctcaactaaagcagctgcggttctgagttgggttagaacattgcaagagttcatcaagagacgggggagagttcggaggtcagggtgaggtgagtcccagaggagaccaagaagaagtgatgtgaactaggtttggagggatgagtaggagtttgaagaagagagaaaggacttgagatagataaaaaccagtatgaataaagactgggaggtgttgtcacttgtgaagtattcagagatgtggcagatcacagagggcattgaatgccctgttaagtacctgtaattttactctgagaacccagagagaaaacaccaaaggtttaaagcttggatagggagggtggagtgtgctgtggtcaggtttatgtttccagaaa

SEQ ID NO: 53341 - DNA, 1098 bp, Homo sapiens
gggagaggaggggcaacagaattctaccagggagactccagagtcagttggctttgcccctcactgctccttgtcactgtcttgtctctctgtcctctgtcccacgtaagcgtctctctgaccctgtttccctgtcctcttatgggggtgagttagaagctcaaggtttggactggaacacactgtacatcctctggtctcactcactccctgtacctcctactcaggtttagagaatggcccgaaggcctcctgcgctctttctccctccaccgtgactgttgggctgtccttgtgggtgctggggaataagtgaggagcttgggtggtcactggggtcagaaggtctaggtggtcattgcacagcccaagtggggggctctgttgaactaggctctggatggtcagtgaggatgactgggggtcagaaagcgtcaggggtgggcattagggacagcagtaaataccagctaactggctctgcccttctctccattacaggttgattgtcctgggctgtggctggctgtggagctagagccctggatggcccctgagccagccccagggaggacgatggtgccccttgtgcctgcactggtgatgcttggtttggtggcaggcgcccatggtgacagtaagtctgacccctcaaggtacagatctcccaggttgaaaggtggcatccttcccagcaggactctgggatggggacagaccggctactaggagagacagggtggccagaaaccctttagaccttctgtcctagagagcccccactgcttggagagcctccttctaaggaatacctgggtacttaggagcatctttaggcaccagagcggggcagtcgaatcgtgaccctgtcttatggggctggggtgagacctgtcctggattcatgtggtcattgtgtgatgtgcgcgtgtgtgtgctgtgtgcactgttgcagatctgtgctgaaggcacagtgtgagctacagccaggggtcggcatgggaatggggggtggcacgcagggcatgcgtatggatgtgtgcccaggacgcgggtgtgtccataggcccaaggagggtcaaaagcgggagccaccca

SEQ ID NO: 53342 - DNA, 1683 bp, Homo sapiens
ccctgtggacaccttgaggagactgtcagaaggcaataactaagtcgggggggagggatgggagaggcagatttacaggaaagcattcacctgggaagatatccagagagacttaggaactggactgtctaggcctttgggactgctgctggtatgtgggggctgggagagagggaggagtctcggttcctggccggagccccggggtggatggtggtgccatcactgagatggagagcagggggagggacaactctcagggagagctggagctcttcccagcagctctccagcacgcctttttcctggagcttggaattgatgtggggcgggcaacagaagggtgcagtggtagtgtgaactccagacttggaacacctgggttcagatcttagctctaccacttaccagctgtgtcatatgggacaaatcccttaacctctctgggcctctagaaacagatacagttatagcactcacctcatatgcttaacagagttaaaaaatgttaaactctctgaacagtgcctggcacatactaagcgctacataaaggtgaggtgtccttgttttctttgtaggtctttctctctgcccccatgactgccaccttcctcactggccattcctatagtgactgtgctgtggtgacttggtgtctccatctcttccaggcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtgcgtctgtggtgggaaggggtcggcagggctcagggtctgcccacactctctcctttcagtgtccctcctcatggaccttttggaggtgggaggacaactgaccctgagcaggctcctgtgtcctgagtaggctgtgaccccatgtctgtcctctgacaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaaggtacgtgctagggagacgtggcacggtgggctgccgggctgaggcgtgggaagagccagccagccctgatcctgtcctgggcccatgtgcatttggcagaaaggaggactggccacctcggggtcagtgaaagtcagtggtggacagggatagtcattggatctggcctggattgtgcggcttatgctgaggccagccatgtggggcatgatgcctttgtattctcctgctgagccgggtcgttggttgggtggggtctggggtctgacttgaggtgtggagctgcagctgtgtatcccttgggttacgtggttatggctgtggctgtttggcagtgaaccggatttccatgtggagcctggccgtaggtgtcaggcaggtgtgttccttgttgcccctgtgagctgagggctggggctctgtccgtggattttagtgtcttctctcacttggtggcttctccattcattcacaaacactccctggaccaccttgaagtcctctgagcaccgaggaggaggaagctgtgtctaagccaagtcttgaggacaggtgggag

SEQ ID NO: 53343 - DNA, 1034 bp, Homo sapiens
gactcttgcccctttcaggggcctgcaggcttcagaggtgccctcccactccctgggatgccagcccctccccatcaattcccaccagcctcacagccccttggtgcccagcaggaggagggagagacaagctgcccagcagggcaagattctggccccagccacggccgcctgagacagcccacgaagtgttagctcatttaatttaattaaaactcaacaagatggaggcagctgtagcgcagttaattaaaacagccataatcaaggcagcaaacggccggcagtgtttgtggccgctgcccagcgcagcacagcggccagcacggttcggctcctctgcattttctcatagttcctccaggcaggctccccaagcagccagacgctcctccctgctggcctgggcccctccacagaaccacatggacttgtctggcagcagctctgggaaggctcgctcacacattggttcatctagtatttatatagtgcttggggtgcccggccctgggccaccccttccttgcctatcactccactggatgccactcaggccccatcctccttgtcctctcggcagcagctaacattcctccctccttcccaaccacactcccatttttccctagcctttcagggctctgtctcttgcgacttccctcttcctagtgccccttccctgcagcagcatcttcccttccaccaagccctgcctttgccctatggacacagccttgccctggacgagctcaccccctcctaaagctccaactgccatctcctcacctgcaactctagctttagtctttccagcccaaacctcttacctgagctctagatccaaaattcgacctgccttctggtcaccctgaccagtggtgatcagtgatgagtgatgaccttcttttcagacagctgtaccctctttccataagtggcaccctccaacctggaacatgggtctcaagttggtttgagagctctcaaatgtaccaccctcgtggctctcaaattggcccccttctcccctc

SEQ ID NO: 53344 - DNA, 1682 bp, Homo sapiens
gatgagggcatggcgtgcttgtgaatcccaggcccgccagtctgcaggctgctcccacacctggctctgactggcttagtggggctgcggggccaggaacactaacagggatgttgattgggaaataggctccagtactggcaagagtgtggcagaaactgaatggagctgggggttggggtacagtccctggcagagcaaaggtgggtcttgctggactgtggggagcatgagattgtgctccaaagcacaaccgttggttctagacaggaggccactgggctcttcagggagagcttcctggaagcagcaggggtgccagggtgtggcctggatgagcttcgacatctggtcaacatcagccacagatgctgtcgagacctctcaccgtgttccaggccacactcgacatgggccgtgcctgacctctcgcttcgtgtacccacaggtgccttgcagatagagagcagtgaggaatccgaccaaggcaagtacgagtgtgtggcgaccaactcggcaggcacacgttactcagcccctgcgaacctgtatgtgcgaggtaaggactcaggcagtgcctggcccctgtcaccacagagctgtgctgcacctgccgggctctctgcccagagcccttggtgcagacacgcaagggactgccatgggcccagtctcttctccttcctgcttctttctgcagcagcagcaacagctcccactgggcaagttcctggcgtctgccactacttcgccttccttccttgcaggcccatggggaagcagccactcttgggagcatttgtatcttttgtaggtcttgccgcatgggcccggagccccatgggaatttggagccatccaatccgacttcttggtgtatgtgcatgtgtgtgtgcacacacgggcacacttatctgtgtgtaaatgcatgcatacctggcctggctttccttcagtacatcctcctgcctgccgcagcatggtgggctccagaaccaccatggctctgggctttggggtagtaaggcctcaggaacggaccaggccaggtgagcctatcctctggccaggtcttcctggagccttcctggaggaacccttgtgttcagctgtgagcccctgtggttatgttgcctcgggtgagcacctggtgtgttccagatgttctttgctgggagcgagtggacagtgtgctttctggaagtccaagttcccagcagagaggaacctggggactgttttggggtttccaatctctgctatgctcacagcctaggggtgactaaagctggccaccttgccctttcctgagaacacactgggtctggtatacatgtgcccagaaggggccctgagagccccttctaccctcatactgtcccctcacctagccttcttgtacagatggatgtcattaaaagttaaactgttgaccgggtgtggtggctcacgcctgtaatcccagcactttgggaggctgaggcaggcagatcacgaggtcaggagatcgagaccatcctggccaacatggtgaaaccccgtctctactaaaactacaaaaattagctgggcgtggtggcgcgtgcctgtaatcccagctactcaggaggctgaggtaggaaaatcgcttgaaccagaggttgcagtgagccaaggtcgcgccactgcactccagcttggtg

SEQ ID NO: 53345 - DNA, 1364 bp, Homo sapiens
cactgccattgtctccacccatctgactctcttcacctgtgtccactggccgcaaggcttcgtctcctcatcagacttggcttcggtgtctacctcacatctcccttctgtcccccaaattctcagggctcccagtgtcgctctctgaggccacgcgactgctacatttaatgggacagtacacgtgaagcaccaggcacattgccaggcacacaggaagcacttgctagtcagtagcctctgcagctagcactcggctactagtcagtagcctctcggatagcactgtggggggatgtgtcatccagttacatctgactttgttcacagttgcctgcagctccacccacagtctagcaggcccaggcatgctgggtgggccagagcctttctccttcaccacctgactctccctgagtgactcattctctccttccatctacagctctctgggtgtacagctgctggggccagggtggagccctgccctcctcagagcctggcctacctgtgccaggactaccagccttccccctttctctagggacctggctgcgggccacagctgtctaaaacagggacagtgcctttttccccacaggtgcccagacatgctccttacaccggtggtgtgtgtgggggtggcttctagtggctcctgtaccttggcaggtttgtgggctgggtgggccttgaccccagagcccggtccacagggtctgtctgagctgtggggtgcgtgtgaggcatgggggcctgcctgtgccccattttcacctgccccggccccaccctcggcctccctggcgcctgctggcgggcctcagccctgtccaccatgtcctccatgagtcctgagtcttttgtgagtgatgtggttcgtgtgcacctgtgtgcatgtgtgtgtgcgagggggcacaggagtctcgtctcgtctccgtgctgtgtgggcagatgaaggttggcctgtttttactctctctgtgtttctccttgtcttttttttattccctcctcatcttcatcgcactctgccatcaacccaaactctcatctctcagatcagcgagaaggttggtccttttcacttcttatccatctacagttcgcccatcgatgggacacgcctgtcagtagggcccagcgggctcggtcagctccctcaggctcactgcgccgtgcctgcctgccagtctctgttgtttgggccggcgggcaggcaggaccagggatgggtgggcagacccctgacctgcatgttcctgctgcttgggtccctggtgcaccacgtgtctgcatgtccccttagcctggttcccctgcaagggtggtggggtgggcatgctgcatggcatgaaactgta

SEQ ID NO: 53346 - DNA, 1120 bp, Homo sapiens
ccctgctgttgcttctgtcaatagactgtccagggtgaggcctgttcctttttggaggccctgtgcctgcagcagtgggtggaggatggttggggctgctgcagtgagatgccagccactccagctgttggcatgggggtggctgtctgggcaggtctaggatgcgggtccctgttggcacttggaatacaaggaggttgtcccttgcctgtttcccccacccttcctctgtagacataccctgacctccctcacatggaaaatgtctcagtctcagtaacgtttctgcgtggctgaagcccagtgtccttgtgagagtgaaggtggtgtgcccaggagcctctggacctgaggcccttgcttggtgttgcaggtgaccctaaaggccactgttgacctctcacacttatgcctagcccctagagctctccctgccccctgcatctaggagggaaaaaataaacacaactcttctgtgaagcgcctcaatttcctgacagccgcaggagttggaggctttagaagacgtggctcagggcgttggcctgacctccagggctgatccatgaagtccgccttttggcctgaagaccctgtcctccagggacaatttgggggtaaagtccagtcaagtttctaggttggtgcccaaggtttattggccaaggacctacttccttctgctggggctctttgtcctggtatccaacgacgtgattaggccccatgattccaccaccgactggggtcaagcctgcaatcatgacctctccctggcacaggctgtctaaacccatccttacgcccgctggagcagcgtcctctcctgccagcctctgctaattctgatgcttctccccagagccttctgggtcttttttcaggcctgtcagctagggctcgaaagggtgacagtttttcatcacacagacctactcctactacgtatataaacttggtcatgtggcttggttttaaaacagttcccttgactgtaattggcaggtgatagcatctacagcatggaaacctgcacctagtaggtgcttaagcatagcttcccttcccatgaagaggaggagacagggcacccactggccgagaggacaggagagattta

SEQ ID NO: 53347 - DNA, 1088 bp, Homo sapiens
accctagggcctgctttctctccttggtgctccagccaggagcaggcagagataggccctggagaacaccctgggttgtggtcctgaccaggcctggaccttgtactgagtccctgtgtgaccctgggcagacaggaccttcctgacaggcctcagtttcctaggctataaaatgggagcttggttgcaagatctctcattgagtaagtcatcgtgctccagacagtccctgagtgtgggggccacttctaggctggaagtgggtggggtgggagtggatgatgagctggggtctggcggtgccacccctcctgtctctgagcatgggtttggctctgaccagaggggcttcctgaatgaggggcccctgcccttccatgcagtcgtgtgtcctgcccggcctgtgagtgcctctctccctcctcctgcagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaaggtgagtgtggcaggtgctgtaaccagtgccctccctgtcatctgggaggtcctggtggtgggcgaatgtgagctggctgccatgggcacaggcatggctgagggattcttgccctttcctgggtgtccctgccctggggtcctccagcccttagagggagggagggatttctgttattagccggcttaatgataatagttaaggcatattgagtttcttggtgggagacatcatgctagcaagcacagttgattttgtttttttctgttttaccctgggagataggtgctcttattatttccatttttgaaacgagggaaccgaggcacagagagggtgtatcacttgccccagggtcacataaaaataaatgacagagcagggact

SEQ ID NO: 53348 - DNA, 1699 bp, Homo sapiens
ggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggaggtaggtgggggcatgccggctgggcagccaacagcagagaaggggaggctgaggttgtggcggtgcctttccccctccctcggctgtgaggctgggggctcttgggaggatcaaggtgccgtattccatagatgtgtggtcagttgggatgtaggataagggtgtgaggttaggacctgacttcctcggctccctcctccctgggcacccctgacctcacgcagatgaggctgacctgcctggtgtggggtgttgcagtgcctgcccagcccgcggacttccaggccgaggtggagtcggacaccaggatccagctctcgtggctgctgccccctcaggagcggatcatcatgtatgaactggtgtactgggcggcagaggacgaagaccaacaggtgtgcagcgggcagagaagcactgagggggtctcctggtccctgagggtctgtgatgggcttaacccaggagggtattttctggattctgtggcttatgtgggcacagcctctaaggtttctgctggaggcttagtggtgcatgcgtgtcatgtggcccgcacagcctgtatgaatctggagtcattgtcaccctgtgctaggggcaaagtccccagggtctgccttgggtttcctaggctctgtggctcatatgactggcagagccctgaagtttccccagaagccatgcgtcccagatggctcctgtggtccatgtggtctgtgaggtgtctgtggcatgggctaagccctgagttccttttgtgctccatgtggccttatggtgtggagccagtcctggagccgtggtgggtccagaggtgtcacattgcagcccatgttggggaacaacctgtgagtgactttgagctcagagctgtcagtgagtgctccctgctcttcccagcacaaggtgaccttcgacccaacctcctcctacacactagaggacctgaagcctgacacactctaccgcttccagctggctgcacgctcggatatgggggtgggcgtcttcacccccaccattgaggcccgcacagcccagtccagtaagtgtctcccaagtccgctgcctgttacacctgggctgggacacacacacacacatgcacacacatccttccccctcgaccaggcaggtggggtggtcaggtctgctggccaaaccgaactctggcctgggctctgagtctgggcctcgggagagggccaggtaagtgcctcccagtctgtccagtccaggcggctgctgccctccctgctccctgcccagcctcctgcccctcctcccgcccatgccccacacactgcccaggtaagttctgtgtctgtgcctcatctccgcccccactctgtgctggtcacactagcttagctgatgggccatcctcggtgggtctgccatgtcccagacctgctttggcggctgtttctcctccctatggccccgcatctcgtctccccatcacccacattcccttcctcatactccccatg

SEQ ID NO: 53349 - DNA, 1045 bp, Homo sapiens
ctagagagggccgtggagctgagggtgggattttgttttgttttgttttgttttgtttttgtttttttgagacaaagtgttgctctgtctcccaggctggagtgcagtggcatgatcttggctcactgcaacctccgtccacctcctgggttcaggtgattctcctgcctcagcctcccgagtagctgggtttataggcgtgcccgccaccacacccagctaattttttttttgtaattttagtagagacagtgtttcaccgtgttagccagggtggtctggatctcctgacctcgtgatccgcccgcctcgacctcccaaggtgctgggattacaggcgtgagccaccgcgcccggcctgggatttttcttttaagatgggaaaatttcaagcatatttaaatgctattggaaacagtcaataggaaaaaaagaaaccgtggaaaagagggtaactggtggagccttgggaggtggagagaaggggaacagtatgggtggtgagagagcttagccttggacagggtggctcaactctccattctcatgggtggaaaggagagaattgctgcagatgcaagtacggtgggggggttgtagcaagagatggagggagctgctgtgaaagcctggtcttctctgcagtgtgggagacatggtcatgcgccaagaggaggcaggcaaagggagctggaggtctggggagcatggaggagggggactgtttcatgtgaggtggcagagcgagccaggcagggggcagaaacaggcagcatggagagtcctggaggatgaggcctctagggacgtgtgcataggacgccagcctgcctcagtgccgctgtagagaaggagggggagagctggattcatctagggcttggcagcggccaggaaggagcatggaaagatcaggaggcgagggaccttgcgatattggtgagagtgtggtaggtggtagaccgtggaagctgaacatggagggtgggaaggacaaggttgatggacaggcatcctgaggagctggcgagcaggctcagtgccc

SEQ ID NO: 53350 - DNA, 1980 bp, Homo sapiens
gtgataactgtgtgtgtatcaccgtgtgtgtgtgtgagagagggaaggagagagagggaggcaggtcagagggagtcaggtgtccttggcgagagtggcagcagcctgcctggagggaccctgggatggccatttcagcacctaaggggtagcctgcccgggtgagtctccagtccactgtgactcagtcattgtgcctgtgatccccaccctccatctgcttgcttcccccccatttgtcttccccagccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacggtaggcagtgccaccggggcgggaggggaggcgttctgcctcagacaccacccaccaagctccccagggccttcctttcctgaacacaggcccaggtcaactcatctttctggttcaggtgtaatggcctaaagtggggggatgtcacttacgggataactgaggcccaaatcccagcctttggggctgtctccaaagcagctgaaaccttcacaggctaagatgggagaagcagccctgtctaagatttgaaaggtcaagattgggcagattggtgtaaaagatactcaaagtagaatcagcaagactccacgttggctggacattggcatgattggggcctaggaggagtcaggacaggttgtgctgactaggggtggtcaaagacctggtgccccacctccacctgttcccccatgtcgaccctccccaccaagtgagaggcctgggccagaggggtgggcagggccagtcctgggctcttacccgtggcgggcagagggagccttccgtgtgcctcaccagggacagatgatctaaggaaactgtatcagggcctttcctgggggagtggggtgctgaggcaggaccctcaagtttgctgtgcccacctgagctagggttgatacctccaggcctgacttccttctctacctgaccccccagtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggtgcagcattgggtggtggtggggtggcagggtgagcacagaccagcatgcacaagctcccttttggggcccagatatgtccctcttcccctgcctgccctcagcagtgctgtgactgcctttccttggttgtgagacccgagatgctttgcagcatcaggggttaggctggggttttttgggtgtgggttttttgtttgtttgtttgttttgagatagagcttcactcttgtcgcctaggctggagtgcctcctgggttcaagcaattctccttcctcagcctcccgagtagctgggattacaggcgtctgccactgcgcctagccaattttcgtatttttagtagagacagggtttcaccatattggccaggctggtctcgaactcctgacctcaggtgatccgcctgcctcagtctcccagagtgctgagaatacaggtgttagccactgtgccccaccaggtcggggttttgagatgtgcctttcccctagacagtgctgggctggcatccactcttcccacagaaagggtagagagagtgctccagggctgtcttacccc

SEQ ID NO: 53351 - DNA, 1053 bp, Homo sapiens
cctctagcgcaggacagggtccatgtgatgtgagaacctccacgccaaggcttggttgggacagcccaggtctccccgcaggcaaggagactggaagggacgtgggcccagccacaccctataaagtggccatgcactaaggacctgtccagagtctcctctcatattctgttccatgcttcttgcaaggactttccaacagagtgtcccaggacaggaggaacttaggccacccagcatggaggccagtggacagaggccagaccggcactgtgggggtgcttgggctggaggaccccaggtacttccggcttggagacatcctggaccatctccctgtgatgtttcatggggcctcagaatggagacctcacagtccctccacctgtccatctagaatatctacatgcaccaaaggcccgcaacactgccagccccgaaacattccttcctaccttaatcctcagacaccccgaggaaggaacgggtataggtgatttcccgtgcctgtgggctacagcccaggctctgagcttggcactcacagccttcatagtcttgctgactggcttgcccttgggcccaccctggccatgtgccctgttcacccccaactcttactgttgtgggacacttctcatgcctggggtgattgtgtaatgtatgatcacatctgggatgctttggcgggtggaaggagacactgaatagtcaattccatggcaacaagcacaggccaggactgtccgaggcaaaccagggcatatgggcaccccattcacccctcagtgtcttcctttcccttggcctgagctgttgaacccacccttcttgtctggcagcctctccctcccagcaagcccaaaattgtcagagcatctgtagctgctttgtgttcttagggccttctgtcagcgggtcctctccctgcaggctgcctgccctccctgtctccctaccctcctcagccctggcacacccagttggtgctcagtgaggcagggattcaaatctttgaaccgggagttgttctggggtgctacccccatgggt

SEQ ID NO: 53352 - DNA, 4486 bp, Homo sapiens
gcgtgcggctcctgggatgggcggggtcctcccaggcctgcatcctacctgcctgcttcctctccagcagaggccaccattgtatagccccaccttccacaacccctggccttgtgtgccccggggctcccctcaggctagggtcctgaggtccctgacaaggtctggcctctccctgcattcttgtgatgggaacgaacccctcctcctccctcaggaaaccactatcagcggcctgaccccggagaccacctactccgttactgttgctgcctataccaccaagggggatggtgcccgcagcaagcccaaaattgtcactacaacaggtgcaggtgagtgaggggtcaggacggacctgagggtggggcagcaggagggcagcgccagagcccagcccgtggtccttcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaaggtgtgtgctgtggacatggcatcccttcccgagtgtggctgcatctgggggtctctgctctccttgagccactgacctctggcgactgtgatccaccagcctctggtgtgtgacctccaatctctcatgactgtgaccactaacctctagtgaatgggcaccacattcttgatgcctgacctctgctgtccttaacctactgacctctgctgtatgaccttctgatctcttgtgaccttgacccactgatctcttttgactgtgtcactattcttgggtgtgcaacctcctgatctttggtgtgtgacactaatctcttggggccatgacccaccgacctctagtgaacatgctccaccacgctctggtgtgtggccacatgcttctcatgaccgaaacccactgaccctctgatcactctggcctggtgtccatcggctcaagcttttacactcgcgtttctggagattctgaccctggttgctgtggcatcccccgccctgtttggtgctcactgtggaagagcttgggctgggagttcaactgtgccgtttgaagctggctgggagtggggcgcttggtactctgcagccatccttcaaccccctgttccccaaccagtgtctcatcctggccattcaccttccacccttccagcccattcaccccacctcatatacccagcagagctgactctctctatgcctttgcagtgtttgccaagaacttccgggtggcggctgcaatgaagacgtctgtgctgctcagctgggaggttcccgactcctataagtcagctgtgccctttaaggtgagtaagggccacggccagctgagcctggcacacacacaggcctgctgggtgctgtctttccagtcctaacccatgtgcatccggctgtggagcaggaatgtggttgtgtatccgtgcactgtgccttgcagcccgtggtagggaacctcacccaaaggcattgattgcccctcccgtcccccacagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtgtgcacacgaggtatcgggggaggcggggcagggctggaggtaaccagcagtgacagtcctgattcctgccctgcccacccaggtggttctacattgttgtggtgcccattgaccgtgtgggcgggagcatgctgacgccaaggtggagcacacccgaggaactggagctggacgaggtacctggggaggggatggggacactgacagccccattgcagtggtcagctgtggccttcctgccctgagcactgtcccagtgactctcagattcactccccaaattgaaatctctcttctggctggcagcccgcccctctctggagagagggactctgaggaaaccatctgggagtattcacagaactcccggagggcttacgaagaatccctggggtgggatgtcgtggagatgcctctgcaggtctagagaatgccaagccctgtagacactgcagagcctcgcagatctagaagctatggagggcttagtgagccttatagccaggagtccctgaatgtttgaaatccttcagtcctttctcatagccagtgtggcaacagcctggttagggtggggcagcttacacacagggctgcttctcatgggctggtggggaggagtggcttcacggtgtctgttactctgtaggggcagtgggttgggcaggtgtgggctctgacacggaaggtgagccttgatctcggcccagggagctgacatcccaggccacagcctcagggctggccggcatgctccaaggcccctcatgacccccatgctctgctctgccagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccaggtctgcctgagccggcttggctgtcagcaccctgattccctgggcctggcctgagacgatgccagtctcaaacaccacaagaccccaggtctttatcagtttgggggcttcgagatcctggggcagcactaaagacccaagatctgtcccggggatcctaagacgcggccctgggacccagaggccagacctaatgtggctccagggacccagtcctgccaggtccaccttgtagggtctgggagaccaggcccagggtaacccagacccagagccctttctccaggattaataggcagagggtggggggttctcacgctgagctcacagcctgctgttctccaccgggccacagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggtgagcactgccctcagagctccgggaacggccacctgcccctcgcctttcaggccctctccgggtgtggtgcctgtggagagcgtgcagccttgcatcctggaccctgagcctcaggctcagcaggaaggcaggaagggcaggagcagtgtgtgtgcctacctgtgtctgcaggcctgcatctgtcaggtgagggagcctctgcagcagcctgggcgtgaggaactaaagcctcagagggttgtctcatgtgcatccctggcacgtctgtctgtctctgtgtttctgtggataagagtgcgtctgtctcctcttcagttttaagacaccgccatctcctgagctcctacctcgagtcctttccttctgccaccattcctggatgattccccagccctactctcctgcttaggcctagagaggtcgagctggaggcccacaggccatggatgctcactaacagacatgactgatggcctgctgtgcccgtgccatccgcagcggcctcagcctcagtgtgtctttcccactcagttctctatcggcagtggccaccacctgccctaggagtctcccttcctatccgtgcaccttccagcctgaaagggatttccaaagatttaactttgtcactctcagtttaaaaccttttgatggctgcccacgtaaagcccaccctctttagcctgacagccaaacacctggctaatctgacc

SEQ ID NO: 53353 - DNA, 2951 bp, Homo sapiens
agtccactccttcctcccagggtggatggacctgtgggcgggtccctaaggagtgtcccacagatgcactcatccttcccacttccacctgcattctgggtctgtccagagaggtagaccccctccctgtgaatgtcatgtgggtgccatataaggggcctgcagggtccccatgtcattagagggctgagtgcttggtggaaactgtgaccgttcctttcttctgtccttgcttgtctttcgggacctagtaaacaagaaaggtaggagttgttccttctctcttcacacacctccccctctacttctaatccttgggccagcagggagggatgacgctttgaccagaagtcccctggcctatggctttaagcagcaaactgtccagtcagctcagcaggctccctggttcaggactgagtcctcattggtgtgaggaggcagtttctgtctcactcttgccagttcaactctgcagaggatgcttcttctctggggcacatacataatacagactgcattgctttccctgagcgtacagagctcaccagaaccatcacccggctcccagttctctgagaagttgcctaagtgctgcgagagacagtctcgcacagagcaaagagcagtcactgtgtggaacagcagagaggcatgtccttgtacccacctgagcacactcactcaaattcttctttccgaagcacatgcgtctgcagaccacaagtagcctctggctatttgttggcagctgaatcctatggtctgtctctgaccctgtccttgtagatgggaaaactgaggccagtgagagaggactctgcccagctagggtgacgcctttcccgtccctcccctgctgccctgggcatttaccctgatactctgagggccaaaaagctggggccctgtctcctgtgctgtttgtgtattttatgtgtcatttgcatgtttgttcccggtggttcctgctactcagctgggtggccttggagatagcagtcactgtcctgcagtgacctgccttctatccaaaggagctgctcgcccctgcaaccccttcctccctgctgcactgcccctctgctcacgccacactcctgctctccctaccccctccctgccctgtgttctctcatgtcaaggctgttctggccctggctcctccgcgctcagagatcctgggaagaggtggggcagtaggaggacagagccgtggacatgggggctccttggcagccagccatgccatgtgtcactgtctcagcctggacctcaggttctcaccagcctcccttctgtctctctaggaaaaggacccactctccgtcctctaaggatgagcagtcgatcggactgaaggactccttgctggcccactcctctgaccctgtggagatgcggaggctcaactaccagaccccaggtagggcactcctatggcctgtgtgcccccagcccagacctagcaggcctgtgggtctgttctgcaggtctcagggtcgccactgaagttcctgggccgcatgcacttgttcctgctccttttcttcctttctgcccttctccctgtgctcatccactttggttggaatgactggggagcccccatatcctgcagctggacaggtgccccaggccaggaccctcttaggtggcaaagccacttagccactgccttgtcttcagtcaaggcctctgaatatgggctgaggacctcccagagcccacgtctctgccacagggtggccagtgtctggcgcacgctctgacgcctccacatgaaagaggggcatgttagcagtgggagatgcctcaccagacatctgtggggagatgaagtgcctgcacctgagccttcctggaggccgaccccaggtttaccataccacgtacctgccccttctcctagccactctcatggggctgtccacctcttccttctacctgaaatgttactcctcccaacacccagcagacacagctcagacctctcctcttgcccacacccccacagggttaggtgtctcttcttggctccaggaacctccctccttcttccttttgacgcctctcacagtgagctgggattacctcagtgacagtctctgagctctgtggtgccaggaactgtgtcttgtcatcccccatcccttgtattcagcgcacgatgggttcttgttgaatgcctgtgaaatgaacacacagacaaatgaaggaatgagtgaactaatgcatacacacagggtttgtgtatgtatgagctggttattctgcatgtcaaattaccccaaaacttagtggcttaaaacaacaataattatgtattatctgtcacagtttttgtgaggcaggaattcagacaggggcacagcaggaacagcttgtctttattccagaaagtctgggccctcagccggaagacttgaaggctgggagctagagtcatttaaagcaggggttggcagactatggcccgtggccaagtacagcccaccacctgtttttgtaaataaatttttactggctgggcgtggtggctcatgcctgtgatcccagcactttgggaggctgagccgggtggatcacctgaggtcaggagttcgagaccagctaatgaaatcccatctctactaaaagtacaaaaattagccaggtgtgtggcccctgtcatcccagctactcaggaggctgaggcaggagaatcacttgaacccaggaggtagaggttgcgtgagccaagatcgtaccatcgcattccagcctgggtgacaagagcaaaaccccatctcaaaaataaacaaataaataaaattctactggaacagacacacccatttatttatatgctacctacctatggttgcttttgcactgtaaaggcaccattaaatagatgcagtagataccagatgtccacaaagcctaaactatttacgctctggcctgtt

SEQ ID NO: 53354 - DNA, 1017 bp, Homo sapiens
ggacacccagtctgtattaactgggagacagaaggagccttgacggaacttgtccgcagccccagcccctcaccgccccctcctcttctccgccagcccctcgcaagcccgctcggcacctccactgtgtgtgatggtgctgtaagcagaaaaagttaacgggctttcttttcttgccccgttgtttttttcgtttgtttgtttgtttttttctctgcaggttccagtgtccccagttgcccgaatacctcaagttagttttcaaagttcccgtgtttgggggatactttggcttctgtgtctgtttccactccttacttttgtttaccccatcgcctccatccttccttgaattcttctctccccttccctttcttctcccccaatcccactgtctcctaacctttttccttccctaccctcccctctgcccaccttgcttcctccaggcctgttttctctcccaccggccccgtctctgttctgcctctctggcctccagtcccggcctgacacccttccttctgcgtgcctctacctctcatctcctctcctctgtctcacacccccctcctggtctctgcttctctctctattgtgtctgtacttcatgaccactccatctacacacttggtgcccgggatgacgatggctgtgagtctcccatggtgactgccaccggtgaggggcaggagggctgtctgcaggcagatgcgatggagcccagctcctgtcacgtctgctgccaccgacctgggcgtcccacccctcctgggaggaaggaagcctctcttccatcttgagagacctgccaggcagggcctagtgcccccactcagcaccccgccaccaaaacaggctccacatgctcatggcacaacaccgccctctgtcctctcccaccctccgccatccctgtcgccgcatgtgctgctgtctccatgccaccagttccaagtgctccatggtcacacatgttcacatgtgcacatacatgcgttggggctttctctgcc

SEQ ID NO: 53355 - DNA, 1022 bp, Homo sapiens
agggagggatcctggactacctgagaggggccaccatcccttccatctgtcctggctcatttcattaggtgaatgcagggcttcgggagggactctgggtgttcagagccctcagcagtttcgggactgcctgagagggggccaccacctgtcctagctcatttcattaggtgagtgcagggcttcgagagacccttcacctgccccatcccagctcagaccactctaccaggcaaggggatttggtaccatggtcagaggagtccccagtccatcacttttctgataggtgatgtggcaacctgtgagctccatggctggcaccacgagatagagggcctggctgtggcctgtggagtgaaggcaggatgtgagcatcaccgggaaggctgggtcccctgcaggagaagcaggtcaaccttggctcttaccccaccccacccgctttctccattctctgcagtccatcgaccctggacagcagttcacgtgggagaattcaaacctggaggtgaacaagcccaagaaccgctatgcgaatgtcatcgcctacgaccactctcgagtcatccttacctctatcgatggtgagccaagggggtgcccctcccatccccttgctctcccccttgctagctagggcaacatgtcattctacagaggatgtccacgagtctcaggggtgcactgaggcatggtgggctgggctggggaccctgtagtaatgccctcccacctcctttcttatccataggcgtccccgggagtgactacatcaatgccaactacatcgatggctaccgcaagcagaatgcctacatcgccacgcagggccccctgcccgagaccatgggtgatttctggaggatggtgtgggaacagcgcacggccactgtggtcatgatgacacggctggaggagaagtcccgggtgaggctgcagggccctgccaggaggcgggtgggaaatgcccagccacaaggtgatacagggcaccttcttctgtgccgctttcttctgtg

SEQ ID NO: 53356 - DNA, 1879 bp, Homo sapiens
gtgtgaccgccatggagctcgagttcaaggtggggctcgggtgggcctgcttggctccagggcctagactgggtcatgcagatgacccccacccccacaggaagcctggcctgaccaatccctgcctctcaatagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttataggtcagcatgcatgtcactgccccaccatgccctacaggggcctaggcctgtgcctggctggtgggggtgggcagcagagtagggccagcctagaagaccagagagggctgggtagagcagtgaggacttcctggaggaggggtgatctgagcagggccccaaggggctaggcagcctaaggggagactctaggggcagcagcacctccagcatgtccagtcttatgtccaccccagacagcagaaggcctacatagctacacaggggcctctggcagagagcaccgaggacttctggcgcatgctatgggagcacaattccaccatcatcgtcatgctgaccaagcttcgggagatgggcagggtgagcccaccctttcccccagggcccctgtcatacctgggagaacaccagccacccttgggggagctgccgcctatgttactgtctcctttgacaccccagctgcttgtcagcatggcctcaggcgcccgttattactacctgaggcatctgtcccagaatcctgtgaagcctggcacccctcccctattccttctcacctgattatgggggcccgaccctctgtccacaggagaaatgccaccagtactggccagcagagcgctctgctcgctaccagtactttgttgttgacccgatggctgagtacaacatgccccagtatatcctgcgtgagttcaaggtcacggatgcccgggtgagtgagtgcattgagtgtgtccataacgctgcctgtccacacgctgggtggatggctgcctgcatggtaccttagctcaagcttcagaaatctgaggcggtgggtgggtattagggtgtgagcacatctccccctgtggcctcgggtgcagtgacacagatgcatgcctgtatcatggtactaccctggtctagtccagaggggtggctgcctaaggcacgaattctaatcatgtaccccacccacctttcccaggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcaggtgggactggccccctggagggctggggtgggtgggcctgaaggcctggcagacccactgcatgaggcaagcaggactcctgacccaactgtgtttctgagcagtgctggcgtgggccgcaccggggtgttcatcactctgagcatcgtcctggagcgcatgcgctacgagggcgtggtcgacatgtttcagaccgtgaagaccctgcgtacacagcgtcctgccatggtgcagacagaggtaacgcagaccaggctgcagggccagggccttggcagcagcgctgctgggaaccctaggctttagcaacagtttgatgcccacaggcatgtgcattcattcatgctgccaacctttcacgtggcctgcgataggcatggtggtgtgtgcttatggtcctacctacttgggaggttgatgtgggagaatca

SEQ ID NO: 53357 - DNA, 3099 bp, Homo sapiens
ttcgaggctgcagtgagctatgattataccacggcactccagcctgggtggcagagcaagaccctgttgctgaaaacaaaacaaaacaaaacaaaaatgctgcaacattgcctgtgctgcctgggggctcaggggattgatgagtaagatgtgttctttcattcggcagctctctgctgagccccagtggtgtgcctggctctgggcaaggttgcacagagcaatccttatggggtgcccagtcaggagcagagaaacatgattgggatggcagatggaaggcaggtagatgtgggggcctgagagaatgacaggagagagatgagccttcagaggctctttcaggctcccccgcacactgcctgatgtagctgccagggtccagcacctgctcttggccagcagaggctaactccatggctgcagtgtgagtgtcagctgtgtagtgggggtgtccactggcgcgacccacactgaccagccccctatcctggcaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaaccaggactctgtctcagctgtttctggaaccaaagagtctgggccaaatcagtagctaggatgggttctggagattccctgctcctgaggagacggggagggtaccctaagtatttgtgccagtgtaggctcctggcatggctacccactttcagaaaggagtggttataaaccctgaaaaccaggccaccaagagccagccaggccagagccaccagtgcatgtgaagagcaccctaggccggggagcataccctttgcctctctttccctttaagattctgtgggttgcactatcggggcattgggactgcccctctcccactaccttggaggagagggatggccctgtggcagtagagactgaatgtatggaaattggttagtgagatctcctgtaattattgcaatgtggataatggacacaaaaaacagtgtgtccatctggcccctggacacacagctgcatcacccactgagctgtgcagctgctccactggtgagcagacaagtcctaccaggttgtcaaattgtggaacttctagggatacagatgaaggagacccagaacaagctgcgaagagaaatgcgtaagtcagcaacaaccacaccaaggcagcatctgacccagggaaggcttcctggaggaggtggcattcagagtgtttcgtagaatgagtagcagttagtttttttttgtttatttttgagatggagtcccactctgtcgcaaggctggagtgcagtggcgtgatctcggctcactgcaacctctgccccccgggttcaagcaattcttctgcctttaccctcctgagtagctggaactacaggtgcccgacaccacgcccaggtaatttttgtattttta

SEQ ID NO: 53358 - DNA, 1049 bp, Homo sapiens
gtggcattcatacattataaataaatgtatttatagtttgttaaaaggttgtaagcctaattagtggggagtacaataagaaggaccaaggccgggcacggtggctcacgcctgtaatcccaatactgtgggaggccaaggtgggtggatcacctgaggccaggagttcgagaccagcctggacaacagggtgaaacctcatctctactaaaaaatacaaaaactagctgagcatggtggtgcacgcctgtaatcccaactacttaggaggcagaggctgcagtgagctgaaatcacgccactgcactccagcctgggcaacagagcaagactgtctcaaaaaaaaaaaaaggactgggcgtgtgagggaagatttgattatttgatttagggtggtcaggggacacattgaaaagatgggacttgaggaaagacttgaatctggtgagttttgcctgagtatcttcgagatgagcatccaggtggagggagcagctatagcaaaggccctgggtgggagtgtgcctgatatatgagggtgggtgtggctgtgacaccctgagcaaggggcaagagggtagcaggggatgaggttagagaggaaatggggccagctcctttaccattgagaagactgcagaaatccagtggtggagagaagtggccagattctggttatatcttaaggcagatctgatagaatttgctgatggactcgatgagaaagagaggagtcaaggttgaccccacagttctggcctgagcagcaggaaggataaagttaccatttgttgagatgaggaaggttgtacagaagggttaagtaatctactcgagggtcccaactggaatttggtggcgttggtaggactcccagctctgcttaactccagggctcttttcacaccgctacctgcctaaagctagaaatcgtcagatgcattgagaaaaaaatatttggggccgggcgcagtggctcacgcctgtaatcccagcactttgggaggtggaggcaggcagatcacgaggtcaagagattgagaccatct

SEQ ID NO: 53359 - DNA, 1307 bp, Homo sapiens
ggtgtagtttaagtagagtctcttcagagagttgaggatgttgtgcttgttaaggaagaccggtttacatctgtgtgtacattaccttcctcaggcttcctcaggcccagtgctcatggaagggacgttgagggactgactacgtattagagccttgaaggccaagattatgccttgttcatttgaaattcttgctgtcactggaataggggattatgtcttgtaatgttcataatgcctaataaacccctgtaagtggtttacatgtttctttttactttcaaaaaggtactgtaccccacgctatagtgagtttgaagagctcgagcggaaatactggaaaaatcttacattcaatcctccaatctatggtgcagatgtgaatggtaccctctatgaaaaggtgaggctcactggaaaccctctgtgcagtgtttttgtaattttgtaatacctttttttcggcccggcacgtagtaggcacctaaaagctgtttggtgaatgggtggatgaacagatgatctacccccagctgatgttgctgtgctggcctaattgtgggccattttgcatgtgactgaattttatttctcctgctttacatgtgaattggatgatgtggtgttcttttcaagggttgttagcatagtcggtgggtggtagctgatgagttcttgaaagggtgggttggctctcagataatgaaatgaggcagtgtggtttctgcagaaaaaagatgactgactaatctaatgaaaggggtatacatttaagaagagaaatacatttagatttttcagaaccctcaaacaagattctgtggcaaaagctattttaaccacttttattggcttgaaatcctgccttaaatatggtgaaaggggagaatatttgggaatatcttcagatgactgaaaaacagtagggcattcagggattatcactcataattgttttcatattttaattttttttttttttgagacggagtttcgcttttgttgcccgggctggagtgcaatggcgcgatctcagcttaccgcaacctccgcctcccgggttcaagtgattctcctgcctcagccacctgagtagctgggattataggcatgcgccaccatgcccggctaattttgtattttttagtagagacggggtttctccatgttgctcaggctggttttaaactcccgacctcaggtgatccacctgcctcagcctcccaaagtgctagaattacaggtgtgagccactgcgcttggcccatattttaatgtttttatcaattattggaagagttaaaaaa

SEQ ID NO: 53360 - DNA, 1050 bp, Homo sapiens
tcaggagttgaagaccagcctggccaagatggtgaaaccccggctctactaaaaatagaaaaattagttgggcatggtggtgggtgcctgtaatcccaggtgcgcgggaggctgaagcagggaattgcttgagcccgggaggcggaggttgcagtgagccaagatcatgccactgcactccagcctgagcaacagagcgagactccgtctcaaaaacaaacgaaaaaacaaacaggtgactgtcatctctttattcatctttcctacactagtattcacaaagtaatatttgccctttgaaggtaaatggtgtcagttccagtggtagccgtgaaagtcaatgaggaatgctatggtcttcacgtccatagtgttttgacattattcccaatgtttgtcagagatgacagcttacttgtgacctactctgatttgtaggttcagagcctcggtttctatgcaaatgtaacttgccctggactgtcattgcctttgcagcatgttgatgagtggaatattggccggctgagaacaatcctggacttggtggaaaaggagagtgggatcaccattgagggtgtgaacaccccatacctgtactttggcatgtggaagacatcctttgcttggcacactgaagacatggacctctacagcatcaactacctgcactttggagaaccaaagtcctggtacagtctgcctgcagtcggcaccgggcttctatgctagagcacgggctcatgttcattgtgcgtgggaagcacctcaggattgtgttaaagggcagaccctggttcaggcttggggtgacattccatgttttaaacacactttcaagtgctaagatgcttgctgttggagctctggtgctcggaccaccttttgagtagggaggctttagagagcagggtgctggcagttacccaaagacacgggggctcttccaggctatcccactgctttctaattttttttctgaacaggcctgaggcatttcttagcagcagacttccaagactagagtcactctctcagatgacagaaagc

SEQ ID NO: 53361 - DNA, 1003 bp, Homo sapiens
ctcaccgtcctgggggcctaagtgcagagcctaaccaccctctgtgaccccgagttagtgcccaggtagatttgccccagtagcatgtgctctctgcctttttttccctgcttcccttcatgtttgaaggtcctgcaaggataacatgccctcagcctgtgaaccaaaacaatctggttataaaccatcttgcacttgtttccatgtggagggaggagctaggacgtgggggtgagttggaagcagcaaggtatgctcacctggtgctcttctggttcctgctgacagtgctcctgtagaaaggacatggtgaagatctccatggatgtgtttgtgagaaagttccagccagaaaggtacaaactttggaaagctgggaaggacaacacagttattgaccatactctgcccacgccagaagcagctgagtttcttaaggagagtgaactgcctccaagagctggcaacgaggaggagtgcccagaggaggacatggaaggggtggaggatggagaggaaggagacctgaagacaaggtaacccagcagcccttttgtcctggctgcgtgagggagggatgtctgggtaggtcctgtaatctgtggagaggctgtttcttgttttttttgttttgttttgtttttgtttttgtttttgtttttgatggagtctcgctctgtcgcccaggctggagtgcagtggtgcgatctcggctcactgcaagccccgcctcccgggttcaggccattcttctgcctcagcctcccgagtagctgggactacaggcacctacagccacgcctggctaattttttgtatttttagtagagacagggtttcactgtgttagccaggacggtctcgatctcctgacctcgtgatccgcccacctcggcctcccaaagtgctgggattacaggtgtgagccaccgcgcccggccgaggctgtttctaagatgccgtttgtgccttggctaagggagtgttcttggtaaaggctcca

SEQ ID NO: 53362 - DNA, 1051 bp, Homo sapiens
taatgtcgtgatttaagtctgcagtgctattggtggctgagccaggggatctgtgctctgaggagaatttatcctgggccatatgggaaagaaaggaggaaccgttccttggtacctgctatatgccaggcactttgccagctactctgcataccttttcttaatcctcacaacaaatctgttaggtgggtggtaatacctgtattttccagatgattgaacaaggtcagagaggtgaagtcccttgtctcaagtcacaaataagaggtgtccctgagttttgagccaggcctgacaggctctggccattcactttgggttgtgtgtggatgtgtatgaatgtgtttgagtaagtggatgtatatgtgggctcttaaaagatttgccctctcccttgcagcctggccaagcaccgaatagggacaaagaggcaccgagtttgtcttgaaataccacaggaggtgagtcagagtgagctcttccccaaggaggatctgagttctgagcagtatgagatgacggagtgcccggcagccctcgcccctgtgaggcccacccatagctctgtgcggcaagttgaggatggtcttaccttcccaggttagttgactatggtgtattttccacaaccctaactcatatatgtgtcccgtgttagatgccatattgagtgctgggtcagaaataaaaaaggcagagtgacaggtccgtgagcagatagcatacttggagtgtgagaagtgctttgggtagggatgtacagggaggactggacacgtagggaaaagctcctccctctgcctggtcaggggtcagggaaacactggaggttttggtgaaggtgactcttacaaggtaagtaggaccttcccaggcggacagagagagaggagggatgtagaaagggagtcccagatgggaggagcagggcacaggcatggagatgggaatttttttttttttttttgaaatggagtcttgctctgtcatgcaggctggagtgcaggggcgcaatcttggctcactgcaacttctgcctcctgggttcaag

SEQ ID NO: 53363 - DNA, 1029 bp, Homo sapiens
tcaggcttcctccttaaatacatgttgtcaccaaaagctgattcctgcttttgtgcaaaatggctcttggtgggtctgccactctgagtgatcagtcatgtcagatgccactggacccccactacccaagtgactttccctgactccccagccttggagcttatgtgggtcaagctgcagtctttggtgaggggtgggagatagaagaagccagtgcagaaggtcctctttattccctattcccttacctttagtttttaaaaatgtatcttaaaaatcttcactatggaaaatttctgacgtacgtacaaaataccatcacgagcccccgcgtgtactcatcatatatatgattaacatttggcacatttgctttctgttttctttggctgcagtacttgacactcagtcatattcacatttccctagtgttgccaatagtccctttttatggtaggtttgtctccttgttgttgatactcataacttttctcggtgccttctctgaatctcagggtacggttttggtagacttctttttaccttgtgaatgttcctctttccatcccactgtggttgcaggctaatgagctaataactactgtgtttccttctcattgcctctgattgcagttctctgtgccttcttatggcagcttccataaaggagggctttttcagcctggaaaccagagtctctttaactcccagttgccacctagcaattcttccttcgcagaggccccgggccatttcatccatcctactgttgactactgttcactacagttcatgctgtcctcttgctgagtcttcctgacattcttgtttctagttgcaatcacaatcacaaaaagcagctaagaagtagcaagagctcactgtatattaaatactttgtttatcttttttgagacagggtcttgctctgttgcccagggtagagtgcagtggcacagtcttggctcactgcaacttctgccttctgggttcaacccatcctccccacctcagcctcccaagtagctg

SEQ ID NO: 53364 - DNA, 1008 bp, Homo sapiens
ccctctgtaatgaggatggaatgagtaaatggaaggtcaggtttgttttagtaagaagccaccatcagaattaattgactgggaggaataagggacagatagtcaaggtttgggggcagaagctgagcaactttgtccatccctggagaggtcttatagcactggatctatatttgtagacaactgggttccttagagcacccttatgttcccccacccccactttaagcatccccaagctgtaatctgggctgcctgctgttcagtttccatgccaccatctatgtcaagggccttttttaggtcagtctggtaaactgcagtttttggtaaaagcaccctggctggctgacactgccgaaactgtagagttttcattacctactgactgagccacagccatatgtctgctgcagaagttcttgttagttcaagctactttgaaaagtgagttcccaaaacaaggtgggagaacaattggttcttctctgtacagaataaaccctatcaggaacactaaccttgaccctggtgccagatgttggatgagggaggaaagaactcaggagccttgagttccagctttcttcaggcagggccctgggagtctgcctgctatcccgccctgtctgcaaaaagagccctctggggaagggtttattactaccgttttactggtggggctgctactcatccaggctcacacagctgctagttggtcgaaccctgacctttctgttatatactgagggaatttagaaactggagcaatcccagggaaggcagcaccatgagaagggtgcggatgccatggtagcaggaggagtactgtccaggagatgaggaaatgtgaaaagatattcaaatctttgaatggacctgactactttggtcagaggcagcatgacggtagtggaaagggctcagacttcggacttggacaccaggtctccctccctgaggttagagatcacgtcttgtttttctctgcattgccaaaacaagtat

SEQ ID NO: 53365 - DNA, 1051 bp, Homo sapiens
acggagtcttactcactctgttgcccaggctggagtgcagtggcatgatcttggctcactgcaacctctgcctcctgggttcaagtgattctcctgcctcagcctcccgagtagctaggattacaggtgtgtgctacgacgcccagctaatttttgtatctttagtagagacggggtttcaccatgttggccaggcttgtctcgaactcctgacctcaagtgatctgcccgcttcagcctcccaaagtgctgggattacaggcgtgagccaccgcacccagccccacaatatcctttaatcttcagtccatgcccatctttccctgcatgtcccaagaatgtgttttatagttatttcttttgaactctaatataaatcaaactaaggtcacatactgtatttggaagttatgtttctttactgttgtatgcccctccccctacttttaaaaaaatttcaattcaagcataacaattcagtgatatgcacacattttaactgtacagctcaatgaaattttacatatgtaaactgtataattttgcttcctgcaattttcacttaacgtagtgaacattttccctcatcattcagtattcacaaatggaatgatctggggccacttttggctttgtaaatggaacagatgtcagtgtgttaattttttagttgtgagtgtgagcctgcctgtctgtttctgtttcttccattctatcttggtcactcctgtttggccaggataaagaaaaaaatctgtgcttgggttctgggcaccatggctcctgattacaactgaacgatggggcatataggggttgattttaattgtctgcgttggtgtccttagggtacactgaggcggcgcacaatggcagctgccagatgccttcagattaaacatgactatgagggcagcgtagaatactatctgcactgagctggagttgccagaaatgaagaaacaggcacctaatggaagtacagaccagagctttccttggctgcttggaacaggtttcaggggcctttgggaaagcacctctgtttggg

SEQ ID NO: 53366 - DNA, 1812 bp, Homo sapiens
gtaagtggggcttgggtcagaccttaaagattaaagagtgagtcagctatggaaaaagggagcagaagggagaggtcatttcagcctgggggagaggtttgggcagaggccgagagagagctgtgattactggcagattagggcacagccggggacgttttcaggaagcacttgggtcctatggtaaagaggtctgcatagagctttccagtttattctcactccctgagacctgccacacaccattagcctgcagctctgttcatttttcaacagagtggtgtaagaagcatgatccggtgctaacctagggcagtgggcagtggcctaggtgggcagtgggggtggcactgcttccacatactcagaggagagacggttctggttctcaccttcctgggtcccaggcatgtgctggtggaagtcagtggtcacccaggtgagggaggaagcgctgtcagcaggcccaaaagagaaggccacagagccttgggcccagaggtgactgagggagcctttgccttttggcaggtgggtccacgtttcatgtgctgtggcaattctggaagcaaggtttgtcaacattgcagaaagaagtccggtggatgtgagcaaaatccccctgccccgcttcaaactggtaagggcttgtagactctacataatttcccgacttacaagtttctgggtagaagagaacagggacctcctgtaccccttggttttggttagagtttgtgattctcactctgtggttagattccttagtggaggccaggtgtggtggctcacacctgtaatcccagccctttgtggggccgaggtgggtgaaccacttgaggtcaggagttcaagaccagcctgggcaacatggtgaaaccccgactctactaaaaatataaaattagctgggagtggtggtgcgcacctataatcccagctcctcgggaatctgaggcaggagaatcacttgaacccgggaggcggaggttgcagtgagccgatattgtgtcactgcactccagcctgggtgacagagcaagactccgtctcaaaaaaaaaaaaaaaaaaatttccttggcagataaagttgtaaccagacctggattagagcaggctggtgtgtccttgtattttgggaaggggctggctcttgcttgcttggctttgcatttgggaggggaacaacagaggaagctgcagtgccagttcctgcaatcactggttttcttcccctgtgctacagaaatgtatcttctgtaagaagcggaggaaaagaactgctggctgctgtgtgcagtgttctcacggccgctgcccaactgccttccatgtgagctgcgcccaggctgccggtgtgatgatgcagcctgacgactggccttttgtggtcttcattacctgctttcggcacaagattcctaatttggaggtgagagagggtgtcattctagaatcctcttgacagttttcatggtcattttctctgcatgttttccatttgttgtatcagcaactatttcctcaagcattctgcattatgaagagtgctaatgagttaagagattgagaggtggcccctgtccatctccactccctgccttgtactccataagccagtgacaccaaactgcttgtagttgattcgttttgattatctctttacttgtctgcctctccatcagaataaactccttgagggtccatatcttattaatgtggtcatccttattacttaacctagtgtccgggacatgcagaacctctgaaaatgttgagaacaaatggggagagctcccaagagttaaccat

SEQ ID NO: 53367 - DNA, 1051 bp, Homo sapiens
cacactcattcagggaacagcaaggggggccagcatggctggggcagagtgcctgggcaggctagcaggcgtgcttggaaatgaggccgtcacatactttgtgatcctgtttgcatcaagggcaagttcagaatgagaagggcatggttgagggcaccagagatggcaatggcagggcccttggaatgggggacagtttgttgtgtgtagctggagacatctgggaaacctaagtctttgtgccctagccctgagggtaatgctgcaggtgctaagatgtggtgcagctttgcctggcggcccaggcctcagggcacctattgagtctctccttcgatactttgatgtcagttcttggcaagatcagaggtccatgttgttgttcagagagttctgggtaagataatatggtataagggccagttgtggactagctaaatttatgggaagagctaaatttatggaggaaatgtggtactggtctcttccaatgtcctggctgggatggtgggtatctggaaaggcttgttttagctcccatctcttctctcctttttacttttactttcccatgcttatctttccctgataaggaggaactaattgatcttcatctccatatgccaggcctgcaaactccacgtgtgagtaaccaaagcctctgtttttttccagcgtgccaagggggccttgcaaagcatcactgcaggccagaaagtcattagcaagcataagaacgggcgcttctaccagtgtgaagtggtcaggctcaccaccgagaccttctatgaagtcaactttgatgatggctccttcagcgacaatctttatcctgaggacatagtggtaatatctgcaaggagcttctcaggcagtttggaatggggggatgtttctaaggtctggctggcagactgtgtgtgtatgcctgcttcttctagccaggtccctggtcccatcaccatgtcctcaaacagaaagaatcatctgtaccagtctttctttgcaaagaaaactgcgtgctgctagggtaccctattttccctagaag

SEQ ID NO: 53368 - DNA, 1039 bp, Homo sapiens
agctggtattggcatatttgattccaaagcctgggctctcctattgcactagaatgccctcaaggataatttagacggcaacagatgcaggtttcaaggaattgcagaaaatactgattcccaggtacttctagggaaaatagggtaccctagcagcacgcagttttctttgcaaagaaagactggtacagatgattctttctgtttgaggacatggtgatgggaccagggacctggctagaagaagcaggcatacacacacagtctgccagccagaccttagaaacatccccccattccaaactgcctgagaagctccttgcagatattaccactatgtcctcaggataaagattgtcgctgaaggagccatcatcaaagttgacttcatagaaggtctcggtggtgagcctgaccacttcacactggtagaagcgcccgttcttatgcttgctaatgactttctggcctgcagtgatgctttgcaaggcccccttggcacgctggaaaaaaacagaggctttggttactcacacgtggagtttgcaggcctggcatatggagatgaagatcaattagttcctccttatcagggaaagataagcatgggaaagtaaaagtaaaaaggagagaagagatgggagctaaaacaagcctttccagatacccaccatcccagccaggacattggaagagaccagtaccacatttcctccataaatttagctcttcccataaatttagctagtccacaactggcccttataccatattatcttacccagaactctctgaacaacaacatggacctctgatcttgccaagaactgacatcaaagtatcgaaggagagactcaataggtgccctgaggcctgggccgccaggcaaagctgcaccacatcttagcacctgcagcattaccctcagggctagggcacaaagacttaggtttcccagatgtctccagctacacacaacaaactgtcccccattccaagggccctgccattgccatctctggtgccctcaaccatgccc

SEQ ID NO: 53369 - DNA, 1018 bp, Homo sapiens
cccatttgatacatctttgttgaactggcctaagttcatgccagcatctgtgctctatacaaattgtggaaccagtgggaaggatgggtgcattttaggtgcttgaaaagcaagggactcaacctccagtgggatcctcagattgctctccgagctgtctagttggtgagaagcttccctggaggaagacccaatctcctttggctggtagatccctgaggtcaaagtggacaaggatggggaaccacagagcagggaggggggcaatgaataggtgcaggacttgggtgccccggagctgcaccggctggcccttaaacagccaggcacttcctgtggcatggccctgtccaggtgcaggagaggcttaggtcagttcagctgctctggatgcttccttgtgtccctgggggttgagaggtggttgctacttggtatctcattgtggagaaagggaggtgcaggaggtgatcttttctatgtcagctccctcctggggcccagggagggaagttggcctttttttttctttgcccacactccacttggggattcccaggggatgtagcaagggaggctgggcagaaccaggccttagtggattggtgagagaacactaatccatacatctttggaagagaggaacacttcaccagcctttttacacaggatccctacctttctcgatgaccccactgcctccaggggtgggcgctgggtttaatcccagcagtttttactcaacagctgaccagttttccagaaactgcactttttttttttggtcaacctaataactcttaggaaactgcaactcaggtgatccaaatcacacagaccggcccgttctctcccctactggctgcctatgcagtcgggtcgacctcaagagaactggccccagccaaaagcggcacctcccggcctgccagtcccttcctgccttaggcagctcctcccagaagcctttttgtagggcaaactgccttccctttgtaaggtagggcctttggatcca

SEQ ID NO: 53370 - DNA, 1028 bp, Homo sapiens
gacaagacagggaaactccatctcaaaaaaaaaaaaaaaatcccatacaaatttaaacattgttgctgggcgcagtggctcatgcctgtaatcctagcactttgggaggccgaggtgggcggattgcctgagttcaggagttccagaacagcctgggcaacacggtgaaaccccgtctctactaaaatacaaaaaaaaaaaaaaaaaaaaaaattagctgggcatggcagcgtgcacctgtagtcccagctgctctggaggctgaggcaggagaattgcttgaacctgggaggcggaggttgcagtgagccgagatcacgccactgcattccaccctgggcagcagagcaagactccatctccaaaaataaaaaatttaaacattgcttaaatgccaacagtttatatggcatttagctattcccaacccttgctcagaagtgacacaaatgtgtgtgaccataatatactcatcagatggggttgctaaaacatacacacttctcctcggcctgtcattgctgacttcttccccctgaaattttgctcctcctcagtcatcttctgatgatttttttaaagatagtaatggaagtttaattcatatttattttccattagattctttatatgatcatcctggcttgacatgagttcctcctctctcaactcctgtagaacttaatttatgttactctgatgaaatgtcatctactgccttggcccattatttgtctatgtatcataaatttcctcttccttgatgtcagtttttcttgcaaagtaactgaaaggtggcatgtttatgtatttttaacacagcttaaaaactcactgaacccttttgtttggaatatgttaaatcaggaaattctgttactgaggatttaaagaatgtagcagttgttctctttggtctcgggattcccttaaagtttaaaaattattgagtattcccaaataactttcatgtttgtgagtattgtctgtcgatatttaatgttttaaaaatcactgagtacaaaaaa

SEQ ID NO: 53371 - DNA, 1048 bp, Homo sapiens
ttaaacaccaagagaggtttataaataggaggtgtggtatttttcttccaataccctgctgaatcactttgagtgcccttcgaggtgtacatcccgtacatcccctctttgagggcaaatggcctgggctgttataatggcttcttcttgctctgtgcttagccttctccagtcagttctccatattgctacacgagcaacctttctaaaacatagatttacgtcatttgtttatgtacgtggttcctcattgccaatgggataaatttcagactccttagcgtggcttgtaatccctctcctgcccttctgcttcagcttcccagagtcagtttaattcaggcaacgcctctgaagcttttcctgagcctcccagacaattattaattcccataatctcataacatctgttccttgtttattccataactgcacgaatcaccctgctccttgagggcaggcaccactccctgtgtgtccgctgctttactcaggtgtgtaacaatgacttttgctgggactgataagatggcatagctggtagcatagttccagcatagttactttgcaatagtccagcatagtttttctaaaatatgtctttcctttctgaaaaaatacatgagcagataaacaatatggaactactgcataggcctaaaacatgtaaagtctcagaaataatagcaaggaaagggaacatttatattttgtttttcttttttcttttctaattttttttttttttttgaggtggggccttgctctgttgcttaggctggagtgcaggggtgcagttacagctactgcagccttgacctcctgggctcaagtgatcctcccaccttagcctcctgaattgctgggattacaggtgcacaccaccatgccccggtaatttttttttcttttgtatttttttgtagagatggggttttgccatgttgcccaggctggtctcaaactcctgaactcaagtgatatgcccaccttagcctcccaaagtattgggattacaggcgtgagccaccgtgcctggcctgtattt

SEQ ID NO: 53372 - DNA, 1048 bp, Homo sapiens
tttttagttgttctcagtgggaagtttggacaagatatatagttccttgtgtagttagaaatacaagtttctgatttctttttcttttctttttttctttcttttcttttctttcttttttttttttttttttagacagagtcttgctctgttgcccaggcgggggtgtagtgatgtcataatggcttactgtaacctcaaacttatgggctcaagcaatcctcctacctcagcctctcaaatagctaggactacaggcccatgccaccatgcctggctgatttttaatttttttctggagacaggatcttactatgttgcacaggctggtctcaaattcctggcctctcaaagtgctaggattacaggcatgaaccaccatgcctagccatcaagtctctgatttctatttcacttaaaactttatgtatttacttttacaaatataaacattaaaaataaatatatggataaataaataccttgtcaaagtattccatctgaacccacttttcagagataattattgtcaatagtttggtgcatattcttttatgtatgtactagatacttagtcttattttttttttctttgagatggcatctcactctgtcatccaggctggagtacagtggtgcaaccttggcttactgcaacctcaacctcctgggctcaacaaatcctaccttagcctcccaattggttggggctataccaccagtacaggcacataccaccatgcctgaataatatttttttatttttattattgagatagagtctcgctctgtcgcccaggcttggagtgcagtggcacgatttcggctcactgcaacctccgcctgctgggttcaagcgattcccctgcctcagcgtcccaagtagctgggactacaggtgcgtgccaccgcacccagctaattttttttttttttttttttttttgagatggagtcttgctctgtcactcgggctggagtgcagtggcgcgatctaggctcactgcaagctccacctcccgggttcacgccattctcctgcctcagc

SEQ ID NO: 53373 - DNA, 1034 bp, Homo sapiens
actctaagttattcttcatttggaaattctctctatagatactttaagagagaatatatcaataagatgagtgctttgtcttttaagaactaaactttttcttttctaggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccagtaagtatagtcactctagctcaccccaggagaagcctgttgcaggtcagttactggtttttcgtgtggctgcgtctcatattcttcagagatgggcaatgagagtaaactgaacatttctgggactttggcctagaaattgcctgccattttagctggtataggctgagaactttgatgttttttaaaaactgcatgccatgacaaatctcagttccttttacaaacttggtgagaatgtgctattcttcaataaaaacccaaactatactcatacttctagttcttgaacgcttttgttctttctaattgctgtagcatattgccactctattttgccatttattgccttagggattagtattgaagttggtttccatctgcccttaaaacattcatctttatgttgaattttcaacataatattgtctctgttttgttttccctaaagaaacgttgtctactgaatctttgtagccgttgctgctattgaacttgcacctggctacaataatggcttattttccctacccagtaactcctaatttttttcttctctttgtgcactttgtctcatgtgttacatagtgttttccacatagcctgaatcccactggtttggtttctgtttacctgatgtggcctgtgttttggttctaggcttgcagttgaagggcttacattgatcagcaccagcctttgcacattgttttcttggctgtagcttgaaatatcacacagtgaccatagtggttttctttttggttattttgtctg

SEQ ID NO: 53374 - DNA, 1030 bp, Homo sapiens
ttgaacccaggaggcagaggttgcagtgagctgacatcacgacactgcactccagcctgggtggcagagcaagactgtctcaaaaaaaaaaaaaagatttttacatgtttaaagggttgctaagcaaaacaaaacaaaaaaacagaaggatatgtgacagagactgtggcctacaacgcctaaaatatttactgtccacctacagagaaagtttttcaacccccaactgaaatctcctatttcaaactggaaggctagttccttccctcccaatttccacatgcaatgatcacctcccatttcatagagaaaataaatctattgggcaatctacttcttactctcccatccctataccaaaccactgcggtttgccagttacccataatacttcattaagtcaaactgcaatgaatttgaaaggtcattgaaaacctccttgttactgaattcagctccctattttttcagtctgtattttactggctgctctatgacatttgataacgtgtggcttccattctcacggagttaactgaacctgctctttctgaaatcgccagtagcatcctaattggcaaacccaaagaatgctttccacaccttatcttctcctttcttttgctacatttaacattattgcttcccatctatttctggaatatttctactcccttgtattctgtggtagtattttctcttagtcctcaccatcccacatccgatcagtttcccaatcctgtccattctccctttgaatttcatccggcccccaacagcctcacgtgagaccctcattgtctgtcacctggcttaccacaaagctctcctgctaggtcttagcctccttacgctctgtcttacacactgccgctagaatggttttcctgaagcaaaaatctgttgatatcattaattttctgaaaaatatatagtgtctttctctactctgtctacttttactcaataaaatccagactcctaacttggtattcaaaaccccatctggtctgcttttctgccttatttt

SEQ ID NO: 53375 - DNA, 1053 bp, Homo sapiens
cgtaggtactcatggcatgcattttgtgcactaacatttccccaactatatagtctttttcctttctttgacatcttcattttaaaattctagtgtacattgtaaatttcaataggccactataagccttttttggggaagaaacaatgaacaattgagtatataagtagaagaaagggcaagatcaaaggggaaatgttagtgcctttaactagattcaggaaggaacttttattttgctttgttttaattccattttcactagaagaaagaaaaagaagtaaatttgtcccctaatctggcaagaaatgcctctaaagaatttggggcctgtccctgccttgagacgtctctccctctggcaggaggcaaggggtactgggctgggcagggtctcctggctcagtggatgggtgggcatgggcctgggaggctgggctgttcgactgagttcccttccagttgactctgctttgagggagggtttgggcagagccagtgggagcttgcttttttattataagaaggagaaagaaatgaacttgtcctcttgtgttgcagattcagtggttctttcctttgactccgctggacaaacactaggctcaggtaccaactcttccccctctatcatctttttggccttcaatattagccatattttttgtgaagcctaatcaagtatgggtttgctggggagggcagtggaatatcccagaattgggggaagtctcaagaagcctttctagagactttatggtcagggaagcagaagagggacatatccagagaacttttccagttactttaaaagtgcacagaggagttacagtagatgctccctcttcattcagagttgtcaagagtcacataaaaggatgtctgttttctgtgcatatatcctgtctcagaaggtggggcagagggcattgaaagaccccaggctgtgggaatgctggagcagataaccatcagggctctctactagaatgctgggctggtgggagcatcccagtttcctgaggacatacactccattgcatgtttacatgc

SEQ ID NO: 53376 - DNA, 1003 bp, Homo sapiens
ctgacagcccatttggaactattgccaacttcttcctccacccaagccatggcatatattacatatgtttaatataccccatgacttttttttagagattgtacagtgacatttcttaagaaatgatagagctgttttggctagggtaggtcctcattccatttactgccattcccttcgtacttagcaattcatcatagcccagagattggagccaaagaccactttaaagaagatctggcagcagagctgcttctctgggtaaatggagttttcttgcctcatggactatcctgcctatgtggctttgtgaattataattcgaagcacggcaatttctgatagaaccaagttcatgtttttatcccataaaataccaaactttatatacctcaataatgctccttaaattggtgttcatgggcaatatttgtggttgtcatcagtagcagtcatttaataagcatcttctttgtgccaggtacagtgacagctgattggaatttgtggtggttcattacaatgaaaaaaggaagtgggtcactcacaacggaaatgccagtagcatgttaggctcatcatgtacaaccgtattccttgaaattccattctggggctcagtagcctgaaggtgaggctacagtaggacacctggcttcaggaaccttcaagaagctctctcttttgtcctggaacaggatgtgactgcacagcctggtgctcccaactgcacgtcagaatgtaggtaggaagtaatacttatgtgctatactaggacaaataggagaggacttggagttgtctacatagggcattgtgaaaacatttgtgatttttttttttttttaatattacagaactgtgatgaacaggccaggtatggtggctcacacctgtaatcccagcactttgggaggccaaagcaggaggatcagttgagcccaggagtttgagaccagtctgggcaacatggtgaaacctgtctctacaaaaaaataaaaaa

SEQ ID NO: 53377 - DNA, 1142 bp, Homo sapiens
caagaaaagcctcgtagggtctgccaggcttcagctgtggcaggaggtagagacgggtaggccgggtggttggaatcgtgagtcagagggcattatgagaagggtttgacagaggactgaggttgagagaaatggggtccgtggctcattgtagctggctatgcattttcctgggagatttactagctctttagttttccaaagattattcctattgttcgcaaggggactttatttgttcaggacaacacatttcttctggtaatgctccttgtaaccatgtgtatcacatgggagtcatcattttccacaaaccccatatcctcagtctctgtgactagaacagaatgaagtactggtacaagctccgccagccctagcctttccccaggagtttcgcccttgggagcagaggggcgaggggcgaatgcaatcccttgccagtggcaaagcagaagatgtttgcctacaggttgctggtggtcacattgcctcatttacgaagaaagctcaccaggagagagtacaggcaatagagggaggcccggatggcctccctctattccagtcactttcggtcacccctgagaccctctgcactctggccccttcctatgttttggttatgtgaaccactaaatccatttgcactaacttcccctgagttagtgcaaccagtatgttgagcatgcaggaaatgtcaaggatcatcacagacatcttcattttgtctcctactgttcccttaaaatgttttcatgtcttcaatacatctgaagtaataaaaattccatggtcacagtgagttgccatttccaaacttagagtgccccatcttgtgtaacagtcacagctttcaactcacagtgccggcaggtgcctggtggggaaagggcatgccctgcctgtctttcctcttccctcctctcccagctactagctgctgcctctgacctctccgtgattgctgttggagggagagagaatgagcagtagagacctagagtgtttgcactctctggacctgacaaatagttaaagctgactctggtggggtgcttttgtgagtgttctgatgacccctttccattttaggggcctcttctctgcggttcccccagtatgggtaatgcccatgccac

SEQ ID NO: 53378 - DNA, 1032 bp, Homo sapiens
tactaggcttcttggtctctctagcacctagacagtattggcgtatgtttgtcaggtgcccgttaaacactgaatgcttggttggatggatggatggatggatggatggatggatggatggatggatggatgatggtaggatgactgcgtactttcctatttgacaagcatgccttgagttgcagctctctctactctgtgtgttcatgtccctgcaagcctgctcacatggccgatgctcaataaatccttgcagaaccaccttactacctactgtgattcctttctattgttagtcatctttgtgcacctgtgtcccctgccctgtaccaggcggacatcatgaaggatcagaattgtgtctctttccttttctgtcttgcataagaccttttccacagttgactctgatgacgatggccacacctacgtacaagacatcaaaccaggggctggttggttttcccactgaatggtctggcgtctggcttcttggctctggtgcctcatactatgagttcaggcattgtaaatctcccaacttttacacattatgaaggcaactatgaaggaaaaagtgtgtgttctgtataccaggctagtagagagatgtcagcctcatgttaacatctagggaatggggtatttgattgtggtagaaagccataggcttcactcttagaaaatccttaatttagtactctggaaaaaaacaaatcaagtataagccgtaagcaagtgaaatgccaccagaacggaagagatagagtaattaccaagttgaatcacactgatgaacaaaaggcatgttctctaggacatactacagtatttaaactgtcttcagcagtgaaaggaggaggatgaggaggacgctcatctcctgctgtcctgacagttgggtcctgcagagtaggctgttgtgtagctttctgttgtgtatcaggccagttctttgaactatgtgagttaacttggtctttagcacagtaaattggcttggcctcatttgatttaactcacaatctaagg

SEQ ID NO: 53379 - DNA, 1126 bp, Homo sapiens
ctgctgccacagtgtggtgttttacagttgccatgtgggcaagagcatggggactttaatgctcagtctaatttcataaggaattccatgtgaagacacaaaaatatgaaaatgaaagcaaacaactcttaacccccagagccttgtgaaaaaccaggtcatttgtaatagtgtataaacatggagcagtctaaatatagcctgaggtgagtttaacacttctaaaacagcctgtcaagttccctagggctgcaaggggaaagcatttattgagcacctactatatgcccagtggtgcactaggtactttctatgttacctgttcccacaacatttgcttagataatctaatccggtatcatggctttaaatatcatctatatgctgatgactcctatatttatatcaagcccagttctctttccccacactccagactcatttacccaattgcttccttcatttggatatgtattaggcatctcacacttaacatgtccagaaccaaactccagattcacacccctgcctcccagaatcttttctaccccaggaaatggcagctaactacatccttccaattgctcacatcaaatactgtagcatcatttctttgacactcaaatctgatatcagcaaaccttattagctttaccttaatatcctcagatccagccacttctcactacctctgtatcatcactctgtccaaaccaccatctctcacctaatttttgcactcctaactagtcttccagattttatgcttgcttctctgtggtctatttccacactgaagccaaagtgatcccattaaaatacaagatagatcttgttactcctgtgatcagaactccccaatggctccccatttcttgtagaatgagagccagaacctttatagtgctcatcaaggccctacatggtccacaccttcgtttcttgttgctctccttcttgtttattgttttatcctgcgctccttgctgtgattcggatattccagacctgttcccgcctcagactcttggcatttgctcattcccttgtctggaacactcttccccagatacctgaagagattgcgcactctcttgcctttttagaacatagttcaaatgtcacc

SEQ ID NO: 53380 - DNA, 1535 bp, Homo sapiens
actattcaacttagctttctgttttttccaaattcacagtcagttttatcctatgttttaactataccgaaagctttgtaagggcaagaactaggaatgttctgctcacagatatattcacaatgcctagtatagtgtttatgtgcatagtaaatattcagtaaatatttgttcaatcaatcgaggacagaaggaagagggtatgagtaagaaagaatagagccacctttaataacaaaatccagatctttcaaatattgttattagaagatttttagggagacggagtacagtggtgaggactgtcaggtggccccttcctttatctaaccctgactttccccatctcctggagagactgtcacttgaagaacttctgccaccatcatgctgacttcagatggccagcttctctttaatgccttaaaaaaaaaaaaaagaggaaaggggtgtgtgtgtggtgggagggatactttctcttggcttctctaagcaaagctaaaaatatttcactaaagattaaaagaggacaacagagaaattaaccttgagaggacaagaaatccagaggagtagtctggtttccaaaatgcagaattctgtctcttctatagctagcacaagccagggccatacttacttcacaacaggagagcatagcattgcaggatttggctaggttctttgcttcatgacatctagcatttttcacagcccactgttcaaagactttctcctagacatcttgagctatgtgatcaagactgaaaaagccaaattcccactttgcagctcaccgaggactctctgcacggtggtttttggccttgactgcatattggaatcacctggagagcctaaaaaattactgatgcctgcatcccaccctctagagattttgaagtcactgagcgaggacacagcctttgcattaggatttttaaagctgcccaggtgagtctaatatgcagccaaattgagaaccactgctttaataaaagattctgtttcctgtctcaggaagtctccacttccccaggtaattgataccaagaataaatctgcctgtacataggagtatgtctatgtgtgatgattcataactaagacctcactacccagagattctgatttagttggtcaggaattgggctcaggtacctttatgtttaaacattctcccagattattctaatatgtcagggtcaagaaccatgaagcaacctcaggcctgtcactatatcatatctgaatataatataacaactactgcagaatatcataacaattatgttagggtagtggaattgcggctactttcttttgattctaaatattgtttttattacacctttacaatgaaaaaatatatttggatgtttctgtaattttttcgaactttcattatgggctatagatctctagacactatttttggaaatccattttatattagtttttggttaccaattttttctctagtttttcttaatggtcttttaaaatctcagccaattgaagaacttcctatacat

SEQ ID NO: 53381 - DNA, 1083 bp, Homo sapiens
atctcctgccacaaacaacaagtatctgtattattagtactcaatgccatggctttttggaaactgttttgtggaaacagtgatcttctcccttcatttctccagtaccattcagctcatgctggatacatcatttcatgaggctgcgctatccttcctgagacctgggagtatctcaaagatgggactgctttgttggtcatgaacacacaccagtgtcagagagtgcagggaaagtgtaaatggtaatttgttttctggtcatattaaatgtatcatttgacattttatagtgtaaacagaacagtgcatcttctaaccatggcttctcctggactccttcagccccatatgcctgggtctaagggaggtactactttgtagaggattgttgtaaagctgaattagatcattagatccgctgtctggtgcctggtttgtgctcagtgaatgttacttctcttgtgtctttcactaccacccagaaagaggatgtgtttttatttttaaggaaataaagtgtggaagcaaaattgaattggagagtcacagcagatctctggtggagtgcctccgtgaaaattgtctgttgaagcacttggagaacttagtggggagcatccctccagctaagaggaaataaattacaaggctctggagacaaatgtaacctggagttaatgtcagctccacaatcactgatcaaataggaaggtggcctggtttgatgaaaaggtattgcagtgcctagcagcaagagcagaaaggcagggcctccggagctgagaaataccacaagtttcagatggctcagatcaagcagtcccttttttcttaaagtgatagaagacatttgacagtgcttcagcatttgtcgtagatggctgtacacgtatcatgatggcaaaagctgtagagaaacctgagtctacattggaagccacaaagagcaaagagtcagtgatgtctagggtagaatggattggcacagcccacatgtgggtagatgatgaaactggtgacaatgcaagcaagacccagcagaccttggagtaacaggtcagacaggtggcagtcagagga

SEQ ID NO: 53382 - DNA, 1098 bp, Homo sapiens
acagaagttgtccttaaggagaaacatttccatcttggggcttgagaggatctatggcagtaaaggctatttcaaaaaaaaaattaaagtgaaaatatttaatgacagaataggattactcaagctaggcgaagctgcttctgccatttccctcctcatgtcattatcccagaaacaactctctagtacttggagaaaggcatcctcatgaggaaggtagaagatggaattgaagaattccctcctctgtggatggaaagagctctgtgtagagaggctcatctgcacgctcatgcatgtccccctagcatggtaacactggctttgattaagctgctgggttgttaggcagtgtgctaagtgctgcctacatggtcttcttttctcataaggaatgctttaaactaaattagcacatgaaacgagggagcaggcatggtaggggctgatctgagtccagtcctctctgagatggttctagaaactagactgatggttacacaatgtccatcactgatctgtagagtcctcaggaatcactgtcaatgactcttccccagtttccctggccatcaccccacttcccccttacacttcctgttgattaaccttccaaggcaaggtaaccaactgatttcagtccagcattttattgggtacttgtatattctgtgccatacatgctttgctaaaatgatcatattctatgagagaaagatatttaaatggacaattactcttcagtgtaatggagtgtaatgctaggccttaactatgtcctagtcatcattgtatccttaatcccaggccagttagttagcatgtactgagcaccagcgaggggccagacaccgtactcagtgccagcccttctttctcagcataactcttaacaaaaaaattttataaagtaagtactagtataatcccacttttaaagatgtgcaaattaagggcacaaaacaatttaaaagacatgccccaaatcacacagctattaagagagccaggataaaaatccaagcagagtgactctattgtctctaaatatttgttgcctgtggaaatgagaggcagaaaggggaaggcggtaggaga

SEQ ID NO: 53383 - DNA, 1068 bp, Homo sapiens
atgtagtctggcctccactctcgcttctctcctcctcagaatgctcttatccagaccaccaaaaagcactgacaaatccgacagatagatagtctttctcttttcatgatgtctctgaagcatttggcagtattgatctcttcctccattttgaaactctctcttctccttaattatttgttcaaactccctcccagttctcctacctctctgttccttctcagtctctattgcaagagatcttcttttcctgtgcccatccttaaatgttgatgtttgcctggtttcggttatagctctcctctcttctcactccactgctttagctaacatcatatgtgctgatgactctcaatctttttgcagcccacatctctactgatctctagacccaaatacccaacttcctgctggacagctccacttggatgactcaaaagcatcacaagctcagtgtatccaacgcaccgaatttccaacaaatctaatcagcctatgttcttatttcaggaaatggcaccactatccattctcacccaaacaagacatctgggagtaattcttttcccttcccctcttaaccagatatctaatgagtcgtcaagtcctggcacttgtgtactgtcttctttccgaggtcagttccttcccctgagccctgattctccaacctctcccacctctgcaggaacctggatcttcattctcttcactggttccttcttatcactatttaatcatattcaggtctctctcatctcttaaaaagttgccacattgatcctattattctgtaaactcattcaacaaagtgccagatatttttctaggtggtatagcttcagcactgcataagttacataaaacctctcccctcagagatcttacattccactggcagacacagataacccacgcacataaagtgtcacgccatttttagagcacctaccgtgtgccagacactgtatttcattacttcatttagcctttacaatgggagcggatcataattccaaaagacacaatcatgaacaccatagtcccaaatgctgaaatcctaaaaga

SEQ ID NO: 53384 - DNA, 1008 bp, Homo sapiens
aaccgtgacccacactcaaggctgtggggaaagatagctcatccaggaggcctgggctcctgacgcagccctgtctccagtgggcctgctccaggaaagttgctaactctcatagagatgcattcctttgctaccgctcagattattgagaggaaacacagggttcagagaccccagcgtggccaaggaaagctgttggcaaaggcacagctgcatgtagagtgaggttcaggagcaaagggtgagccttgctctatccatctctgttccagtcctcatcaggtactccacagaggagcatttgctaaaggaagaaaggtaggactggccatttctgccatgcatctggatcccaagggccatcctccatgagcagcaggtctcttcctgtctagccatgagcccctttccctaacccctggagtgctagatgcagaaagggagggcagtggagggatgtaggctatgtgggttacagtcaccatgttctccctagccagaggttgatcattttttccagcctgtaactgggcctaatttcagaccttttctgagggtaggttcaggaagtagaaagcttttgagctgaggcaaaagtggtcttactgtacttagactgtcatctgttggcactgcggtgaggctggtcggaggacgaggggtacatctttaccacctggcctcaccgctgtttcaccgatccctgtggcttgaccttgtgtgcctgtgccaggttcacagcatctccttcatgctttctcagcaaagatggaatacagctgggagctcctctgcctccgtctgggcaagtgaagagagcttaggttttgaaatcaggcaaacctgggttagaatcccaactttgctactttgctagctgtataaccttggacaagcccttagtcatgttaaacatcagcctccttatctgcaaaatgcgaataacagcccccatctcatgggcatttatggggataacactaaataatgtccatgacatgtgtgtcc

SEQ ID NO: 53385 - DNA, 1027 bp, Homo sapiens
ggttgtgacaggtccctatccagtgggcagggcccattgttgtagctattcattcattcattcattacctataatatgctaggtgctgttctaggtactaggcatgtgatgttaaagacaaggcatggtgataaaactgtcacctcagctcgcccaggaggcgagcagaggtgaaaaatggcagaaatagtaggaataccagcctctgcgtttgtatgggggctggaattcttattgtgggacagttctccctatgcatctcgacaatagtctgtgacaggtttctatcactagcttgacccatcccatttgatcaggtgttcagagagagaggattctgcccctacagcctcacccaaggtctccaaagtcaggaacaatgtttgagcccctggactgaagaaggcagctatagtattttcctgtaggaacagagtccccagctaggactaagggggacctgcatgggaaattccaggagcagtctgcattcatgcattgcccagtctggggcgatgatgatgattgtgatgtcatctagccacgtgggtgcagggtcttctgacttccctggtcagcagagttggctcacccttctcacttccctgcagagaaacacacagaggccacattcaggaccccagagatagcaaacaagcagataggtctccccttagtctgtgacttggatgctcttcattgaagaaaagacagatggaataggtttaggggaagataatgggctccttttttgatgtgttgagcctaggtgccagtaggagatcttggacaagatactccaggtgcagttggatatataagtcttgagctccggatacaggtctaagtttgagatggagattcagcagcccccagttagaaatatgtgtctggatatctggaacttgaaccctcctgtaaacagtcgcattttccagccttttctttataaaacctgcctgggactgtaagcaatgattggatgcagagcagatagtggtcagcaatgactgcccttgtgcccctt

SEQ ID NO: 53386 - DNA, 1115 bp, Homo sapiens
tggttggatccatctgacttttcctgctcctacttctgggctgcttggcaccactgccttggcgacacacaaacacagccttggcgctactgtggcttcatgctctccagcctctgtgcacagcttagcaatccttgtccctgtcccaggggagcatgaattggtctggttggccctggaaaatccacatggtggaggctgtcaccccaagctgctcctgtctcttgcagcccacaggcatttacggagcacctgctgtgtacttggctgagagctaggggtgccacaaagtctgctggggaactgggcaataacattagcatgtgttaagtgctaaaaggtcagtgtgacttaccatggtgactgtcccaaatctttcctattcataagtccctacagtctacaccctcacactacaaccccaaatcttcccaaggaaaagagtcgatgtggtgagcattttctcaggttctccatacctctaagctcacctgtcagagtagccatcttcacatcctcctccctttccacggaaaagatatcctgtcttctgtcttcctcccctcatactctggatctatccccttcctctcctcccgggcttcattccactgttacgctggctgtcacctaccccctccctctctccgcttgtctcctttccatctgaatacaaacatctcagttcttcaccatcccacttcatctccagcctccattccacttctgtcctctccttcactaccaagtctctttagaaattgtctgatctctgtcttgaacacttgctcacttctttccctcctcaacccctgcagttggttctgtcctctccattccccaatagtgtgttccctaaggggccagtgactttcatgtattaccagaagcaatgcggttaatacgaacgaggatataaatagtgcccatcctgaggtcactgtgagattaaatacgaaaatggagagagcacttagaacagtgccaggaatgcagtaagaactcagttgtcattgctattattactgttgttattattgtgacgttgatcatgtatttcataactgcctctctgtttggctgcctcacccattatccaccaaggcagggactct

SEQ ID NO: 53387 - DNA, 1112 bp, Homo sapiens
gaatatagaatgtggacatatattacatatattttcttatgattatttctctacctgtctctatcactagcttcttgaggaaaggaccaagcctaatttacttttaggttctgagctcgtactcagcacaggacctagcactgagtaggcaagcagttgttggatggggccgtgttttccagctccatctagtcccatgtaagatacggaagcaagagcttcctgaacaggcttggaatagtacttgttggttggcacctgatgtttgtctctttacctctgagctacctctctcaggacatatgatgcccacctgctcttaaacttaccatcctttctccttcgactcctgctctcccataggacccatctcccatggaattcattcaagtggtcagcaaggggaacgcagcaagacacatatttgacagggcatttagaaagtgttcgcattacttgcttagacatacaccaggctcttcctgtgcatggccctttatggtggggctgcagcagctagatcccaagcaagaccatgtagactctagaacacctatctccctacgttatgtctatcccaccactactcagagaaggttctaggaaggtggatctgtgggatttggcttcatcctgttggatgacagtctcaccttgtgggagccaaggcctgtggttgaatataacggactgatgtgctgtggtccctggtctaagaactcattgctgggctctgccttccctttgtctcatgggctgcttgcactcgtcacagtcattgggagaagtggctaaaaggctggccacccaaccaaccaggcacagatgtcaagctgaagccatctgttaccctaatccagcaaacccatatctggaagcacctctttcagttgggttggtaggaactaggagaagaccctaccctagatctgctggtgcccacacataactactccctcacctcactccttaataagaccagtcagctttcttgccagtctgtggatacaggcttaatattccaagccttagaacatggtttaggttgatgagccagtgttgaggacattcaccttatacgctgcaccttagccacatttttgagcattaag

SEQ ID NO: 53388 - DNA, 1098 bp, Homo sapiens
gaatcgcttgaacctgggaggcgtaggttgcagtgagccaagatcacaccactgcaactccagcctgggcaacagagcgagactctgtctaaaaataaataagaaatgataaatgtttgagatgatggatatgctaattaccctgattggatcacaatacattatatgtatcacaacatcactttgtactccataaatatgtacaattattatgtgcctattaaaaatttttttaaaagtaagaatgcattttttccaggcctatagagaaggaaagtggttgggaaatagagcagaggtgtacatttcaggcagagataatgcatgtgtaaatgcaagaagacggacatgtctacaaatagtgctgcgctgggagtatatataacagtagtcccagaggagtaaaatctagattgcattagattggagggtgactaggagatgaggaagtggagacaggatatccactgctcttcctagaacttttgccatgaaaggatgaaagagaggctggtagctaaagcgggtacatggccaggacgctttgtcgaatttgtttgtttgtttgtttgtttgttttcacaggggagagacctgagccttattgtgtgcataaagagaaacaaacagaaatggaatccatagcatgatagaaagatctactttggtgtcatagggatggggtaaggaggccaaatttaagaataggtaaaggggctgatagatttgtgggtaaggaagccagaagctgagggagtacctatctgatggtcttggtttttctgtgaagtaagagaaaagatacctgcttaaagagagttggaaaaggatagagtttatggagagtagagaatgtttggaatagctgctgagcaaagttgagggcccagcgcctcataaatttgtggtggcatcagtgcactttagtgtatatgtgtgtgtgttctcgcagcccctcaagtataaaaggtacaacagtgtaagattagataaatctctggttggattttgcctaatgtgtgggacaaaagaacagtggaaccaacgggtacaggaccctggcaagagtgagattgaggagatggatgggatctagcc

SEQ ID NO: 53389 - DNA, 1036 bp, Homo sapiens
ttccctgctcctttggcccttgaccccacgcccttgtccaggaccaggctgggatagaggaagaagaccaatgggcttctggcagcatttctgagagaaggcctgaaccatacaatgggtagctgggccctgagactctccagcatctctatctaggccctgacacttccccaggaaaacagggccatggaaaggcttgggtgccaggcgtgggtggtgaggagggagctttggtaagatgacattctagggtaaaggttccccaaggggtagtggtgtttaggcaggcttcaggggagagggaaaagtgggccgagcttggggctataccaggaaagcaagaaaaggggaacgggacaggaggctctaggactcaaggctcccagcagccactagagagcttacccatcttgcttctcccatccctgaccctggggcttcctgctctagggtctgttggtttgggagctgtcactgccttctggacttaagccttgcccccttcacctgcccccgccacccaggccctcagtcccattgctgggctagtcccagccccagtgtgttcagttcttaccctcaaacctctggtatctgaggactgggatgtcctgccaagtgctgacagcccgtgggggtgcaagtcaggtggagtggttccacttacctgctccacccaccctgtgtgtgtactgtatgtgcatgtgtggatgtgctggagaaactgcccatgtccagggaaggccagctgggcctcaacacctctgcacaccaccaggcagcggtgggtaggaggctgcacagtgtgtggctcacctgtccaaggcaggggtcaggcggtactctttggtgactgacaagatggctttgatcagattgtctgcagacagaggagagaggtttctgttacagggtcacttacctttctataaaatgtttactgataatcctactggaagacacaagtccctaggggctagagtgaaagtggaagtggagagagctctggacacaaggatgtattgggccactgccc

SEQ ID NO: 53390 - DNA, 1042 bp, Homo sapiens
gtcctagagcctcctgtcccgttccccttttcttgctttcctggtatagccccaagctcggcccacttttccctctcccctgaagcctgcctaaacaccactaccccttggggaacctttaccctagaatgtcatcttaccaaagctccctcctcaccacccacgcctggcacccaagcctttccatggccctgttttcctggggaagtgtcagggcctagatagagatgctggagagtctcagggcccagctacccattgtatggttcaggccttctctcagaaatgctgccagaagcccattggtcttcttcctctatcccagcctggtcctggacaagggcgtggggtcaagggccaaaggagcagggaaagagacctggtgggcagctctctgtacagaggtctccgcctctctcccctcagcctccgctgccgccgctgcatcatcgtgggcaatggaggcgttcttgccaacaagtctctggggtcacgaattgacgactatgacattgtggtgaggtgagctccccaaaatggcacctcgggtgagtgtcgtggccccaacccttagtcctgagcccattgagaactgtctgtctggctagttgggctggaggtcaacggaagcctcaagaactctgggttggagggctttggaacagacaactagcgggggcacctggggagaataggtccaggtgacctggactccctattctccatgcctgggatagtctggggtcatggtgccttcccaaacacaggcccaggctctgagtgggcctgctctctgtagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtggtaagctctcctggcaccagcttcttcccctcttgccctgggcttccgcaactcct

SEQ ID NO: 53391 - DNA, 1085 bp, Homo sapiens
tagacacttttaagggagaatggtaggaaatagagtctgtcctggtgaaccccagtgagcctaagggctgctgtctcactctggccttctgccatcctcctttcacatcgtttcctctgcccatgggcacctgtcacagcctccctcagggcaagagctcctaaggggcagagcttgatcccattggtttttacccttcagtgctcagtcaccataaatgatctggaattggctcaaacaccagttcctacttcccactggacagactgggaaaagccaggcagttcaaataaggccaggccaaaggggtgggtcagagcctgtcatgggtgttatcacatgttccttccaagaacaccaatgtcagttaattcaaggttcttaaaattcatccaagggagtaaggaaagaaagaagaaaaggaaggaagccagctagagtcggagaactcactatactcaggctactcaggaagcagacagcagggccttgcttttcccaggaagctgaggagctctccgcctggcctggccttggcagcaggcagattcaaggtaccagcattgcaggacgaggcacaggcacaggctcactcttgatgacatctgtgtccgtcctggccacacccagggctctaggactagccttgtattggtgagaactcctacccagggtgggtgggggtgagtgggaagggaagacaggagacagggaggagtcctctgaattactgtgggccttccttggctccaaagtgaaagataatttggacctttagagtgagctgccagaggaatgccggggttgcccgtggcctcacctctcccatctctcagagtggacctgcccaggccctttggctgcccaagggacctcttctttagtgtccttctccaccccaagcccaaggctaatgccttcccaggacctcacccatgctctgcctcacttccctggcatctgagacccaggaaaatgtgagaggctgcttctccaggtcccctcctgtctggtgccctagtcaccagcttgtcctgctcctgtagggatgtttccagtcatacagcctctgggcttctggagag

SEQ ID NO: 53392 - DNA, 1037 bp, Homo sapiens
aggttcaagtgattctcctgcctccgcctcccaagtagctgagattacaggtgcctgccaccacgcctggctaatttttatatttttagtagagatggggtttcgccatgttggccaggctgctctcaaactcctgacctcaggtgatctgcctgcctcagcctcccaaagtgctggaattacaggtgtgagccactgcgcccggcccttgccactctttagcacccgccatgtactctccactctggctatatggacctatggatcctatttcacgcctctatgttctacctgtttccctacccatggatgtatgagatgctcctcttcttataagcctcaggagggcagcagctgtcttgttgatctctgtaagcccatcacctccagcagtgaggcatagttggtatacataagtaaataagcagatgtggaaactgaggcccagagtgcaacagtaccttcgaggagagtcaggattctaactccaaactcctgcctctcagtcaggctctttcctctcaactaggctacctcctttcattgccctggaaggtctttcttttaggttcagacccttgcatccttttgctctcttcttgcctctccagggcatctctttcctcttagccatgtttgatcttctttatgcagttccaagatcattctccttgataaagaaatgagaactgaacagtccctggcgctctgcctttcagttgcctgttggcatcacacggaccgccccaagccggctcttctttttgttcatcgcttttttccaaatatagctttcaaaaagttttctgaccctctcctcatagcacacatcaaaataaatcccaaacggactaaaaagcgaaatataaaaatacaaccaaagggaattttaaagtaaggatagaaatcaaatccctggagggaaagaactttcaagacacaagtgctagaagaaatcaaatttgataacatattagaatttcaagttaacacaaaaagactgccgcacaaccttgaaaaacatatttagaacatat

SEQ ID NO: 53393 - DNA, 1032 bp, Homo sapiens
gacgagtcccctcaccattctgggccttagtcccctctgaaaaatgggacatgggcaccagagagactcctgagagctcccttagtgctcttagaggagacaggggaggtctcctttatctttgacccctaacccctcagacttccagaggcgggaactgcagcgatgatacaaatggtgtggtggaaagaatgccgttttggagtcaggacacctgggtttgaatccacttgcagccacttgcaggctgcttgaccttgaacgtatcgtgtcgtatcgtttcaccttgggatctgtacctgtgaagtgggtgaaagttaaagagataataaagtaacagtcgtgaaaccagcctggagcctcctcacacaggcccccagctgtgcccaatcctggttctccctgttcctcccgagcagcccctgtgctttctccctcctctttggtgtgtgcagggcaggcacaggcaggaaccccaggtgggaagctgttggggcctgctgggcctggagaagggacaggggctgtgctgtgctgtgcttggcacaggctggcacctgctgttcctgtcagtccacatctggcccacccaagaggggcttcccctcagctatgcctaaggtcttggccatttctccacccgtccgtttcctactgtctcccaccatccctccctttacctcccttacgcacaccccacttctggagacaggagcaggaaaaactggggtcggcttgctcagcctgactggggctgaaacagaagtttgccacaaggttccaatgtttgaactgacctttggaggacagacagtttgccagagaaagagatgttgccacagagttgggagccatgaggagggagtggctggaacagagacaatccaccaaaggagcagcagcggaagacgctgaagagctgctggtcactgggcgccctgggtggaggtcaggtctcctttagtaaccgtcactgatgcctctttgctgtctgtgctgtgccacgccctgggctacagaggtgaatcagat

SEQ ID NO: 53394 - DNA, 1651 bp, Homo sapiens
gagggaggaagagagagacttgaaaggaggggaagctgtgccccagaatggacactgggatgtcggatttcagaggtgatgcctttctagtacagtgcagagaccctccggtaagaatgatcccgttttatggttaaagaaacaggcttggagagcttgttgcccagtcacccaactctagtcaacagcagtgttggtctgctatactctacttgctcacgctctgtctccatttttcaggtccactctagaacagtcgatggagagagccaggagagagcagcaagggaagtgggagcacaggagggcagacaggagagagggcaggcacctcccagcccctcagctgctgcagatagggaggcagggcagctgcactgctgggtcttcttattggcccaggagccccctcaggccacagcagcacacccacagcatcccacatcctgtgcctgcccgacgactcccttcgtatcctcctctgttacacactggagccccaccacacgctctcttcaccatcattccccttgtccctgtcacacactccatttccccaaacacagatgggcttcctacaccacaggccctgggttccccattaaacgcctcatgctcccgcctcactgtccctacttggggtccctgccactcccctaggctcatcccttgctgtgtgcctcgttgaggcccgcttttgctgtgtccacagagtgcatcggatggcttctggaaatctgtggccactcgagtgcccaaggagccccctgagattcgaatcctcaacccatatttcatccaggaggccgccttcaccctcattggcctgcccttcaacaatggcctcatgggccggggggtgagatatctgggccctgggagagggaggaggaaagctgggtcagaagtgccttggaaggaagggtgggtggtgggtggggcagtgcttctgcaaaatagctttctggggaagagggctcagtccttgggcatggaggctagctctagggagcttggctgaagtctcagctgtcccagccctccagctgaactctgcatgccttctctcacccctgcccccgtcttctagaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagaggttcggggctgggtatgggggcaatccctgggtggggatgagggggaggtgcataaatgagtagtaaagggaggagccagtggctggtctggctgcccagaactccccagaaggtcctgacaccaagcatcctacgtgccctctccacagcctcccactgaacccagggccttctccctgaactttccttccaagggactctccgtgccctggtcctgcacctccctccccctcgctgcattccccagtcaggaacactagtctagcaccagctcagccatcctctctactgcagttcctgccttcccccagaggacgctattttccctcaaaaaacccacaactgaacactgcctctgggtctcaggacttctccatatctcttccacccttccccacagccaagcactgcag

SEQ ID NO: 53395 - DNA, 1036 bp, Homo sapiens
acacaactgattaccagtatctgccttcaggtttccacagtcacggagtattggagagtggtgacgaagaaggcaccgagccctggaaggggcagtaaaggtttgagcaaaggcccaactgatcacttcatctctcctttcagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatccataggactaccgcaggcccggactcaccaacttgccacatgttctaggt

SEQ ID NO: 53396 - DNA, 1040 bp, Homo sapiens
ccctcaagagccagggactcggtttcccccgcaggcctccctcccctgtgactccctccacacagattctggggacagagctgttacctgccactaggatccccgcctgagagctcctcactgacggctccctcctcggagtccccttcattgggtctcctaagagcaccaattttggtctctggcaagcctcccacccccaaacgaggtggggaggcctcggcagccatgcccgccctgggccccccctcaccccaccactccctgggcacccaagccggggtctagcagggggccagcagccaaggggctggggcaggagacagatcagggcccacctccctgccagggagggagcaaagatggagcggcgggaggagcagccgggggctgcaggggctggagcagcaccagccttggacttcactgtggagaacgtggagaaggtatgagggctctggggtgggcactccagtgacagagcagaagttctggggactgtcactgatggcagagctcaggcctgggctgggtgcccgctggtatggtgcccccagagcacctggcatttgctctctttctgggcaggcagtattgcagtgccctaatgggctatttttgtctttccttacaggcaggtcccctgtggatagatactctagggtcttgggatggtcccttcagggtgctgtgacttagccttccgtccagactggctatgttccagctccatgggaactgcatgagcagtgcagtaggaaactgggaacccaggagacctgcagctcagtctcctggaattatactgatgccaaaccatcctggacctggttttgttgagccaagggctcagaaaataatctggaactaaaacaatctgggttgttttgactctttggagaagggtccttcctttattggatggaagccagaccagtcctgagcaggcaggcctggggctgtctccctttgttttgtgctgagtccaagggtcctggccctgctgggagccttacagggctcctccctactcgcctgcc

SEQ ID NO: 53397 - DNA, 1088 bp, Homo sapiens
catctggactgacctagggatgatcctgggggagctgaaaggagctgttggagttgatgggagcagctgtgcctgggagggtcaagtcccctcaagctgttccatgcccttctcagacttagcttcatccctgtgaagctgttccttccacctgggccttgccctcaagtgcctcccctttggggagatcagcctcctcttttttgctttcctgtggagattccctctctgaacccataatgttttgctgtaaggagaagaggatatggtagagcatgggcaaggttcaggctctcaagatatcagcaggaccccaggcccaggaaacactgcagagcgctgagctctccctgctcagccccccagtcagggagagggagcagccttgcaggaccaagtcacgcctctgttctgggctctggcaggatccagagtggccagcacctgctcagtcctgtgctgtcctgcaggcgctgcaccagctctactatgatcccaacattgagaataagaacctggctcagaagtggctgatgcaggcccaggtctccccacaggcctggcacttcagctggcagctactgcagcccgacaaggtaccagagatccagtactttggggccagtgctcttcacatcaagatctctcgctactggagtgacatccccactgaccagtatgaaagcctaaaggcacagctcttcacccagatcacccgctttgccagtggctccaagattgtactgactcggctgtgcgtggcactggcctcactggctctcagcatgatgcctgacgcttggccatgtgctgtggcagatatggtacgactcttccaggctgaggactcaccagtggatgggcagggccgctgcctagccctgttagagctgctgacagtgctgcctgaggagttccagaccagtcgcctaccccagtaccgcaaaggcctggtgcggaccagcctggcggtggaatgtggggctgtcttcccgctgctggagcagctgctacagcagcccagctcacccagctgtgtgcgtcagaaggtgctcaagtgtttctccagctgggtgcagctggaggtg

SEQ ID NO: 53398 - DNA, 1071 bp, Homo sapiens
tcatctcaatctccccaaaagttgtaacctagctggatgtggtggctccacctgtaatcccagctactctggaggctgagcaggaggctgagtctcttgagctcaggagttcgagaccagcctgggtaacacagcaaaaccccatctcaaaaaaaaaaaaaaaaaaaaaatcttaacccattccggaatcagctctcagtccaactggagaacacaattcaacccataatgctgaccttctcatacgtccttctcagagttcttctgggggtccctgatctaaggttcttcccaacattgggaacatcaaatctgccatgtagaccctgaccctttttttgcttaggatttgataagggaaggggagctttgatggaagacaaggagattatgcctttctcttaaagccagtgtggggttgagcagagagctctgatggattttctcacctcatgcctctaggtacgtgaacacactcctgaaactcatcccgctggtgctgggtctgcaggaacaactgcggcaggcagtgcagaatggggacatggagacctcccatggcatctgtcgcatcgctgtggccctgggcgagaaccactcccggtaaagggtggagcagcttggggtgggatagtagggccctctaagaaatggggttctggaagtccctggaaaggtagaatgacctgactctctccccagggccttgctggaccaagtagagcactggcagagtttcctggcactcgtcaacatgattatgttctgcacaggcatccctggccactatcctgtcaatgagaccaccagctccctaaccctcaccttctggtacacactgcaggtgtgtctgtgtgacctccagtaggactgggctgtggtggaagaaggtggatcatgggcttctatgactgctggtgaggtggctaattctcttccctggctctctcaggatgatattctatcctttgaggcagagaagcaggctgtataccagcaggtgtaccggccagtctacttccagctggtggatgtgcttctgcacaaggcccagttcccttctgatgagga

SEQ ID NO: 53399 - DNA, 1522 bp, Homo sapiens
ggctccatgctaggatgtgtttgcattttgtatgtgtttcagtgtgtgagaccttattttgtatgttttgagtttggtttgggaagggaacagaaatcacctgtaagtagtatgtgaattgtgttgggtgctgagatgaatgtgtgccttgatgtgtgctgtatgttgatgtgttgtgtgttttgtgttgtttgttgatgtgttaggccttgatggatttagagcgtggacgtgtgttggaggtgtgtgtgttgggttgtcggagtgtatattatggaggataggagtgtatgttgtggcattggtatgtctgtatcagagtatggtttggagatgcatgttgggctgtgggggtatgaagttagtgtgatgggggcttctgtgtgttaggggatcctagcacgcagaccccctaacctgtgaattggggtaaatggagtgtttctttgcttaatcattccacagatatttattgagtgtgtgatacatgctgtactttgctaggtactgaggatatgatagcgagcaaaaccaggcacagttcttgctctcctggaacttacaagtctagtttctgggggatgggtagggtgggaggagggaagaatagggagtgttctgggcctggatggatatgtgtgtgggtgttttcaaaggtgtatctttgatgcggagggtgtctgaatgtgtatttgtggatgggtatgttggaagagtgcacagggggactgtgggaaggctgagggtgtaggtgtgtggacatggtttggggatgtgcaggtgtttggtgtatgactgtgtaatgagggtgtgttccagatggggagagtgtgtgtatgttagcggtgttagagaagtgtgtaaggagggcatttcaagtgatggtgcatgtgggggtgtttgcacatgagtaaacatggggggtagaggggatgtgaggggctggagggtagaggtctatgtggtatgcactgggggcattgctggggagcagcagtgtttgaggatgactggagctgtgcagagcatctcctgtgacctgaggatgtgccagtcatgtcctggtaccactcggggcaggccatctgcccccttcacttcatctcttccccctcacccacagcagcactggctccttggtgtgtgtatggccgaagagggcctggacacagggtaccctgggtgaaagatggggctgaggctccaaggctcctgctgtacttttcttctttttgagcaggagctggagggtgcctcaggaatacaggagggacatgggaggagggctgttgggctgagggctccctgtctggctgccatctcttcttcctgctaccctgttcacaaactgggggtgcttaactccctctgtgaatcaacatgaagtcactgctggcaacctagagcctgcgagacatctggccctgatggagggggagggaaaggtgtctggaacccaaactttctgcattatgatccccacccccaacctctctcacgtacacctgcgtgttcatgtaca

SEQ ID NO: 53400 - DNA, 1002 bp, Homo sapiens
gaatctggttaaatacagttaacatctacatcccaggaccagtgcaggacctgcagtatttcatgaattaaaaagaaacacaaagagaaaaggtatctggtttatttaggttgctgtgatctccctgagaaataagagtcagtatagaccaacgctgtccaaccaatagaactttctgccatgatggcatatcctgtagctgcactgtcccctcatgtggctgtctgaacacttgaatgactaatgtgactgagaaactgagcttttaatcttaattaacttaaatttaagtttagccacatgtatttagtggctactgtactggacagtgcaggtctagctagaccagtggttctcaattgagggcaattttcccccacagataacatttgccaaggtctggagatatttttggttgtcacaactgggggagtgcttctgatgtctagtgggcagaggccagggatgctgctgagcaccctaccatacaccagacagccccacaacaaagaattatctggccccaaatgtcaagtacgagtttgagaaaccctggtctagactgtctagcacctgccttttgacaaggacagaccctcaactgcagcctgggaactgggattggccaaaggtcctgggctgccctcaggaagacagatgggtccagaggcctcagggaagtccctaagccctttattccatcagccaaacaacacgcattactgggcatgtgctgagcttgtgccagtgccaggacaggacagagacggatcctatcctgtgaagggctgcctgctctccctccttccagggtccttcaaggatcttggcagggggatgggaggttggtgcagggagcactaaaggtcctagcagccattcataagtccatctatgtctccagccccacatggtatcagccgcttccctcatcctcataggcgatggcaatccctcgtcttccactcacagcttctgtcactggcgtctgacccaggcggg

SEQ ID NO: 53401 - DNA, 4281 bp, Homo sapiens
tcaccaggacatcgcgggagcccagcaaacgcgcttccctgccactgggttagggaaggcttgccggaaggacgatttcggaggacagcaggtgttagccaggcagcggagcgagcgccaacaggcgcactggggcggagagacgccgtgagcaaggtgaggcagagggcacgcgcggcgccacccgccacaggctaggacgcacggctgccagagaggacgccttaggggcccgcgagcaggctcgggaataaaacagggctggcagggcgaggtggagagactcgagaaggaccggccagatgtcgaagttcctagagaggagggcgcccaagcctccgccgagacgcgtgactacaactaccacaatccccagcgcctgcggttccagcgtcgccttgctctagacgggcggcggcgctgcgcggggaaccggcgtggggtcacgtggtaccggcgcatcacgtgggcgagttaggtgacgctgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggtgaggccgggtcctggcgggcgggagcagcatcgcggccgagctggccgggtcggaactcggcggggaagtggcctgcggggaatactggccccccgcgcgctctgcacccgaggctctggggacttgcgcctgcgagggcctctgactccgacaaaggagacccggatttccagctgcttgaggaggggtgcgggcgggtaggggccgcgagggcagcactcccccgtcctgccactatcgctgtctcccctcgctcccacgtctcactgctgtcccccctttcttgctcctgaccggcccgctcggtcacaagccggctgctccggttcctcttttcccagtcgctttgccctcccccacccacagcttgttgggtaaacagcggaacggactgggccggcgggatctggctggagcgcttgctccctcggtcccgcctcggattcgggcttgcgggtggcgaccctgcctgcgcaggtgcttggtctgggaggtggttttagcgagggaatggcagaaaatggaggcctaagcagaggaatctgtctacacagctgtactgtcacctgggggcagcctgaggacgccccttcagggaggtggcccttcagctcggcagctactttaggttgaagaacttctctctaccgagcagcccgtaaccccctttttctccctcactgctgcaggagtctgctacaccatttttgatttgggcttccgctttgatgtggcatggtaagggagggcagggggaggattccccttgaagcttcttccctgcagcctctcttcttttctctggtctgagtccctcccccacaccactgcctgcctgggacatggacctttgggaaatacgcggtcagttgttgcctgtagaactggtggtggggttgaagggggtttgaggggttaagattttgtgctccgcttccctgctagagctgaactgctttcttctctgcttccacaacaggttcctgacggagacttcgcccttcatgtggtccaacctgggcattggcctagctatctccctgtctgtggttggggcagcctggtgagtattggggtggtgggactgggggcaggggctgagtcatggcaggtggtgtcactggggtcttaggcatgctgagggcagtgacagcttgggctctgctcatcagttttttatccttccaccaggggcatctatattaccggctcctccatcattggtggaggagtgaaggcccccaggatcaagaccaagaacctggtcaggtaagtgtcagggtccttggacttttgtcagaaccagctgtgttggcgctgcctgtgtgtttgatctgacatactgtttctgacaagccaccttgtgggatgggatgttataggggaaagattgctggggacttactgggcaggaaggacggtttctttctcatttctttctcctttccactccttacccctaatctctaccactaccagcatcatcttctgtgaggctgtggccatctacggcatcatcatggcaattgtcattagcaacatggctgaggtatggaaggccagggtggtggcgggaatccattccagtgtgttctacacattccttagagattggatggggtgcatcaggatggtttctgattacttttcttcttccctcagcctttcagtgccacagaccccaaggccatcggccatcggaactaccatgcaggtgggtggatgggcgtatgaatgcaaaatgctgggacttcatgcctgcttccactctcccccatcccagcttgggccatcattttgatattctctcacctactttttctgctttgcagagtggggatggtgattggccccattagcccatatctcccccattcctggcttagcctcactgcacccctctctatcctcccaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcaggtgatgaatccccttgggaagcctctgtgtccttgtccccaacctagccttaccctccttctggagaagctgaagtgctctccttctctacctataactatagattcccccaaacagcttccacctcctcatttccatcttctggttttctcctacaggggctctctatttttgtctctgatttggtgtcactgacaacagccctgttctttttcccccctttctaatgcgttgtatctgtatagcacttagtcctccctctttctgttctctcattttatctgccatgcttttcatgtctccagtctgtatttgtgatctagactagaatggaattttgtctgtctatatcagtctgtcatggtgtgtttgactgtctctcggagctatgtgtatctccctctcacatgcctgtcagtaggacaccattgtctaaattgtgtgtgtctagtctgtctgacagtgtgtgagtttgtgactaaggatcagcctgagggtctgagtgtgactgtgggtgcttgactgagttgattcttagtgactagctttatccatatgccacttctctccgtctgtcccacagcgtaactctgtggttgtctgtccctgtctgccttgtctgtcacagtgtgtccatcctggttagtcatatatctcttgtggtctgtccatccaaccatgtgctagatgtcatcttctatcatttgtcactgccttacctattcctctgtccctgcctgatttctcctgttctttttttgcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtcagtgcagcttctgttgccctcttgcgtcaccgttcacagaggaagggtaaagaggcctgtacgcctcagcctcatgccaatcccttgtcagctttctgactgcacacttctgatctgcacagagcttgctcctaggtggggaggcacgggtgctgggtggactctaacccccaaacagacttgtttggggatgagggagtgtgcagataggggcccctgggtgtgtttgtgcctgtagtccttctaggcccgtttgctcagggctctgactgaccaccatgcccgaattgtctgacagcatctacttacctggttgtacagtcgggcaccatcatctccgtccttgtgaggcctggagcctaggcagtggtctctgcctccagtgatggtcctgtccttctagcagcagcccctcccagaaacctctactctgatccttgttccc

SEQ ID NO: 53402 - DNA, 1070 bp, Homo sapiens
ttggcagaagagggactggtgatggaagccttcctggaggaggtgatggtaacctggagtttgaaatagttactcatttaacaaatatttgcctcacacctaccttgggcacagtgctacattccccaggctaatagaggaagccagcctggataaggagaatcatatctggaagattctggaatgtgaacatgtatgatacataccgagagtctgaaactatttggttttaagatctctgaaggctgatagtgacagtggggcgggggaaagtcacgtctggatgttaggggtttttcttctgttgccctttcaccatgtacatgtcaggggtcttgaatacctgatgggaggttaacttttgtcccagaggactggggagtcatggaagaacctgaagaagggagaggcggggtggggtttgtgtttagaaggcacactgtttgagcttcaggaaggcgaaagcctggcatagccgctgggtggagcaggagagaaagtcagcccggcctgaaggaatcgatggagtccaagggagcatagtggtacagggcctggggatggaggtgctgtgtccccagcttgagcaggagggtttttctactctgaacacggggtaggagtgggggaggtggtttgtagccctggtgtggggttggtgcctgggagaagcatgaggcactggggaggcacagggagctgatgaaaaagtggttctgatgaaaactatggtcagcaggaaacaggtaagagaccaagaggagaggggcttcagggcatctggggaggagtggagctccacagtacacgccaggagccttggtcctgtttcaggagtagcctgcctgagtgccaccatcaattacacatgtctggcttggttgtagatgtggcaagatagcaagaagtttctggcttaaagaactctgtgaatgttggattcatggattgggtatgactactctgggtctgccacccccagaaagtttagcacaagtcacagagcagcgtcaggaagcccttgtttacatttcacacaccctttaggcccttctcccagccagcctgat

SEQ ID NO: 53403 - DNA, 1023 bp, Homo sapiens
ttggagtcaaccctccttcccgaccccctccccctagcccagccccagtcactgtcagggtcgggccagcccctgcactgcctcgcagagtggcctgggctaggtcactccacctctctgtgcctcagtttcccccccttgagtcccctagggcctggaagggtgggaggtatgtctagggggcagtgtctcttccagggggaattctcagctcttgggaacccccttgctcccaggggaggggaaacctttttcattcaacattgtagggggcaagctttggtgcgccccctgctgaggagcagccccaggaggggaccagaggggatgctgtgtcgctgcctgggatcttggggttggcctttgcatgggaggcaggtggggcttggatcagtaagtctggttcccgcctccctgtctgagagaggaggcaggagccccagggccggcttgtgtttgtacattgcacagaaacttgtgtgggtgctttagtaaaaaacgtgaatggagcagctcccttgtctgtttgggggtgggggtcgggtccctgaacgtggttaccctgagtgtgttgtggtggaagggcacttggggaacctggcccaacaagtaaacctgacccgggccatcctggttctccaagcgctgccactccctaggctttcactggccttaaggggaagtttgtccttgcactgcttccgggacagtggaggcgacgaagtaataaacccgtggacccagatttctcaggtcttaacacgttccctgaggcctaaaggtgcccagggccgagcccaaagtgcttgggtcagggctcggtggagcgccgaggtgagtctgaactcccagccggcacgcgccgcccgccggaccaaacacgggagggggcggggccctagagtcgcggcgtggtttcccgggtgatggccacgcggaagaggtggggctagggccctggttcccactgcctggtttctgggcccccggcatccgagtcggccaaaagccgggcagaagaga

SEQ ID NO: 53404 - DNA, 1110 bp, Homo sapiens
gtagccttgggaacagagttgactccctgggaaggcaagaaaggctccagaaaggcagagccgaatccttcctggggtttcctcccatgagtcaattctttttttttttttttgagacggagtcttgctctgtcacccaagctagagtgcagtcgcgcaatctcggctcactgcaacctctgcctcccaggttccagcgattcttctgcctcagcctcccgagtagctgggattacaggcacctgccaccatgcccagctaatttttgtaattttagtagagacagggtttcaccatgttggccaggatggtctcaaactcctgagctcaggtaatccacctgccttggcctcctaaagtgctgggattacaggtgtgagccaccacgtctggccaagataacttttttttttttttttttgagacggaaccttgctctgtcgcccaggctggagtgcaatgaggcaactctttaaggctgtctgaagatggatttctcccgaggcctgtcaaaaactaacctttcttccgtcccatctgacattaatccagtgtgcaccagcattgccatgagactgttccttccacgtggctgctgccccccagctcgccagccccaccttgccactcatgcttcccacaagatcctgggctggcctggacccctcatttcagaggtcccgacttcgctatttccctccatttcaattcaaataacaaacacatcttgcaagtccagtgctgtgctacatgctgggcacagagggtaaaagaaacacagtcccaagccctcggggaactcactgactcatagttgacgaacttataagcaaataagtgtcatatgaaataagagtactcgtagagatttgcacaaaacagaaaggaggaagcaactttttcattcttttgagagagagggtcagaaaaggctgcagagaagaggtgacatttagcccggtgcagtgccgaagatttgtagaatttcacctggtgaactgctgtggaggggacagctgggagtgcaaggaggtgcggctgcacatgggtgtgtggcaggcccagaactcggttcaagtgaatgacatgacaacaaacccagctgccctg

SEQ ID NO: 53405 - DNA, 1049 bp, Homo sapiens
gaactaagggctgtttcctgctcccacagctcctccacttcctccaacacagtgaatggaaattatgcttcttcctctgtctactaaactgtgcggtccttcaagctaggaaaagagcctgtcacctttccatcccccgtgaggactccagggcttggccaagatggaccgttaaaactgattgacctgacagtcctgtctgatactcagcggtgagactgtcaaggtgggccagggttctgtggctgatgtctcaacatctggctcacaagcagctcagaccagcttgtccaagccagccctcctgtccccgcaccaaacctgcagcctcaccagcattcgtcctctgggtcgggcaccggtttcctcccactgcaccagcagaaaccagagactccttcttatccctccccctacccagtccgattcatcaccaagtctcgccatgttgccttttatatttctctgaaatctgtgcacctctcctcaccctattgtcaccttcctaacctgagccccttcatttttggcctggctccttccttccttccttccttctttccttccttcctttctttctttctctctctctctttcttttttctttttctttttcttttgacggagttttgctcttgttgcccaggcaatagtgcaatggcacaatcttgactcactgcaacctctgtctcccaagttcaagcaattctcatgactcagcctcctgagcagctgggattacaggtgcctgccaccacgcccagctaatttcgtatttttagtagagacagggtttctccatgtcggtcaggctggtctcggactcctgacctcaggtgatccacccacctcggcctcccaaagtgctgggattacaggtgtgagccaccgcgcccagcctggcctggcccatttctaattgacttcctctcttcaacttcagcctccctccagtcctttctccacactgtatctagggggatggtttcaagatgcacattccaccaatggctcctccttgaagttgatcttctgcttaaaagctttca

SEQ ID NO: 53406 - DNA, 1043 bp, Homo sapiens
ccggcgctccgcacccggcagccactgcagatctcgagcaggcggcggggccgggccgggcgggagagtggggcttgcccggagggccgggaggggccggtgccggcccgggggcggggccgtggggcggggacctcggcgccccggtacttttccaccgcaggggccgggggcggggccgccgcctccacgccagcttaggcccacacgtggcggctgatgtaacgcccgtgcccccacatctctctccccgattaaagcggacgcgccccacttcgaggaaccgggacgctgcgggcggtgccgctgctcccagaccgaccgcgcccctgcccgccggccggaggcctccgcgcctcgggccggcggatacttaaaggagccgcaccccctttcgggcctgctctccgcaagccacaccccctcgcggatcactcttaaaggagacgggacgcttgctcgctgacagcttccgcacaaagcgcggtctatttctccgctgaaaggagcgtgagggtgcggccgttgggaaataaaggctgcagggcgaggagtggggaaagagaaaaacctgaaaggttaaagactgccaaagtgagggagcatcagaaggttggagagtagtgggtgaggggactggttctagggactaatgggcgacactgagcatgcccaagtgtttccaaggaccgcagagaaaacgccccctttacttggcctatgcggcgactgcggctgtacctgctcagttcccggctctggggacacagaagaatcacgcctctgccctggtagaactctccatctagtggggagccagacttgggcacaaggaagcatgcctcaattgctacgtgtggcaagcgtgggggtacagtaggaaggctgacagcaacggggaggacctaggaaggcttcatgaagataatagcattgggataggttttgaggatgggtaggatacatacaggtggaagtggagacaagggtgctcaaaaaacatggaacgggtgccggggcaaaggcatgaagcaggagccctc

SEQ ID NO: 53407 - DNA, 1156 bp, Homo sapiens
aattaagcatttattctgcctctaaaagaaaaaaaaattcaaaattaccaaataattgcagttaaatattacttcctactttacagaagaatacaaactaataaatgtagaatgaatggtggaattagaaaatttattttgctgccaggtgcagtggctcatgcctgtaattctagtactttgggaggccaaggggggtggatcacttgaggtcaggagttcaagaccagcctggccaacatggcaaaaccctgtctctactaaaaatacaaaaaagtagccgggcgtggtggtgcatgcctgtaatcccagctactcgggaggctgaggcatgagaatcgcttgaatttgggaggcagaagttgcagcagtgagccaagatcgtgccactgcactccagcctgggggagagagtgagactctatctcaaaaaaaaaaccaaaaacggccattcatactgcagtcggtcagtattcggttgttggattcagtgtgctatcggacccaaagggtgatggcaccgctaggatgaagctcgtgagatttttgatgaaattgagtcatgaaactgtaaccattgcattgaagaacagaacacaggtccatggaacagtcacaggtgtggatgtcagcatgaatacacatcttaaagctgtgaaaatgaccccgaagaacagagaacctgtacagctggaaacgctgagtattcgaggaaataacattcggtattttattctactagacagtttacctctggatacactacttgtggatgttgaacctaaggtgaaatctaagaaaagggaagctgttgcaggaagaggcagaggcagaggaagaggaagaggacgtggccgtggcagaggaagagggggtcctaggcgataatgtctctcaggattactgtttcaaagtcatacgggatttgggatattttttgtacaggttgtgtttatgtcagtttttaataaacataaaagtgggacaaaaaaatgaaaaaaggaaaagacataaaggaaaaggaaatttattttgccatccctaaggaaatttaattgaggaaaaatttaaatttggtgttaaaaccagtaggtgaatggctggtagggaactggacactggatacacaaaaggcagaatcacacagattactttc

SEQ ID NO: 53408 - DNA, 1027 bp, Homo sapiens
tggtcgatatctggtgtgtacccgcatatgtcgtctaagctcatcagaacggaagaaagaccatgaacaactttcccagttgcaagaatatggcctctcacctgggaatgacaagggagagatggaatttagaatacagtaggaaggaaggggtctaactctgtgaggcagagcagtccaggttgaggattcaaaagggaaggtccagggaaccagggaggggcaacacaatcaggagtgcccgccccagtcatcttggcacagtcctcctgtatggcaagtcggggggccagtctagcttagttccaagcttggaagatgaaaggctcatcccaaacaattacccaccagtggcccaggacaaatctaaagcccagagactcctccatccccaccccacctgacacctccttcacctgtgtgcttgcgctggtggctcacgaggtgggagcgtttggtataagcttttccgcagttctcgtagttgcagcagtaaggccttgcctctgaggagccccttctaccagtcccttcctgaggcctggagttcttctctactgtctgtggagcaggtccgggctgctctggtagaaatgggccttcttgagagtctggctgactgacaagagagtcctgagatcctaaaaccagcaatgactgggactcagctgggggcatcccaaggtcatgggcatcttgcgggggcaacatctgagccatggaggggagcactgcctgggcctcagtggaaggcacagtcgggcccaacaatgtttcgtcagaaggtactgtcgagaggccagggtaaggcactggagggttcccagtgtgggacattattgggattccagtggaagccgagactggcagcccattggggggcatccttagattcccaccgaagggcctggctacccttggaatattgggctctcctacgggcattagttggggcccactgaaaatcgtcatctcttgctgagggggagacattctctgacagtaaatcatccgggaaggagtgaga

SEQ ID NO: 53409 - DNA, 1277 bp, Homo sapiens
ctgcccatgctgaggagagccaacatgagtcaacccagagcaagacgatgcctcccttggggtccacaatgatgacttctgcatgcactaacatccctgggacagttctcacccaggacttaacaatgcaccctcttaaagcccttgaagacctaagtgagacttattccatgggccagaaagtgacttcctttgatcaggtaaaacacacagcaggctcccagatgacagatgttactgtcaccccaaagtcatcacccactgattgccagaagacaaccatcactgcaagcaacatgacaatctccaatgaaagtagccagctgaacaccccaagcagtgaccagaccctcaatgagagtcagataccagccctgcttggagatcagatgaagaccctcagtgataaccagactctctgtggggaccaggtgaccttcagtagtgaccagaccctcactgatggtcatacagtgacttccggtagcgatgagaccctctctgggggccaaatgacaaccagtctagacctctatggagggcaaatgatgacttccattgataaccagaccctctgtggggagcagatgacgacctccagtggtaaccaggccttctacgggagacagatgacgacctccactggtaaccagaccctctgtggagagcagatgacaacctccactggtaaccaggccctctatggggggcagatgacgacctccgctagtaaccagaccctctgtggagagcagatgacaacctccactagtaaccagaccctctgtggggagcaagtgatgacctccactggtaaccaagccctctgtggagggcagatgacgacctccactggtaaccagaacctctatggggggcagatgatgacctccactggtaaccagaccctctactgggggcagatgatgacctccactggtaaccagaacctctgtggagagcaagtgatgacctccactggtaaccaagccctctgtggagggcagatgacgacctccactggtaaccagaacctctatggggggcagatgatgacctccactggtaaccagaccctctactgggggcagatgatgacctccactggtaaccagaacctctgtggagagcaagtgatgacctccactggtaaccaagccctctgtggagggcagatgacgacctccactggtaaccagaacctctgtggagagcaagtgatgacctccactagtaaccagaccctctgtggagagcagacgacgacctccactagt

SEQ ID NO: 53410 - DNA, 1002 bp, Homo sapiens
aatcatctgtggtgaaggacatttttctattttatttctaaaccatcagagactgataaagataataaaattataaagacaaaatacaagtccatgtttcttcatattagattcaacagcatacaattgctgtaaaattgttacgtaagtttttcagtgtgtactctcagtttccattctcatcatagaccaggggtaagtgtaaacagcactggtttgcagactatcctttaagtagcactgttcaaagagatcacgtcttagctgcagatggagaattgattggaagcggattgaatgtgggcagagatcagtagcgaggctatttctctgatccaggcatgtgacagtgggtaggccgacggagaagtggcaatggagacagaaattttggaggtaaaagccacagatttggtgaaggggaggagtcaaggggaaagataggaattaagatgcctcccaggtttctggcttgagcagctgggttgggtgatggtgatattgactgaaatctggactggagaagataatgtttgagagagggccatgagttcagtactgagctaagtttgaggttccttggggcctccagtaggagatgtccaaaaggcgaccagttttggagctggttgtggtctttaactgagaagagagacttccctgatgtagtctagcactgactccttccttgggtctctgacagactcagctcgtggtagtgctatttgtctctgggggaggtctgtggaagaagggaggaaggggcattggcagggctgcgtatgttggtagtaggattcaggcccagcttctgtagagatgcctgaccttggcaaactctgggggagtggcaagtcccactgtgcccactgggtggcagtagtgcttcagatgagttgtatggactaggggttgctgggcctttctccaggtaattagccatctgtcctactccagagttgacctttggactccacagaagcacttacatgtgggcccctc

SEQ ID NO: 53411 - DNA, 1089 bp, Homo sapiens
ctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcggtaagagtctggacaggctgggaggcacgcctgggccctgcgagtgagcacatgcacatgggtgtaggggctcctctccctctagtgcctgcagcaggaacgatcatcacttctgtgcgagtctgagactgagggtaggagtgggttgaccagtgggcgtccttgtccctgagcgtgtgaagcacatgcactaagcctgactcaggccttggggggtcactgacctcaatgccttctgtgtatcctcagagaaagcgacgggagtcggcctccagctcatcttccgtgaagaaagccaagaagccgtgagaggccccacggggtgtgggcgacgctgttatgtaaatagagctgctgagttggaccaggctgcttccttttcctttccttcacttctgatgcccctagtgggaagggtgggcaaggaggggattgtcacggccactccacagcgtggcagataggtttgcctgtgttcaggcccttagcagctctctgaccactaaccactaccagtttcacccaaattcctgcacctcagagcacctgtggtttacactcaagatggctttgcacacagcttgtactgatagtcgccgcgcttacacagatgtgtgcatattgagtgagggtgtcacaggtgctgcagtgacggccagtcacacatggatggctttgtgcacagaggcagtctggagcatgctctacctaccttcacatcctgacagctttggcgcagcagcagcctcacacacacagatggctttgcacacacacccagtgcctcgtttccccgactttattcagtggcacgttcacagcggggatgggggtagacacaaggtggggcctgatctgtcctggagccctgggggcaccacacaccatgcactatggatgggagggggcacaggaggggcttggtggccccacagaagcctgtgta

SEQ ID NO: 53412 - DNA, 1181 bp, Homo sapiens
ccctgagcattagggcgggcccacaagggagggagtgccggggctgcatgcccaggccgcactgatggtgacggatggtttttcattatagcctctcaggtcctgcccgcaccctgtgtggaaattctatttattccctaatttgtaaaaattccctctttatctgatcccaatcagggcggggtaattggctctctggggcagcggctggggtccttgatgaagagctatgtggatgtacccagcctggcccccacccagcctgccaccagggcccacaattaataatgatttgcaaatggcagacaagcaataacacagaaagatgtggtgtccgtgctgcctcttcatttccttcccttgcagataaaaatggccacagaacaaaaacccagcactataaattctagaattagttattcactgggataaatggggcctggagccaccagccactctccctgccaccgttcttgcctgctttccctgatccaggttctggccccatgtctgttcttgagcctggcccctgactcttctgcctctttggctcgcagcacaattcctcagcttctcccaccactccagctaccttctcctgtgtggccaagacttgggagtggtcacctggtctaggcctgtagcttcctctgcagtggctggagccagcaggtgggattcaccctccacctcctcttgtggacctccctggctgcccaacgtggtttctgtcctcattctgtattggggtttgaatgacgttgacatgtcctgccaggcctgggagtctggataagggtttgtcttgggtatcatctttggcatttgggaccaatcatgtcctttgcctcgccaaatctgagttgagttcctggtggccaaatgcactgcaagcgacataaggggtttgatgctatgcttactggtcaggcagttctgggatgctggcaaaggggtttccaggcactgtgccctcccggccaggcacatccccccctccaccccactgcccccaagtggctgtgagctggcgggtaatgggtgtgtaatggcctcatttccatgcctggcctccaggagcggcggtaagtgtttgattgccttaatttccaaacacatcattatcccagctttaccagcgcttaataaacactttatgaggatttttttaaaaacatctt

SEQ ID NO: 53413 - DNA, 1046 bp, Homo sapiens
gatgttgagggcaggggatttgagatttgtggaaagtagagaaacttgaaattgtcactatgggtgaagggagagagagtgcacactgatcaggaacactggagattggctgggcagttttatatacccagctgaggctgatgactctgattttgtaagtggcactagtctatatggttgtgattttctctagtcatacgctccaggtggcaggcacagagaaggcagagtctgggtttttccaggcaagggtgacaaggaaaagggaataagagagttgaggattggcaagaaaaagactgaaatgatggaccatgcaatccaggctccaaaggcagacatgtcagttacgttgctaggacagaaactatgacttttcccttctttttcactaaatagaacccctgtataattatagaaccgctgtataataatcagtgtgtacctagttaaaagactacgtttttagttttccagacagctaggtacagccatgtctctgagctctggccggtgaaacaaaaggaaatgtgttgtctgggacttgcaggaatgatacctaaagggaaacagctcatctgggaaatacgctattcttgccttttcccgtcttccccctttctttttcctggaatgtggatttgatggttggagctccagcagctattttggactatgaaatagtctgaggattggaaaccacatgccgagaatggcagggcagaaagaaagaagaagtctgaatagtctgatgattttgtggaactgaggggtgtttagtcaacttatattgcaagccatactcatagaatgcctttcttagtaaagctatatttcttccctctctgttttcactggggttttagtctaaacttgattcttttagcctttttcctaacatagcctgtgtcctgagatacagcaagaaacaatttgatcaaatgtttcaagagagcaaaagaaaaaaacggttaccaacttcccagcctgaaatagcagcgtcctctttgtccttcggcctgcctcctttattcagtgagttctat

SEQ ID NO: 53414 - DNA, 1044 bp, Homo sapiens
ggaaaccaagatgctagaagggaacggaggtggggaagggcctgaaaccttcagggctttggaagctggagacaaagaccatgacagggtttcagggcctgggcatgtcaaggctttgggtggcaaatgtcagggctggagtaggtttgcgtgtgatcttgcccctctttcttttcctctagtccttccttccttcttttcagtatgtatttcttgagtgtctctgtggataacacctgtgccctcaaagagttcatggtctagcaggaggtgaaggagaggcagttacgataggcggagaattggctgctgtgggagcacacagaagaggttcctaacacaaaggcgggatggggggaaggcacctagaggaagcactagcaagcctgggtcctgagaggtgaaggcaatgagccaggtgagaagtgaggacttgaaaactcaaggtgcaaatgagcctgaatttggctgtacaacaggggagtgggactgatgagaccagagatgtaaacaggtccagaactcagacttttataaaggggtttggatgcattgggagctgagtcaggcaaggtggcaatattgaacttaatggggattagctgagcagtcctgagagcagtgaggagccactggaagtggtgctggtggtggtggttttaatttttgactcttaaactttttactttgaattaattttacatttgtaggaaagtttctatgtatcccttacccagctttccctcatgttaacatcttacataatcacaatacagttatcagtaccagaaaattaacattggtactgtgctacattaaagggcctcttaggccgggtatggtggcacacgcgtgtaatcccagctacttgggaggctgaggcacgggaatcggctgaacctgggaggcggagatgcagtgagctgagatcacgccactgcactccagcctgggcaacagaaagaaaccctgtctcaaaagccttattttaatttcaccagtgtttccattaatgttctttttctgctccaggttcattgaagg

SEQ ID NO: 53415 - DNA, 1084 bp, Homo sapiens
gatgatggagccttccctgtgtttagtcattcattcagaaaatgtttgctgaggtcttctgggtgcccaggccaataccagggcttcagaggtgagagatgctcctttgtgggaggtgaagtgagcacttttggctgaggcacgtcaatgttgccagccgtgttcctggttctaccatagggttgaggtgccagatccagccctgttcttccatggaagcacctaagccttcaggatgctgagaagctcacgcaggtcttctcacaagtccccgggccaggcgctcccctgagtcccctgaccagcccatttgagggttaatgcccttgactacctcaagggtgggcaagaagagcaagtaggactcctggagtccctggaggaggtgggcctagcacgagggacagccttagaaggccacaagcacaagatcaagaaatcaccagttgctcaagttggcagaggtagtgggagtgcatgttttggaggtggtgagtgaaaatcctgtgttcaggagggctccatggtgacccatcaggacagcttgatcattttggcggaagagtgtccccactctgagccttgtcagcttagggggagtccctgtctacttgggcacagactcacagcctctgtcctctgctgccctctcctgccccccttaagccactctcctcctgctccccacactccacgcccttccctcatctcttggaacctgccacaccttcttttaccttattgccttcccatgtggctttattttcccccagagccccatatttccaccccacaacctaattaactcttcctcatccctcagagctcagcttaaagtttgcttcctcaggaatgctttccctgactcctagacttgatcaagtccccctttccccgtgtactttttctcagcaccctgctctccccatttgtagcatttaatcacagttgtaattaagaaattatttgtttgaaagttgtttaatgcctgtctccctcactagattgtaagttccctgaaggcaagaaatgtctgtttcatttggcttatatccccaaagcatagcacagtgtctgacacgta

SEQ ID NO: 53416 - DNA, 1056 bp, Homo sapiens
aggcccccaggaggttccttgggccccagagggaacatctggcaagaggccaaggccaggccagctgagccccagggcagggtaaccctgcccctcttgcttctgaggcaggagagtgaatggggcctcccagcaggaatttgggctctggactctgggctctaggggccatatcccaggcctgcattaaccatcacctcctgcagccgcttagttcttttctatcctggcctggggctgagggttgagggtgtgattcattcacactcatatcccatcacacagtgatctgcagcagtcacatcaagaccttttgccacaagatggagataatgcagagtcttgcagccccacagcagtgtcacacaccccaaagcagacccccacaccagatatcatagccacacataccatcacaggccatacccacagggtcttgcacataagcacctactgtcccctgccacagggccctgagttcttaagcccctctcccagaatagctaagaatagcagttagatcttatgtccagggctgggggttaccaggccccttccagtctcccaccctaggaaataagcctagagagttggtagtgaccagggagtgggaggaagctggattgggggggggagggggcagcagtggggagagggagggtgggagcagagataaatgttagctcatttcttccgtaattagttactccctcatccccgcgttgtaattgtgaacaagctgtaatgtttaattagtctgtaaatgaaaccccaatttcataatggcctggctgacagggctaagtgagcaggggaggaggaggaggggactcttcctcccctcctcctgcagggtagatgcaggctgtgggatcacttccttttcctttcagccccagtctggcctctgtggggggaggctatgtgatggggttcagtcctatactctcgctgtgaatatcccttccatgggcccatcttaccagaggaaggggagaggaggctctcaggcatccttcctgcctccccgtcactcttgggttgggataggacagt

SEQ ID NO: 53417 - DNA, 1234 bp, Homo sapiens
ctgtgggacatccctccctatgctttggctccagcataggtgctctgtcctcagtattagctgtgccccctggggctgcccctacccttctgcagggttctggacccttcctcttagctcctcccatcctggacactactgaccaggcctaggccccactgggcaaagtggggcctgtggcctgcagagaggggaatttgtttggtctggtctgaatcacaccagtgtcattctacatttgctgagggccaggtattagtacagagggctttatatctgttctctcattgaattctcaaaccccgtgataagggctgtcatctctactggatgtgaggaaactgagggtccagaaggttgtcatgaccgattgctgctcagcaaggaagtgagagagcaggaatttgaacatatctctcctagtctagggttggagttcttcaccaccacgagtactgctttccttccattccaccagctgcagacacgcgacatgtcaccacgcctggatccatttaagagagccatccttgtaccgtaggcagagaagttcattcagctactagcctgtgaacacagaccctgactcaaacctcctactaggctaaaccagcccaagccaggctgaaccaggccaaaggggactggaatcaaataggccctgctctcaggagctgtgtgtctgagacagttgggctgtagcaagaaggacacacagaggacagaatgtacccagcagctgagccagcgcagaagtgtgtcccagcacacggcctctaggcccatgtagctcaaggaggggctggtgtagcccaagccagcctgctgtggtggctgagggtatagctgtcccagaggcccctccaaaactgggtccctgctgtaccctcccaccaggcagggctgggagctgggagtgctggagacatgtccagggacacgtgtgcaaggggagcttgtcctaatgaggagaacatggctgctagttaggcaaggggcgggcggggagccgcagagctgattgaaggcaggggcaggggtcagacaattaggcccagatcctgccgtttgatgtgagttctgaggcctcaaagcctcccttcagccggctccctccactccctcctctccctcctctccctcctctttcctttcttctgcccaaagacaggaaggatggaaacgcttacactcactgttactattattaaacgctgtggcaggccagccagac

SEQ ID NO: 53418 - DNA, 1945 bp, Homo sapiens
ctcctcgttgaggggggtgcggggggtgctggctaatgagctcgtctgcagtacagctttgccttccctccttgaagtttcccgggtccctctgaagacctcgggcccaggattagcacacaccaaacgccagcccccgtcttgcccagcagggagttccttctgatcaccctattcctgctaccataggcaaggaaagggggtggtaccaagatagagccactgtggcctgggggagggggccttgcacctctgggaagcctcaagcccctctgcatcccttgacagagtgaccgtgtccacctctctgcagagggttcttgcttcccagagctgcagtcttctcctcccatcccctttctccatgacatctagcctggcagtgtccccattcctgtgggggacccccactcaaggcaaggaagaatgtgaggaccttggctgagggtttaggaggtagcatttagatctgataggatgtgggactttctggctcaactagagagcctcagaatcagtgagattcatgaagtcttctgggcttcagatgacctgagtggtgatgcattgatgtgaggcctctacagaccttgatgtccttccagagaggtaccttgcctgcttcccccagctttggccaccttcagggctgggaggggaggagtcagcccagctgccttgtggggaagggcagagcacagtactactgtacactactgccccctcccatccagttctttctggtgtggccctaagaaagtgagaagctagggagatggatggtcatgagaagggttaactctcccatcattgacagggtctgcactggcctgcctggatagtgcctggggagagggtgctggctccttccttcctgagctgacccccttggagccccagagacatctgaggaattggttcttgccagacaccagactgttcttcagtagcaaccatagatggaagaatggctagatggatgggtgagttgatggactagatgggtgggtgagttgatggacagatggatggaagaaggttctcctgtatgtatgtatgtatgtatgtatgtatgtatgtatgtatgtatgtgttatgtgtgtttgattctttaggaagtacaatctttgtttccccaccttcctagccccaggccccggcctcgcctccccttgtctctctctgtatctcctgtcaaaccatcgcagacttaaatgacaaagaaatcagaaagacagatcaatgccggccaaattagcacttgcagatagactctgcggggatgtcagcgccctgacccctggtgatcttgcagcctccactgctgatattatgcaaattgcatccatctggcaggacccgcgtgctggctgctcctactcagaggagtaatgggctgggggtgggtgggagtgttagagcaagagtcagtgaagtgtgtgcatgtgtgtgcatgtgtgagcatgtgtttgagtgtgtgtgagggcgtgcggtgcccaccaagcactgggcggtgattgagtgattgacagggcagataagggactgcattggattcctgtgggctgggggattaggagcagccacagatgggagataaccggacttcatttcagtttattttcctccttatcccctctccccaccttcactccctgaaaacacaatatctgtagtttgtgttttcatcaatatttgcaagtcattaccactggtttaaggtgagagacaatgtcagggcccagaccaggccagcccctcccccagttcctggtaccctgagaatcaatccctagagtggcacagacagccttcactccagtggcattcacagcagcccctcctttcaggcccacagtactcatgggacaatccacacttcatgggccagccctgctgacctaccccatctgacctaatgccaactgacattccttaagctggg

SEQ ID NO: 53419 - DNA, 1237 bp, Homo sapiens
atggcctgcatatcttgtggggagaggcatgggctttaaaagtgagtggtgggcacagatgactacaggtgcagcggggtagcaggtgtgaggatccagaccatatgttggcagaccatatgttggcaggagcacaggttgctgtgggaccacctatgttttgtgggcagctatctgcgtctgttggctgtgcctaagcagtacccaagatggcaggagctggggggagcatgaggtgctgggccctggtactatgcttagggtggccccgtgaggctggtggtcacatctgaaggttaggctctgcaggtgcatgtgtcagtacctggggaagacgtgccagggctctcagcagggccaacagcgggagagcccaggctgagggagagcagttttaattaaccgtttttaatatcattttggactttggctggtatgtgaaggtcccgctggaagcagcatttgtaaaaattaaatccctcttattaggagcttggcagacccatgtgcatgcgccaccccctctcccgccccatgccccccctgaggaagtgctggatgaggccatgtcacagcagcaattggttatcacgccttatctgggaatatgaaactgtgcggcatgacacccacggccgcagtggagacgccaattcatctcgccctcgctctgacaagccagactgcccttcctgaaaggcatctgtcaggcgggaccgggttgcctcctttcctggcaccttcgctttcctgccaagggcccagctttccctggtccagcctggccctcctggggctctgctgtcctccgtccccctttcacacgtcccagtctgtggaagatcttggggagtcataattacaataataatctaatcacggtgacgcggtggggcaagcatctaatgttatctgaagtggtcttcccgcttagctgcgataagactcaggatgacgtgcagataacgttgagctgccctgtccccgagccataagcagagcggaggggcctcggcagccctgccgcccgcccgtcgctttaagctgggaagcggcagcacctgctaatgcaagtgtttaatatttgatgggctgggataaagcaggatcaccttcgaattgaattgagtgtcagccgagaatctattactgaaattcgggtgtgatttgacagcaaagtagacgatgttattcttcactagttactgcaatcttctccccgacatcacttaaatat

SEQ ID NO: 53420 - DNA, 1036 bp, Homo sapiens
catgtagaaaaaaataggaagagagagtgcagagtgggtgagtacacagatacgatgaccaaatgcagaggagactatacaggagattgtggggaaaatggcagagagctaggaaaactgagtagagtgtcaagaagggagaagggtttcagagatggagcaggctgcaaaatggcgaaggcaggtaagaatctgaaactgtccacagatgtggggcagcatggcggcagcttgaccagactgcagggagtgaaggagtgaaggaggaagggagtggaggcagtcttgagaagttggtcgttaacaggagaacagcagtagctggataggatgtgaaatgcatatagaactttaaaaataatctaaaacttaacataggtttcagagagccaggcagtgttttaagcactttacagacagtaatcctcatttaatcctcacatcaattctatggggtagaaactattataacccccattttacaaagaggaaaccaagacacagagaagttatgtgaaagtgatagaaatctaagcatatgcttgaatgttaatgaagaagccagcagagaagaggaggttaaggatttagaaagacaagaaatactagatggagcaagggcctgaggaggtggggaaaggatggcctgtaaagcacaagtacggtgttggccttagacaagaagcgtagtgtctcccctgttagaacaggggaggtgaaggagcaggtggggaaggatgcagatgcatttgtagataaggggcatgcagaaagagctctgcctagtggctttattatctttctggaagtaggaaggcattagggttggtgagtaccattgagggttgctaaggctgtggtcttggatctgtagtaaccactttctgtatataagaatgactttttctggcattgttgagctcaagagcaagtgtggagaaatggagtcatggttggggttttccagaaaaggtgtgctctaggacaagtaggcagggtgttaaaaattgggggatgggtggttgaagtgatagat

SEQ ID NO: 53421 - DNA, 1110 bp, Homo sapiens
aggcttctttcctgaggaaccacaagatggaccagcaccctggactgtctctgccagccctggatgtggaaagctctgcccatgactgaggcactgggagtggggctttggcccagctggcaagtgccctgcagtccctgtctcctgatcgggtcctgatctgggggagctaggatgggggtgggttggggggagtacattgagccaactgccttaactgaatttccatacctcctgttgttaattatagagatgtaataatgcgattagtgcacgattaaaaaaaatccctgatatgattaccatggatttaatatcacatgatatatcattatatcgttatgcagtgacagatgtaattgaaatacacttattggagccgggggtggtgtttcattcaatccccagcaccccggggaggaaagggctggctaaaaagaagcggtgggagaggaaattgtaatgaaaacaaagaaaactcacaatgtagctctcaccctgggcagctggctcagactgacctgctgccttagactctgtgacagtgcacgtggagccccagacaggccaccctcttctgcagggactgaggcagcatggctcaggagctacttatcttattctcaacccagaaacttcactgtccccaaggcccctctgactcagcggtgaagccaagaaatctgagagcaagaaagagaaaactccacctgaaaatactcgggaccataatacttgggatcaaactgagctggtagctgtcttccactcctgggacccccagtaccaaatgctgtgggacttagacctgtggcatagcccctgcctttgctgtagtggtggcccagtgcactagaggcagccatcatgttggaggcagtgagcagtaaggttaagtacacagagacgataattatcccactcaggttccgttgatgaagagaggcagcagcagctctggggcccctgaagtatgttggtagccggagaacactgtacacacaacagaactgccatctggggttagggaggatgggcttgtgtcacctgatgcaagtgtccatccctttgctgctttagctgtgcgggtcaagcctctgctggacccga

SEQ ID NO: 53422 - DNA, 1092 bp, Homo sapiens
atttcatgcttgattttctgtgctcagggactctggcgttgatttgattccttccaggccttagcatgcccccagtcaccccacctctgcccttcccccaccccacctccaatcagtcagccaggcagccaggcagccagccagcttctacttacctgttctcagggaagcattccccacctaagtcagactccccttttctctcctattataaaagcttatgtgtcttgttggaacctttattacagttcctttgagcttaagtctcttggagaaagctgtggaagctctctgaggacagtgttgtgctctgttgctatatatgtgcatatagcctggcatgtaataggctctcagtaaatgtttgttgtgaatgagtcagtgtgattccaaagcgtgcactctccatcatattacagtagagtgaagactgatttgaccaaggaagatacaggagccaggatgttgggtgcaccccaaagagaaggttctttgggccttagctctggaggctggaatttcaaccttctcatcctttttttccctccaaacatcagagaagagaagggcttcatctgattctaaaggtttttactttcttcctgggtgatcttatctactcttagtttcttgtaccactcatctgcttcttaggattctgtctcagctcagaccactggtctgagctcctagcctacaccttccctgggtgccccacctatggcccactgaaggccgtgtgggtccttcttgctgatttccttcagtgttgttttgcaaatatgtttacatgtctctccttctagcctgggagctccttgagggcagtggcttggtctgcttgacctgtgtatctctagcacccagcacagggcttggcacatggtagttcctcaataaatgggtgttacatgaacaatctaatgaagagggagggggatctgggatgaatgttttgaacacccttcttctttttcccagggggaaagaaagtgaaggcgtgtatgctgtgtgcaagcatgcatatacctttgtatgtgaggggtggctgggtgggtggtggtggcggtagtgccgcatgctcaataaagg

SEQ ID NO: 53423 - DNA, 1096 bp, Homo sapiens
gcatagcggggcgcagccgccagctctcctcagagcggctctctaaggtagctgcagtctctggccgctgcctgctctcgttcgctctccttttttccctctcctctttctcagctctctctattatggggacttgctccagctctttctctctcttctgtctctccttttgttctctctttgtctatttatcacactgtgaaggttgaaagagatgttattaatctgggagaatgaaggcaggattagtggtatgaatcggattttgagaggtgtaatgatagaaagactcgctcggctggcggcctgcgtgagcttgataaatggggagcactccagactgactcgcgccttcctccgcgctgtgcgccctgcccgctggggcgtgccacgctctcagatctgccagccggcccaccccgctcctacctgaaccggagcaaaaagccaagggtaaagcagacacaaatatctcccatcacacttggagacatcattgcttttagcacccttttcaagtcgaggcctgtcgagttctcaaaggactgtgggcagagggagtggggacctagacttcaggctagaacagcacctgcctgcttctaggacctgtaagaaatggatgtcaggggtcagggagtgataaaaaacaatccctagaccaatcaggtaagaataccagaccctatgtaaatacgtggttaagcaaagtgctgttgagagaaatgggtgtggaggtcagggtggggcatggaggagtgggaaagagaaatcatgaagggcttcctgaaggtagtgtcctagcagacaggatttggagaagggaagttgagcgttccaggtggggaaatatagtataagcaaacatgtggggcagaaataagcctgactcttggggtgggggtgggggagttgaatgaagtacctcagatctgatgaatttcagatcaagaagagacctaagaaatccagtaaagtccctcatttttcagtgaagaaactgagacccaggggctagagtttccatttctgaaattcttttttatccaagccctgttgttatttctaaaggtactcccttctagccatccagaga

SEQ ID NO: 53424 - DNA, 2541 bp, Homo sapiens
tgcccctaccattccagtcagtagcccatatgaaccagctccatggaagaaaaggaatttctagaaccagtagcttctgagagattagtaaaaccaatagttctcttttctttgtacttaactcaccctaatagtttgagcccataattagaattgggctttattaggctaattaggaggaaggaatgatggcaggagggcatgtggagatgcatcagcgtggtgggcagtaaatctaggcttttaataggtttgttccataatcagctgatttggaaggctgactggtggctgcccccccttccttgtactgccaccactccttgaagtggccttcacactttgccgtccttgtcctcgatgctggcagcagcgctgggatatgggggctcaggaaggagggaggagaccccacccggagcttcattgcctatgcacgcgccgtccagcctggcggcatgattaccttgctgagaaatccgtccaggcgcggggctgctgatagcaatcattgattaagagggtaattgtcctgaaaattcagattgatcagaaggcagaaatgataacttgtgtaactgtgtttaaagccacgtcctgtcaatagaagagactgagatgtatcacgccaagaggggggcagaacggatgggtgtgtgcgggtgggcgggtgctgccatccttctctcagggctaagcaggatgtttcttgtcagtaacctggactattggagattcaatcacttttatctccccctctctctcaatccaaatgccttttcatattaggaaattagaattggccctgctcatgcaagatttattagctctgctgagcagtcgcaccgaagagtaaatgatttcgctttgctggagctttttacacattaggacccaacttctcctttcctgctctgtgctactggctgtctagaggagggagtgagctctagaactgaatactcagggagtgagggaagagcatcacttggatctggcttcttgatctgccagagacagactgacttttggtatctgactgacttcctcctacctgatccccagacatgtcccctactggggtctagggttgtctctctcctgaggagatgaggtttattcctcagacttgaatgcctgggtggtggcttatcttgggaggaagggctcagggctcagagagggctagaagagttagaggaagcaaggccaggggaggggcaagagtgtgtgttgggtgaggtttggcaatagcagcatagaatagggaggacaccatgacttctcttctcagagcccaagcctatactcctctcaggagtggggccacaagggccagagcatctttctgagcccccggggaagctgtccaggaagccacctggttgcttagagagtgtggaagctgtttagaacaaagctgagggtgtctgggcctgctgcctgtctgtatctaaggtactacaaagttgactccggctgaggctatctgatctgccaacaacacaggctcttagtggaagaaggaccagagatccattccaagtttctggaaccctactgtgaccttgggctgagaggcagtgtgggcctgtgtggccagttggacccagcctgccctgaaagccagggcaccagctggctgggcttattttagggaggacagttccccttcactgagactgtacaatctccttcttgcttttcgttttcagcccctgacctccttgggtcgcttgggcccatggatgaacatcagttactatcattcttccccctcccttttccaagtgtctgatcctggagggctagtgaaatagaaaaaagtgtgagaatccttctgatgtaggagctgagggaaggttaatggaacttctggattttttaatgaaagggatcccaaggactgcccatttcaacatccctttccccttgtggtttgctcttttacttggccctgtgaagcctctttttttctgctttcaggttatttccccaagtggaaatgtgactgggcaaacttgagagctgtggctggaagtgatggggttcctgggagtgaacggtgggagtaggcagcagccattctggcccagagaaaggctgagttttggggcaggaaatagagggagggaagcagggaagcttttgggaggaaagaatctggagagtgtcagtaagatgttccctagatgggacctgctctaaatagaccaccaggccaccagctttctgctgaaggtccgcttaggtctttcctgtacctcacaaggcattgtcctcagagaagccttgacacttctagaaggctcctcccgctaggctggattgggcagggcagatcttccctctgcctgtgccatccccactgaccctgcgcctgccacaagcgtgctaagggatagggtagtcttggcagcctggtgtagccccacctcccccactctgctagattgtgagggcgtgggtgcccagatggaagtgctgtgccatgggcagcttcgacttggagatagagaactcagaagacagattcccagg

SEQ ID NO: 53425 - DNA, 1152 bp, Homo sapiens
ggacctctggactcagaggtgactcagacctgatctccacctgtacagagctcctggtctggtagggaagatggatgggtcaataggcagatgggggaaaaacacaatagaagtggtaagtacagtgatagaaatatgtatatagggtgtgtatgaatcatctgtgttaaaaattattttgaattcagctctgtactgagtaaaaatttacaagagacagaggatccatgtaaacacgtctgtatgttcctgtgcctcctgcctgtgccactcgataagctttgagctaccccgatgagctagtccctgctagtgcctgctgtgacttcttcaaaggccctaaagcggggccctcaagataccctagattgccctacttggaaaagagggtggccctcctggggagataaggtccaggctggcttagggagtgtttttgtgtgggtgtgggcaggtaggcttgagtttgcacaggcatgaacccaagcgtgtttatggcagctgtcagtggcctgtccccagcaccacaaccaggtcttatgttgctaggcctgggcttggcacctacttggctgcaagcaggcaggcgggctgcaggcagatcccagggcaagcctgaggcctccccagtggtgtgtttgctgtgcctaattacccggcagttgtttaactatgcaagctgcatgcctgcctttattgcgctgtgattgctgagctgcctatggggagtgtcataaaaagatataaaatgcccattatctgtccaacgccctcctcctggactgtgggtgtttgtgttttattttatttttatggcttgagggaagctctgcaggaaagaaagggagggaagaagaaggaggggaggagaggcccataggaattgggggttgggagaatgagcccctttctactgtggtcaggagggctctcctaaccagaaggatgatatggaaatggcagatctccagggtcaggacaaactgcttaggaaataagccccagatcttcccctcttcatccacctacaagtcttgtagcttatgtttccaccttacctaagtatgctagcttctccctgctttaggcccactgccttgggtgcaggacagggttgtgagaatggtctctcattcccacccagttctttac

SEQ ID NO: 53426 - DNA, 1053 bp, Homo sapiens
aggtgggcagatgaggcccttgtccttggagggcagtatggtgtaacatagagaaatctggactgaacttgacgctagaaactaaagacgtgggctctggtgttgggttacttgccctttctgagtcctcagttttctcatctaacaaataagggagttggatgagggagtttcttcttgtggtctcttggcctcttctacctctgccactatgagatcattcatggaaacttaggctttccctttttgctcccatctaaacatgagacagatgcaaggaagacagcagaagttccacttttacccttaccaactacaatgtctggccttgggatggctccactgtcccattggaagaagttgagggtccagggaaggcagggcattgcttggcatcaggacaggagagctagggactcaggtattgtggaggagtttggatagctgtcacttgtcacattttgggctggcttggactgaagccaaatgcttttaggctttgggcttcaccatgagaatacagggtgagaagaagcttgttgtctccctgtttctttgtgggtggaaaggagaggggcctctgagtaccctaacggcagggagcagcctaggcccttcctctggtcttttatcctctatttgttgtcttggcagacaccaagtgatgcccaggtagagactaggaaaagtagctggatgtgtgttcacattcatatgtgaccgtgctggctcaacccatggtctttctgtgagttgacttggcctgctgtcacctgccttggaggaagagtggtttgagcttgggtgccttacctttccctggctgactcctcagggctgatctggatggctgctatagatgggacctttggctatctcagtcttcaagtgggattgtagtaggtttttatttatttttcccattaattggttttcagttctctttaatttctgaatttgaccagctggggcactagagaagagatgggcaatgtatggtacagtgccctcagccctaataaagacatttctctcttgttcgggctaacatcc

SEQ ID NO: 53427 - DNA, 2189 bp, Homo sapiens
tgttttgacaggaagagcaccagagccaagggtaggtatggaaggctctgctccatcttttctcttgagcaagataccaaggccctggatgatccagctcattgcaccattcctatctccacatctcctgtctctccataacattccagccatatcaaacttgttgtttttcaaatatacatgactgtctcacctccccttacatatactgttcccttttcttacatcgcctttccccttttagtgtgttgggaaactcctgttcatccttcaaaacccttgtgggtgatgctttctctgatgttcccccatctctggtagaaatagtcacttcctcctttgtatggcttcagaactttgtattgagtgtatcacatgcttttgtaattatctgcttacatgtttttgtttcccactatactgtgagttcactgaagtcaatataccacccatctctgaatttccagtgcatggcactggacctggcacacactaggcatcaacaagcattaatttaatccacactgaatcttgggctagactgatgagctccagagtctggatgcctattcctctgctggaattcccagacaaataaacttagagaaatgaagaaacttgcctaaaggcacatagccaggaagaggtgaagctagcatttgaacccaggtcagtgtgctcttttctccagaccatgtatcttagggaagtgggcagggaaggaattagaggttaaggtacgaaagacagaaattcattgccctgaatccttccttccatagcccaggacttaggtccactttgctggaaactgcattagttcttagcatttatgggactcaggtcccagaagggattgtgcctcctattgctgctgttgacctttggacagttattccatacagaatacatttctcgattgtgagtttgtaaccaagaatcaggacagtaccttgggaaaggtacctaagtgtggttttggagagctcttagagaagtaggcagacagagtacaaggagctattagcaatgtcagaaaacgccacagacattcccttcgttcttcaggacttggtggaacttgtattttgggtatataatgataaagtacataatggaaaaaaaaactatagtaaatttgtttttttaacgtggatttgtagtttattttattttattttattttattttattttattttattttttgagacagtctcttgctctgtcacctaggctggaatgcggtggcatgatctcggcttactacaacctctgcctcccaggttcaagtgattctcatgctcagccgccagagtagctgggattacaggggtgtgccaccatgcccagctaattttgtatttttggtagagatggggtctcgtcatgttggctaggctggtctcgaactcctggcctcgagtgatccacccgcctcaacctcccaaagtgctgggattacaggtgtgagccactgtgcctggcctgtattttattaattacaatgttatctgcaaaaacctggaaaaatagtatggctgtatgtgagatttaccccccatttagtcttcaggtgatacatggtatatacgctgagtcctggggaggtgggatgtggctcacagctagaaactgctgtgcaaaggaagagctttggagccagaggagtctggcttggatttctaatattgctactcactagctgtgtggtctggagcaagtccctctctgaacctgtaaatgatgattaatatctgtcacacagaatttaggctctggagtcaagtagacctgatatggaatcttggctctacacttactaactgtggggttttagaaaagtcacttaacttctttgagccttggtagctccctctataaaacaagaaaaatcatatccaccttctagagttgacctgaggataaaatggtagcactatgcccctgcccttcgcttgtccctggtactggccactggagatgagatgactaggctatcgggagaagaggagtcagggggacgggagatccaggtagacatacaggacattgtgggcaggagctaggaaaaagagactctcacagcagagttcatgtgagcattggcaaggatgagcttaatgctgtccttggaccagcttaccctcagctcacactgcgggacagagtcgatcatctcacaccctt

SEQ ID NO: 53428 - DNA, 1035 bp, Homo sapiens
catacatgccttcatgtatatgcacatattcctataagcagtcacctgcagaaatatttgcaggcatacccagacatgaaggtgtttatacatacatattcataaagtataaagataacatgcacacaggtaaacatatatatatctcttcatcgataaatgaatatatatattatatatatatatatatattttttttttttttcgagacggggtctcactctgtcacccaggctagaatgcggtagtataaacatggctcgctgcagccttgaactcccgggctcagatgatcctcccacttcagcctcccaagtagctgggactacaagtgcccaccattatgcctggctaatttttgtattttttgtagagaaggggttttgccatgttgcccaggctggtctcaaactcctgggctcaagcagtcctccctcttcagcctcccaaagtgctaggattgcaggcattaaccactgtgcctggccaataaacaaatattttgaatgccttctgtgtgccaggtactgtgtgagggcctggggatataagaaggtggatgttgaataaataattttagttgcattgagtaacactaaacagttcagagtcatggatcatgtaagaaggaactaacttagtagggtagggtcagagaataattccctgaggaaggatgtctaagctgagacctgaagaatgagttgaaattggctaagcacaatgtagcatgtggtgagaccctgaggtgaggagaagaagcctggcagcttcatgaaactagaatgtaagttctaagaggagaaagaatttgtgtcttttgttcactgctctacccccatcgctctgaatagttcctggcacacagatgtttaatccttatgtgttgagtgaatgaatgcctaaaatgtagtgaaggtggcaaaaggagagtggcatgagatgaggctagaaggaagtcaggagcctatagaccacactttgattttgaccttgatgtttagggtaagaggaagctgttaaagggtattaaat

SEQ ID NO: 53429 - DNA, 1459 bp, Homo sapiens
ctttcttttcttatatctgttctccctctttttctttttgttcttctcttttcttaacttcatccttttccttagctaatatgcactgaaatgtggttatttctgactgtggagagctgcttggggatccagctgctgggcagattatgacactgccctagttggtgtcccccagacaggcagagaagtcccagttaaggagattttggggggctcttgctcagagctgaatctgtgggcagagctggcttgtctctaggagagacatggcactagctgagcctctgggaaagtattctcctttgttatcatcatcaatgtggtctctgaccctcctaactggccctgatatatcactctggttgggaggcagagtacacttaagttggctttgttcctgccttgctccaggagagcctggctcatgtgaggaagagccatggaaactagagtccaattccctttgggcatgagggcagagactggaacttatgtagaatcaagcacctggggagttggtgctcaggctatggaccggcaaggaccatgtgtggctacgatagtgagccctggcagagaatgaatcacttagaaaactgtactttcctagcagagtatccctgctctagaggaatccttgctccaggaggcccagtccactagggagactcacccccataaatcattctgacctaagggcagcagtcctggaacagcctcaggaacctcatgctaccagtcagaggaagctcagagaaaggagaacacaccgggggtcaaggtagtggctcccagggggcttagagaagagagaggtcaaggggggtgaggctaggtatggcgaggatttgagtcttgacctgggcattcaaggaaggtgggatatggataggaggaggagagaatgctttctcagcagggagggcagcatgcttttggtgtgtgtgggggctggagctaagcaaacatgtggaggagcagtggaagagaaagctttataagtatttgtgccacactgacaatgaccttggacttagttccatgctttgtggcatcatttgtgaagttgtttgctttccactggtggacaggtgctttgcacttggtttgtttgcagtttgactcataccccctctcctgctgatctcccatgaaactgggcagctgctgcttactactcctcttgtgctgaaaaagctacgcactcccctggctttgggccttgctctatggcttgccttctgtctgaaatgtccctcagtcatcttcatcagacatattccctgccctggaagattcacctcaggtatcacttctgctgagaagcccagcagtcagtctcttgccttgaggttccttggcacttgggaaatcacttatctcagttgaaactgaatccatgtgtatttccttccagacatggccatctggatcacagagatgaagtctggttcctctc

SEQ ID NO: 53430 - DNA, 1036 bp, Homo sapiens
ctccctgcattctaattgctgcagttgtcctttgctctggagacttctcctccccattgtctgctgaggcacacactaatggctgtcctccctggcactgctgggaggcacggtggaggggggtggagaagagagctcattgctaccttcctttccccagggataaaggaatctagggcctattaacaagtggctttagctaggacgagcacagtcccttgccttcctggccccctccctaaacctagctggagaaggaggcccacgcagtaggcttggttgatggggccaaggggctttacccattgtcagtcctatagccagaatcatgggactagtgattcctttacaggctacaggaagccaggggacagacccttgaatgctcagctgatgaacatcatcctatgttcccatggtcccacacacagggtttggaagcttctaatgagtgatgtttcctgttgaaatttgttgcatttttcccaaagattggccaaatgcaaaagtctgtttggtcccctgaaagttgatttagatgattgctcgtggtagcagatgtgtcccattcattgatttaagagtgtcatgtgctatatatacatcttcacgaggacctttcagtaaatatcagttaccctccactgcagctcttctctcccaaggaatcctgttggaaattgccattgaaggtgctgaccccagcatatcccggaagtgctggcattccggtagtagcctaaagtcagcacctgttgagagctgctctgggccctgtaagtactgtgctggggactatggggactgccaagtgatcaggacagaaagaccagcacacatatacctaactatagggtaagtaaggtagagtatgaaaacactacaatgaaggcacaacacaaatgctgtgagaatccagaggagcactgtagagagatggaatggtagtattttttttagtactaaacttttttttcttttgaacagaattttaaagcccaatgtgaatctggttgaagatggggaaaagccctgc

SEQ ID NO: 53431 - DNA, 1137 bp, Homo sapiens
caccagttctcctagtgcagatgctatgcagatccaggcactgggaaagacaggtcacatgcggagacagctccataagtgtctcttcacagatgcagaggcacatgaaggctacaggggtgttggcacctgagccactatgctcctgaactggggctggcagattcaagaggcaaagatgccctgccatcatattcttcttattccccagccatgccaatagggtggctgcttctgcttggtctgaattaggtttctttggtcgggttcctaagagcacatgagaggctgtgaacaccccagtgaagatgatgagtcagggagcagaggtcttaggagttgaaggctggggaactcaaggcttcacctggcatagtggcccatgcctgaatgatttgtggactctgggggcttagctttgtagggctttgggaagggcaactatgagtgggtgggataaattctcagtgtccctggctaaagggtgacacaactcagacttgatagttctgtaaaactgtttcttccaaagcttgcgaggatgttggtttggggaagaaagccagccagcccagagaatcccgggagcctgacaggcctttttctctgcgatttctttctcgcaggcagcccgaggcagcctgtctctttgttaacagagtgacagcaatgtgacaccatggaaataattactaacaaatcacggtgctgactgcaaacagctctctgtcttcagaggcatgtcagggtgcattagagcaggactggaggagcggtgcatgtgggggctgaggcacagcctgcactcaaacactctcttcttccaccaccctgacccctttctgcaatatctgactttcttgctcttggcctttcccaactaggtcagctaaggggcaagctggacaagtggcatgtagctggtttggcttcctctgggcaggtagctaggactcccatctttgccaaggagcacctaggtagtgatgagagccaggagttttccattatggggcccctaaaaggtggaaggatgctctatttttctgatttactctctgccattgagaccagcttcacctgccagtagttttgggttttagggttacagaacatttgcttcaactggacccagat

SEQ ID NO: 53432 - DNA, 1775 bp, Homo sapiens
tcaggaagccctggattttctcactgccactgtgtgttgggccctccatggtgagtactgggtgagatagcccacaggcttaggccagggaggaggagcttggtcccaggagcagtgcgaaatgctttctctgagagatttgtgcctccagaactgagggttgggactcctggaaaagtgaacatcagagaataaagagagtgtttattgagcacttattacttaccaggagccctattgtgctgtttacacatatgatgtcatttagtccttaccacagttctgtggaataagttcattttataatccttttttaacaaatgaggaaactgacgcctagagaggtaagtaatttgtcaagggcacataacctgtttgtggcagggcagggatttgaacctgagcattctgactctagaaccatgtgtttaacgacagtcctgtctgaccgtcctccttcatgggctgtggtttggtgatacacggtgggaatgcccctctcctctcctttgtttgcactgagtggcagagcctcaggatgttttctgacaccgtgggctgttggttcctcatttgatatcggtagaggtgtggactgttaagttcatttgatatgggagcccagttggccaggagatgtggtggggatgattaggggctgcctgagagcctccttccagggttacaagttaatgaatcttcaggtctgttttaaggaaacctcagccaacttcactttggacacctctattctgtatttatgtttggaagcacatggggcatcgcaccgttgccccttgcccacaggtgtaccagttggtaccagcactgagctgcatcacctttgattagcagcctgctgggggaaggggcttgagtaagaactccctgccagtcctgacttgtctcatttcccattacttttatctgtcattgcaagtgcttgggctcccctcctgaactaattaagtttgcatgtttttagacatattgccaaatagggcttagcaaagcagaactgagctacatctctttctgagtagggaaggaaagagatatgaatgcttctccacaacggccaggaagaagcatggatgacatggagtgaacgtgtgcagatgataggcattgcctggccttcctagggacacagcaggcctgccaggcagccttctgattggccgacagggacaggtgaaagcccaccctccagctctcttagtgaattgggcattctaagggggctgagaatggaaagagggcaggttctgaagtatttttctcccaagcacaagcgaagttgaaagtcatatttagtgatatttgcatgaggaatttgtagggctgtgtgctgtttgctaccagtctgaatcaacctagctcctaggcctacaaccacctatgtggctagcagagtgcagggtgacctttccaagtctgtgagaagtacatcggaaacttggatagccaaaggccccaatttctctttttacctagaagaccgcaattcctcctcagccattggagtgggtgggtcagggtagtggagggaagtagaatagcgtgcccagaacctccccaccctggaggtggggttcagcatagtggatcgtcctagtgaggtaatggctgattgcatgtttttgtgtcagacggatgcctggagccttttccctagtgtgggatggcctgaggtctgagatgccctgtggcagtacatatttgggtcctatccaggtggcagttacaggggcaaattatgtcatggcctcctt

SEQ ID NO: 53433 - DNA, 1052 bp, Homo sapiens
taaggcgagtttttatttagtgatgtggatttaatttcccctctcaattttttcaagaaacaacacttgttgtgggtctggctcttggtcagcttgccttccctacctgacccactttttcttcgccttgcttggtgtttcttgaagcttcccatagggtttggtgttgtttctctgcttacccaggtagaaagtgccactttcaaagggctccatctttggtatggtggtggggttagcgctggtgtagactgagaagggacacctgcacaggcacccacttgaggaacttagattttagcctgtagcttgaagatccaggttcaccagccatgtagcacagcacggctgagaacctagactagaggctttcccagtgggccgtgagtctgagaagaaggaagattgagaagagggaaagactggagggaaagagctgacctgagggaggccctagcccttagtgcagtctgggaagaggcccctttggagagggtaggataatcagatgctgttctctggtggaataggggccaggggcctgctcagagtctggtgagaggaccctcacttaggctcagcctcagttttggagcaggaagttttcctcccccttgagggaggagagaggttgaacacataaatgcaggcatttgacttcctttttttcccctgccttcttgctggggtgtgcatactacattctggctgtgctctgcaggtgtggacctgaagttcacttcaggttttaggaggtctggagatggaaagatacttgcccagattacactatcactgttggagatggggagcatgcactcagcaggggctactgaggtttcttcgaggctgctgtcaagcggtcaagaccactgaagagactgctgctacctggagtgaaaggtgccacgatggaaccacgcacctgggcgagcactgtggggtagtgaccgtcctgtggggatgtggaagatggctggaagggtggcctagtgacgtgcttgctgcgggtcgggctgagtcctcttggcattgctcaacagctgactact

SEQ ID NO: 53434 - DNA, 1051 bp, Homo sapiens
gatgctgtttcttgcgctgtagcccgagggaataaggaagggcagtgcttggtcttagcttgtctcccaccctcctctggcctggaggttttcacagggggagaaggtccccctcccatgtctttctctatagggggaggggagaagagaaaaagcccgtggatctcattaggtgctttatttattttttaagaccaataaagccaaagctcagaccttatcaagcataggagaaagcagagtatctgcaggaatagcagggcacatctgcactggaggtgtgcagcctagaggaagtagcgtagtggcagggagcagggcaagataccttttttttagccgagagatcctgtcccatggaggagagagatgcagattgaatttcgtggggcccccaaggatggagccagggtcagagaggcaagtttaggctcacctcagtggcagagtgtatttcctgtccctgggagtgtgggaacctaggctgtgaccagtctggttgggagtcagagtttgggcacctgcggtagattgggagaagataagatgagctctgagatgcttcccagccatattgaccatcttttttttttgaagagattcattcctatgaccaagggagctccttagcatggactgctccctgttaaaccagactcaaggagacagagggaactcattctttcctctgtcccagccaccatccccagccaggacctggctcctgagggatgccagaagacaggcacctttttcctggaacatctgtagctgggatcctggaggaagatacttgctctgggccagcagcaaaccaggactcttgaggttatgggttttttttctcagtggccccagtcgaggaggagatgtggtcttgaggaggcaaccccctgttaaccctaggccagccctggagcagggtgcttaaagaattctgggtctcacccaagaagctactttctgctacttctgtatactttgtgggtaaggagggaaaattcctggtatcagcctgaatagagagtttctggcaggtaggagaccggac

SEQ ID NO: 53435 - DNA, 2830 bp, Homo sapiens
ggctgagccaccatgcccagcccagaactaactttaatttcatcccttctttgtccagtgccttggcagagctgaaaaggggtggtccatccttggagggattaatacaggagcctgaggccttccctgagaaggctttgtctagctgagccaactgctcaagcccctgtgtctctgggggctaaatgcaaatccttgaggagctcagctgtgagccatgctttactgagccacaaatgaaaatggctgttgtctgggaagcatggtgagagaaggagctgacctcactaggctcctcccaggctgatgattctaggatcactgagcactggagtggagtttgtgaaagccccaggatgctggagctccatttccccagctccaggtgggagagttgggtttagtctgcagtgaggcatcctgcagcagaacaccagagcagcaccctggttttccattttggtgtagtgattttcttgccccacatcagtgattttcctggggcccagggcaggggcttatggggtacacacaggtgctgacctaagccttatctccagggagggagggctcttggcaagggtgcattgctttcctgtgtgagtgagactttctttaagcccttggcattcagctcatttgagagacccttggtgggagccaagagaaggagtggacctaaccttgccgcctgaaactcagaccagacacaagactaacatttggaccctggagcttcctaagaagtgagagtggctgtggtccgccttttccaggatggtcctgatgttgagcctcagctccaggcctgaagatgtgtctaagccctaggcttaacaggagagaagctggaccagaatgggcagcggtgggcctgtgggtgtctgtcactaatctggggttggtaataagcctcctcctgactctctttggccccttcatgcctgaggcaaaacagggcaactgcctgctcggtttgcggctctggaagatgtagaggctctcggtactagttggggctgggtgtaggagggggctgctgagaacatgtattccatgagggcagagtttttacatttttcttcactgccggatctctagttcctgtaatgcggcccagcccgtagtaggctttctatgaatagttgttgactaaataaaaggaggagtcctttgtactccaagattattgaagctgctgactgagggcacttccccactcccagccccccagcccttagcggaccatcttttcttctctttgactcaggccctccctctactgggcagttctttggtcttccaggcaaggaaagggtgtggaggtgccagccgggtgggcatgctgtgggttaaagctttgcaaaacaacagtgtagttaatctttctaatttattttccttttagaccatgggaagtctgtaggcagcagctgttacccaattaaaatacagattaatataaaaacagtttctggaatataaaatagagtggctgtgtccttacacttccttaaaataccacctaataatgacttgatgaactacagaaacccacctagaggagctcagcgtttttaaaatgaaaatttctccctaaaaggtgtatattaccattccatgtaagtcaccatgagaaaataaccttcccttttagagccagcaatttctgtgagttgggtatttggtattcattaagtgtaattatagtttaattggagtttaatctccccccccccaacacactttaaaaaaaagaagtttccaagcaagtctgagatactgctctttctggaagtagccagggacatgctgggggtggtgatttccagttggtgtccaggacatgggggcctcatgccctcagatccttgtaggcaatctatccccagtctttttttttttttactttaaaccaaaccaaaacaaagcaaaacaacaagcttgtttgaacccaggcctgacctaggtggagcataggcctgagtcagaaattctctaggtcatagtctgaacattaggcctttttgtcttagtttccccattggttaaagatgactctgtctcttgcttggctagttcatattgatggcccacgtatgcagggtgaaggataggagcctgtgggacttcatggatgttagggaaggtgttagggagagtgtgggagggggcagtgctggatatcaaggctcagagaaggggtggacttgaaaccaagtgtgcctctcctgtatgagcactccccaagttttacgggaacttctgtgaagctaggagctgaatttacttgagactgtaattgtgggaagttattgagcctattgaatacaaaagacatgtaacatcaatttgtttgcaaactgaaagctgaaacaggtgtgagaacatgccttgtggaaacaggtgtgagaacacgccttgtggtcagcatgtgtatgtgtacacccatctcagggcaggatattatgggagaagcacacattgtgtcctgggtcctgggactttattcccaagtcttctaggtgggctctgaacctaaagcagtgccagatcagagccctttacaacagaaggagaaaaacagaaaggaaggggtcctgttcagccttgagtcccttcaccctggttttctacccatcggctatttctctttcctttcagctcaccgggattattcaagccatggtggatggtcagccaagcctgcagcaagtgctggaggtaggttgagtgacctttaattcctgacctctgaccccttcctgctgcctttctctccctcccctcctgagaatgtagccgtgtaatttgactatgattatggctt

SEQ ID NO: 53436 - DNA, 1185 bp, Homo sapiens
tatacttaagtagttcctctggcaggattttctctcttgtgcacaagaagttcttaaccccagtgtgtgtgtgtgtgtgtgtgtgcacgcacatgcgtatgacatgtgcacacacatgggcacatgcttggggagagaagcaggctcagtgctggacagtaggaagaaggattccagtttgaacaagtctctagcacacacagagagactcctacttttactgcttcatattaggaatgtgttagtacccttcttgaggtcccttcttagtttcagttgagagtcggcctggagacgtggttctgacagagataggatgggatgtgtttcattccttcccgagccctttccctttgacctctagaatctgctccagttcatcaagtctctatctctagcagctgggctgctgcacagtccctaaccatgtcttctttttgttgttgttatcatgaaaaaaaaactagagaaatactcattttgctaagtgccagtaaagggctttgtcttgcacctgtacttataaagggtgagatttattggtctctttgtctgaagagaaagagtgggtctgattatcagattgcacaccagagacaagtgcttatgtaatcaacaaactgtcttggtgtcagaatacgattgtgttggagataaactgtgaaaggagaaagcactggatgctgacatgctattggcactgagtttcctgggctgcttcctgtagttgctagtgttcttgatgaagccagctcattcctggacaaagcccttgtgagggtaggggatctcagtaaccagccatgttatcagtcagggtcaaaagccccttgccttgtggtttctgagtctggagaagtgggagttaatctgtaatccctcattgaaaggagccacagagcacacattaattcttcctctcacctctcctgctttaagtggctaaggtctctgagctctgtttagcctgtgagccctggttctcagcttagtaatacttggctttgctctagtacctttcattgtaaggagtgaaagctttttacaaacatgtattaacccaagtgggactgggcttaaactgtaacatgaaggatttaagttaggcctaagatagaacttcccagtattaatttgataaaattgtctcgttccctcatagcatcctgtataaaccttacacgt

SEQ ID NO: 53437 - DNA, 1030 bp, Homo sapiens
aacccaaaacactaatgaatccaaaacactcattctttgttgacttggagctactgttggaaatggttgattacaataacttatttttccttttctgtatctttggcactccaggaaatcatcgagttccccatcctaaagctaaatggccggaccatggagattgagtctacctttcacatgtatgtccagcctgtagtccatccacagcttaccccattctgtacagaggtaagggccctggaagtgggcagcaggggctgctgggaggggaattttggaatccttggtgctctatataggccacttagagaaagcatagggcttatcaatccttaaggcaagtgcacactagacctagcagttaggttttatgaagtctgccactccactcaggtcactgttgttactggggacccagggagagcagtggcttagtctacccctgcttccccagcatcccttcctggtgaccggcacttggagaccaggagcagaatggcatttctggggttcaagttctttccagttcagttttccttagggccccttggcaagaggtaaagatttcagccacttggaaggcagggttatgttcaggccttcttagctttctggcattgttactctgtcctcctgtaaagtggtcctgtgtgaagcgtaggttgagtttgtcgaaggtacattctgtcaccgagggaagagaagagtggtctcagtgaagcatgagacctggctggccaaggctgaaatctgcttatcctaggtgggtactgtacttggcctccttgtcagcaggttagtattggttgcattttacagattgtgaaactgggcctaactgagattttaatgattgctggaggctcaaaagagccattggcagaggggaggagcccctgcaagttctaactcccagaactgtgtgaagtcttctgtggctacttttccctgtgacatgtcatgtaatgcactcagtggtggccaacaggctgtggtgcaatcaggggttaagaatgtgtggtagcag

SEQ ID NO: 53438 - DNA, 1161 bp, Homo sapiens
agattgaccatttctccttgtgttttcccacccatcaatttcctaagtgcagtcaggtgtcatccgtttcgtgttgcttctccaggctgtctctggagagaaccactttaccttgattttaatgatactggaaaggtcttctccagaatgaaggacctggggaaggggtgctgctggagctgactattagggtcactgaataggcagagcccccttcctttctctctgcagtggaggccctttccacatgctaattttactcagagaattttgcttttatttattttttttattatttcctatttgtctcttccagatgttttcagggcagtttttttttgtgttgtaaactaattccattcatgttttaaaaatttatgaaagcgctaataaaaatgtcaaagtggtaaaaatgttagcttttcctctgctttgattaaattttgcaaactgtttttgaatattaaaaagcaataattttttttattctctctcctcgctttccctcttctctctggtacgcacgtgctctcttctgccctctccccactctggtgcgttcctcccttcccaggagcgatgtatgaggcgtgctgcacagccagcgttctgcaagcctgtttgcacaccaggaccttggtgctgtgcatctctattaaatagcggagacaaattaatcttagagacaccaaacaaattgtcactccttgtccttctcttccattatgtttcagtggactgggaaaggctagctaagcgattgggctggcgttgtagaggtagtgtgtgctgcctgaaaggtgggaggcgctagctcctattactgttactcttttctccttctctttgggatcccctttggctttattttttatctttttttgaaaaataagaactaatgaagaaacttaccagcttggttcaaacttcatacaaggaaatctatgcattggtctgatggctggttgtctatatggcaggagatcagacccatttcaggacagggacctgggcaagagaaagaagggcgtattcttaggggctcaagttagcaagcctctgctagagaaccagttggagaaactggggcagatgataccactgtcttccttcccatttccagaaacaatggggatgagggctgtgttcagtccctggaac

SEQ ID NO: 53439 - DNA, 1719 bp, Homo sapiens
tctctttctagatggtagacttgagttctctacaggatagccttttagactaagagaaccagatctttcttgacccttcatattttgaaagctgctagtcctactcttaagtctcattctcattttcccattttggagttccagctctgtccctcacaagcagtgtaagtgtcagcaagtgagttaacatctttgggccttagtttatttgtgaaatagggatgactatgattcccacctcatgagttaggaggattaaatgagatcattcctattagcacagtatctgccacgtagtaaacaataaatggaataaaacgattgcattttccacatgtcttggagagcactggaggccagctcctcttcaccctttgcccagacttgagcatctcagagagaggagccacctttcattgtattcatctctgtgtctacagccagcccctgcctggtgaatagtagatgcttaatagtattgatttatgacctgaagatggtgatggtgatgatgatgtaacctgtctgccaggattaaggagggtaaaataagaaaatgtatgtgaaactacacttttgtgaatggaaaaacaacactgtgtacgtccctccactaaggtatttatcacagtgtactgttctttgtttgcctatcttttccactcatagtccatgtgcttctccaaagtggagactacatcttatctctagtcctgctccagcccctgtctgatagcctacacaaagtaggcactcaggtagtttaattgaatgcaaatggcatacaaaggcaaagaattgtaaagctattattaggatagggaaagagggctggtaaatacgactggtccttccttccttcctggtgctacttttacacaaaactgtttctgaaataaacctcttcctaggggaatgatgaaattggctgagagaaaaggtcagggtcaggaataacagtttcattatctgagcaactggacatagaggctggcacttgggcacattgtcacaaatctttgtgttgggattaatgccactaacctgtagtgttggggttccatctctgatcattatcagctaaaaatcttcaaaatgtttgtcatgcttcaggtgccctggctgcagagttgtgccaacttggtgcagattggggcacctctcccactactgggctgtttgggccagtattttgaggttctgggaagtatggaagtactggctgggcaatatgggatggtaagaagtacctcagtgaggtccttgctgctctaatttctcagagagtcttttctcagaagcttctcttttgcatcctcagtagctcaagtgaatatgccagtgtgtaggctcattgttaataacagctcctcatgttgtggaggaagggcccctgcaaagtcacgttttgagactggtgcttgaaaccacctcttcttggtcttggggagaaggcttggctgatgagctagcattatcagagatatgtttataataggcccaatttgatgtgtcctgagccttgggtgtaggcaccctgggaatttcaggggcctacccccctccttttttttttttttgcgtggatccgagtctggcttgttcttcctctctgggagcatggcactgagtttcagcacgtagttggccccatttccctatgggtgaggaagctaacatcaggaaagtttgaatattgagctacagtatttgctgtta

SEQ ID NO: 53440 - DNA, 3042 bp, Homo sapiens
ataaatggtgagtgaaatcagggaccgtaaaataacagtgacactgagctgccttttaaagtttttgttggacataaaaaaaccgcctaagtcagcaaaggaatggggaagacctcattataaccaccttagaggcaatgaaaaggcttctttttactctttggatagtaacttaaagctctgtgttagatgctaggggtataaagacaagtaaggaatggtccctaccctcaaggagctcatagtcaaggagggcagacatttgtgtaacaaccattaggctgtatgataaccaccatgacatggtaagtacttggtacagtgggggcacaaaggatgggaatgatcaaccctgctcacagtgtgggggagggctgcatagttttcatgttataagaaattcaggagaccagaaagggccaagtggacctgaggccattcagaactgttatagcaggaagagaagaaggggttcacacagtaagccagaatgaaatggcctaagtctggaaaaactgaccttgattacaggcttgtttgtagaaatattgaaaatgaggtaaaaggagaataaagactttgaacctggcaagtatttcactgttcagttagttggattatctatatcagttttacgctgtttctcacattcgagctagaaggtgtcattgtgatgctataagtggaagtacaaaggctagaagaggcttaagagcattttacccaataaagtgtgggtaaaaggggtgtgggtgaaagtggatatggtgtaagctaaggctctgaggtattgtcaagaaggctaaggctctgaggcattatcaggaggctgatacctcagcatagcatttgggtgggctgctaggtctctagggagagtcaaaggctggggaatgacatgacgcctccccttcaccttccccctgcttaaaaaaaaaaaaaaattgggaatttggatctggatctgctaggacctaccttcaatagaccagggaggtttagacccttcaaaaagataaatagctggctgactaacattgagattagtgtggaaggaatgactgatgaagaggcaggaaggtctgggtaatgtggagattggtgggatcagaagcgactggagggcatgggggtggaggctgagcttcctctgagcattggcaacaggtacagccatagaaagcaaagccagcaggttggaaagcggggacagtgggggaagtgaaatccaagagtgtttaggttaagtccataggcttcacttctccctacctccatcctgccctgcttttcctctcccctcttgattatatttcttttgtagactgatctccattgtttgacatgaggaaactgatatcaggagaccctttctgcatctctgtatctcattgggaaaaaggatcttgcatcattttgattaagatgccattgggatgattattttttatcctcttatcctgggtgttcacgatacttaaaaaacccccacattcttacatttatgtgatgagttttgagctctagctgtgaaaattgagccatagcctaaaagcctgaaacaagagtgtacccacattgacaccagctacccccacccccagcaaaggctggcaggtctgcagcagaagggtgaacaggctggcacaggcagaaaagcgtttatatgtattgatgctcctgccacggacaaaaccctgttaggtgttgggagagtcagaaaggaagtaaatcagaaagaagaaatctggagggagagacaaacatcagggcagcttttatttggatgtagaggtgccttgggataggctgctgtttgggtcctgtccctgcatgtagttggccagtaaggagatctggaaggcctgtgggtggcaaaacaggtctgatacacaagtggctctacttctgttgtagtgtatagtcagtgtctagtcctggaaggccattccagccaagggctgatctgagggttaggtgctggcagaggcacttatttggagatgccgacgttgctgaaagtaaaggagtgttcatactctacaatgggggtacagttggggagccggaaaaggaaatttgaatgtattactgagtggaaaagaagaaacagaaatagatgttataagccagagtccatgggaatggaaaggaagttgttccaagaggttaaaaatgtatgttgggagactggtacggatgcagtacttgagagagatgctagtgggttggactaggatgttagttggttggcgatggtgagaatggggagaagttacatgttgtaacccttaggtgtgctaggaaggaaacaggcttgagaaccatgttcttatgtagctcataactcttttggagactagtggcctactgaggagtcagtggtactgaggtttgttaaggagtggcgcatggaatctatagttgttgtaaatggggtactctgagtagaagatccgtatcagggagaacataacaggcagagctgttatagttgagttccttagtggtaatgtgggtagttattcctctaggacctatttgatgcattgtttggccattggcctagaggaggtaggtagtgatggttaggtagataggataataactggctagaaagcttggaatcttgctctctaaaagtgtgataaaactgagagccatgatttgagattgcattgtctggaaatgcagggacatgtctgcgttgttcacaacactagcggcattttaaaggccagctggtcaactgaacgggattggtagttacagatgggtgggtagggctgatgagtgagatgaaacatggcattttgatcaggtctactttcactggaaaggtaatgtgactagagaaacaatgtcgggggcagacctgaaaggaaattcatggttgatggtgttgaatgtggtggctggtgaggatagcaaggagtccccaagtaggtgccttaggatatgcaggaattctgtgatcctgctccaaatttgtggccagggttggagaggcctttctcaggaccagaggcagttagatagacc

SEQ ID NO: 53441 - DNA, 1677 bp, Homo sapiens
accaaagcaaatgtaagtgaggaaaatgaggtataggccacagcacgttgggaggaggaggtaacctcagctgtctggatgaccagggagggagggtgcagcacagctctccccatccgaggagctgccatcctggcggctacccactttcctccccaagtcctctggccatccgtcaggctcctgcatagtctttttgtctctgctctgcagcagccctactgactgtttgccttctcatctgtattcaagtgcccataactttggagaaaaatgacgtttggggttgaggtttctagtgtttggtctttgtccacaggagcatttttttcctttttacggaaaccttgaagagagtccatctgcattttgagttagaactatgagtaaaggagtttctcgtttccagacaattgtccaggtgctgttatttttgaaggatatgtggggagggttggtggtaacagagatggctaatgtagaagagattcggagggtttccgtgtgacctagagttgccacatcattactagtcttttgtgaaagagacattttggaaaactttacaggaaattggttaagatccctacaaagcaaactatattgatttctttctccttcgttcgaggctgaaaggcaggaatcctcttaaccccacgtgctgcctccccgccctgcccaacacattgctctttgccccatgtttagcttctttccttctctctgttcttggttcctgccgtgactaagtggacagaaaagcaattccctggagaaagaacccacccttcccttcccatgtgcttgtcctggttgtagctcctccagtggggagggatggggcccaggcctttttcctggagagcctaatccttggattgtggtccctctgtctgtggccccagtcagcatgtacttttttctgtacagacaggcgaaggcgctgacgctattcttctaaactggaaaatgaaatgcaaaaccgacgttaatgtaacattatggttgagattaaatgcaccaaaatcaggaaattcaaagttatgcttcccacagcaactataacttagcctcatctggcgtgtgtagtattttgtgttagtgtggatggtgttatatgttaagacattaaagttaacaccataagcagagcacaaaatgcttgagggggctgagttatgatgactgtgtgagctgtaagtgttcttgtacaggctcccgactcctggaataatttttcccctgcccatcagagcaattattgcctttctttctagttatatctctactttaacacatctcttctttcagggtcactataaatgaattcctctattgatggccagtgatggtgggaatggggtggcccactaggcccctttgtcttttttgtcactgcctccataaatgtggtccttgcccctcctccttccaaagccatcttcctccacaggctgctgtttcctggtggtccctcataaggatgggcctccgcctggctcccactatggctcctcactagtattcccggaatgggaacaagcgtttgctgtgtccgagtcttggctgtattgcaacttcacgtgaaagccgaagggcctgtctgtatttggagcagacatagcaatgtagaagcaaaatatacatctcggggaatggagcactgatgcatggtgg

SEQ ID NO: 53442 - DNA, 1010 bp, Homo sapiens
agtgcagtgtgtgatcacagctcagtgcagcctcaaccttcagcctcaacctcctgggctcaagcgatcctcccatcttagcctaccaagtagctgggactatgggtatgctccatcatgcctggctaattttctgtttattttttataatgatggggtctcactatgttgcccaggctggtttcaaactcctgggttcaaatgatacttccacctcggcctcctaaagtgctctgattacaggtgtgagccaccacagccagcaggaactttcagtactcaagatcctgcatggtacacttctgtttttatgacagtgtgtcataccccttgagtatataggaggcagaaacagttttaggccatggcctatttggaggcttaatgtggggctcttttatctatctttgatttccagaagttcctgagttagttgagtcagcttattgggactatcttaaaggaatgccatcacgaaaaactaacaggtgtaagccctgttgtacttgggtgagtaacagcattggttataaacatggtaaaacatgatattttccatttgtcatcagttttgctgtttatttttgtactttattcagctaggtgaaactggagtggttggcttgccagttacaggctttggtgttctggtttttgcactcattttatttgtgttacatgttttgattcagattaacatgataggtattggttgaataggagactttttcatttgaaaacacttttttcacttaaatgtaatttagatggtttaaaatgttttagagggtccaaatttcaggaatgtggctcctttcttgttttaggaattgtttcctgacatagaagcagttttttatctggtttaggagaattatgcctcctttgtcctcgctagcaggagttcattttgctcattttggtgtggatgtgcaccgagtgatggttgttgtgaccctgaggcccagagagcagcctgaaagctttggtgggatctttaattgtgcatc

SEQ ID NO: 53443 - DNA, 1002 bp, Homo sapiens
ctttaaaaggagaatacgaatgatcttggaaattatagacccgttagtttactgtgattccagagaagatacttgacctgatcgtcagataatcaatcagcaaacagctagaagagcgtggggcactgagtaataacttacatgggtttgtgaagaagagcaaatcctgtcagatcaatcttaacttcttgctgtgacatagtgatggatttgagtggatctagggcaagtgataaatgtaatgcatcttgacttcattaaacctctacaatgctgtgatcaacagttgggaaggtgagtttggggccagacatctgtgttggactacccatcagaccaccttcaggaaagggacggcaggttgaaacttgttagtagcaacttaaaatctcccttttttatgggagagcttttttaaggtttgcaggtagcaggatcctgatgggattcagagaaagccaagaagacggattggagaagttgtcagtcctagatagaatagcatccttccattgaggtcaacataggtccggttcttattagagcccctgtgctgtttaggtcttctggtcaacaagggaagtggagaaattggaaaagctcaggaattggaccacaaatcattagaggcacaaaaatagaacttagaaaataaattgattatagttttggtgactgatttcttgttcagactgaataaattcatcatgtgaggagtaattattccaaggagtacgataacaacttgctcttgattttaatagggacaaaaaagaaagaagtttaaatggaagcaggaaaggttgagatttgggatgagaatgaactgccagaagagacagcaaaaggaccggaataaggtatacaccttagatcagccttccttagtgctgtctcagaacggcttgatggctgtccatttgacagagattctttgattcttttttttttttttttttgagatggagtttcgctcttgttgcccaggctacaagttgctct

SEQ ID NO: 53444 - DNA, 1026 bp, Homo sapiens
ccaagatgacctcaatgattcttaactcctgctattcacacccttggtagttcccctcctgcactgaatcaaagatattcctgtatagctaatagaatacagtggaagagataatgtacgacttctgagggtaagttataaaaagtattgcagtccactttgctcttttggaccacttgctctgggggaagccagctgtcatgctgccaggacactcaagcagccctgtggagaggcacatgtgtgtaggaactgaggctcttagccaaaatccagtgcccaacttgccagtcatgagaatgagctatcttagaagtgaatctaccagccccggtcaggccttcagatgactgcagccccggtggacatgtgacttcaaccttaggagggactttgagccagaccagccagctaagccactctcaaattcctgactcacaggaactgtgagggataacaaatgattattgatgttttaagccacaggttttgggatgatttgttatgcagcattagataacctgagcaagtaccattgttggtctgttggaaaggacaatttctttgcttgctttttttcattagtcaccagctgtgttcaaagaccttttagcttttaagttaatgctgctaggaggcttggattagctgcaggtgatattgaagtatgtggtgtttgctttgagggaatgattgggggctgatgtagcagttcattgtagtgttggtgcattgaatatgtctggctctaggactgtaactcttctctatagggttaggttatagagtgtgtgatgcatagacatgttgctctgggaacagctttcaatcgtaaggaggagggagagaaggggacctcagcatcgggcacttcgaaggtagggaggagtgtggtccatttaaagataaactgggtttgtctgtcatggttggttttttcaggaagggatctgtcttcaaaatggtaaattattttacataaagcaggtatgacaacctctagtgttccctttctcctctcctctt

SEQ ID NO: 53445 - DNA, 1792 bp, Homo sapiens
acttaaaatattttttggtcttagctccactgaatccccctgaaatctcattatagggatagggaaattgaggacctacactagcgtatatcctactatatatataggcaagttactgtagctcattcagtgagtcaggagagagatgggaagacagccatacttggcattatctgcttctgttcaggtggtagtggcctcattgcctttgagtacgcgctggacttcacagggtgctatccctctaccctatgtgaagggagccaggtgcccacttgcagccatcagaggcaagcctttggttgtgttggaatgaggcttcggaaagcacaaactatggccattactgtattgtacagtgagatttcttatttgaggattaaagttgagagaaatttgaatgttgagtattaaagggagaaagacaacatttctgctttgttccttttttctttttaaggaagtttgagttattcgtgagtaaaacttaggctttgatttttgtatttagttaggcctctgaggagcaggcattctgcaaatttaaggggaaaacttaaaggaaaagtgatttgatttttttttttttttttttgcacatgttcactcagaaaactttactagacttttagccatgttcctattactgccacatctgggttttctttttcttccctatttaaaaagtcccgcagtcattcagggcctcgagtagagaccgagtctaaggcagcaaatgagaaggcctaaggctgcagccagctgtgctctccaggcactgttcattcccccagggtgccacttactagtgtgggggttgggggatcaccagaatgtcagagcaaacccctgtgattcgctttgtttgccttcaccttgggagaggggaggagggtatgtggagacatcaagatacagactggaaagccaggggcaaatggctcctagtggagctgagaaaagaaccttggacattttctgctgcttgtctgagtctacttagcttccaggactcattgtacaacagggtcacctcacgttactttggacccatagctttaatgttaactgttgccacctgagaagtgactgcacaatttttctctcttctctcttttgaactttagagctccatttaaagatgcaggccagtgttgcatgttgttttgagaatgatctgggagactcagagctgtaataatgctgcaggtgctgctattagggtcttgaactttagtaacgaatactatgatttagaaaaggggcccagaaacactggggagtggcccatgttgcgtggatattcctgaagactagatggaacagggccacagtgggagggagtaacccaggctctctgttctttttttttttttctttcttttcttttttttttttttttttaaactttcctcccctaagttttagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctccccagaggtatcactactttttagtgctggactttgaggccacgtgcgacaagccacagattcatcctcaggtaactgttccatcattgctttagaaaaggtggggggggcaaggagggagggaggatagttttgcttcctgggacacaaaggagctttctca

SEQ ID NO: 53446 - DNA, 1017 bp, Homo sapiens
cagtaactgctgatatgtggaggcctgacctcctaatgtctactctcaagacttcctacgagagaagtttttttgttttgttttgttttgttttgtttttgaattatggtcttgctctgtcacccagactggagtgcagtggctccatcacagctcactgtagcctcaacctcctgggctcaagtgatcttcctacttcagcctaccaagtagctgggactacaggcatgcagcaccccgcctggctaatttttaatttattttttgtagagattgggtctcactatgtttcccaggctggtttcgaactcctgggctcaagcaatacttctgcctcagcctcccacagtgctgggattacaggtgcagtcactgtgcttggccaaaagaagctttttgatgtagatgaaatcaggtgagaaagcaaggcctgcaggcaagaggaccactggccatcagaatagggtatatatagtatgctctgtcagaggtctggagcattttagggttgcagaagacatcgatattactctctgaggctgccttatgaattaattggatttgtaggcccagaatctggggatccaggcttggccaggtgggcatagcccaataggatagtagtaataacattaggataatatatattaggctgttatatgccaggcactggtcttagtgctttacatgtgttgtctcattttgttctcacttaaggagtaggtgctattgttattgtcattttacagatgaggaattgaagaacacagcatgcccaaggtgccatgggtagtaagtggtaaagctaggattcaaacttggaagccctccttactcatcatgcttaattgcttatagtatttggtagacaggattgactgactgtatatactacgcatattctgtgcacactgtagaacattaggactttcagaagtctttacacttttttatggggttagagaagagtctaagtccttgagggactttggatccaaactagaatgggtaatttga

SEQ ID NO: 53447 - DNA, 2247 bp, Homo sapiens
cctcttgttttcccatcctgaggactcccttggcctgtgtgtgtggatgttaaaggttgaccccctctgctcacccctccagtaatggaggctataaaatgtctatttacccaagacaccagaacgactcctctgtggttcctctaatctggtgatttggtgcttctttggtctctcaggtaaatacagattgagtctttttataaaggcatattatttccctcattaaatgtgtgttttggcacatgtgttatttacctgatagacagtaatggctgcagaggagccattggtgtctgttgtgtaaatactctgcacagagaccatcctccaggggctctggcgcaggcctgcttctccaaatcgggctggccccgtggcagtcccatttacccctcccctgtccccactggggacctgggcccttcatattgaggagagaatcattcattttcctccttgccatgggctacttaatacctttaatttgctaggagacggaaaaggatgtctgagaataaatgtgtataaatcttagtctctgatgaaagatagtttgcagaaataggcagaatcataaactttcttttgagttctggccctcatttagatactcaaagtcccagttgatattataagctatagacttatagcctgcaaatttgtgactaaaacataaagacatcaatagaaaagagaaatccctaagacaccggagggtgcaagggcaagtgggatgctgctgcagggagcaggtgtgtttcctgagaaggctgtatggtagcaggagtgccagtgaagtgggcattgagtaggggctcttctgatggaaactcggctggatagagatactgtttgggctgagagatgctttgagcctctctaccagagagaacatgcagcctaccttctgtgggcattacagggagatctgtctcttcaaatactgtctgtgtgatatttttaattttaaaattgtaaccacattgcacatggattttaaaaaacaattttatttatttatttatttatttatttatttatttatttatttattgagatggagtctctgtcacccaggctggagtgtagtgatgtgatctcagttcactgcaaaccctgcctcctaggttcaagcgattctcctgcctcagccccctgagtcactggattacaggggtgtgctaccatgcctggctaatttttgtatttttagtagagatggggttttgccatgttgcccaggctggtcttgaactcctgacctcaagcgatctgcctgccttggcctcccagagtgctgggattacagatgtgagccaccccacccagctgattttaaaaaacaattttaaaaaaacgtttgaaacagcccaaatttacataaaagttgtaagtacagtagaaagaattttttccctgaaccatttgagggttaagttgccgacctaatgccccatcaccctgaatgcttggtgtgcatttcctataaacaaggacattttcctacctagtcaaaatacaaccatcaaaatcaggaaattaacattgatataaaacctctatataaaccttggaccccattaaagttttgccagttgtcctaggaatgttctttgcagcaaagtgatccagttcagaatcgtgggttgcatttggttatcaagtctctagtctcctttagactttcctcagtaaacgttccttggcattcatgaccttgatacttttgaagattacaggctggttattgtttagattgtctctcaattagggtttgtgtgacattttctcatgattagatttaggttgtgtagcttcaggaatataacagaaatgatgctttgttcttctcgtcgtgtgattttgatttatcccattattgataatgttcactttgatcacttgattaaggtgatgtctgccaggcttctccatcataaaattactactagttgtaattaataagtattttgtggggtgatactttgaaactatgtaaatatctcacatcaaagtttaattttattgatttatatctttatggactcatggttttctattcagtgcattataatccattactatcattgtttcttggccagtgggtggcttctgtatccttttggtatgttcccatcattatttgggtgtttccttgctttctgatacaagatgttatgcgctcatcttgtatttctcttgctgcatccctggaatcagccatttctctaaggacctctgttt

SEQ ID NO: 53448 - DNA, 1614 bp, Homo sapiens
tttccactctgtaagatggaaagatttgctcctgtggaattttgtttgagaagagacttcgagttccttgtgctgccgttcttttaattctgctcttgtgctcaggcctgtaatttttctttttaaatataaaaaaatatgaaaactagttaggatgatttggatagacttaattattgcttaaggttgagttacttttagttaaagttacactttgcctcaaaagaaaaactgcagttgatatgcattgttggtcctctgtcggatggagggaatcagtcatgtggggaaatgtgggccatcacacgtggtagagaacagggccccaaagagctgagcacctccgagcccttagtttcctcatgtgtgatatgcgaatattcttacccattctgcttgatacttgggaggattaaataaaatatgtaaatcatcgatacaatgcctggcttggagtagattttcagaaaagggtgtttgctttttctctttctcatgtagtaacagctcccttttattgagcgcttgctattgtgcaaagcactttttgtacatcgcacggttgaattgaatcccaaagacataggtattattattattatagctattattacaaataatttgtagtagagtcaggatttgaacctaggtttgtctattaccagtgttttaacactagattatataactccttgcttttacagcagttccccatcttgggaccaggagtataggaagtatttaacagttctgggtacctctcttctgggatcagatgctgtctacaaatgtgagaggtgcttaaagggatgatgctaccataccctgccctccatccatctctagtctatttatggtgtgttaggaagcaaggctttgccccttctcgtgtgtgatgaggttgcaactgacttgcaggactttgcaaaaagatgtcttcaagctttggccgctgaaaggagtttgcccaagctactgggcatggctgctgggttagcaaacagcaggcaaatcacaaacaattgcctctttttatgtgtttcttggagctgctgaaacagaccagttgaaggggagagcaagcctgctgtgacctatgatgttgccctcagaatttggtgttcctgaagatctttagtgattttagctctgctggtagtttgggattattagcagctgcttctgagttgggggagctctccatagctgtgccttggagcagaagcagctgtagctacaggccaaggcagggactgagtgtagagaagaggagactgttttgttgaggtgaggactcagttttagagttcctgcttcctttccgcattgggaccatgtggagcttccagggcatgtcaagctttgttttgtcttcaacctctagccttcaacaaactagacagagtcctcaggctcttggcctcttctgtgagactgcatagcttgggaaatgactagtgaggccttttccttgtgttggagcagtagcctgagaccctggccttggagttgagagcctgggttctattcttactatttcttgcagtgtgaaccttgggcagtccttttctctttctaatctcattttccctggctggttggactgtgttgcct

SEQ ID NO: 53449 - DNA, 1050 bp, Homo sapiens
atctatctatctatctatgagaccttgctaggttgcccatgctgggctcgaactcctgggttcaagtgatctcctgcccacaagtagctggagctacaggcatgtgccactacacctggctctcgtttggcttttgctaatgtatttgaccaaggcctttgggatcttggtttaatttaggttgcatgtcaccttttggtgggtggttagttccaacctgtctgttttacaaggatcagggaccagctaaagaggcatactctggatgattgatatccagggactcgagcttgtttgttcaatagctaagggccaggcactgtgctagttcctgggattgtagtggtgaacaagaaagccaccttccctgacaccatagagcttacaaattcatgggagagactgatagtaaaaaggcagttatgatatgatctgagagtgctatagtaagggaagtgtagaggctttgggaatactcagaaaggtctctaacccagacttgtagactcagggaaggcctctcagaggaagtaaacctcctcacatagaattaaacgaaccctcaaagaacacgggaaattaaaaaaaaaaaattaggtgaagacatgagggaccaagtgtcagagctttgttgaatttgagaaagttcaatgtggctgaaacagagtacttagtggtcaggggacaggaggatatggggagagatgaagcaggagctaagcagaggccagagccttagccttataaactcttaggattagaccagggagtagaaaaaagattagattagtgctctgcaaattttttctgtaatggataagatagtaaatatttaggctttgggtctctgtcacaacttctcaactctactaaactctgcagttatgcatgaaagtagccacagacagtatgaaaaggaagagcatggatgtattcctgtaaaactttatttataaaataaaggtgacagttagatttggcccatgggacatagtttgctgacctctggatcagatttaagaacagtaagaagccattaaagggttttaa

SEQ ID NO: 53450 - DNA, 1031 bp, Homo sapiens
gatgtggggcccctcaatgggggtttggattttgtccttagagctggattttgcaacaaatagtgcccatcgttgtgtctgcgagaggtctctggccacttcaatggcatttactcttgtcagacatttaatcagtctcccagcggaagggcagcaaaacatgaatcctattggctaaaagagtgtacgctattcaaactatagtaggttgtgagtggctaaatgagttttgattgtagagtttcttccagaaattggcttcatcaaattctgctttattctgactttatcatatacagcatgccttgttttagtgggttcttgcttggagcttagtttattatacctgaatctcctaccatttaaaagccaatttataaacagggacttggagtgtgactccactaatgtgtgtctgtgatcctggttagaaacccacttggctgccttttcctcaggaggtgggggttgggggaagggagctgccgggaagtgattgataaggtttcctttatagattctgtggtgcttcactggagctcagagcactttggcaacttaagcactccaaattaaaagctcattaacaattcctgcccaaagatcctgtaaataatcagctagctaggtcatagagcttggctaagagcttttcttccaacttgaaatttccaaataaaagtgcttttattccctttcattttaaaaagtgttttctttgtggtggggtaaattggtgagtggccttttcccaggggatctgagtagaagaaagtcttaaatgtgtggaatggtagacaggaatatattagttccaaccctaggtgtttctttatgcaaaagacatcactaacaggggcatctctgcaacttctggtcctttggaggatatgaattagttgaaaaggatgataggtatctattgatgttttgacttgggatttagttaccttgactttcttagagcttgaagcaggcttggaactatcctgaaagtgtttcctagtctatgtggccattttcagtatggc

SEQ ID NO: 53451 - DNA, 2028 bp, Homo sapiens
gtgaaatggaattctgaccttgaaattaatgagattctgatcagaagggtggggaaacttctttatttccaatgcggtgttatacaaattggagtccctttcctcttttattcatttaaaatagtcttcccttatagagtaccctgtgttctcctttttttttcttgtacacaagcataaaacctataggagtgtctgtgaggggagggtgttcgtacaccctcgttattatccagagttgcatttgtgactaatctttaataaaaaacaaaggtgcaaagtgaaaaggaggctgtgctaccctgtggtcaccctggagttgtgctttttactcccttccttaccttaggtggttagcacatccctcactgggtcatactagatagcgtttgtgcttttgattgcgaatttttggaaggcaggagaagtatttttctgtaaggaagggttgaagaggcactaagacaaagtctgcagcagctttcttggctcctgtcatatgccgacgtgtgtcggaatatttatggtctgttttatgtaaatacatatttaagggtcgttagaaggcctgattattcccactagatgcctttcaggtcctccctacagaaccgttttgaaataagtaatatttctcagataatcgagtgacagtatacaagactgcttccaaagggagagaaagcttcaggggcagatgggggcagtgacggggtatggggatatgaaaagacagaggatagaaagtgttcagacgagcagagtgataggatacagtgctttcgccagattgcccaaattaaccatatatggttgatatacacacacacacacacacacgtgtatatatgtatatatatttattcttaaaatttagagttaattgctgatatggttgactcatttttcagttctcttcatataaatatcttttcataaaatattttttaaatgttttaattaagtgcagcagtcaaactccgaagtaagcatttagctttagagttttgttggtgggtgggggtgggagatgagaatggtggtgtgtgtcctttacttagagcagaagtttttatgactgagttttaggtcattaagaaatcagttgtataatggaaacactgacagtttttactgctgcagccaccccctgctcacacactacatcaatctgcagatatgtccacttgtgagcccactggaaagagaggcctgcagacatggtgtaatgcacacatgttctttccttaaatctgggtactggtaggcaggatttcttttgtggttaaacatgcatttttatagacagaaatatagcgatttgggtcaagcatcatctttcctgatagatgattctggtttgcttgcctgtccatccacctggcttcacaggtgattcctgagggaggtgttgtgctctatggaaaaacaagcagcctttactctgcaggactgacttacttgccctggaaaatgggagaagtgttttgtgagaagccattcatggaggatgcataattccccaggaaggagactgaggtaactcctgcttattgtcactccttgaatcagtccccaagactcattgtccagggaaataatgctaaaatttacggaccaattacaagtagttcacgtgtgctttacatatgaaatgtctacagccatgtttcccagggcctttaaaataaacatttcctcattaaggaaacttcacaacaaaagggaagataagtattgtctgctgtcttgtgttagaatctgtacatttattacccccttagcactctggctcctgtcatgtgcatatcctgatggtcctcttcaggctgcccctgtgcccagattcctgcctgtgtgacacagtctttggccagcctgccagcctatccactcagcccagattggagttggcgaagtatacatgctcaccacagggctgagagggcccagaactgcccgcgtggagcggcgactggccctgtcttctggcttaccccagggatggaccctgggcactgaccacac

SEQ ID NO: 53452 - DNA, 1059 bp, Homo sapiens
acataccctttggtgggatgggagaagatgatttagtatctgctaacgcccaatgtgctttacagacatagtagtttaagaagagctaaatctgtgagacgagacagatgcacctactctttctgtgcctccatttcctcaggataaagtgggatgaacactagtatcaatctcttagtggtgttataaggattaaatgagttaatagaaaatacaaataaagtcctaggaacagtgcctcgcacaaagtatgccttcaataaatgttagctataattaatatgataaggggttgggcacagatttgaggtctcttaaaccaggctcctccaactcttacctctactcctaattgcattatggggacagtgactccagcaagccctgaactcttataagtctgtgcagtttatgacaagtcttcctacgactgaaaaatcttccaattgatattcaggagttggtacctataatgttgtttttccttcttggcttcagttatatgggggctggagcagggatgagtttagcacccacccaatgaccacctttttaaaatacccgaaaaggcacagagtggaaatgactagaattctacactaaactcctacccgaggaaggacagtaagccagaaggaattttttctgggtttagtaaagggcttgacgaatcctgttctatgcctctgcctggtcagccaactcagatagcaagtctgtggaccatttactgttcaccagctattttgaggagaggatgaggaggtgacagaatgcctagaatcactgggaaatttgaactgggaaggaaccattgcaggctgctttatttttccaattttctaataacttacataatgcttaagactgtgttttcccctttaaggggaaaaaattgcttttgctctatttagagctcatcacatttgtacattctacaaatactcttctcctaaatctcaacttgatgacttccaagcgccgttctcacagctggctgctttcgctcccactccactatcccaccccgccccatcatctttagttaacgatggatgc

SEQ ID NO: 53453 - DNA, 1050 bp, Homo sapiens
ggcaatgccaaaacatactcacactcttgggaccccagagcgccctctcgtctgtttacccctggcacctccctgggcctggaagctgaccttatttgttatgaagttcacacagaagtgcccagggaattagaaactgaaaacaaactcttcaggattctctatcttgcctaaggcaacacttatgtcccccagtaaaaggtgtaaattaacttagaaaagataggtcattcctttgaaaaactgacagttgtttgggtggcttagagcacaattttgcttattgaacgagcctcaatcttcagagaagtaagtatttagaagactactactgccttatggcaaatggaatagcacgctttgggagtggcatagcaaaccaaccaatgcggtagactttctgtttccaagtgagcagctaaagctaaagtcgattgcatagacacagctgtgggtgggccaactgcatgagcacagtttctgagccaagccgctaaaatattaatgattagctttaaggaggagcaattctgattgaggccactctcctgttagaaaccataattagcaattaaaatatattctaaaaactgttccaaccagcagcttttaaataaataattgtcactgctgattgaacttgttttatttccctgtgatttttcttatcttcccccaccccaccccgcataacttacaaccctgtaaatgctcagtagctgttaatatgagtctgtcaatacatttaccatggtgacttgggctgtatttggcgagcatttgaagaaatcagtcactggttggagggaggaaagacaagctgtcgatatccagggagaaatgctaataaccctggtgacaaatcgtcctctggattctctaagggttaagaaaaagcacctcttagacctgggagctcaggggtaagggatggtgacttgttaggaagtgcagacagtagctgtcatgatctgcaatgtccttttcattgtcttgctttcaacctctcaaaaccacagatgagttctggagacagacaggcctggattt

SEQ ID NO: 53454 - DNA, 1062 bp, Homo sapiens
tctcgcctcactgcagctttgacttcccaggttcaagcaatcctcccagctcagcctcctgagtagctggagttaccggcgtgcactaccatgctcagctaatttttttgtatttttagtagagacaggattttaccatgttgcccaggttggtcttgaactcctgggcttgagtgatctgcccatctaggcctccccaagtgttgggattacaggcatgagccaccatgcctggcctacccctctttaaaaataaacaaagccagaaataatcttgcttctttatgtctccccatctcagatgatagcactgttgttcacccaattgctttggctgaaaagttaggaaccctccctgtttgcttttccactcttgtacccaagggccctcttactccaccctcttgcctagtggaaataagacttctcaaataactggtagtggcccaaaccacattgaaccatttcacaattttgagacctagatattgaatcattaggatccagaacaaatatctctgctgctgagcttcactcatgtgtatctggctgccttctagacttttattcttggatgtcgtgtgggcactgaatactcagcaggaccaaaaccagatttaccatcttctcccactaaacctgtatctccctttgtattgcctattttgatttatcatgctaatgttattcaaattagaaacaggatccctccattacctcaccccttataactaatcaattttcatggcctaacaattctgcttaataaatacctccatctgtccctacttcttttcccatagttcatactctcctgctgtcttagcacactgttgcagtaggctcctaacatgctctggcattagcatctgctgtcttccagttcattccgtataccctactgataaaggtcttgctaacatgcagacttgttcatgtcacctgcctacctaacacccctcattcctatcacaaaaaaagcccacaagtcttcagcctcccgttccaggctcttttctcaccattctcctcttagcttttcatttataagcatatcttgca

SEQ ID NO: 53455 - DNA, 1060 bp, Homo sapiens
tgcttactatttgttttgctctttcctttgcttctgtcaaatctctgtttttgggatgtgagtttagactccttactatgattccctttagcgagggcataggacacaccaaaatgcctcaagcacaaaatgccaaggaggacacctcagtgacaggatgggaaaatggaatcataggagggagaggagaaaaataagaaagaggaaaacggagagcaaaagaaggggaagaaaagaaatgaaaataaaatgatgcataggaaggcagcggtgagtgcatggagctagcagtgagactttctaatagtcttgttgccagtctcctgggggctcatggggctctcaaagaaaaatttatgggatggaaaaaatgtggtagggatttaataaatatttgattaactgattgattaattcattaaggagcttggtattttaagtaggttataagaaacaagtttgttagaactgcaaaggcatgaactggagacagtaaaaacattgaaaaccacatggaaagatgaataagttgagagagaagaagaaccctgaaaactgatctaatggtctggaataagaagaggggtcggcactggagataatcaactagtcataaaactacataaatacaacacagattgttttggaataaacacgggaacttagtgaagatcaagggtgaccttctgagttctctagctctagcacgtgccatctgtccctgactgacacctgaaccgatctcagaacaccctggggccagacagctaagtgatgaggaaggagtggtactgagggagtgtaagctttggggtgggagtaaggggtaaattaaatgcctccaaagatccctctagctttcagatcttgtgatgcttgtgaaaatattgctagagtgtcatattcttagaataaggattctcttaatttggagaaaggccctaagaccttcaaggggaaagaatacacaaaagccattgggtaatccaagccaagacaattaccattagtctctggaggtgtttaatttaagagagaaagaagttcctttccactgaag

SEQ ID NO: 53456 - DNA, 1184 bp, Homo sapiens
gtagagtgtcagggccttttatcaagtgtggagtccttgattcctgaacaaccatatccatattgacttgtctacggattttggcttcggcttctttacaatagaacaagaaagccaggtgtgatggctcacgcctgtaatcccagtgctttgggaggctgaggtgggaggattgcttgagcctaggagtttgagaccagcttgggcaacatagcaagaccctccctctacacaaaataaaaaataaaaaaattagcagggcatggtgtaggcacctgtagttgcagctacttaggaggctgaggtggtaggatcacttgaacccaggcgttacagtgagctatgatcatgccaccgtactcccagcctgagcagcagagtgagacactgtctcttaaaaaaaaaaataacaagaaacttaaatattcttatgaaatagcctctgcacagactccattgttaggatttttccagtttttttttttttttttactaatatcataatggttaggacagtctctcaagccagaccacctgggttcaaatcctggatgtaccatttcctaacttgggtaagttgcttagcctttttgtgcctcagtttcctcagtaaccacttcagagagttattgtgaggatgaaatggctattttatataaagccttaatatactgcctgatacatagtaaacattcaataaatgttaactgttttctagttgtcttacccacacccaattcaatagcatttaaaaaagagatttacctttatgaaacttcccaaagtatctgatttagtgttcttagaaacaacagttctctttcttttcgcacgattggtttacataatgtttaattaaattatgtaaatgtaataactactaccacaggaataaagaaattttggaacaatcacagtgacttacactcagctggtaaaagtggaagtagtatatgtgtgtggaagagtggcctgccagccgtgagcattcagagcactgtgtccattaactggaacatattacagctggaatggaaagttttagttaacccagtaagtcagtagggaagaggctggttaagagagcatccactcttggacgacagcctctaccttgcagcttcctctctcccttgctcctgttataactgtgctttcatctcattgactgcctagatccaagc

SEQ ID NO: 53457 - DNA, 1114 bp, Homo sapiens
tgcttgcctagattgccgctatagcctactaactgctctccttgtctctggtctcatcctttcctgattcatcattcatagagctgccagctattatccgtatctcatcagcatccacatcatcattattgttacctattttgcattatacttactggtttatgtgcctggctccttcattatactgagagtgtctggatggcaagaaatgtgttttatttacctttgaatctccagcaccttacacagggtctgacacatagtaaaacttcaataaattaatgtgaaaagaaagaatcaaagaaaggagatggggtttcagttcaagtctgcgtgacctgaaaacccatactgtttctacactatcataatatatctttagtcacagctgtgttgctgataaaaataaggacacagctcaaaccctcccactgcgacaccagtggaaaagcaggttactgaatctagattaactaaagattcttcctcccatagtcacaataatccttcccaatcctaattcctctcaaatggaaaggtctagaagccataaaaaaattttaatggccataaatatattaaatatattatattaaatatataaaaaaatgatcaactttactcttagataaatccatgtgccatttttttttttttttaggtggaccctcgctatgtttcagaggctggcctcaaactcccgggttcaggtgatcctcctgcctcagcttcctgagtagctgagattacaggcatgcaccaccacacctggctgcaatatgccattttttacctatcagattggcagagatcaaaaaggttttaatagtgcacaagtataccttagagatgttgaagattcagttccaggccaccacagtaaggcaaatatcacatcaaagcgagtcacatgaacttttggttttctggtgcatataaaagttacatttatgctatattgtagtctattaaatgtgcaatagcattatgtctaaaaaacaatgtacacaccttaacttaaaaatatttcattgcttaaaaatgctaatgatcatctgagccttcagcaaatcatatttttgctagtggagagttttgccttaatgttgatggc

SEQ ID NO: 53458 - DNA, 1589 bp, Homo sapiens
taactgcgagggaggctgggaatgcagtcgagctgtgtgcccaggaagaagaggaagaagtgagcacatagcaaactgccgcacagtgggtagaactgacaaagacagtagactgctgagcaccagtgagtacgaaggcaacagccacaggatccccctgtggccgtgtctggagacatagcacgtacttggggctttaggtgggaggactggcagaggccactccatgaacgaaaggaggctgggcaccaggggctgagtaagaactgttttgaacagaatgggagctgactcacatctggaggagggttctcaggtggggtccctcggtattgctgtaactgggtcaatctgattgtctctcttcaacctttttcaaccatggtaagcacgaatgccctaagccattgactgtaattaatgaatttctctcctatgcatctggattgtacagtctagatgtacaagttgtactatccttgggagaactaagaaaatagttgctctgacagccgggcacggtggctcacgcctgtaatcccagcacttcgggaggccaaggcaggtggatcacaaggtcaggagatcgaggccatcctggctaacacgatgaaaccccatttctagtaaaaatacaaaaaattagctgggcatggtggcacgtgcctgtagtcccagctacttgggaggctgagaatcacttgaacccgggaggcggaggttacagtgagctgagatcgtgccactgcactctagcctgggcaacagatcgagactccatcaaaaaacaaagaaaagaaaagagttgcttaggtaattgttctgtctttgtggctcagttgaggaaccctggctgagaaacccctgcctgaagagatgcaaacagcattttatatttgaggcaaatgctctagactattctctccctccccccaatctcctgcgccctgaaaggaaacaaactgatgtcatgagaaattcctttctaataacaaaaacaaatgggaggtctcccgggattgttcctatggagagacagtggttgtgtaagaatgagaaaacagtgactcctgctcagggttctggttaagtagcaggtagaatttttccaacatcattttgaatcaagagaggcaccgaaatcactgtagtaaaatcttcgagtgggaaaaatataaagaaaacaaaatccaactaaggccgtttttccccaggaaaggcattagtcaggcagccgctggagccagccacctctcaagagcctgtttttcagtgtcactgcggtgactctccatgctctgggttttaattctagcctctaatctcagtcgcttctgtgataaattaattgtaataatagaggccccagttacgaggtctgcaccgtttgcttgtaatgtgagcgacaggtttagggcctgctttatttaagatgctggggtaattacatgggagttagcatatgcaggcagagatatgattcattcttccagccacaagcatgacacagctgtttgcgggataaaataggggaaccgtgttgttacaaaatgttccccttattatacctcattaaaaacaaggctgtg

SEQ ID NO: 53459 - DNA, 1038 bp, Homo sapiens
caccctattgaccctgcctgcctttcatgtcccccaccccatctcacctaacttctttcctaatgtagcttagattatcttctagtaattgtctccctgaatctcaccatcagagcttccctttctgctggaagctctgatgcacacaaacgtgcaaaaatatttaccatctattttaaaagccttccatttccccctgtagctacctctccatttctctgttcccctttaggtcaccccctctcctttcattctcaggtgaaccctcactagtcagatttttccctatccttcctgtgaaatggcttttgtccaggtcactagtgacctccctattgccaaatccaacagccagtcctcagtgcatatcatactcaatctgtcactcccgtcttctagaaacactttcctcactccgcttctaggacacaccctctgttggttctccttcttcctcactgcttgttcctcttgctggttcctcctcctttcagtgatgctaaactttggagtacccttgacttagtcctcagatttcccttctcctttatccgcactaccttcccaggtgatccctccagggcttcataccagctccatggtgactcccaaatttatatctctagcctagacctctcccctgaactacaaattcaccaactccactgcttactggacatctccaattggatgtctaacaggcagctcaaatgttaagtccaaaactgaactccttattctaactgcacaggatcaaatgattatgtcctttatctctaccctgcccgtcaatagccactccagtcttccagttggatcaggccaaaacattgaagttatcctggactctggtctcccacaccattcatactgcctatcagcaaatcctgttggttcccaaatctgacagcttctctccatctctaccacatgaccctggaccaagccactactactatctctcacctagacaatttcaacagagtccttaggttttcctgcttctacccttgttccggcccttttaatacataaatc

SEQ ID NO: 53460 - DNA, 1001 bp, Homo sapiens
taaaaggatgtggaatcctggccagtgcccagcatcacagtggtcagagagggctgggtatgcagaaggacttgggagggtggcagggttgctggtggcgggtgtggaggggtgaagggggcagagtctgccagctccttcctgatagtgggagagagcgatggtcttcagtggccagtgggactcttcctcttctcttcggtccatcacaccaaggcaggaaggccactggcactggccgccatgtgccatacacatatttcccttgtctgcacaggagtggagtgagggcaggggtggggtgagggcctctccactcggggcagccttttggtttgccagaagtggatcctcctggccttcatctgtttgcccctgggggtcatctatcagcctccagcaataccctgcaggccggatggcccaagccaagtgaaacctcttccctgtagcagaaagcaggtccagcatctcccaaaacgggcgctctgactggctgggcttcttcgatgttcagagagcttggccaaagcacgaacactggagtaggagccagaagtcctgtggtcttgtctgagcttccccactgacttgcccggtgtggtaaattcatagacacagaagttccttggaaacgttctgcctcggtttcatctgtaaaatgagggcaaaaatccctgccttatgggattattggggagatcaaaagtagctaatgagtgactacagactccagaaccaatcatagattgttgatcacggagtctcaaataacccatcatgccctcaggccaaaggccaatgactatttctgggtaagtatgagaagcaggtgggactggaggggcagctggggtggtacaatgacaaggagaagaaggaggcagagatcctccagccccatagctatcttggagcagaaaaccagtgttgctgtcctccatggggcaggcatcagggcagaccacaggctgtaacccaccttagaggaatgccttctt

SEQ ID NO: 53461 - DNA, 2365 bp, Homo sapiens
ggccaaggcaggcagatcacgaggtcagaagatcaagaccatcctggctaacacagtgaaaccccatgtctactaaaaatacaaaaattagccaggcgtggtggcgggtgcctgtagtcccagctactcgggaggctgaggcaggagaatggcgtgaacccgggaggcagagcttgcagtgagccgagattgtgccactttcctctagcctgggcaacagagcaagactccgtctaaaaaacaaaaaaaacaaaaaaaaaaaaacttaatcctgattagaaggtgaactctttgcagctagaggccatgtcttcattgtttagtaaagtgcctggcacagggtagatgctcaataaataatgaatgaacgaacaaatgaaccatgagaaactcacaggtttctaatttgaacagatgggcagaggcaccattcactgaggtagatgagggagaggaagagcagatttgttggctgggttgggaggggtggggagaaatgaaaaaagagtttagttttagaatgacatgcagagaaaggcacagttgtcaataagcgtgttgtgttttgagaacaatgagaagtttattcattcagtcatttatttatttagtcattaatcaacaaatatctatttaaagcttaatacatgtcaagcactacgctaggcactgaacatatgataataaatcagacaaagtcaagaaagggaaatggataagaaacacctattaaaatgcagagtggctcatgccattatcaaagcaagcatagggtgctgtgtgtggggcctcagaagcggaggctgcaagacttcctggggaaagtaacaccccagttgcatcctgaggaatggaggaagtaggtgctagccagactgaaagccagagaaagggtgttcgaagcagaggaagtagcatgtgcaaaagcccagcagcaaaagaaagaaaagcactcagagaactccagatggttcagcaatgtgggaatccagtgtcgagctcaaggtgctccacggacagtagtaagcggcccaagttgtgaacctccttgacccccctccctccatctctccatgtagagagaagaatagattgcacggaaagtcaagtgcaggtgtcagtcagtccctgtgactcacagtaggatgtgtgaggggaaatgaggagaaagtagggttgaaattataaccttggaccaaattgttaagagccttgtctgccataatggagggtgacttctaggggcagttggtaaccactgaaagtttttaattgggagggtggtggtgatgacatgatcagatccatatattagaaagataactcagggctagtgtgaaaaatggattagcagagacatgacaagaagggactatattttctgtcaagaaggcattcttcaaactggaaaaaaatagaatggtaagaagatgctgaagtccagcattgtgtgtgtgtgtgtgtgtgtgtgtgtgtgtgtgtgtgtgtgtgagagagagagagagagaaagagagagattgtaagaaactacatgagtctcgggctgggcgcggtggctcacgcctgtaatcccagcacttggggaggccaagaaaggcggatcacgaggtcaggagatcgagaccgtcctggctaacacagtgaaaccccgtctctactaaaaaatacaaaaaaaaattagctgggcatggtggcgggcgcctgtagtcccagctacttgggaggctgaggcaggagaatggcatgaacaggggacatggagcttgcagtgagccgagatcgcaccactgcactccagcctgggtgacagagcgagactccgtctcaaaaaaagaaaagaaactacatgactctcagttctgacgttcatgggcaacttaactccctgccatctgcctctcctgccttgggtttccctgacacattttgcctcctctgctcaaagagtcctccctgcgtcttgcccatcttaaagtaaaacttcaagttcaagccttccctactgctcttcccccagacagattgaacagtttcattctctaggctgctatatcattctggacataacaactacattataattcctgtttttctcatctgtttcctaaactagattatatactccttgaaggctaagactgtacaagtttctttgtatccccgacatcaggtattgttcatggcaaacactcagtgagtactggattggaatttataggaatgctaataaactgggatgatctaataatgtgatttgtttttgtttttgtttttgagatgaggtctcactctcttgcccaggctggagtgcagtggcgcaatcatagctagctgtaacctcaaactcctgggctcaaaggatcc

SEQ ID NO: 53462 - DNA, 1080 bp, Homo sapiens
ttcacacaccctcaaatctcccctttaaatcttcttttaatcttaacttccaagcacattactctcccctcttcctctttccctttactgataaacttgttcaaaagacatctcactcacattgcctccacttccccacctcccattcagtcagcccattcactcaatgagctctatcccacttcttcactgacattctgatcacctcttctttcttcaaagccgctcttcccttagcttctctgactcatctctttggatcttatctacttctactcctgctcattctccttccccagcttctgcttgatgtgccccttcagtatcgctgcttcccagagtacactgcttcacttctctccttacttacgcatcttcccggggtgagctcatcatgcctgtagtttcacctgccacctaaacactgatgaataccatggctgcaacttcagcctcaacctctctcctgagcttcatgcccatattccagctgccaactcactatctctccttgaatccttgcagagcacctccagactcaacatattcaatactgacatcattatattcttccaagcctgcaacttaaatgatccatcagcaccatctaaccacacaagcagaaacctagtttgacctagagtcttccctttttctttccccgttatctgtcctctttcaccaaaggaaggaggaaaggaaggaaggaaggaagggagggagggagtaaataagtaaaacttgggaagtaggagagaagtgagttccttgccttgtaccttatatcagaattaatgaattaagccaggcactatgatgtacacctgtaatctcagccactcgagatgcggagatgagagaatcgcttaagtccaggagttcaagaccagcccagaaaacataacgagaccctgtcttattttttttttaagtaatgcattaaatagatgaattaaaaatttaaatgcagggctgggtgcggtggctcacacctgtaatcccagcactttgggaggctgagatgggcagatcatctgagggcaggagttcgagaccagcctggccaacgtggtgaaaccc

SEQ ID NO: 53463 - DNA, 1075 bp, Homo sapiens
ccctgccccagcccctcccaggcccgctccagggccagccgcactgggcctcattcctggagggccctgtctctcggcagtgttgctaggtgcggtgagcccaggcgcctgccaccggctggccaaggctctgcctggagaccatcggagagctgggaagaaggagctgcattatttggttgatccctccctccctcccccagcctcagcacagtgagctttccggagggatggttctgagccagcccatccccaggccttcctctttgtgcagagacctccccgtcagaccccccaccttcgccggctaccccctcccccttccctccggttgagcagagccagagttaagcctggggttaatgcccagtgacacctgcaggttggctagtgttgttgacatggggctggggggaggggagggggtgatgggggagatcgttggtggctttattatggagaactcagcaggcctggggccttctattgtccaagtggcaaataaataaataggagaaagtaagtcttccccatggcttaccgacgggaggttaacagctggacatgacatgacaaattgggcatttttctttggggactgatccttacagcagctagcagggagaatgagagagagagagggagggggaagtagagagagcaaaagcaagccggagcacggaaggggctagtcacagaagtcaacgtggaagccgtgtgtgcatgtacaagagtacgtgaccggggtgtacaggaaacattgcatcatgttttgggcattaaaaaaaaatacatgcaagcatttcacatgtaacgacttcaggagtcaatcccagaaccccaaaagctgggtatctggctgtggggggagatatctctgggatctgccttcttgaacccctcccccgtcctgccaaatggaaaaaccaaaaggtcaacgccagctctgatcccaaagaatctccttcctccagatgagtgggattactgggcagtggcgagtggtggagcaagcagcctatctccagcctgggcccggggtgagaactcttgcattatgcccagttgcccggaa

SEQ ID NO: 53464 - DNA, 1039 bp, Homo sapiens
gacccctcgctggcaccccaaagctgggacttctgagccagctctgcccctgcatttccctccacccatgtctggttagtctcaaatccctctcccacatccactctcctctccagcccacctgctatggacaactgcattgctacagcagcctctccaggcgcctcctggcggtcctctctcacctgccccagtcccagagtcatacccctcaaggcagatgacactaaggaggggttcagcaagtaaataagcaaaggaagagaaggaagcagggcagaaagaagggagaagaaaaccaaggtgttcatgttgtcacacattgagagggatgcttcctccagggtgcctggcacattaggccctgggaatctgtggacacgagagcccccaggatgggaaaaggcattgccaacagccctgtgagacagagctgaagtgaagatgtctccttgtgtgtgtcacaaaaatgcaactggaccaagccttccccattttaaaaaacacattctttaaaccctcctcactccttgagcttctgtccccttcactgcctcactgctcaaaggcttttttatatttaaccacttccattctctccactggctcatttctgccacagtccttacctctttggtgaatctgttctcctaaagattgttcatccacatctccaagtccatgttggtgttcacccttcttaacatctcttcgcctaaccctgcggtcaccctcctgaaacacttttctctctcggcatctctcataccacctcctggttctccttgcagacagctccttctctggctctttgccctcctgccaccctaaataaaagtaggtgtttcccagtgttctacctttgaccctcttctctcggtgcacactttaatctgatgagctcatccattcctgcagctgcagctattatctttatttagaggactcctgaatataaagctccaaatctgacctcgtgctgctctggtcccatttttccaactgcctggtgaatatcttcagcgctttgtccaataga

SEQ ID NO: 53465 - DNA, 1048 bp, Homo sapiens
agagagaagacggtgaggatgcctaggattctggcttaagggcctgggacaatagcggtactgttcgtggtagagagaaaatgaaggaaagagaacaagttgcgagttgatgtgtgcgggtgctgggggtaataagactgtgttaagagtctgggttgagatactcagtatgcagtaggtagatgggcctagagcagctataccaaagaccacttcaagatctcatgactggataactgagaggatgacaatgtcatcaacagaaataatgaccgctgaaggtgaattatcatgggagttggggctacatggcggattgaattttgagatgtctattggacaaagcgctgaagatattcaccaggcagttggaaaaatgggaccagagcagcacgaggtcagatttggagctttatattcaggagtcctctaaataaagataatagctgcagctgcaggaatggatgagctcatcagattaaagtgtgcaccgagagaagagggtcaaaggtagaacactgggaaacacctacttttatttagggtggcaggagggcaaagagccagagaaggagctgtctgcaaggagaaccaggaggtggtatgagagatgccgagagagaaaagtgtttcaggagggtgaccgcagggttaggcgaagagatgttaagaagggtgaacaccaacatggacttggagatgtggatgaacaatctttaggagaacagattcaccaaagaggtaaggactgtggcagaaatgagccagtggagagaatggaagtggttaaatataaaaaagcctttgagcagtgaggcagtgaaggggacagaagctcaaggagtgaggagggtttaaagaatgtgttttttaaaatggggaaggcttggtccagttgcatttttgtgacacacacaaggagacatcttcacttcagctctgtctcacagggctgttggcaatgccttttcccatcctgggggctctcgtgtccacagattcccagggcctaatgtgccaggcaccctggaggaagcatccctctcaa

SEQ ID NO: 53466 - DNA, 1114 bp, Homo sapiens
aataaaccaatgaaatctgagaaaacaatgtcctgctacttctcttcagagctactgcccaccccctactcagggcgaaggtgggtctgtctgccagctaagatgctggtgtgggattctccccatccctggctggagacccctcattcaggcggcccctgcagcttggcgtgtttacctaacgtggtgaacacatgctctctctggaggatcattgttttccctctgaggcccttcagtcacactggagtcccccagttaagaagcagcaggaggaaggggaggaaggggtcactagaatggggaagcagaactgggagggaagagacatcaggctgatcacgctgggcaaggagggaagagagagagggagttccaaggcttcaggacctgctggctggtgaacacctcttactgttggaaacaccaggattctaggaatgatgggttgcgagcaagagactatcactcttggaattcaccctttttgagaaccacagaaaaggtggagagagaaaaattccccttggtgataaaagttcctcatgtgcgctctgcctccttcgcttaaacttgaccttcacttagcaattgttcagagagcctcctatatgcaaggcattgtgctagggactggggctaatgaaatgaatagttgggaaagatggccttgtatatcaacattgcaatgctacatcatagctgtttttgtttgtttgtttgtttttcccgagacagagtctctcactctgttgcccaggctggagtgcactggtgtgatcttggctcactgcagcctccatctcctgggttcaagtgattctcgtgtctcagcctcctgagtacctggggttataggcatgtgtcaccatacctggttaatttttgtatttttagtagagacagagtttaaccacattgcccaggctggtctggaactgatctgcccgccttggcctcccaaagtgctgggattacaagcataagccaccacgcccggccaatcatagctgttttgagagtgtcaagaactaagtacagtagttgcttactagaaagaaagggtttccacttatgtttggaggggttagggaagacagcatctctgagctgg

SEQ ID NO: 53467 - DNA, 1035 bp, Homo sapiens
tctgtccaccccacaagagtaggataggtgccacttttgtgtatttccacagcactcctcatacccactcttctaataaggttatcttcttgtaattgcctccctgcttgtcggtctctccaacaaaattgtgttcttagtgacatcaggattatattttgtttattgcttgtggtatccatggtgactagcatagtatcttgaacatgataagtgccctacaaatatttgctgagtataagaatgaatgaatgaatgaatgaatgaatgaatgaatgaatgcttcatggcatccagctacccagtcctgacattctctgagtctcagtttctctctcactaaaaacgagatgacttctttttcattgttgtactctctgcaaacctgtagaaatgaacccctagtggctatgagaagctgcctaggccaagggcgtgggattcaattgctgtttggtttctctacactctgcccatcaacaggaggaggcacttagtattgaaagactcatggtagacaaagtaggataagactgatgaaaactttctggaataaatatatggtccagttagtgtcccatctctgagaatgcctgctatactagtcagtgttctagcaagaaacagaggcccacgaatggggtaacaaaggaaagtttaaggaaaggacgatttataaagagaaggtgaagtacttcagagctagcaacgacaggggagctgttactacccctgggattgaaggagcatataccagcacccaggaagaactgcggctatgaccacggctgcaggaggagctgtgactttcaggaaaggaatgctaacccttggctggcagagaaggagccagggcaatactcaccccaactgcttctctcctctcgttctctaatgtcctccatgtgtcaaaccccataggaatcctgaaggcaagcaagcttggttgttggggcagaagacagaaatcagctttcagggcacagaacagaatggagaagggtgatgtgtgtatctgcagaagcgaacagatat

SEQ ID NO: 53468 - DNA, 1377 bp, Homo sapiens
gagatggagtctcgctctgtcacccaggctggagtgcagtggcatgatcttggctcactgcaagctccgcctcccgggttcacgccattctcctgcctcagcctctggagtagctgggactacaggcgcctgccaccatgcctagctaattttttctattttttagtagagacagggtttcaccgtgttagccaggatggtctcgatctcctgacctcatgattcgcctgcctcggcctcccaaagtgctgagattacaggcgtgagccaccgcgcctggcctgaatgtaccaatttatttttacctctgtgactgggcatatagctttccctttgcttagaatgtcttctatgccttcatctgcctgttgaactcctactaatctttcaagacccagctaaagtgatacacccttcttgaagccttccttgatgtcgttaattgtctcctcctttgtgcccctacccagaatgtatttctatcaccacatcattttctaattatctgtccacatgtttttctccccaccagactatgtgcttcttttgtgtgtgtgtttgagatggagtctctctgtgtcgcccaggctggagtgcagtggcacaatctcggtacactgcaacttccgcctcccaggttcaagcaattcttgtacctcagcctcccaagtagctgggattacaggcgtgcatcaccacacctggctaatttttgttttttcagtagagacaggtttcaccaagttggccaggctggtctcgaactcctgacttcaagtgatccatcagcctcagcctcccaaagtgctgagattacaggtgtgagccaccacacccagtgctatgtgcttcttaaagaaaggtagtgtatttccttagctttagcacagtgcctggcacatcaaacatgctccctagtcaattaatgatgacctgaatgaacaaatgacacccctctctacctgctgtcctctggtaaacctgccctctttttaatgcaactccctcagactggctggacctatttagggtatctccttccctctcttgccttttcctgtctgctcttcctgttctttttttttttgacagagtctggctctgtcacccaggctggagtgcagtggcatgatcttggctcactgcaagctccgcctcccgggttcatgccattctcctgcctcagtctccctagtagctgggactacaggcgcctgcaccacgccctgctaattttttccattttttagtagagacggggtttcactgtgttagccaggatggtctcaatctcctgaccttgtgatccaccagcctcggcctcccaaagttctgggattacaggcgtaagccaccgcgcccggcctcttcctgttc

SEQ ID NO: 53469 - DNA, 1055 bp, Homo sapiens
agagagactccatctgaagaaaaaaaaaaaagataaatcagattatattactgctctgctcctaacttttccagaccttcctatcacacagaataaaatccagtgtcctcttcccaacctacaagaccctacagtctggcccctcttccatctgctctctctaccacggccacattatccccatcgttccttgaatacactgagtaccttccccatcagagcctttgaacttatttcctctacctgaaacactcctccttcgcagatcctcatgactctcttcttcatttcactcagatatctgctcaaatgtcacttcttcagagaggcctttcctggccacctgctgtcactctcagcatctccttaccctgctcattttccttcattttgcgtgtgcctacctgacatgccactgtgtctttatttgttggttgcctactccagcagtagaaagtaagttctacattcactgttagatttctagctcctggaacatggtaggtgcttaataaatttcttgaataaatgaatgaatgtttgctctgcttttgtctgcacatgttctatcagggtgatctcatgatcttccatgtaaatgctacaccatatgccagcagcttctaaatcttaacttcaatccaaatcaatctcctgagcttccaactcactttccagccacctacaggacatctccccatgtgtcgtatgtctaacacacatatgtccaaaatggaacataccatttttctcccttctttagctcccatttcattaaatggcaccacaatcttaaatgcccatccagaaacctgagattattacccctcttcctttctcagacctccatctaatcaatccctaaattccgttcatcctacccttaaatagctctcagatcagtccacttccctccatttccaaggctcctagcctagtccaggccacattgccatctctcaccccagtgactgggacagcctccagctggtctccctgcctccggtccttcctctacaggatgttttatggttaatctaaaacataaatcctgg

SEQ ID NO: 53470 - DNA, 1016 bp, Homo sapiens
ttccagaagcagatatatatatatatatacttatacaaagattcattattcatgtgagaaacatttattgaggctctaatctctgcaggttctattctaggctccgtgtacccagaagtaagcagcacagtccttgcccttggcttctcgcaaagtaatcagtgaatgaatgggatgaagcctcacttctcccactgacaattttagcttcattttcatagctgttcaaacagatactagaaatctgtgccctctctgtttatgaagttcagcatgtcccagcttttctaacctgtccctattccaaatgttttgacctattgccataccatgtagtcacactggattctaatttttgatttagaaaatgtggtcattactggattatttcgagaatcaaaagaatcaaagaacatcacttctgtgatgtgctaagtgctctatcagtagaaggcattattcaaaactggcttagactagagaggcaggttcagccacttctttctttgtgcattcagggtaacctgtacgtccttccttcccagcaccaatctcctttctttttaatgtgttttaaggtatgtgcctctcattccaaattgtatctgacacagggcctggcacgcagtctaatttctcagtaaagatttattgaatttctgaatggatggataaatggtgggggcatagacaagtagacagcaaattatgatttaagacagaatgaaatgataattaccaccactaacattttttgaggacttactatatacaaatccaatgctagttcctttacatgcattctctcacatcattctcacagctacaacatgaggtacatagcatcgtgtctcttccagatgaggaaacagaggctcagagaggttaaatgacttgcccaagacaccaaggtcacctgaagacctgggaactccagctcgagcagcccaggctgctcaccctgacctagccagagggttacaggaaatgtcctttggcccttagattgtccctcc

SEQ ID NO: 53471 - DNA, 1051 bp, Homo sapiens
ccactgctgggctcagtgatactctcacctcagcctcctgggtagctacaggcacacaccaccatgcccagctaactttttgtagagatagggttgtgtcatgttgcccaggctggtcttgaactcttgagctcaagcagtccgtccacctcggcctcccaaagtgctgggattacagatgtgagccaccgcgcctgaccctatttattcttgaagaccacactcagacaatgcttcctctttgaagccttccctaataattaactactctctttttcatgctatgttccacatatgtctatatgtcgattattgcatacatcatataatattgcaattatttatttatctgtcttgtctgggagattctgagctctttgttttatttatttatttaatttttttactgctccttgtggagcagggctaccccgtaggcagtgtgcccagagtagctgatgctgagcttcttgagggcagagagattctctgattcatcctggaacactcaagaccctaggcatacagtctggcatagggtgggtattagtaactgttaaatgattcagggactaagtgaatgggagtgaaaggcctgcaggagaatgtctggaaaaaaagagagatggggtgggggaagtgtgagggtgagagaggtggggataggggaaggaaggcaattgaggcaatgccgaaaccttcttttgcttaaatgaagccttgcttcatggtcagtgagagtcagaggccctaagggtgtcaaagggtagaagctctcgaaatacagaagctccagaactgctctccttaccaaaatatcaagtggtcatagacctggtgggaaatgggtgaccagtgaccatgtgaacataaccagacagcaaaatcccatgcctagaaacactgacagacatgcacaccaggacatatggccagtcacgtgctcctagagggtccccagcagctcccctatcccagagccctcggcaggcctctctgtgggcccaagccccacccggaacccctgggctgcacgctttctctctctcac

SEQ ID NO: 53472 - DNA, 1028 bp, Homo sapiens
aggagtctgggaaggccacgtggaagaaggaaccctaggttgcatcctaaaggatgaggaagagttagccaggttgtgcaactagcccctgtcctatcctttttggttgtttagcaagcccaaagcagaaacaaataggcctattgggttccaagtgactctggaactgctgaaaatgtcacctctgccccacgggcaccggccactaccctggggtctgggcaagagggtgcacagctgttcccaggacatccctgggcaccagaagaaagcatgggccacagctaaatacatatctctcccctgcccgccctacccctacctcctcaaccagggatgcctattaatcctgacaaatgatgacttacgaacatgtaatgcaaactgattcatcatacattcaaatccgctgccccgccccagcgggaggccccagccagacaagtgtattacacggataatgtatttgacgtattaataaaaccagccgcattgctctggcccggagactggggaatgccaatatacgatgacagatcacatattgatgaaatccagatgtttggaatcatagtcttggggcctcgttcatattgactgaaggtaaaaaatgccatctgtcagcatgttaactcttgctgtcccatactcagcagaggcgccaatcatagttttaagagaaggaggaagggactgagtgaggggagagtggatgagtaattaggtggtttggatggatgacaggtggatgaactggagggtagatggttgtgctatgtataagatgagtggatgggatgcttttcatgccttatgtccttgacctctcaacagcatttgaccttactgaggacagtagagtccttgcaactcttcctttcttggcttcaatgacatcacactttccttgttttcattctacctcttggctgttccttcttagtccttgatgccttaaacttcctctaactgtaaacgaaggttctgttccagacactcttcctagtgtattctctctccctaggtga

SEQ ID NO: 53473 - DNA, 1010 bp, Homo sapiens
gaggccttagcacaatgacatttgtatcaagaactcctcaaagatggccatggacacagtgggtactacttacccaaaggtggttttgaggggatggatacatggggagaaccaaaccctcactcactgagtatccccttccccattcctcggtagaagactgcatcctttttcccataattattcagaacaggaggccacccctagcccattttatagggagtgaggaatgactatggaagatttgggaatgggtggaatcagtgaaggagagtgtttggagagattagagcaaaggccaaggtgagaatctgagggactcctgcacttggtgtcaagataaggtccaggaggcagggaaggagacagaggaggaacactcagtgagttaagaggggcacaggagagcatggtatctcaggatcctaaggaagaaagtttctaaatgtatcaggtggtcagcagtcaaacagggaaagactggagaaggggcccgttgtatttagaagtctggcagtgactggtgacctctaagagggcagttttgggaaaggagccagagtgacaagtatcacttccatggggtagacccaaataccctgcaagcctttcaaaggtataggaatggatcgtgtaccttcgtttagaaaactgctcacctgcagcaagctgggagaggaggagcagagcacctagccctgccttgggtgggtataggccttggccaaggagtcaaagccccaaagagaaaggggaggctgggggtgccaggcagctgcagactcacagaggtagcgagctacactcactgagtgtggcccagcctgcagcatttaatggtgtggttcaggaaagtcagagacaagcttccaagtcggccaccacaggtgacagctgacacctgagcatggctggcagggctggggacttggacatcagtgaggcctgtgttctaaggacaaacccctggcagacacagtctacctccgtccctagctccccacatatac

SEQ ID NO: 53474 - DNA, 1063 bp, Homo sapiens
gtgtgtagtgtggaggatgggttgcagagagagaagctagagaccaaaagatgagacgggaacagctgcaaatttcgagagctcgtaagattatgtatgactggagcacaacgacaaccaaggtaggtacaaccatggaagaacaactcagggctgacttgcctttgcccagtgccatgctgggctctgggttcacccaaataattcacacacggccccaaccctgaagtggtcagtccactgataaaaacttcacaagcgatgataacggcgcagagatgaatgtactcttacacaaggcaaagctatttttcagttagacctggaaggatgagtaggagatacagaggtggagatgagaaaattagcgacctttcaatgtacactttcaggatctagaaaaggattgagtgtgagggatggagaaagtggggtccaggacgactctcaactttcttctgtgggcacacctgagtagatagtggcttcctcttatgaacagggaacccaagaggaaggcctctgtttggaggatactgagttccatgttggccatgttggccgtgtgggtatgcagtgcctatgggagctccaggggccgtgcagcagacagctgacatgttgggagtcctctgataacagaactggatggcctaggggttgggcggggatcgcccacaggcgatagggaattcggacgccttgtcccctgtaaagcacccaacgcgatgcctctgccctaagggcagccgcgagaaaggcaggcacaggaggcgggagccggggccgggcgatggggcggaaggagccccgcagcgggaggggtcgtggagtggggtggaaggacttcgcagccgctaaagattgggtgggtaggcttcacgggcggtgggagggaccccggggaggcttctgccggttgctacccgagtacaaacggcagcttcctggtctctgtccggccgcccccgccgcattgtgaactttcacccccagcgcgcgacggcggcagatcacgtgattagggccaacatggccgccgccgccgcttggagctgaagtg

SEQ ID NO: 53475 - DNA, 2017 bp, Homo sapiens
gcccggagcggccggaggagcagaggggccggcgggagggaggaagtaggtttgtttacgggctgtttggggcggagcagctttggtcgggggtccggtgctggggcgggggccaggactgcaggccgcgcctgacgctctcttttcttttcttgcatctgcccgcgatcttctcccagacctttctgcgagtacgagccaaccggcagacccgactgaatggtgagtcctgcccggcccctccctccgccccacccccggcctcctccctccctccctcactgcctgccgctcctggcttgcctgggtctcttcgactctggggcccgttggcttcttcgcagtcacggcgcctgagtatgtgcaaaccaaagctgccgctctcagtttccccgtctgtctaatggaggtatggcgcccagctcttgcccaaacctctctaaaggccctgaagaaccctgggggggcaataagtgccggagaatgaggaacgagctacacaattctactcgggagctcagctttgaatttgcaaactgctgggacctcactatacaaacctgcagggcgctgagaatgtttttcttccagtttttaatcagtgcccagtagtgtgaatacagcccctctgctgagacttgacaatacagtgagatctggagttcccacggcaacaggaactaactcatcccagggctctttgagttatcagtcggcccacatttcacaaaggtgatcagcgtgggctcgacagctcttagaggccttctctgaaagcaggccgtgtatgcactacctagcagccccccttttggattcaaacctctggagcattcctgtttgctgaatacaattgaatgatcctagctttttgtgcttactggggtgtggtatctggggggtggctgtaaggggtttagggtctctgggtcagctggtaagtgagagaggccatggagttcaagatccccagctcttatcacttggtttctgctgccaggctgagccctagtctggaaaagggagaaattcatgatgggctggcgccatgttaagcaccattctcacaacgcctctgagaagagtattacacaccttttgtgaataagaaaacaggctctgagaggtgaaagtggtttgtttaaaagtacacagctgggatgtaactgagccatgattcaattgaagtttgtttcccaccaaagcccgtgtttctccaaccatgccatgctacctccttggcaaatgctttgattcttcctactcgtacgtagcctctggatagagaacagaactttccctaccacactttggtaagcttaattcaggatttagaagatgaatgggaaggtgaaaaccaaacctgccttccttctctgagaatttgcagatgaagcccagtccattggggtgctttccagggacaacaagggatcatctgctggcctgtgtgtcctgagcaaggagcgcatccagtattgtgcctttcttgaccattccatgagattcgtttccttagtcattgaacattgtggtatcatcagcaccttcttccccagggaggcattcccttggtgtaggcatggtagggaggaagctttgtgttggcacactgctccttactacacttctagaactctcagggtcctttgctcaatgcctttctgatgtttcacgtccattctccatcccagccctggctctagagtgtcaaggctacctaagtctgagattccaagagttagggcagccaaaatgaagagttctcgatctgtgtccacaaagtcaagtgaggcactaggacacagtcatgtcacctatagtgaagacacaggaaagtgaagagatggactgggctacagaccaagtttcctcaaactccatgcccagttctggcaggatggtagctttccttttggtttgggtctttctggggttgctctgttttggagttggagtagctccctgcctcaggctcacaacaggcaggagctggagccctagcacactcactggg

SEQ ID NO: 53476 - DNA, 2595 bp, Homo sapiens
ttgggtttcttcatctgttaaaatgggataatgcaatctagcttcagcaagtggtagtaaatgagctaccttgggtaaggtacttggctgtgagcctgacacacggtagaagcttaaattgtaacatagcagctctcacctgtgttcccctcctagattgcattcatgagcttcccgttagggtcactgtccatgagaaagttcttcctggccctgctttggggaacctttccctcctttgctggctctccccactccccatcagtctggtcccagagtagccatctctgatcctgctgtggcattctggaagggactagagggaagagagtttcttgttttgaccccttcctgcttcagtgacaggagggctacagagagggattagtgagctaattagaaatgattgcattgctcagcattaattagcagtgttgtgggcttgcagtgtgcactttggaactgagccccctgtgggacaacatggcaggcagccctctgcctccagggcctgccagcccctctgtactgattagaaatgatggaacaggttcgggtgggcacaataagggctgccttctcagggttccctgagccttctgacctggctgccaaaggtctgacccagaccgtcttacctttatgactgggcctcagtctcctcttctgtgaaatgggattagtggacctcagagaaattcttcctgataagattctaggtgggatgctaggagctgtacctcagggctcttggcccaggaaccaaagaggatttagctgatgagtgaacagcaggccaagtcaggccatcggaggggttaggttctagtcaagagatgctctttagagttgtatttcctgacaccaaaagagttcatggtcttggccttctggagagatacctagcaacatggagtgtctttgctcactggatttttattaaacactgcaaatagaaaggtatgggtagaccttgcaccagctgcagccaaagagtggacttactcactggcttagttagcaccagtctcctccccaggtgctcttggcaaagcccagtccccaaaggagcaggaggtatttcaagatgagggccagatcaggcactgaataaaaaggccaatggctggcaagaggtcaggatgtgtcagctccactgggaccctgggggctgcagtgaccgtctgcttgttctgtgctttgttttcggtttccccgtgcagctcggattgggaaaatgaaacggaggaagcaagatgaagggcaggtatgtcccctgtgcaaccgccccctggcaggatcggagcaggagatgagtaggcatgtggagcattgcctttctaaggtagaggggccatcaccacccaccttccttccccgctcccttcccccgacactagctgctgactgcccctgaatctgtgggctcttggggtctccatgtggtctcagcagcttcttcccttctgaccactgctctctccttttgctttcactctcactcattccctccttgggctccagcggaaaactattgggaagaggcccaggtctttgacctctaaattggtttgcttcaaaggagccctagagctgagggcccacttggcacaccacagctggggctagagctgtgccttcgttgcagactgtggggagcaggtggggatggcctgggcccagcatgatcctgctctgctcttcacagagggaaggctcctgcatggctgaggatgatgctgtggacatcgagcatgagaacaacaaccgctttgaggagtatgagtggtgtggacagaagcggatacgggccaccactctcctggaaggtggcttccgaggtacaagcagctgacacgtagacattggcactctggtgccaggcctctgctgggtatccatctgctggaagccaagaggccgaggctggtggctggtcatccatccgttccaccacgtggggactgctgctggtggggctcctttgtgaccgtgctgcctgcctgtgatgtgcatattaaaatggatgtatttgggtggggaaatggaattgtgaggctgcaagctaggagtgacgaaggggggctctcagcttcgggtgatgcattgaaggtgacagccaagccgcgttagcacctgcataaaatattaaagggacggttatgcatttatcactccatccctcttaaggctgataaatgagaatccagcaacctgctgtacacctccagcactgggggccctgagggcttccaggcaaacacattggattttcctcctcctcctcttcagccctatgtcagggaaatcagttacagaggagagtgagttatggcaaaatttgacctcccatgagcttcattggtgaatctaattttagctctgatcccatcccttctccctgggcgccctctgccctgaagcaagaggggcctgggcccagctgctccctccttcccttgggctctccccagttgctacaaaggagtgtgcagggccctgcccatctccagtgccctcccagctccttggaagagcaaggcttgacaccccccaccaggtcagacagcagaattggttgggtgcccagggtta

SEQ ID NO: 53477 - DNA, 1347 bp, Homo sapiens
acagctggtactgcagcttgtggtcattaagtgagccaatctgcttcccgtctgcctctctctctgggcaacacctttgggaatactgctgtgtatggtccctggggaatctcacagcagctgggaagaagttctctgccttcgtggggccgtgctacctgggcagatgctgaggagtggtctctgcagggccgtccagtgcagactggttccacgaaggggctaagagcccagatgagacattatgcctctgggcgtctctcacattacccaggtgtttgggggcaagccaaaacataaatcaggaaggttagtcagaccaaacagtctccctgagccggagctggagagtgttagtttgccatttcactcatcccgtactggagccttcgagtatctgaggccctagaagagtgagcagcagggctgacgactgtcccatgagttggacacatgggtgtccgatggcagccacacagggtcagtttcaacgtgctgctctggttagctctgttggcagctgcaactgctcacatcctccattgctgtggcaccttcttaggttccttggcacagacctggacctgatggcttctgggcaccagacagggcttatggaggataaagctgcaaagggcctgctgatttgacaagagtatttcccctgtgccgggatgcacttgcacagcagtgtgaggggctcttaggccccgggcgggtatccgttttccctgagtgtttacactgtgaggttgttcctttcaagaattcctgaggggagttcaaagggggcttttctttgagcgatttggagagcgagaatgagagtgagacttgaagagggaacaggggccggaggtgcctttatctgcagagaattgctccagctttcctgatagaagctgctgccgcctcttaaacagcttagtgcagtcaaaagacaggcagacttgaaaggctgttttacagcgagatcagcgggggccacgaggcagagagcggggcgcagtggagcggaggaggctgaggctcctcagtgggggggctatcaaagggaggccctggctgatccctactgcctctgcccccaaaaccctgtctgcaaaagctggccatctgtcagcctaccctccctggccaggactgataggccctaactcttggggggttgggtgtggcctcgccaggcgggctggtgtcagtgcagcgcattgatcgcccgccgggcgggccgggctgcaagccgggcagcgcgtgcttaatgtgattgaaaggcagttaaaatggcggtgaccttttcaggaggaattagattgcctgccaagaccggttagagggagtgataac

SEQ ID NO: 53478 - DNA, 1979 bp, Homo sapiens
ggattgatattttaggacaaaataaagaagcagacagagcaggtgagcactgaggtaggtcccactggaaacagatttttgaaaagactaaaggaaataggtattacttcaagaaagtaagttggaaggaatttttgctgcctaggaggcactctgaccttcccaattctagaagaaatacttaagctgtgtgtctaagttgttgattgtcctttcagaaccatagattttctaacctgctactgctctttacataaaggacagcacacagagcctagtgcgccaccaacattccactaaaagagatccgcagttagggagaaaagatgtttttcttgggtaccatgccaaacctgggcagagcaaggggcttctaggctagagaagcagactacaggggaacctaactatacagcccttaagacaagcctgcttccacctgtagtctaaggaggtgtgtgactaaggagccatgcctttcctctcctgtcctccatccagctcctggatcctggagaagagacctatagtggtgaaccatggtccctcctgtgtgttggttgccagtgagagttcacccaactgcattggggagcccagagctcctcacatctggaagggacatgctggaaagaggacatgggaatgattggtttcaaataaggtggcaatgatgtgggcacaagagtggtgagatggagaaatttcccaggaagcttcacaggaaatggaagcctgcagctgtatctttaagccctggcggtgactgcgttgctaaaatccagcatgaagcccctctgaaccaaacaggaggagtgggtagggaaaagaagggtgttaagacagtcagcagtgcagggtctttgtcctgctcaggtcctggcctgaagcgtttcttatctttcatgagttccttacatttaagccggttccaagtagctggatgagaagtcatgaagcaaacaggcagagcagctgtggcacaaatcttttctcttcttttcttttcttttcctttttatttatttatttttgagacagagtctcactttttcacccaggctggaggctagagtgcagtggcacgatttcggctcactgcaacctccacctcctgggttcgagagattctcctgcctcagcctcccgagtagctgggattacaggcatgtgccactacaaccagctaatttttgtatttttagtagagacggggtttcaccatgttggccaggctggtcttgaactcctgacctcaggtgatccacccacctcggcctcccaaagtgctgggattacaggtatgagccaccacacccggcctggcacaaatcttttatctggctatttcttgataaaacttcagcgccagaagtatggggcaagggggtaagaggtgttgtaagccccagggcatgggcacataggccttgccctagctgctgccttctttggtgtgctagttctcaaaagaagggagccccaggtgctaaaaatgtcccccagtgcagctctgctgttggtccagccagtgacaggtgttggaacagcacactgctggaggcggtcttggagtggagagggttgggctgctgccttgtgactccctaccatctttagttctctctgtcgcctgttgggaggggtgaggagaggtggcaaggagcaaggcaccttctgtcccccgtggcaactgatgggatttaatcgccttttggaacacaattgttaagctaggacagagggagtgcaggcagaaggagcaagtatcaatggttttaaacggcgtctgtctctctgcgtctctcctgacgtgaggcagtgaaacgcgttatcgaggaggcccggaaagtggctaagtgcgtttgacacacgccaactccctgcctccacactggataattgcattgtcaactgttcagcgaggtggcaggtgacactgcaggccgattgattgtcccgcatcgcagctccccaga

SEQ ID NO: 53479 - DNA, 1711 bp, Homo sapiens
tcatctgatcaattgattaaattaacactgattttttttttctcccttctcaataacccaggaagaaatgagtttatgggagaagggtcgtttttataaaacgtagacctgtgtttcatttctgcacttaactctctccctctttgttgctcagttttcactgtgaggagaaggatatttttttttgcactacccaccccgccaggaatggacaactctggcaccaccctgctgggtatcattgaccatcaggcttaggttgcctatgggtgggggctcaggcctttatgccactttaagctggggcagaactgtagcaagaggccctccctggtgactgaagggtactctgggccatcttggaggtcctgggggctgagttccttccctagatagcagtagtaggagtggcagcttgcctgttatcgctggagctacatggaagaggagccagagacttggaaaggagctgtctgtgccatcttgcctctgagtactggcttgggatattccagcagctgagaacatcaaacgactgtggagccttcctctccaagcgggagggggggcaagctggcgggggcgctgtctgcataaaacggctttatggccgtttctttttattatgattctgccagaagtcagcaagtgacatttcattaagaaaataaagtttaatgtgctgggaaagaggttggagcaggctggggcagcacaagagtgaaattggcagcagcagcctgttctgaacacctgtgggggtagggagaggttcccaacatctgtctcagctggaggatggggtcagggtcagagtgaatggctcagaccagaggcagaggccttttctttggcaaacaaagtgtgtcgtgctgtccatcctgcctcactggccagcggaacagaaagctgctgcccggctgggagctgggatctgataaggaaagttgtatcctgagagatttctctaggccaccagctaactaggacctaatagagcagtgtcgccagtgtttagccagtactgctggggtgtgctgtgtggcaccagccatcagcctggccagctctgctgggtgatgctgagatcacaacagtgagtcaaacttgggacccttgcagcttccactctggtgagggacagtgacaataggtggtaataaatatgattttggagttacacaggattctgggtggacaccagggaagggacacctgtgtataagaacgtgggaagccccatctgccacgcagagcaccatgaggatagggatcagatcttgaagctctctattctcaacatggagccaaacagaggatgagcccaataaaggttgaaagaatggcattgaggtgagagttctttcctttagcagggatttagagagcagctgctctgtgtgggcactgtgagttaatggtaggaggcatggttgggctgagtcagacttgccaaaggagcaggcatgtatattgtagaccaggagggagaaggttctaggcagagagcaggaggtgcggaggcatgggggcatgagaaagcacaggatttgggagaccacagtagctctgtttaatggagtatgagtcctgggccaggcatggtgggcagtaagactacagagaaaaggacttcaggctacagggctgctttctgcgttgagaagctggggcttttcctggcagctttggggtaccctgttttctctgc

SEQ ID NO: 53480 - DNA, 1979 bp, Homo sapiens
tgatggtggagtttgtctcccaaactgtcagagggtttatggaggtgccactcacccacaaggcgggaattgcttgtcaggacacctggccgtgtacaggagacagagctgtaacttggtgttttctcagcttaatggccctgctgctgacctgacctgcctgctgcctcaagtgtgtcagtgcctcagggtagagggcaaatgaggactgtcagggagaggtggattgcaggctgtgcctggcatctttccttcccgatgctgcttgcctttgggattggtggtgtctttgtgagaccagagactggtggggtagaagggagaaggatcaagactcagtgtttttcagggcttgaaaaatggagaacattccagatggagtgaatagcatgagcaggggtcttaagagcagcatatacaggctatgtttgtggtttggtgagcagcctgtgtgtgcacatgcttggggtttacagagtgaattagtagagagcaagagtaaagacataaatggacccagatcttcatggatctggctgaggagcctgggcttggttgtgcatgcagtggggagccatcaatggttttggagcaggaggaaaggtggtcagaactcagtggtaagcagaatgaaggaacagataagaggcctgaggactccctacaagacataccctaatgagagtataaggacctgagaggaaagagtggacaagcagaaatgtctgaaatcatcaggcagatactaagctgcttcctcacttctttaaggatttccttgctgatcccagtagccacagagtctcacattcttttgtccctggcagggctgtgctggctagtgaggtgtggtctgagacccactaggaggaagtggggagctggggggaacagctctatagcacttgaccctaggctatcaggaagggtggtcctggatgtcagagagatcgcctggcaggtgagcaggcctggtgtagccccagcagctcgcccctccctctgagctgagagtccgtctgtggctgtgccagatgcacctcaggggtcagccacttgcgtggcccatggcctggcctccgctcagcctggttgccttcatggactgctttgagaagtaggtgtgcatgcctgtcctccctcgtctgtcccttcttaatccctttataactgcacttgtccaggaatctgggctgagtgaggtggagatgaataattaatgtcaggcgcttcagacaccaaatatttgaacagctgcctggtgtttttgctggcaaggacctagcggccaaaatcaggatgttggccgggggtcccactctgtggctctgattggccttagccagcctgttctctcctctgatggacttgtcaggctggataatggggcataggggaggccccactcttttcctgtgaaattcctagacctgaatttttctgtcctcttactgttcttcctagacctggaagataggtggacagcaggcctgggctgagtgtccccgaggacgtgacataatatatgaatgggctagtttatgagcagagaccacttggagcagcatgcagtagcagagaaagatgaggtttgcagagtgaagggcctgaaatgtcagggtcaggggcactgaagtatctggctctatacatcccaggcccaggtttccctctgggccttatcaggtccaaagcctaacccctacctggaggcaacaggaggggcacccttggcctcgtcttgtccccaggccctcctcacaccctgcttcccacaggctctggcttcatcatgtgcagcggcaaagagaacccggacagtgatgctgacttggatgtggatggggatgacactctggagtatgggaagccacagtatccttggagcactatgggggctggtggggctgatagggcaggcacagggaataagaaaagtagctcttctagtattcacctgcaccaccccccgggccaga

SEQ ID NO: 53481 - DNA, 1017 bp, Homo sapiens
caaccctcatagcctgctgcaaactaggatccattgtccttgaccaccatgccagatacacagaggctgatgtcatcccctgcacaggcgaggagcctggtgaagccaaggagagagaggcacttcggggcgcagtcctaaagcaagtgtgggcacaggcttgggcgggtggagcagagaaacaggaagccctgaggcaggggttaacgcagtactgaccctcagggctgtcctgcccgccttcaggcctcactttgtttttcctccctcctttcctccagtggcggccctcccagcacgcgcatcacacctgagttctctaaatgggccagtgatggtaagtcctgccccaggttaggagtaatgggggagagggggtatccctagatggtggtgactgactcaagcccaacccctcacctgtgctgcccagtctggccggagtgtgagttgcccctctgtcccagcagagatgccatccaccagcaatggtgaaagcagcaagcaggaggccatgcagaagacctgcaagaacagcgacatcgagaagtaagtgtttggccaggagagagccctgggaccacagttcagtgggaggaggggccctttgctagcaggaaggcctgctgccagggcttctggccctcccaagtgcagctcagtgctgctgccctgggcacacggccggcagtggagcccagctggtgctaagcgtgactctgtgaattgatcactgggccacggccccagaagccttggcggtgggaggagcagtccacccgcctgcctgcctgcctgcccgcctgctgcggcggccttcgcccggggaatgtgatgtatggccgcccagcccagccggcacacttgattcatctccagtttctgtttcttaatcgggagctaaattggtttcatttttcttgtcccgggtggcactcgcagtggattttaggcaggaacattgggtatcatcacttctggtaggaatttttggcctgggttctctggcagaggaaa

SEQ ID NO: 53482 - DNA, 1030 bp, Homo sapiens
tctagttctctgatttggggtttgggagttagttctccattctggtgtaggctgcccccagctgcaggccttagtttccccatctttgacataactatataggactaggcaaattctcagcttagtccttggagtggaagggagcacagctacaaatccttgtctccttatcaggaatttacctgtaatccagatggggatggcacatatggcattgtgcaaaatgccagggaaggagcctgctgttcggaggcttgtgaggagggaagggatggtaaaggcttccagagccagagagctaaatggaagcccccagggaatcagccagtaccaggaggaaagagtcagagcctttcttggcatccctggaaagaggcaaggcagagggaatcatggaccctagggtgatggatttaagtgtccctgatacaaggacacagccactaaggagtcacgctctgtgttgctgctagctccccaaaggaaaaaggccagagattgaagttgtattgcccatgaaatgggaccactaccctccctgcactcccattaccactcacatccagcaatgacaggccacctgtaagctctcaagcttcctgagccaattgtctcccctaaactgcagaacaggtgcccccaggagactgtccttgcccaaagtccacgtcccttatgattcccccgcctcagtccagcctctgcttcctgattgagtacatctgtgaaacctgagctgttcgtacccccactcttccagcatcctcagcagcttcctgctgtccacgagataaacttcagctccttcaggtgtggcatttgaggtcctcttgcatgccatctcctttcttactgtagcactttgcctacatgtgggccttctagccagactgggctcttgggcctcttggcctctgtttctgctgttcccttggcctggagccccacctcctcctgggtgtagccagtatagtcatggtcaatcacacagttattagttgatcatggaatcagtctgccaggtttgaat

SEQ ID NO: 53483 - DNA, 1123 bp, Homo sapiens
ctggaccaaggagtgtagtggagctctctactccaagggggacattggaatgttggaagtcacaccacgagagatttgctttgagaacataaattcctctaggcgctgggagagtggaatagagatgaggggcctggaggcagaaaggctgtctggaaaaagttagtggtggaattggtggaagacatctgagagcctggactcatggtggtgaggagagatgccggagatactaggagagatgacagatttgggtggttgggaagactgcgaaggagtggttgaaaatggttccctggtatctggtgtagaaattcatccgaatgggaatggaggaatagagagggtgaggagtttagttctggaatgtggaatttgcagattcaggttatcagagaaagggggcaggcagggatgcctaggggacatttatgtatttggttctggaattcaagggaggcgtaggctggaggtacagatgagagatgccagcctgctacccaaccatgccttcctttttacagaatcaccgaagattcagctgtgaccacgtttgaggctctgaaggctcgggtcagagaacttgaacggcagctatctcgtggggaccgttacaaatgcctcatctgcatggtgagtagaaaagaacctaggggtgcccttggtcaggcttccacgccctctgggggagttggagagggtgggcctacctcagagtgaccccttctctgccccctcctccctaggactcgtactcgatgcccctaacgtccatccagtgttggcacgtgcactgcgaggagtgctggctgcggaccctggtgaggtggcatgggggtcggggaatgggaggccgctccgggcactgcccagatgtctgtgcttatgcctgagcctgcctgggggaagtggggagcatggcgcaaaggagaacagagccaggagccaggatatttacccgcaggatatttacccccaggctcgctgcctctcctccccaactgcaggtttaggaacttctccccctccatgagttcactgcattctcccttccccgccccggtccccgaaggcccactgcatcacacagactggtgaggcctggggtcaggaggaggctggc

SEQ ID NO: 53484 - DNA, 1403 bp, Homo sapiens
gtaatctcgttagggctgcggctgccacagctggacccagccttgttctcattactggggctcctgctgcggggctggccaggcggtttgatcctggcgtccccccaacacaggagcgtgcctgcctgctcacagaagctgcctatgcgtccccagcctgggctgacaggaccaaggtctcagcacacactggtgcagagagacatggctgcaggcccaggtgctcacatgcgcacacatggctcattgtgtagaccagagccctccctgttctccctgcagggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagttgctgcctgtgtgttatgtgtgtggggtggtgggggagctaactaggggaggtgggctgaggcagttaaggggttaattcctggtggcaggatgggggaaag

SEQ ID NO: 53485 - DNA, 1042 bp, Homo sapiens
gatccgtccgcctcggcctcccaaagtgctgggattacaggcgtgagccaccgcgcccagccgattttttttttaaccatttaaaaatgtgaaaattagtttagctcgcaggccatacaaaaataggcagtgggctcagtttggccccggggttgtagttcgctgagccctggatcagaagaggaaagggcgtggacaaggtatttactttcctcacttgggctgtcttcgagtctctaaagaaaggtgcccttgtgttggtttgtccggtgaccccatggtgcctcctgcagaaaggcagctggagcagcacggggtgggaactggtgcatgcgtgctggcaggatgcctgggcctggcacccgttgttccctgcctgcagcagccggagtgctgctgactctggattgggcagtcacccccgcccccaccccagctctggtgttgacagtccacatctgtgtttcagagaacagccccagcccaggtgggaaggaggcagaaactcggcagcctgtggtgattctcttgggctggggtggctgcaaggacaagaaccttgccaagtacagtgccatctaccacaaaagggtgagtactctggtgccctctcccctgggctgccgtgagggctgaccacctttgaggcaggactgggaatggctttaagaacagcctctagagttcgagaccagcctggccaacatggtcaaaccctgtctctactaaaaatacaaaaattagccggcctggtggcacgtgcctgtaatcccagctacttgggaggctgaggcaggagaatcgcttgagcccaggaggtggaggttgcatgagcagagattgtgccattgcactccagcctgggtgacagggtgagattccgtctcaaaaaaaaaaaaaaaaaaaaaagcctgtgaggaaggccatggggttatagggacttggtgggattatccccacttggctgccagctctgtggcctggcgtgacccctttggtctcctgatggcttccccttccttcctccctgcattccacaatg

SEQ ID NO: 53486 - DNA, 1053 bp, Homo sapiens
cctctagataagagccctttctggctgggcgtggtgggtcacacctgtaaccccagcactttgggaggccgaggttggcggatcacctgaggtcaggagttcgagactagcctgaccaatatggagaaaccccatctctactaaaaatacaaaattagccgggtgtggtggcgcatgcctataatctcagctactcaggaggctgaggcaggagaatcgcttgaacctgggaggcggaggttgcagtgagccgagattgtgccattgcactccagcctaggtaacgagagcgaaactccgtctcaaaaaaaaaaaaaaaaaataggatgctttctaagtgtctgctctatgccaggtgctggtgctgtactagaccctggatttgagatccaggcctctttgcaggcctccttttctctgaatgtctgtggtacttaacactgttaaccatgttctatccacatgccaggcccaccaggagctcctttcattattttattaatcctcacaaccaccttgtgaagtagggagaacccttaatcctgttttacagatgaagaacagatgctcgtggggaggtaaagtgtcttgcccaaagtaattccagatttcagcttaagagccttactccagagcttgtgcatgccgagatttcagttgccattaggaggggctgcctgaatacgatgccatttctaggaaacaattagggacatgcacaaagaaaggggtgtccattaaagtatttttataacagcaaaaaattggaaacagcatcatatccaataatgggagatttggtcaccataaattatgaaacattctatagcctctctgaagccactaaaaataatggtgtagaaatatataaactgacagggaaaaatgttcacaatatattgccaaacggaagaaagcagattacaaacaatatgattccaattttattagatattcattttctactttttctacagtgagtatgcattacttgtgaagtaataataatttcaatttattgaactctttccttctgccaggcaccatgataag

SEQ ID NO: 53487 - DNA, 1032 bp, Homo sapiens
gagccagagtatggaatgagggttgggtccaggcgcggggaggtgacctcatgaacctgtgggttgcgagcgcagctgtagccccgcccctcatgcggccccgccctccctcgggccgccccctcatagggtctggcaggtcctagacttagagaggctcagagagccccgcccctcgtaagtcccgccccagagtgttcctccctggcgagccccgcctctgcccgagtcagctgctcgcttgggacctctttttctgtctttcctgtccggggtgctcaggtccatgccctttaatcacttctcatagctgaaggctgccgaaagctggatccctcctgattcctttgtttgggattgggcttcccacatctagcctatcacttattattttcccgaaggcgtggagggggaggctcgcggggtcaccgatcctcgcagaagcccgggactcagaacccttagccgtccctctccactcttctcggcagtggttaacagtgcagtctctgccgtcgggtagaactcgactgaaatcctgactccttcctttaggagctggattacctttggtaagctaccttctctgaacttcagtttcctcctctgcaaaaccgggataaggatagtaaccttcctcatagggctgttggggccatctggagattgtgtaaagggcctggcatggagtgagttcagtaattggcatttacgatcagcattgtttctctccttacattaaagaaagacatgtaggattctccacaaaattaggattgacagcaggcccgcatccatgacagtgtgagtagatcggggtccagagagtggaaagtttggtctctctgggaattctggcagaagggccttgaagtatgatcagcctgaggccagcgtgtccctcacttgcattagtccagcatcgccttcacgcctcctgtctcactgcctgcagcccagcctcttaaactgctaccacagtgatctttctaatgcaaaggtttgatcttatactctgctctccataaaact

SEQ ID NO: 53488 - DNA, 1050 bp, Homo sapiens
aatgtttctgaaggccctcagatgaggaacatttcatgctgactgtctagtaagcaagcccatcacatgctcacatggcgtgatggccagaggggctgcagggcacaattggtctgctctctcctatcctcccccaagttgtacgtatttggagggcagggactgcagtacagtccccttatttgggttcattgcttctgggaagcccgatctgctgtgcctcctaaaatgtggaactggccctagttccagttcctagcgtgctttggcgtatgcttaggcccctctgccaatctcttccccagtgctttgtacctggcttctcaacccagagccagggcagggactttgacaactatgaagggtggtgagcaaagagctgttgctgctgccgcataggggtctgagagcacttatatcttaacagtctgccctttttcactctcgtctcaaaccaggagtatgacagtagttttccaaactgggaatttgcccgaatgattaaagaatttcgggctactttggaatgtcatccacttactatgactgatcctgtaagtacatccaaagaacttctctttcttaagtgtacaattgagagacagaaaacttctctttacaggaatgagggcatgcaggaatctttactcacctttgagggttttattattatttttttttgagatggggtctcactctgtcacccaggctggagtgcagtggtacgatcttggatcactgcaacctccacttccctgggcttgagtgatcctccccacctcatcctcccaggtagctgggaccatagatgcattccaccgcaccctactgattttttgtatttttggtagagacagggtttcaccatgttgcccaggccaatctggaacttctgggttcaaggaatccgcctaccttgacttcccaaagtgctgggattacaggtgtaagctactgtgcctggctgaggttattttattttacttttttttgagacagagtctcgctctgtcgcccaggctggagtgcaatggcatggtcttggctcac

SEQ ID NO: 53489 - DNA, 1304 bp, Homo sapiens
cagtagctgggattacaggcatgtgccaccacgcctaggtaatttttgtatttttagtagagatggggttttaccatgttggtcaggctggtgtcgaactcctgacctcgtgatctgcccacctcagcctcccaaagtgctgggattacaggcgtgagccaccatgcccagccgaggttattttttaatatcctttggtgggctgaagctagtgaggcccacatggggaggggtctgatctttataaactgggttccacccccataccataggttggctagattcctgcattagtaaaaatcatgaaagtagtgctgaaactcttgtaggcagcagagtgagaaaaatgggaacaaaatccagtgctcccttcttgtgctctggagtatctaatggaggatgcaggggtcctagtgttagatcttggcctctgactgggccagacatgggattggaaggggtgggagttctggacaagctcgcttttgaaattgctctgaccctttgctgttggttgcctcctctcatccgcttgcagatcgaagagcacagaatatgtgtctgtgttaggaaacgcccactgaataagcaaggtaagtcctgttcagtcaggaagaggcttcagactgactaatgggccttctgtttccagggagcaccccctgaaatactctccttctgcagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttagtcccttgcatccatttttccctccttgtgcccttccatcccctttttttgtgggacatcgtggtaacactactcacagacgtgctgaattctgaggctcttcctcgcttcttgtgttttctttgggtcacaccctttggcagcttagtggcccatccttgagtggatactgaatgaggtatcacccgttacgtgctgaggcagggctggccaggctccaggggttcttctgtgccttatgcagccacaccattgcccactggggttcacagatttggggaactccagatctgctctatctgctttttttttttttttttttttttttgagacggagttttgctcttgttgcccagactggaatgcaggggcacaatctcggctcactgcaacctccgcctcccaggttccagcgattctcttgcctcagcctcccacatagctgggattaca

SEQ ID NO: 53490 - DNA, 1064 bp, Homo sapiens
cagactctcactaaccccatatgtaccgctaccctttcttccagatgtcatcaaggccttgcgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagatcctagaggatccctactgttttctgttttatgtgtttatacattgtatgtaacaataaagagaaaaaataaatcagctgtttaagtgtgtggaaagggcctgggatgtgtctgagccttttgggactaaggacatgactgtacctttggcctctgggtagtactgattctgtactccttccaggaggccatatccacacctacaattccaatgacaagctgaagactcctgtgacttgtttgatgtctatgagatgcttactaggcctgggaacagaaactcttaagtagaaggaagatggccgccgggcacggtggcccacgcctataatcccagcactttggaaggccaaggcgggcagatcgcaaggtcaggaattcaagaccagcctggccaacatggtgaaaccccatctctactaaaaatacaaaaattagctgggca

SEQ ID NO: 53491 - DNA, 3892 bp, Homo sapiens
cgcagacccccttcccccagcccagggtcggaggcgagtcgccgggggtcggcagaggtcagcagcctgcgagaccctcctaggctcgtggccctaggcgcggcagctgacacgtaagtctcgtcgcccgacgttgtttcggcgctcagaaacaacgtaaagtaaaggggcggggcagcgttttacaaaccgaaccgtgaatctttgcggtttctctttccagccagcgccgagcgatgggtgagtgtcgctctgcattgaggcgggtgaagggaggttgagctcaatcaggccccatcctgcttcacagcctactgaggagtccagacgccccgacccccggccagggacagccacgaggagtggtggccctcgggtttcggccgcccagcccgtctctgggggctgcgaaggctctgggctccgggttccgggccgcgggctgcgggctccgagcggcgccaacatggctgccgcgaggaggaggccccggcctggccgcacgtgtatgatgacaactcggtaatgctgcatactcccgagtgcgcggtggggaagccaaccttggagagctgagcgtgcgaccggcccggcgcgggggtctccgggagctggcgagtcgctagcaccgagtcacagtggctcaagcttccttccccgcttccacatgcaggcatctctcgggacaactggcacaagcgccgcaaaaccgggggcaagagaaagccctaccacaagaagcggaagtatgagttggggcgcccagctgccaacaccaaggtgggtgcgagcgtgggcctgtccgcctgggaggtcgccttcccccgctctccagcgtgctcgggtctttccgtgtgacagttgtgcgttctttcttgggctctgatttctctgtagtagggcctgggtgtcctgtccccctttagctgttggataagtaagtaccaaagagggaatgctccctcaggcccccaaacctggagcttaggatttcagagagaaggatactgtgtggggacttgagcttctggagagggtggcgcctcgcgtcatagtcagaagcctagtcttgttttttttacagaggcttaattttcagcatttggggtcaggctttcctcttggaggcaagtagggtgatgaaaaagaatccttaggcgtggttgtggccgtcttggtcacctgtgtgccacttgccaatgcaaggacttgtcatagttacactgactgttgcctcctcccggcccaggttcctctccctcacttgccttgctctccttggtaacctagttcctgtaaccttgtgttttccagattggcccccgccgcatccacacagtccgtgtgcggggaggtaacaagaaataccgtgccctgaggttggacgtggggaatttctcctggggctcagagtgtgagtgaggccctttgggagtgggtgggaaaacgcacctaaacggtcttaagattcaccaagtgggcctggcgcggtggctcacgcctataagcccagcacgttgggaggccgaggcgggcggatcacctgaggtcaggagttcgagtccagcctgggcaacagagcgagactctcagtaaaaaaaaagattcaagtgcttttagcaagtagtctgtggcttagaccaaggcatttgaagtttctccttgctgaaagatcttaaggtagctggggagttctctccacccaggctgtcctgctccaatctctttttttgagattgggtctctgttgctcaggctggagtgccagtggcgtgatcttggttcactgcagcctccgcctcctgggttgaagtgattctcctgcctcagcctcccaagaagctgggattacaggcgtgtgccatcacacccggctgcttctgtatttttagtagagacggggtttcaccatgttggccaggctggtctcaaattcttggctttaagtgatccacccgccttgacctcccaaagtgctggggttacgggcgtgagtcaccgtgcccgacctgctctgatctttctgaactctgcagcctgagagattggggctggtaaagactgcgggttgccaaacataactagaaacgtgggttagggggttgtggaagacgaactgatgccccatggcttgtaaaggctgagagttcccttatttctccttaaggcctcatggggctgaagaacctggaggagtgtgccagggccatttgtcctccagtttacttgatgccaaatttctcctgtgagcaggttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctggtgcgtgttacttccctgtaggggttgtggggagggcagcctgactccagccttctcgtgatgaaaactctgtccagttctgctactgaagggagagagatgagagccttttaggctgaggaaggccagcactggggtgtgcagggttcgagaaagctcccagggcctgccttccttccctgagctcatatatttgtatccccttttcagactcctgaggaagaagagattttaaacaaaaaacgatctaaaaaaattcagaagaaatatgatgaaaggaaaaagaatgccaaaatcagcagtctcctggaggagcagttccagcagggcaagcttcttggtgagaaggctgttgtgttggaggtggggagtcgcagagattgagtgtgccgaggcacttttcccttgtctcagttcctttgactgccagccatgcagtctaaagggttcactgataacaggctgcgagcacaaaggggaacgtttggtcaccctattcgtatgaagctgaaatgggaagcattgggtagaagagtctgcataggcccgtgcttggagtctttgtatttggggaagtctctgcccaggctgagggggctgtctcagtgatgaaaactttgtccagttctgctactgacagtaagtgaagataaagtgtgtctgaggagacagctggcttcatgcttgcccccagggtacctgaacccacagagattcttaagcgggtggagaggtttgggtagggccaccttgtcgttgtgctaaggatcacctactctcttgcagcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacatttatgttgcctgaatatatgactgttttctctgctttatttccttgccctgcaaaactgatctgggtgggtggctgcaaccccttgccttaacctctgcctcctactgtcctgagccaggctcaccacactgtaaagtccctgttctcaactccatgtccctgaaggccagatttattatgtgggctatgtctatagtgggaacatttctcaccacattttggtggggatagggatgtggcagaggctatgagggggtatcccaaccttggggttcagtaatattgtgctggctgagtcatgattagaatctcaggctatattgcttataaaaaattttaaggatcttgtacccattgtaagattaacagtgatttctgccttgcttggtctccaagggtcacttctttgacttaaacttgccctgtcaaacacttatctttagtcctgacctgcctgacatctgcacttggattttttttttttttctttttttgagacagtctctgtca

SEQ ID NO: 53492 - DNA, 1062 bp, Homo sapiens
actgcttcccaggagggtggggaaggggttgtcacctctgtccagctcccctgcagtgcccagggtgggcttgtgaggccagcaggtgtcttgtgccttgctggaagtgagggtccggcaagtgatagggccctgccctctggaagtcctggacccagcacccagctcctgtgcctgctgggcctgctctggctgaccaggaaggctctgccaccgtgttgagtaattctttttttttttttttttttttttagcagagtctcgctacattgcccaggctggactggaactcctgggctcaagcgatcctctcacctcagcctctcgagtagctgagactgcaggtgtgtcaccacaccatctgttgggtaattctgaccctcggagctgtcaacccaacccagaggtcagggaacacagtaagggggacacagggaaaactagaagggagccttacccaatacaaaggacaagggaatgaggtctgctgagcggttgcagtaccgggccacctgagcatacacgtacctctgctcctgggtcagcagcagcctggggaaggcaggtgtaggcttgggttagagggaggtgggtggcccagtctccccacttgcgccagctctaagaccctgcccttaccggtaggtgatgctaagcacagcgtacaaggccccaaagaggaggaattccttgtagaggagcttgtagatgcttcccctccagcggagaagcaggccagagaaacctccgaagcgggcctccgccactttgagagtgtatgaaaccgtcatggtgctgggagcctggggcaggaggtcacaagagttgcccccagggctgtcgtttagttctccagacaacctcccttccactctggtctcacacaccccagccttcaccctgcgtcagtggacaagggggtaggagcctgcagagcagaaaagtacaccccaccccctgcagaactgagcagtacatgggcaaagccaggctagagttggacaaggtagaactgagatctgtgtcccttcatgcatgaggtttcctcaagctcctcttcag

SEQ ID NO: 53493 - DNA, 1106 bp, Homo sapiens
ctgacccatctatgggggcgaggattttccctgttgagtgggggtttccccggcctggctaaccggatcctgaccctgtgtgcctgtggaggagggaagggttaggagggcaaggagtttgaactctgaacctagggcaggctcagcttcgggggctaagaccctcgtatggcgcttaatgcccctctaagggctgaagttttccctgggcctgcccgggagatgggtggagtctcttctcaggccagctccagtttccatggaaacccacaggcttcccaccccgtcggctgcctgggcagactcccagccagggcctctttcgccgccgccgccgccgccagccagccagcttcttcccaggaccataggccactccagcctcagcttctcctggccccctccctgtgtctgttcctgtccccgagcctctggcctctgatgccttcaggagcttgggcctctcctgctccactcctaaacttcagcttctcagcaaacaggcctcccaagtccctgcttctccctctcaggccttgctaacctcaccagctctagggcctggccaggcctcccaggctccctcctccaccccaaccccttctcactcatggagcccttgggactggtcgtgcatgggaaagctgaacctttttccgcagcactccgaagccttgtcaacaacccgcgatacaggtgaggggtgggccctgcctgcgggtttttcttagctggctctgtgggccccaggactctaaggaggccctggtgagaagaggctgggaattagaacttggccatcctccctggtgaacttaggctatggggaggtcaaatgtggaacatggctactggtcactcagtgtctgtgagaccctgagggccagaggcaaggctggcggggtggagctgctgtgtgagctcaggcaaagcccttccttctttggactttggcccctggcagaagaaaatgattctcagcccctgggatccttagagatggtgggtcatgattcccctcctccctccactcactcagcttggtattgaggcctcactgctagaagaagaggaacagatgacctgttctgggaactgaggcttca

SEQ ID NO: 53494 - DNA, 2303 bp, Homo sapiens
ggccgggcgcagtggctcacgcctgtaatcccagcactttgggaagctgaagcaggtggatcacttgagcccagaagttccagaccagcctgggcaacatggtgacaccccatctctactaaaagcacaaaaattagccaggcatggtggcacacacctgttaattgcagctacttgagaggctgaggcacaagaatcgcttgaacctgggaggcagaggttgcagtgagctgaaatcgtgccactgcattccagcctgggtgacagagcaagacttgccctcaaaaaaaaaaaaaaaaaaagaaagtgtgatagagaagcgtgaatggtgccgagactgtatggggggactctccagtcccgccactagggagaggagaagacttcccagaggaggaaacatttgtgttcgatctggtagaacaaataggattttgttcctaggggaagtgggaagatggtattctagtcacagaggcaccaaaggagctagtgagacatttggtgtgtctgaactgtgaggagagggcaagacgagactgcagaggacgccagggcctggttcatgtagggccctcaagcttttggacttcttttaagcagagggcagtggagattcactgaaggtttccgataagggagtgaagaattggaaactcaggggagaagggattggaagaggtggagaggactcgctagtccagtcaggaggctagtgcagcagtcaagagatgagagatgtcacggatgaaattcaagtttctgctaaaaatagaagtatccttgagtcaggaagggaacaagtggaggaagataagcatcctgaaagaaggggagaattttgcatggcctttatctggttttgattagtggcgaatgtactagaaggtgggtggctgggcttggttttgctagtctccagttcctgtaagcctgctgtctcaggctctagcaattccctgcctcccctggcctgggtcaggatgggtctggggctgctgggtgactcaccgctccaagcctgctcactgcttctggggtggaactagtgtcttggagcagggacaccgccacccaacccacattcatttctgttcccagctgtgcctgcagtttgtggtgaaggtgctggatgtggacttggtttgtgaggccctgcaggtgggtgctgctggacaggcatggtaggagtctggctctgtgtgtggaaatgggctcccagcacctgggagcctgggcctgctgtgtctggcctggaaataacttgggtacatggtggtggtgggggtgctccaaggatgtttataggatgaattctgtgcctagatctgtgggatcctgggtgtatcagcagggtcaggtgcaggagcaggtgttgaaggggctggaggtctttgctggtcttctgtctgtcagggctggggaatggttctcagcttgacttggggtagggaaagggtggctgtagactttagaagtcaagctgggtcaggcacaacggctcacacctgtaatttcagcacttttggaggccgaggcgggcggatcaagaggtcaggagatcgagaccatcctggctaacacggtgaaaccctgtctctattaaaaatacagaaaattagcctggtgtggtggcatgctcccagctactctggaggctgaggcaggagaatcgcttgaacccgggaggcagaggttgcagtgagccgagattgcgccactgcacactccagcctgggcaacagagtgagactctgcctcaaaaaaaatcaagcctaggtcccaggtggggtttgaaggccatggcgtggtctcctgtagggaagagcaggttgtagagtgagtccacgtgtgtgtgtgtgtgtgtgtgtgtgtgtgtgtgtgtgtgtgtgtgtgtgtgtagcaggctttcattgggtctagtttcctggagggctgagggccctgtcagcctccccagctagggctagggtcaggcttgcagtggtgggtcccagtgagcaggctgggctacggcctctccagtctccaacctgatctccctcattctgctcgcaggtggccgtaacctttggcctggggcagctgcaggagcgctgcgtggctttcatagaggcccacagccaggtactgctcccttcatactcctcaccctacgcaccgcattctgctcctccctgacccatttgccggctcgcaggaggccctccggacccgaggcttcctggagctgtcggcggccgcgctgctgcccctgctccgcagcgacaagctctgcgtggacgaggctgaactggtccgcg

SEQ ID NO: 53495 - DNA, 1018 bp, Homo sapiens
actcgtaccgcaatggctctgaggatggggccctggcctacaagctgctcatccagactggagacgcccaggagcctctggatttcagccaggttgggagagggctggaggggtccactagtacaggggctgcaggcctcctgggcccaggccttcagccctctctgcctctgcagctgaccacaaggaagctggtggacagagagggactgattccacccgagctcttctacatggggctgaccgtgtgggtgagcagtgaccccctgggtctggcagcctcacaggccaacttctaccccccacctcctgaatggctgcacgacaaatacgacaccacgggggagaaccttcgcagtgagtcttggggggagctcggcaagagcctcagcctcgcccacacaagccctgagcctgaggccctgcccactctgccccgtgctcaccgccctgtccctctccctcttctcccttcccctcccctccacagtcccgccagctcagcccttggagtttgcccagttccccttcctgctgcgtggcctccagaagactgcagactttgtggaggccatcgagggggcccgggcagcatgcgcagaggccggccaggctggggtgcacgcctaccccagcggctcccccttcctcttctgggaacagtatctgggcctgcggcgctgcttcctgctggccgtctgcatcctgctggtgtgcactttcctcgtctgtgctctgctgctcctcaacccctggacggctggcctcatagtgagtgcttgcaggagtggggacagagacaccccacccttccctgcccagcctgtcatccctcctgccaggagccctctgtgagccctgtctccctcaggtgctggtcctggcgatgatgacagtggaactctttggtatcatgggtttcctgggcatcaagctgagtgccatccccgtggtgatccttgtggcctctgtaggcattggcgttgagttcacagtccacgtggctctggtgagcacg

SEQ ID NO: 53496 - DNA, 1221 bp, Homo sapiens
cctgggccatgaccaggccctcagggataaggcagggactcctctctgccgcacctctcccacttgtctggggaggcctcagagttagaagcccccttcccaagttctgacccgcctaggccctttcccccccagctttctctgtttgctctggcagtgggcagccgggtgagccaggagctgcattacaccaaggagaagctgggggaggaggctgcatacacctctcagatgctgatacagaccgcacgccaggagggagagaacatcctcacacccgaagcacttggcctccacctccaggcagccctcactgccagtaaagtccaagtatcactctatgggaagtgagtctggctgagcccctgagcagctgggggcgaggcgtgctgtgggggttctggagtgggaatccccttcttctgctgatctcctatgcccctggctattgcaggtcctgggatttgaacaaaatctgctacaagtcaggagttccccttattgaaaatggaatgattgagcgggtaagtgtcctgagagggagtagaggcagaactttttctgtagcgtgggaggactcagagaccgagcaagccccacagcctgcaatctgcccccttaaaactaaggagggggattgcagagggcatcctacaaaggttgtggggcaggactgacgtggcccggggtatccctggcagatgattgagaagctgtttccgtgcgtgatcctcacccccctcgactgcttctgggagggagccaaactccaagggggctccgcctacctgccgtgagtgccactcctggggccctgcttcatctcccgctggggactctcccagcagaaaggaggggtctggggaatgaggatgatcaaaaccttaccaaggtcctaattacctcccaggccaggaacagagagcatgggcttccccaaggctctctccacatcctccttctctttccctctcaaggaaggaagacctgacttatttacacaaaactaaacacaaagatctgtaagatctgagcaaaggagaaaaagatccccacaaagaggctttgctgggggaaattacctaggtgtttgctaagccattgcccaggccagaaagaaaacctgctacaggcatgtgcctgctggttgtatattagaaccaagcacacagcttggtaaggaactcagtggggcctttctgggccctttctatgtattag

SEQ ID NO: 53497 - DNA, 1288 bp, Homo sapiens
caggtgggcgacaccatgcctggctaatttttgtattattagtagagaccaggtttcaccatgttggccaggctggtctcgaactcctggcttcaagtaatccgctcacctcagcctcccaaagtgctgggattacaggtgtgagccaccgtgcctggccagaatgatttctcattaataatttcagcaggccaggcacggtggctcacgcctgtaatcccagcactttgggaggccggggcgggcggatcaaaggtcaggagttcaagaccaacctggccaacataataaaaccccatctctactaaaaatacaaaaattagccaggcgtggtggcgggcgcctgtagtcccagctacttgggaagcggagacaggagaattgcttgaacctgggaggcggaggttgcagtgagccaagatcgccgcactgcactccagcctgggcagcagagggagattccatctcaaaaaaaaaaaaaaaaaaatttcagcatgactctcttctttcctgagggctggtttcatatggcagccctttgataggagtcaaactccagtctgtttttccctgggaaatttgcattttgtagactccctcagccctggcccatacccaaaggcagaacccaggttggagtctcacaccctcgagttatttcaaatactggcaagtcctaggatccacagcagatgtttctcagagcttgcctgcctgttgagctcccacacgccatccccaccctacctacccccagccctgcagactctcacatccatatacactctaggccagccctggggtccagagcagatgtctcgctctgcctgcctgcccccagccccaggacacagatgtgcatacacgcacatacacatatccccacccacaccactgctgcctgggtggtcccagatgactcttggatttcctgccccaacagaggcagtctcccttcccttcctccctctccattccccacattctccccatctaaacactgcttgagcctccatgtttcctcatcctctctcctatactccagcataggataggctagaccccagcagttttttgctgttgtttgggggagggttttataagaggatggtagccaattcctaggcttttttcctttatttcagaatatcactcttgtcctatattggctgggggtgaggtaaaaatctttttttttctttctgttttttttttttttttttttttgagagtaagtcttgctctgttgcccaggctgtagtgcagtgacgcaatctcggctcactgc

SEQ ID NO: 53498 - DNA, 1182 bp, Homo sapiens
gtctggccagtgagaatgaatgtctgtgggttcacctctgtgtccacccgacgacaggtgtgtgtacatatgtatcctgctctcagaaaatgggcctatgccggccgggcgcggtgactcacgcctgtaatcccaacactgggaggctgaggcaggcagattacctgaggtcaggagttcgagaccagccaggccaacatggggaaactctgtctctactaaaaataaaaaattagcagggcgtggtggcgggcgcctgtagtcccaactactcgggaggctgaggcaggagaatctcttgaacctgggaggcggaggttgcagtcagccgagatcacaccactgcactccagccagggcaacagagcgagactgcgtctcaaaaaaaaaaaaaaaaaaaaaaaggagagaaaacaaaaagaaaagaaaggaaaataggcctatgccttcctcaggtgtgtgctggggatggtgggtgttacatcttccaagtctgggcctgtgtctgtgttggtgctccctgtcccacatccagaaatcaagaagcgagggctgggcagcagatatacagggtgagaagggaaggatttcatgcattgttgcagtgatgcctggctgacccttctctttccatcccagatcctagctgggagcctgaaggctccactctggcttcgtgcttacttccagggcctgctcttctctctgggatgcgggatccagagacattgtggcaaagtgctctttctgggactgttggcctttggggccctggcattaggtctccgcatggccattattgagacaaacttggaacagctctgggtagaaggtaagttgtggacactggccatagctgctcaggtatggtgagcccaagacaagaacggggtgaggagctggctactgagctctagcaggcctggccctggggctggagggtcacctgctggccagagtcctacacctgggcatctaggaacaccgttccctcccacaaccataaatggacatctgcagatgttagaccttgtgaattgggtgtatagaatatttgtctgtgattttgtacgttagcatttattgctaactttctatgtgtgtctttgacaatgcatcagggttttacaaaggcagctaaaacaagattcatctttcagtagcaaagaaagtaaaatatgt

SEQ ID NO: 53499 - DNA, 1071 bp, Homo sapiens
ctcggcctcccaaagtactgggattacaggcttgagccattgcgcccggccaacactacagctttctatgtgagaaaagaagttcagagaaaaggcctagcatatctcatagtcatttgccgtcttggaggagacaagttttcattctgtcacccaggctagagtgcagtggcgcaatcatgacttactgcagcctcaacctcctgggctcaagtgattttcccacttcagcctcccaagtagctgggactatgggcgtgtgccactacacggcaaatttttttttttttttttttttttagagacagaatctctgtgttgcctaggctggctacttctttttttaaaaataaaaaagttgaggtaaagctatagacagcccacacaaggctaatgactgggaaggccattagcaattacccaatcctgcgaatgagttcctgctgataagatcagacatcctacatcccatatgaactttttcccattattttggggtcacttaattttaattacttacggcaaacctgggaaaggtaattaaattgcagtcaagtgagacttgattaccctgctgctattatgtcttggctaagtggcagggtaggagcataaaattgttcagaagggagtttctcatattcgttatgtgcttgtctctgccagcagtggtgggctgctgaggcttgaaagcttgctgaggctttctggacacctgcccaaggtcttcagggcttgagggatgctaataggaccaccttggagaaggtgtaggcgagactattcagagaaagctcctgcccatctttctcatgttctggcattttatatgacagctgatgctcaggaatccacaatgtagtaaacacttcattgtcaaagcttgagtgtcagccctgtattctgcatgtttggtcccctggtcccaagcaacctctcctgcatttccccctaatccaaggcacatgacccaagcagcagtctagagtagcatcttcacatgctgacaggctagaaagccaggttctcacctaggttttccatgctttttgcagttagcaagtgtagacc

SEQ ID NO: 53500 - DNA, 1112 bp, Homo sapiens
catagctagtcccacatttacccatgactagcatctttcacgctggtctggaaagatgttcatggataacctgagtgggaagacttgtccagatcacaggtgcaccgctgtgtccacatcatgaaagagggaccctgctctcgagtgagcatgctgggaaaagtatcctttgaagtgccaacagggactatgcagcagacgggcctgaagggccttgggtggagtgtggaagaagagaacctagggctgggggcttggaattagccttcacattccagtgtagccgtgctgacaaggcctccgtcagctagtgtggctgccacgcacagtgctctgaccagcattctgtctatgctggagaatcatagacaggcgcactacctgtgccttcctaatagactggtagccaaagccccccatacctctaacctttccaggtttctcacactggagagggaatagtgtgaacttccccttcatgttttcttttggctgggggatagatgccttctcagggtctgtccttgatttcgaatttgtctaaaatggatctcatcctcacctcatgcgtggtcacagtggtccaggaggtgaccaggaacccaggatgcttatgatcaggatgcggggtgttccttgacctgatcaggcctcctttcccaagaggtggtatgtgggtatctcaaagactggtctcagtgcctcccagccaagggacatggcattactttcaaggaggagcattcaaagctaagagactgacaataaggccatctagaagctgctgcataaataatcttggtcctagggggaatgcagcagcctcctgctccccctcactcagacaggaagctatggctgagaactccctgtatctctgattgagcactgggttctacctaaggtgttttttttttttttttttttttttttttttattgatcattcttgggtgtttctcgcagagggggatttggcagggtcataggacaatagtggagggaatgtcagcagataaacaagtgaacaaaggtctctggttttcctaggcagaggaccctgtggccttccgcagcgtttgtgtccctgggtacttaagatcagggagtggt

SEQ ID NO: 53501 - DNA, 1283 bp, Homo sapiens
gatattttagggaagtacatttcctcttttagtttgactttctcttacagattttagtgggatttcctcagggttcatgttttgtgggtgagtttcaaaggaagaagtgtgagctgtaatctcttttaaaacttagagccaagcatggtggtgcacacctgtagtcccagctgctcaggaagctgaggtgggaggatcccttgagtctgggagtttgagaccagcctaggcaacatagcaagacctcgtctcttaaataaacaaaaaaacaacttgactgagtctgtatctgttctgttatctctctctcatttatttccttggttgggtgtttgttctgaagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgagagcatgagttagaaaatcatggggctcttgtcctagaaacagactgagccacttgtctgtttcttcattaggtacatagtaacttgttaagaatccctgtcattcccaaggttgagcaagacctggcacgtcaagggagactactagggtactcaggtgcagcaaaaagggaagcagggggcctggtccatagtcagggcctctatggctccagggaaaggctaagatcttcaggaaggctaacttctggcctttgggtcagcaggttcctcctgttctgttcagcatggggatatctgcagtacttacttcataataagcaggtaaatactctgtaatcattactctgatgaagtaaacataggcatacagaggaggcttccctgagaaggtgaaggagcagagtatagagtggccagatggcaaagcctcaggaaaggaatgactttgagagagaattgtctgcaaacagcattaatgaggagtctcttgctagcccctccttttaaccttgaagtttgtgagatatggggaacaaatagcttccactgaaggagaagcagtgtcctcaaagataagccaggccttaatgaaggcagggggtggagagggggacagtaaagaggctgaaggtataaaggaactctgtattgtatagtaggcccaggaggaaggttttgggagggaggaataataagactaggaaaaggaaatgcagagcagtaaagggtttagatgagaata

SEQ ID NO: 53502 - DNA, 1096 bp, Homo sapiens
tgcacctccaaaaaaaagaaaaaaaatatatagggagagcctcagccttgacagctggatttttcttttcatctagtctcttaccatccagggggttagcccaggcttgtttacaaggtagcagcagcaggttctaagcatgacagcagaggctacaaagtctcttgaagtctaaactcaaaacacacactgtcacttcagctgctgcgctctgttagttcaaagctagttatggagcaagcccagatataaaggatagggaactaaccttacctttggataggaggagctccaacaagtttgtgaccctttttaatctactcgacatactattttgacttgctaatgagtaaatttgcctgttcctttctcataatatccttgcctggttttggcatcaggatcatgctggccttataaaatgagttggaattcctaactctagacatagcacctaccatagggtaggtgtacaaagatatttattggtagaatgaatgaatcaatgaatgaatggataagcaaaatgcctgtagatgagacagaagaatcagtcagaaaagtaaaaatcaactagggaaaaaaacgtgaatacttgaatatgacggactttttttttaatagaagttcagttttgtctgctttcttaagtttgtgtagcctttcttcttaggaagacattctacaattacctgctctgctcccaaagtgaaattcctattttgctaaagcagaacagaaagaaacctttccaagtttctataatttgtatcacattctgaagtcccagttactgtaatagctgcaaagaagcaatacaaggtggagggtctgagagggagagaaaaatgactaaagtgcaacatagctgaaaaattggctggctggaaattattgctcccaggacatcagtgattcaaggtttctgtgagccttaggacttgagtaggggaagcattccaaattatatccaaaaataacatctccgtgtttcttttgttaaatggctggctcataatgagacccttacagactttgttacattctcaagtttccatgtaatgtataagttgatatatgtctaagctgctatgtg

SEQ ID NO: 53503 - DNA, 1051 bp, Homo sapiens
tttataagattgaatgggtgccttgtacatacctgaggttacattgtaattatttactatagaatgttaagttcctaagaatgaagcattgtattctgttcatcctgttatttcctagtactgtagtaaagtgattgttctttgccatattaagtcatcaaactatgtgaaaatgctcttttaaactataaagagatgtataaatataagatcatatattccatagtcatagaaatagacaatgtggtggttttcagactgtttcttagaacctagggttccagagatgtctcagggactgcccacacagttcctgaggtacacaagggagaggtagagtttccagaccctataccagcacaattcaatgagaacaaccccatttattttacttgtttggctatgaaaaatgcttgaagagtattgtctgatttgtgtggttttaagccatcctaattttgtcttgtgatgatttgtgtaatccattgtcctttatgatattgacttttcccatctccatttaacagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcaggtaaggaagattggagtttgttttgtttgttgagttttcgtaattattattctcactcatgctttccctgaaaaaacatttattaagaatctactatacatcacagattctgtgctaggagttgatgacataaagtcaaataagacacagtccctgaatggaaaatgcttagaactattgattagattctttaatgtccttttgtatgcagagaggaacattcagaactatttgcattgtatttaaggctcaaataattgaatacgtatatctaagaaacaaacaaacaaaaatccaatttaaaattaacttttaaaaataggccaggtgcggtggctcacacctgtgatcccagcactttggg

SEQ ID NO: 53504 - DNA, 1051 bp, Homo sapiens
actttgaggactatagactggaatcttttccaagcattttaaaccaaaactgaggtctccattgcagttagcctttggtgtttattcaagcacacaaactatgccaggtgcagtggctcatgcatgtaatcccagcattttgggaggctgaggcaggaggattgcttgagtccaggagtttgagaccagcctgggcaatatagggagaccccttgtctaaaaaaaaagaaaagaaaagaaaaagcacacaaactactcttggggatttgactgggattggaccacataggaaaatgtaaaatgtgaccttcatagtcacaccaagtagctgaattcatgagttccatatgggcaggggtggcatgcaggctggtgatttggatcatagccattatttgtggaagcactgggtgagtagagaagcatggtagttaccttgccctgacagtttttttccaagggagtaaatgtgtttttctttctccttgtcataagaaatcggttgccagattgtgttatttataacaatctgtcatggaacagctgccaggaaaagaaaagaggctattcccagtagctctcctcacctcccgccccaccactacagccacacacacacacatccggttttctgatttaaccttttttcccctctaattttactcagtggttttggcttgatcgaaaatgttcttgtaatgagagatttctgggctttgccatggcttggtaattgggttttctgagcttaatttgtttactttagtcaagactaactggcagcagtttggattttgaattcctgggtgttttggacactttaaacactaaagtgctgccttcccttgaaaccttgcatgtttctatattgtcaagagtgcacacatctgctttccttctgagttgtgctttctgcccttgacattgccctggcttctctagaggagcaggcttgggatgaggcataccaatgactgttggaatagtgagtagggagatctttggagaggccagttggtctctgcagaagaggcatactgttggcattaga

SEQ ID NO: 53505 - DNA, 1056 bp, Homo sapiens
tgactcagaacccacatccactcaatgtgaactctactaccacgacctccccatattcctcacttctccatcacctccagcctgactccctgtctgccctttcacccccaagattttgcacaggttaaggccagttatggcctttttgaaatctgtaatagctcccctttccccaactctaaagcctagaccttaaacctgttcctagagctatgcacacccctgccccagtttaccgttcctccctcagggcctccgtgacactccatgaaaagaagttcttgcataccggaaagttgaataaatggatgaattcattccttcagaatgtgtttattgggccctgggcttaggcacagggtcacaaggagaaattgactttagtgtcctactcggagccaagaagatggatgtgaaatgcaagtagaggtttctcagtgacagactttgcacagttacatatctggggctgagcagagacgtaagggccccactgcgcagaaaagggaaaacaagcaaacaggctggcctggcattttctggcatggatatggtgatttggaggatgggagtccacttctggagccaagtgggcagaagaatttgacatcatagaagacagagacgggagggctgacaaaccagccaggtcagggttgttgacagaagtggaggaagtagtgtctttattaccctgcccccaacccgttgcagtcctttttgggtgtttgtttgtttgtttgtttgtttgggtctctgttgcttaggctggcgtgtagtggtgcagtcacggcttactccagcctgggcctcctgggctccagtgatcttcccacctcagcctcctgagtagctgggaccacaagtatgccaccgcttctgggtaattttttgcagagataggggtctccctatgttgaacaggttgttctcgaactcctggcctcaggcattcctcccacctcagcctcccagagtgctaggattacaggcctgagtagtcttcaagaacaagtacctggggccggcgactcatacctggaattccagcacttt

SEQ ID NO: 53506 - DNA, 1052 bp, Homo sapiens
tttaatgtgattgctgatttctgtttccccagtcttgtagctccttaaaggctggggctgtcttgagcagagctaacctctgcacctactataggtccaggctatagtatggacctggctggataagactgttggtatcatgagtgggacttgcgccaagcctccggatacccagactgtcagatgagaacaaattcctcatgtcaccgtaagatacatttacagcggagttttcttttgggcctttgttgttgcgtcgctacagcaaactttacggtgaaaaaaggtaggggtcctacgggcagcagccagggcagccctggagctgtcgctggagtccgatcatgtgatcttcaacatggcgacgctcttggttccctacagaaaggggcggagcctggactggggggcaggctcagattcaggttaaattgtggattgagctcgcagttacagacagctgaccatggaagcgaatgggttggggtgagttctccagagcacgcggtgtggctagccgggcttctaatttgagtcttccaactcaggactctatccctctactcccctttccccaccctggagacctcccaacctgaactccgttagctgggatcctgaatcctaaaaccatggatttttgagatgttcatcccagggccttaattcaagggatgcctcaggatttccaaccaggatctctattctgggaccatcaactctgatccctctttatcccccagcctgggtatttctcagcccctgaaccagcccagtgacattcccgtttctgaggctcactagttcgaagacccccaaactatccttagtgggccttcattccctccccccagtccctctggttgcttcgagcttggaagagtagagactaagtggagggaagaggccccagggcgggcccttctggagtttgtgcaccacctgataggcagagaggaggcggaacgggcggaaagccagggtttgggagctggcctggaggaggtagatagcggtcctggactgaatcggccttatgaacccgcgctttc

SEQ ID NO: 53507 - DNA, 1419 bp, Homo sapiens
gggtctggtatggcaagaaattctttatctgtcagtcattctgcatctccttagaccactaggcacccactgtgctgtaggctgaaccagctccctggcccagccagggcaatgcagaaaggagagatgggtttcatttagtgagagaacacaatttctgcttttagaaaaatgatcttttatgtgatccatgatttattcatagaaaagcactgtgaattcacacacttgctaaaaaagggcaactgtgatacagaaatgagagtggcttctctcttttttttaaccaacccattgggctgagacgtaggggcccttggctggacagtaagacttgagtagccacaaatggcaaatacaacttcttggtcagtttggagtaaaaaaggtgacagtttgtcgaagaaagaaaaagtaaagcagatggagaagttcttagttcacattctagctataccaccccttccctatcaaaccccacccccaactcaggaactaagacatgaaacagtaaacaccaagacactggttccaactgacttttctgagtgcccttgctacctcctataacaattccaggctgagcacaggggtcaggaaggtagcaggaacatgatacactatggaggtcagccagggctaagacaggactgcccactagggctagaaattaggaagggagaggctaagtgcagaccagccctagcctccaagtcagcgagcaatgagactgtgacaaaagccggcgaggaagcttgaggtagaaaggcaggggaagaaagcaagtatgaggcgagaagagaactatggagctaaagcagccaatctgatggcagagggagattggtgcttagaagcttgtttggtgagagaatgaatagaggaggcacagagatggggaacaaacgtttagctggcgagagagatttaagaggaatgggaaagagaaatctggcaaaaaggacacattgatgcagatcctcaaacatgaatacacagacatccctacatgtagaaatacgctcagttacacatataaagacacagatgcatggataacaagcatacacatggatacaaacatgtttatacacatgcactcgtgtacgcagatacacatactaaacatgcacaaacatgagtgcatttgcacaaagatgtgcatcctcacatgtacacaaaatgtgtatatcctcacgtagaaactcacagtccagtgtgcacatattcaaacaggtacacagccatagaactgacacatacacataaatatatatgtgcacaaacaggcatgcacagatgtatctatgtacatacacacatgtacttagccataaagatacacacacacaattatagatgaaaccacacacttgctaacacaaaggtgaccacagtagatgaatattatgaactcag

SEQ ID NO: 53508 - DNA, 1034 bp, Homo sapiens
ttgaatatgtgcacactggactgtgagtttctacgtgaggatatacacattttgtgtacatgtgaggatgcacatctttgtgcaaatgcactcatgtttgtgcatgtttagtatgtgtatctgcgtacacgagtgcatgtgtataaacatgtttgtatccatgtgtatgcttgttatccatgcatctgtgtctttatatgtgtaactgagcgtatttctacatgtagggatgtctgtgtattcatgtttgaggatctgcatcaatgtgtcctttttgccagatttctctttcccattcctcttaaatctctctcgccagctaaacgtttgttccccatctctgtgcctcctctattcattctctcaccaaacaagcttctaagcaccaatctccctctgccatcagattggctgctttagctccatagttctcttctcgcctcatacttgctttcttcccctgcctttctacctcaagcttcctcgccggcttttgtcacagtctcattgctcgctgacttggaggctagggctggtctgcacttagcctctcccttcctaatttctagccctagtgggcagtcctgtcttagccctggctgacctccatagtgtatcatgttcctgctaccttcctgacccctgtgctcagcctggaattgttataggaggtagcaagggcactcagaaaagtcagttggaaccagtgtcttggtgtttactgtttcatgtcttagttcctgagttgggggtggggtttgatagggaaggggtggtatagctagaatgtgaactaagaacttctccatctgctttactttttctttcttcgacaaactgtcaccttttttactccaaactgaccaagaagttgtatttgccatttgtggctactcaagtcttactgtccagccaagggcccctacgtctcagcccaatgggttggttaaaaaaaagagagaagccactctcatttctgtatcacagttgcccttttttagcaagtgtgtgaattcacagtgcttttctatgaa

SEQ ID NO: 53509 - DNA, 1055 bp, Homo sapiens
agtctcatttgtatgaaatgacagactgcaaaccactttgtttgattacaatcccttcaccttcattatcttttatgtctatttaaactctggatttgccatatccatcttgaccctcccccacatctctctgtttttattttttttattgcaattttcctcttttctgtgggcattcacagattgtttttggagttcattaaaaaggaagtgtgttgtctgggtagaaaattacatttgcatgcttgagagaggcctaagggcttttgtggggtttggcatggatcttgtgttttttgggggtgtgggtgatgagaaaagggaagagtaagaagaagggatttttagaaaggggaaaaataagaaatgttgagattatttctcctatccccattttttcctttccatattatatatgtccaactggtttcttccttttttttttttttttttttgcatgtgtaaaccacttaactaacaatggaacagattaagagatctttcttagaactgtatttgaatgtacagttgtgttctgcaaagcagaaaacgttttctatatggtaattctacatttacaagtgaagctgcaagttgataaacatatctgtctgtctatctcttttcctttgtggtaattggagggaattttatagaaaattgtctcttgaattagtatgacattttatttaaattagtatctacgtagaagtttagccatgttttgatttagaatttcccactttcagaatttagatttttaggtataatgtttagcccttttaaaagttgatagtgctagccgggcatgatggtgaatgcctgttggtcccagctactcaggaagctgagtcaggagttctcctgagcctgagaggcagaggttgcagtgagccaatattgtaccaccgcactccagcctgggcaacagagtgagaccctgtttaaaaaaaaaaaaaaagttgataatgctaatcttttcttttattaaagatgatgtcacttgttattcagaacatatcatttttgtccattgggacgtggggaaaccatag

SEQ ID NO: 53510 - DNA, 1048 bp, Homo sapiens
cttcctttccaatctggaatccttggtccttatcaagtcacaaaactcagtgttgtttgtgccatagaatgcattgtattaagggatttttctgcttgcattagactgggaaatgctttttaatgtgctattgtgttattaaagaatatgatcccagggaagcaagagtgagagaaaatgaaatgagacagggaaggagggtaaggcaacataaggatgtgtcatagagctggttactgcttggtatcaagtagcaactgattgctcaatctccccgaattgtcttataaagcagcagagagaatccccttttatgcccatctttcatttcatgagattcagacctgggaaatattttgctattaaaggtatattttgcatacccctctgtaactttcaccattattgatttcacagtttgggttgtaggaattgtagaaattgctctattgctgttaccactctgtataacctgcaaacttaagtaccttaaattccctgtgtatatggtgtaggtttttcagttccaatgtggaaaagggggttggccatagttcatagccttgttagagtctataacaactcttaatgattggaagtgtaaaataaataagaacaagcattcagtacatttaagaaatttttttctttttcagtgtcatattcttttcttctttcctattattttctttagtgtttattccttattttctgcatacgttttagaaacataatcactgtatagcaaaatagctaattatgaggtgtcatacaatgatactgctcttctcttccctcctctctctagttcctgaatccttaatcattcccttttcttctgacttcccttcctgaaaactttagtccaaacctgggagaagcaagagaaaaggaagtgagatgggaagaagggatagtagcagtggcctgaaagggtatattggagcccaactggagcagtggcctagcatggggtgctagagccaaagtggggtgaggagggtatccacatgaagggggatataatttgagatgtcagagtctgaaa

SEQ ID NO: 53511 - DNA, 1017 bp, Homo sapiens
agcccccccggcctttcacttcccacctgctcccgagggagagagtaaggtttctgggggtaagtgggggctatctgaaagaaaagggtgattttggctggggctcggtgccctacaagagcccttgcttgactttgacgcaaggcacagactgggctctgaaggggcaggctggggggtagacgtcgtcatggatgttggatctcccttccggccatggcccaagtacgacccctgttcccttaaagtcaggacctcgcagaactttcgcaagatgggtcctcggagtctgcccgcgattgcgctcccaaggggtgccgctgccgagggtaggcgcgccagtcgagatcaaagcggatgggatgacgccactggagggcgcgcggggccgcggggcagggtggtgctcctgctgcaggtttcaggcctcttctgccttctacagccgccaggtcagcagaggcggaggcccgggctgtggatggccgaggagccgaactcgtgaagccacgttcctcctgcagctcttaacccaggcgcggcggctcgccgggccgctccccttactccgaaaccgtgagcctcagcccttccctctctccccaatcccagggggcgccggcggacaccccagaaacccacgcgctctcgttcctggtcccgccccctctacgttccctccccctctacgttccctccccttttccttccagaggcggcggccccggaagctcccgccattctggacccgccccctccaagctcccgcccctttcccttcctgtggaggcggcctcggaagctcccgtctttctggacccgccccttccccaccctgctccgccctcggccccggcccccgctccgagctcccttagctctaagcggttccggaagctcccgcctttctggacacgcccctgcctcccccacaggattccgactctctcccggctcgtcgagggcttgacattttaccggggggtggcccagaaaaacctcgtagagatggtgact

SEQ ID NO: 53512 - DNA, 1013 bp, Homo sapiens
cccttgaccttgtctctttctgcctgcctgtggctatagaagtggcctacactgcaggacctggccagtgcttccctggaggtgagagccaccctagggtaggggaaataggaacaatagagggactgacgggtgatctctttgacctctgatcctacccacaggaggtgaatcaactctgggctggcctgggctactattctcgtggccggcggctgcaggagggagctcggaaggtaaggggatggcaggagggtaggaacccaggagtcttgggtgtcttataatcttgagtcttgcactccaatcaggtggtagaggagctagggggccacatgccacgtacagcagagaccctgcagcagctcctgcctggcgtggggcgctacacagctggggccattgcctctatcgcctttggccaggtgatctcacagcccacccccactttgtgcgtgcccagcctccttcctcccagcccaggctaactctttggcccctctgtgccaggcaaccggtgtggtggatggcaacgtagcacgggtgctgtgccgtgtccgagccattggtgctgatcccagcagcacccttgtttcccagcagctctggtaggatgttggggtaacaagggtgcttcaggggtgtctgcaaaggagctctgcttcacagcagtgttcccttcttttaggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtaagcctactggggaaggggcagtgagaagtcctaaggagtgactctgccctatgacactcaaccctgtgcctctcaggtggagcaggaacagctcttagcctcagggagcctgtcgggcagtcctgacgtggaggagtgtggtgagcaccaaacctagcccccaccccaacccttcct

SEQ ID NO: 53513 - DNA, 1026 bp, Homo sapiens
tctcagacagatcttttgtccctctgatccttggtttcttctaggataaaatgaaggttttggacttaatgactactacaggctgtttcagtgtaaccatgctacatctctaagaggcagagaaaccgcctacccccattctcccagacacacctaaacaacccctatccacacacacagtcacagtaagcatcagagatacacaaatgctcccaaacaggaggctttcatccttgacccatcccagccctggcctcacagtctttgcatgtctccagggctgtaacgccggcccccttgaggccacttgctcagctatactagttgtatctcagtgctgcagccagccaagagtaaacccgtgagcatcttgagagtgcttgagagaagctggaccccatgtgaatggtggatgagagggagatagctatcacccttggaaggcctcaaaatttggcctcattgtgactgactgctttggctgggtctttttgtttcaggccatcatgaggaagccacgagcagccgtgggaagtggtcacaggaagcaggcagccagccaggaagggaggcagaagcatgctaagaacaacagtcaggccaagccttctgcctgtgatggtaaggaactaggttgtggcccaaggctcattggccatgaaaggcagattcaggctgggaagggattgtgatacgtatcaagacattaagagacttactaagggccaggtgcggtggctcacacctgtaatcccagcactttgggaggccgaggcaggtggatcccttgagcccaggagtttgagaccagcttgggtaacatggcgaaatcccctctctatgctcgcgtggtggtgagcgtctgtagtcccagctactcgggaagctgaggtgacaggatcgcttgagcctggaaggcagaagttgcactgagtcaagataatgcaactgcatttcagtctgggcaacagagccagactcttgtctcaaaacaaaagagactcactgagggtgtaattctgactg

SEQ ID NO: 53514 - DNA, 1026 bp, Homo sapiens
agccccatgctcccaacgctccaggcttttgcagccggagccgcggtgtacaacggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggtacgctggacttgcggtccgtctcctggcgcggttcaggcagtcggggatggggcggggtctcgccgtcgggtcgccgatgggtcgaacttccgttcagacgtcccgggtccggcgcggggaaggcagcctggcgcgcgctaattgcctattggcctgtgctgccggctcgcagcccgggtggacccgagccacgccccctggagtgcgccggaaagccgggcgcgctagagctcgcgggaggtaatctttctctcctgctctcgcggcgggaacgcggggcctccgtgttctgctgtcttcatcagcgtgggccgcgggtagcgggtagtggggtggctgggtttgggctttccagagaaggtgacgctgcctgagctgagcttaaagcacgcccaggagttagactaggagagggtcgtgtgggggaaagaagggcgttctgggcatcggtaaattcccagagaggatggagagctcagtgatctccagaaagtgaaagaggcggggagtgggccatcggaggaggctgcccagggtgtaagagcgaccgattggtagggaagcttttgtaataatccaatcaagtgataatgtgaacttgaattaaggctggcagtatggatggcgaggaagggacaaattgtgaagcagctaggcggtatagtcgacctagagggtgattgaatttgaaagaggttcctaggccgggcgcggtggctcacgcctgtaatcccagcact

SEQ ID NO: 53515 - DNA, 1049 bp, Homo sapiens
gtcatgctgccaggacccgttctatcctttccctgggcctcgcctgcttcaagcggcagccagacaaggtatgagctgatctcaccccaatcctaggtgtggctgtggggtggagggtagagagattctagggaacatcagataggaagcatttctctcccaaatctttttttttgacttgatagtttttttttttttatttgaataggtttatggggaacaggtggtgtttggttaaatgagtaagttctttagtggcaatttctgagattttggtgcacctatcacccagtgtacactgtgcccaatgcgtagtcttttatccctcacctgcctccatcctttcccccctgagtccccagagtccattgtatcattcttaagcttttgcatcctcctagcttggctctctgaaatcttgatatagcagacttctctttctcccagggtgaacattcctatctggctcaagtgttcaatctcactctgctgtgcatggaggagtatgtcatagaaccaaagtctgtgcagttcctgatacagcatggcttcaacttcaaccagcagtatgcccaaggcatcccctaccataagggcaatgacaaggtaggcctctagcctccctagccttgagtctgccctttctgtgactttatttcttcctaccctaggctggatgtctggggagaatctgcttcttagggagtatggggaatcactagtgacagggcttgggaaacaagactggtatgaggagggtgggcagcattgggtaaggtagagagagagcgttccaagtggggaagtctgggataagtgcccagcagaagaggctccctgggggactctgtcctcctcattgacccctttactttcatctagggtgatgagagccagagccagtcagtacggaccctattcctggagctaatccgagcccgccggcccctggtgctacacaatggccttatagacttggtgttcctgtaccagaacttctatgcacacctccctgagagtctgggaaccttcaccgctgacctgtgtga

SEQ ID NO: 53516 - DNA, 1048 bp, Homo sapiens
gcatcttttggggggatgtaattcaacccccattagatcatattatacctttacctataaaccttcagtggcccctgtggtctgctgaattaactgtagatgcttcatcttggtattccagaacttctgcactaataacaaatataataataataatagaaatagtcataactgacatattgagcactttccttgacattattcttagcattttacatgtatcaacttactgaatcttcacaacaactctgtgggttaggcactattattattcccattttatagatgtgtattaaacaaactgagtaaccaactcagggctctacaactattatagtctgagatgagattcaatcctagccagcctaactgcagtcaccactatattatactgcccatcttaactttttagcttcatactttctcccctacttatacagaaaaaaaaaaaagaataattactaatctctgtgctttgttatctttgtgttccttttgcatagactgtctttcttatccccaaccctgcctatgggttaccatgaaatggaattaaatcctcaacaatgagtgaatattagccaggcctaggtggggaaaggggaaggatattagaggtaaagggaccagcaatgtgtacaaatgtgcaggtgagcaggagtcagacttttataagcaggagtgaaaggctttgtgtgcctttctaaggattgtgggttttatcctacaagtaatagcacatcactgaataattttaacaggagagtggcttcaggttggcatttcagaaagattgtcttggctatattgtggaaaatggattggaatgagggctaaatcttttcaagatgcaaaagggggcaagaaaacaggttagaaagctaatggaataacctaagggaggcgtgagaatgataagttattgatagtgggttctacctgttgtaaaaaatgaaaataaattttaaaaagatactgttaaatgggagaatgagttgtgtactatgagctaaacaccaaactggactgactttgtatttagacctta

SEQ ID NO: 53517 - DNA, 1021 bp, Homo sapiens
tattgcccaggctggtctcgaactcctgagctcaagcaatcctcccacctcggcctcccaaaatgctgggattataggcttgagccactgcactgggtctctctgttatttatgccatgagaaatttaatatttcttttagactccttcaattcaccaaatatgccttcaattcaccaaatatgaaattgaagactatgccttcaattcacaaatatttgcttggaactactcagtccctccctgtgctaggtaatatcatgattaatgcaagagaaatagaggcttcttgtctcccagagagtctccttaagaagtaaattatactatgtaggaaatagactagcattagctaatgctgtgagaatatggcaggatattttcccagtctcagttattaagacagccatctttccagttatccatcctgaaaaattccagccatttttggttatcatgtattccttgcttctaatgagaagctaagctgtgattctaaatattcaaaggcttttgcatctattccttcccgtatatgtgggctgtaattcagccttcttcactttcacctggagtgaattattttccctgtctctttgccctttttcactcttcctgatactcagctctggttgtatagtttatttcttaaaactttttgtggctcacattggtttcaaaatcgagtcaaaaattatttagactgacagttaaggttcagtctgtttttccagccttttcttccactctttctcttgtacaattcacacagctccacaatttcctaattatattctctaggacaagttatttaacctctgtgctttgatttcttctgtttaatgagaatggaccagatcagttgttagaaatcacactgaggcagggcatggtggcttacacctataatctgagcacttgggagactgaggcgggaggatccatttgagcctaggagtagtgagctatgatggcttcttcctgccagctgcacagacaaaatcaattccctgagatcgtgg

SEQ ID NO: 53518 - DNA, 1295 bp, Homo sapiens
gattacaggcgtgagccactgcacccagcttccattttatctctgccttttagtgactgatttcttgatctctctgtgaaatgaacataataatccttatatcatggattatctgagaatcaaacgagatgatgtatgtcaagctcttatactatgtttcctagaaagtaggtgctcaatgaatgatagatattatcattgttattttgttacttagaatgtaattggtgatcttcatgatattctactcatggtaaagactgactatatcttgggctttaaatatatcagtgttatttgagggtaaagacataaaacattttttagatctgaaaaccaggaactagaatgtgaaaggaaatatttttgcattgagcatttattgctttacatgtatttattcattaaagatttcagtggaaatttttttgatctctttagtgtcaaaccagaagagaagtaaaattcaacaaaaatttatgtgtggagttccttcttaaaagaagaaaaaagtgattatttagactatggatcggagcaaacggaattcaattgcaggatttcctccacgtgtggagcgtcttgaagagtttgaaggaggtggtggaggagaaggaaatgtgagccaggtgggaagagtttggccatcttcgtatcgagctcttataagtgccttttccagactgacgcgtttggatgatttcacctgtgaaaaaatagggtctggcttcttttctgaagtgttcaaggtgagtgagtcttcagcttttctcatattgtcttgctgtggtcacatttactgcaggttgatagttgtgtttaattaggatgtaggatttgcctaataaaggtgctgtggatcttgaacactgttctaaattctcctttcaagctatttattaacttatattaagatattttgtttgaatcccaaaaataatatgctggttaaaaattcaaataacataggattctcttccacctcacctctacccccagccacacatgtgtgtatgtatccacacatacattctccagtaataaccactattaacaattcagtatgtatacttctggactctttctgtgcatatacatatattatgcacacaccttaaatacatatattaaaattatatatacacacacccacatatatagtttttgtttgcttatcttcagtaaaattgatagctgggtacaatggcatgcacctgtagcccgagctactcaggaggctcgcttgaggctgtgagtttgagagcagcctgggcaacatagcaaggccctgtctc

SEQ ID NO: 53519 - DNA, 1017 bp, Homo sapiens
ttactcccatggagaggactctacttcttaccactcatctcagctatctaatcattagtattactttagcatgtgatagggtctctacactaaatatcagtgtttgttatgagctctctaattttttttttttttttgagacagacgtttgctctattgcccaggctggaatgcagtagcccaaacacggctcactgcagctttgacctcctgggctccagcaatcctcccaccttggcctcctgagtagctaggactacaggtgtgcaccaccatgccgggctaatttttgtattttttgtagagacggggatttcactatgttgcccaggctgatcttgaactcctgggctcaagcagtcatcctgcctgagcctctaaaattgttgggggattacagacgtgagccagtgatcccacccaatattttaagtttgtggacttaaataagttaggccatccaaaaattcacccatgattttgaagttttagcctaagatatatatattcctaggactaaaaactacggtggaaatttagcagaataaaagtttgagagtctagaggcttggcttgcacactggcatgctgtttatttgccaaattgttatcaatgttttggcttaagcatgctacatagctgttgcattagcaatagacttaaaaaaaaaaaaaactgtgaaggccgagcacagtggctcatgcctgtaatctcagaactttgggaggccaaggcgggcggatcatgaggtcaggagtttgagaccagcctgaccaacatggtgaaaccccatttctactaaaaatacaaaaattagccgggtgtggtggcgcgtgcctctagggaggctgaggcaggggaatcccttgaacctgggaggcggaggttgtggtgagccatgatcgcaccactgtactccagtctgggtgacagagcgagactgcatcttaaaaaaaaaacaacaaacctgttaaacttttttgaaattaaaaaaatttaaatgcagaaaagagtac

SEQ ID NO: 53520 - DNA, 2465 bp, Homo sapiens
agtccaagcgattctcctgcctcagcctcctgagtagctgggattacaggtgcccgccaccatgcccagccactttttttcatatttttagtatttttagtagaaatggggtttcaccatgttggccgagctggtctcgaactcctgacctcagatgatccgcctgccttggcctcccaaagtgctgggattacaggtgtgagccactgcgcctggcctggaaagtcttcttgctctcccattaagtggccatggctccaactgcctgagctactgagaagtgtggccaagtattttgttgcactctttgtctctcatggtgtgagtttaatctcttcagtcagcttggaagcgtcccaatggctgagccagaatgtttctgtctcagtttttggcagcaggctggtcacaggcagggagggagaaggaaagaagttggggaacagcccccttacattctctctcatctgcaggccagcaccaggagctgctgctgaaacagctggctgagggacgacaggctcaggttggcagttggaaggtaggactaggttcagacttgtctctgcatatttctctatggaggacctttcctttctctgtctatcctgttctgcagggaggccaggataccctctcctgcccctgtcttcattcctctcttccctgtgctgactctctctctctccagagctcttctttctaacctttctgctcccggccatgagaaactatccttgccgacatgagggttccaagtgtgctgaagaggacagtcatggggagggagagagggagaggtttggttccacctgagcccatgatctggcagatgttagagcagttgcaaagtggccaggaaggcaagggtcataccctggaggctaccaggacagaggaccaagatgcctggagggagcacaacctccttaggtcagggggtatgggtgctgtgccattggagggaaattgtctcacaggtcgggcactggggaccaaagttcagctatcctagatttgacttgggcttttggggtagtatgagtatctgggttgtatcccataaaggcattctttacctgatagagagtcagtgaggtacctttgtatgtttggatgttacagagggaggagagattggcagggcgcggtggctcacgcctataatcccagcactttgggaggccgaggtgggcggatcacctgaggtcaggagttcaagaccagcctggctaacatggtgaaaccccatctctacaaaaattagccgggcatgatggcgggtgcctgtaatcccagctactcgagaggctgaggtgggagaatcacttgaacccaggaggtggaggttgcagtaaactgagatcatgccgttgcactccagcttgggtgacagagtgagactccatctcaaaaaaaaaaaaaaaaaaaaaaaaaaaaagagggaggagaccagagtcctagcctgaggaaggaggacagttctgtgttggaagggcccccttgatacatcattatcttctctgtttctggttctgttcccctttccaggatctccattcatgttgtccaatctaagctgcctctgcccactaccttcaccatgtctgtttcttcatccagctcttaattcagtcttctggacagtaacagtagctgggaacttttatggaagccaggtaaggataaggacaaggattcccgttttgggggaggctaaatctgaatggtgcctgaatgccagctgcctaattatttaacactaggtagaatggagtctctgcctttctgtgaactcactgacctctgttgctgtttatcctgtcagtcctctatgtccctctctattagaaaggcctagggcctagttctatgcatatcacaatgcttgctgatgacttgttttctcttcccttttctttcctcttagatccccagaggagcaccctttctaacctggagcccagcatctttcagctccatgcccagagtcttaagcaagaggacctattcctttggggccccaaaatgctcctgaatgacctgtaaggactcgttaagaatagtaggatgaaggcttctttgcccaccctcccctccaaggccctgtttctgggctgcccgcccctaccttcttgaagtagctattatctgtcttatctactgaggcttttcactgcctgcccatccttgccccccatctcagctcactgcaacctccgcctcccaggttcaagcaattgtcctgcctcagcctcccaagtagctgggattacaggtgtgcgctaatttttgtatttttagtagagatggggtttcaccatgttggccagtctggtcttgaacttctgacctcaagtgatctgcccgcctcgccctcccaaagtgctgggattacagttgtgagccaccatgcccagcctatagctgtaccttctgagtgcaagctcagttgaacttggaaa

SEQ ID NO: 53521 - DNA, 1011 bp, Homo sapiens
ccaccacaccctgctggtaggtactctttagaggatatttgccccttaggccctgtaacaacatcttggggaactgcttagaaatgggaacagatagagtcttggctgggtgcggtggctcattcctgtaatcccaggactttgggaggccaagatgggtggatcacgaggtcaggagttaaagaccagcctggccaatatgatgaaaccccatctctactaaaaatacaaaaaattagccaggtgtagtggcaggcacctgtcatcccagctactcaggaggctgaggcagataattgcttgaacccaggaggcagaggttgcagtgagtagagactgtgccactgcactccagcctaggtgacagagtaagactctgtctaaaaaaaaaaaaaaaactcatttgaaggcagatgggaattctggttccctggcctttatcttggccaaacctaacttccttgagccttgttatcttcatggaagatctctactatattatcaaaaatagtaatcttgtactcaaaaccttttgctttgccaaagccaattaagtcctagcaagtaccaccataaatcagggtccacatgggagaaaatcaagggccaggggatgcaggtggtgagaccctggggctgagccagctccgggctctgctgggattcccaggcttcttgggggcgggtgtggtaaagggaaggtccggggagggagaactaggcttctctgagggctgagccaagcccaatagggccaatcgttgggcaggtggagtggagaagtaggccttctgctcttctgagtagcgctcctggggtgtcacagcatcccggtaagtccaatcacgccagtggaaattgaagccttcgagtagggcgatacggtcagctcttgtaggtacacagtcatgaggttttctgggtggcagatctggcacctctatccctggcagcagcactacccctcggatggcaaaccagcccccaaatcgggggtgtatgcacacacct

SEQ ID NO: 53522 - DNA, 1062 bp, Homo sapiens
aggctggtctttaactcctgacctcgtgatccacccatcttggcctcccaaagtcctgggattacaggaatgagccaccgcacccagccaagactctatctgttcccatttctaagcagttccccaagatgttgttacagggcctaaggggcaaatatcctctaaagagtacctaccagcagggtgtggtggctcccgcctgtaatcccagcactctgggaggccgaggcaggtggatcatgaggtcgagtttgagaccagcctggccaatacagtgaaaccccgtctctactaaaaatgcaaagttagccgggcatggtagcgcaggcctgtagtcccagctactcaggaggctgaggcagtagaatcatttgaaccagggaggcagagattgcagtgagccgagattgcatggctgcactctagcctgggtgacagtgtgagactctgtctcaaaaaaaaaaaaaaaagtacctacctcaggtagggactgaataaacacgtgtaaggcactttggaaaaatacctggcatatatagtaagcagtatgttggccattaccaaaggccctgggaattctgtactgctgctcatgggtgtagtcggttctagaggggtgggcaggtgggagtagctgaggaagacaagtggctggaatggtatcacatgatacacagaagtatcctcagttctgaatctaccttggcctcaagggcccaggagaataacttttcccagctgacagcctctctgaggacaatgacatatgaatgaggatcaaaacgagctttggccaggcactgtggcgctcacctgtaatcccaccattttgggaggctgaggcggaggaccgcctgaggcaaggaattcagaaccactctgggcaacataatgacactaaaaaagactatctctaatcaaggctagaaccaagggaaggctaagaattgcccagtactgtgcaactacgaaagccctacccaaggccaccagccttgtcttcctctttcctctgtcagttcaaaaagaacagaaacctccagctcttttacatagcaggta

SEQ ID NO: 53523 - DNA, 1358 bp, Homo sapiens
tccagtttggtagagttagaagaatgctgagaaggcagactgagtttgctgtcttcagagctctgaagggctgtcagaaacagtttagtgttaagggtttacatagtcctatgtgtgtcgtttatttagcttttttttccccttaaggattagagagtgttggcaaattatttaaactttgcctttttttgtggaaaatttaaatttcaagtgctacatgaataaattaggcatgatagtatcttaaggctgtggtgatgattatatgtttgtaaaatggttagctcatactaaaagggtgaatgatctaagactgattgcaggggtaggtttcctggtatctgagtgttcaggtgcagaactggttttgtccataggagaatggtggtgcataccattgagaaggttattaattagtggtgcctttctcttgcagtgtgcccagctggctggaaacctggcagtgataccatcaagcctgatgtccaaaagagcaaagaatatttctccaagcagaagtgagcgctgggctgttttagtgccaggctgcggtgggcagccatgagaacaaaacctcttctgtattttttttttccattagtaaaacacaagacttcagattcagccgaattgtggtgtcttacaaggcaggcctttcctacagggggtggagagaccagcctttcttcctttggtaggaatggcctgagttggcgttgtgggcaggctactggtttgtatgatgtattagtagagcaacccattaatcttttgtagtttgtattaaacttgaactgagaccttgatgagtctttattttaggaagcatattattagcttttgattttaagaggaatttactccttgctttccctgttttggggaaaatgaggagagctgcctccaaatcagggaattatattgacacaggtagatatagggaatggaactgaatgaacccaaggtgttacattttgtttcactacacatgagggagaagaataagccctgctatagtgttggccagagcactgcgactgacgccacaggctgggttaccagttaaagtctcagtgtgactacttggacacctatttttgtttagacacactattcaaagggctgcatgggaaccagaagcttggcctcttctgataaatgcctggtacctgctatgtaaaagagctggaggtttctgttctttttgaactgacagaggaaagaggaagacaaggctggtggccttgggtagggctttcgtagttgcacagtactgggcaattcttagccttcccttggttctagccttgattagagatagtcttttttagtgtcattatgttgcccagagtggttct

SEQ ID NO: 53524 - DNA, 1042 bp, Homo sapiens
ctgcaaagaggcgttccttcctcttttactaatcctccttagcacagggtgtcaggctgggggaccccggtcaggtctttcccttcccacgaggccatatttcagactatcacatggggagaaaccttggacaatacctgggtttcctaggcagaggtccctgtggccttccgcagtgtttgtgtccccggatacttgagattagggagtggtgatgactcttaaaacgagcatgctgccttcaagcatttgttttaacaaagcatatcttgcacagcccttaatccatttaaccctgagttgacacagcacatgtttcagggagcacagggttggggataaggttacagattaacagcatctcaaggcagaagaatttttcttagtacagaacaaaatggagtctcctctgtctacttctttctacacagagacagtaacaatctgatctctcttttccccacagtggtagaatgggaaagatagtaggaacagaagctaccaaataagaaaatgggtatctctcttcataaattgaagcccctggattacagtgtgttgtgagggtgagggtaatggaaaagcttgggaaggagaatataaaggctttttattcaaagtatacatactcctctcttctgtcctgctcatttagaatcagtcactcccaaagatctaacttactgaatgtaggatgatctcacagatgtattagggcaaaacaaaatggttgggaatcacctctagagataaagcatgccattttttaaataactttattgagagaagaggttaatccatatagttcatatttttatttatttatttattttttgcaagatggagtcttgctctgttgcccaggctggagtgcagtggcgcagtcttggctcactgcaacctccgcctcccctgagccattgcgcccagcccagactagctttctaaggcctatttcagctctgatcttgtaatttaaaggaaatgaagttattagagtctggattagtggtgtatgtttgggaagacccaaaggtgctag

SEQ ID NO: 53525 - DNA, 5495 bp, Homo sapiens
gagaaaagtcaaatatgcttctgatgttatgaaggcaggtggaggcacagtgatgggaaaggtcaacgtgacttttggggagccaaacaaaagtgtttgtggcattgtgcatttggattctggtttgagagtcttcatctgcctctctctctgcttctgtataatgaataagatgccactgcactaattatggttcagaaagaatgagaggttatctcagtatataaagaaattgccttgctgtttttaaatgaaaacaaaggctgagattcagagacttgtttcgttccaaaagttggaaagctcagactgtgacccttgactgctggctggagcttcttactaaaacaacatttaatgtattcagggacactggacaatgccttgattgtttacagctaagtctctttaagtaggtgaaggctgctggttatgtagaaaattaaggcttgtttctaattcatttctgttatttctagctgataggaagatgtcttcaggaaatgctaaaattgggcaccctgcccccaacttcaaagccacagctgttatgccagatggtcagtttaaagatatcagcctgtctgactacaaaggtgagagaattaacactgggctcattgagatggagttattttatattctaggggtggcttgttagatttgtgtcaatgttgtttgactgtaaaatgttttgtctcctaggaagaagtatttaggttgttaccttcatgttgaagtggtgattatcaagtgattacagggtatatatcctaggaccaaaccacttctggagaaaccacatgcttcattatgtctggacatactagctcaattatcttttcagtattcctcgtctattttctttctttatttttatttttgagacagggtctcattctgtcacccaggctggagtgcagtggcgcagtcatggctcactgcagcctctacctctctgggctcaggtggtcctcctacctcagcctcccaagtagctgggactgtaggggcatgctgccatgcctggctaatttttgtactttttttttttttttttttttttgagatggagttttgctcttgttgcccaggctagagtgcaatggcgtgatctcggctcaccacaacctccactgcccaggttcaagcaattctcctgcctcagcctcccgagtagctgggattacaggcatgcgccatcatgcctggctaatttttttttgtatttttagtagagacggggtttctccatggtggtcaggctggtctcgaactcctgacctcagatgatccgcccacctcggcgtcccaaaatgctgggattacaggcatgagccaccacgcctggcttaatttttgtactttttgtagagctgggcgccatgttgcccaggctggtctccaactcctgggctcaagccctctgcctgccctagcctttcaaagtgctgggataacaggtgtgagccactgcctctggccctcctctattttattattggagaaatactcattatctcttgttataagagacattctacatttaaagtctcagagctcactcaaatctctggagctgtgacactgctcgttcagtttgtttgggtcacgtatatatcacagctgttaatattaggctgagggctaggcactttcccttgcctgttttgaccccggaggagagttgatattacagatggaacaactctcctttctgttgtcatagtttttttttttttttttttttttgagacggagtctcgctttgtcgcccaggctagagtgcagtggtgcgatctcagctcactgcaagctccgccttctgggttcatgccattctcaggcctcagcctcttgagtagctgggactacaggcgcccgcaaccatgcttggctaatttttttgtatttttagtagagacggggtttcaccatgtttgccaggatggtctcgatctcctgaccttgtgatccgcctgccttggcctcccaaagttctgggattacaggcgtgagccactgcgcccggcctctgttgtcatagtttcatgcagacacttggcaagttctgttgaggctcctcctttctttaccttgtagttccagagcagctcgatctcctgggacagttgaggatatagattccttagaatgctaacctgaaactcaggtgtcaagtgtccttttctcagtggtgtagcattagtccctggagttagtttttggtagaacatttgactaggtttcctgacataatcacactttgttcttggggcttctcccagcaaacaaggtaagttgcaccatagggaggtgacctgggcccaggggtataagcaggaggtctaggaggagctgttctctgccctccagagcttgacctgctgaggccccaaagtgcttgttaggcaaagctggaagggttgtttagatgagttagtttccagtgatactgcaaagtggtaaatgtcaaaaagggctgcttgtttggctttttttttttttttttgaggtggaattttgatcttgtcgcacaggctgtagtgcagtggcatgatctcaggtcactgcgacctccatctccccggttcaagtgattctcctggctcagcctccccagtagctgagatttcaggcccccgctgtcacacccagctaatttttgtatttttagtagagacatgttttaccatgttggtcagcctggtcttgaactcctgacctcaggtgatccacccgcctcggcctcccaaactgcctcccaaactgctgggattacagacgtcagccaccatgccaccacacccagcctgtttgacttttcaaacattgctgctacctggaaatgagtgaatatttggaattgttctagtatttaagcctggtgggtgtggcgagaaggctgcctggccagtttgaagatctgttatttcagtggttaatcccagtgacttcattaaaattgcagctagaagttctgttactcactagtacttttgtcttttctgtctctctctgtctccctctttctctctctctctctgtgtatatgtatatatatatttctgttgttttgagacagtcttgctgtgttgcccaggctggcctcaaactcctggggtcaagggatcctcccacctcagcctcccaagtagctgggactacagacacgcaccactgtgcctggcttaaaatttttcctgtcctgtcaggcacgttaggaacacatgtgatcacttaaaccatgcttgttccattactatggttcatcacgggagaagtgcaaaggctgtgacttcttattggtgtcttatctctacagcagaggagtactgcaattcagctttctctgggtattgttaagcattggcattaggccatgcttataagtgcatccttgcttttgctatctttggagaacttggtgtttatgttaattttagccactcagaaaagatcaaaattagactgaacagtgtttactctgtattggtagctatgacatggaggcaggagaataaagtatgggattggaagtttttttcattcaggtattcctaatgcaccaggttctaaaagtagcttctaggagacatctgtattgagcatcttggcagttagtggttattgtgtcagccatcaacttgcttctttttgtataggaaaatataaagcaaggaagtctgtgtcaaatgctaaccatgactccgattttccccccaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatggtaaatctcttggtctatttggcatgtgaacttttttttttttttttttttttttgagatggagtcttgctttgtcgcccaggctggagtgcagtggtgtgatctccgctcacttcaagctctgcctcccagtttcacgccattctcctgcctcagcctcctgagtagctgggactacaggcgcctgccaccatacctggctaattttttgtattttcagtagagacggtgtttcaccgtgttagtcaggatgttcttgatctcctgacctcgtgatctgcccacctcagcctcccaaagtgctgggattacaggtgtgagccactgcacctggctggcatgtgaacttttaaaacagcaactgggaagctttggcaatagactttcaagtattgccttctcattgaagggagtgcaaagtctgactttctcttattgctctcatgacctggcagcagagaagaagcagcttcaattgcagttgagtgtaccctagtgacctaccttaactgttctcagcattcactttattgctggaaaacggaaaaaaaacagtctttttggaaagttagattaggaatatgggaaaggggaaagaggaatgcgtacagtcaagtcaagagtttgaatgtaactgtatgtttgccttttgccatagggtcaatacacctaagaaacaaggaggactgggacccatgaacattcctttggtatcagacccgaagcgcaccattgctcaggattatggggtcttaaaggctgatgaaggcatctcgttcaggtatgtcatcaggacaagtatccagttggctgaaagccttttatttggagagatctagagccctgatctgtagagactccttgtcatttcattcctttatgcaggggcctcctcactaaggccaggccagtaggagtgtggagaccagtccatttccttcaggcttcaagcctctgtattctaacaaagcacatctctaaacctgtattgcttttcctttcatctcttttcccaggggcctttttatcattgatgataagggtattcttcggcagatcactgtaaatgacctccctgttggccgctctgtggatgagactttgagactagttcaggccttccagttcactgacaaacatggggaaggtaagccatctgtctgataacaggacaacagagtggtggtatgaaggggtgggttgccccttcacacctgtgggtgtttctcgttaggtggaatgagagacttggaaaaagacacgtagacaaagtatagagaaagaaataagggggcccaggggaccagtgttcagcatacagaggatcccgccggcctctgagttcccttagtatttattgatcattcttgggtgtttctcggagagggggatgtggcagggtcataggataatagtggagagaaggtcagcagataaacacgtgaacaaaggtctctgcatcatgaacaaggtaaagaattaagtgctgtgctttagatgtgcatacacataaacatctcaatgccttaaagagcagtattgctgcccgcatgtcccacctccacccctgaggcggttttcccctgtctcagtagatggaacatacaattgggtt

SEQ ID NO: 53526 - DNA, 1343 bp, Homo sapiens
ttcgggttcgggagcggccacaagggcgcctcactccaacctcagccatccgcaacagggtggggtattagtatttttccgcacccgccccaacgagggaaagcgccgagtcattccggcggggcgcgccgggcggggctcgggccacatccccctcctctctctcctcctccggcacccccgtccgttccgactctcgcgagatccctactggctataaaggcagcgccccggagagctcttgcgcgtcttgttcttgcctggtgtcggtggttagtttctgcgacttgtgttgggactggtgagtgtgggcagtgcggcccctgcggagtgaggcgcggcgcgcccttcttgcctgttgcctcttcctcctcctgtccggggcccgcccgcgctcgggtgggggtgctgtgatgcgtgaggcagccgggggaggcccggagtccgagactgcttgagcgctgcgcacacccctctcgtgggccccccacgtaggtgcgggaacctggttgaaccccaaggcaagcgtggactcgagtcgagtcttcccccggcaactcgagcacgtggcgcggcgtctgggcgggctggtggtgggggtctccgagactagcctcctgccggacggggtgggttcgggaagcttctggaatggacctgtatccagactcgtggctgtagaagacagcctctatgtatttggctgttccgggtcctgagccttgactagctgcggagcttcgggtaccctttccccgtctttattttcctgtacgtggaatggagttagcgatgagcccaaatgtccccgctgaagcactctctctgctggtgctttctccagtgctggggagggacagggggcacctgaagtggggtttagggatgtggccctctacgctgggcagatcccctgaaggggcccggtggcggcctgaatcccagcagcctttaccccgaattggttgggttttgtacttgggggccacttgggaaagaaggattggacgagaaggccatttgggggcaccaagttgcagcatgccttagtttttggtttttgttttttgtcgttaaaggtgttaaggactttttaaaaaacagttaaaagtttgctaagatccatgcttacaaaatttcttttgcttgtggtattgtgaactaagaactttgggacttggaaaagctttcagaccgcggcttagtgggttaaatctctgttttttgagctagagtctcgctctgtcggccaggctggagtgcagtggcgcggtctcggcttactgcaacccctgtctcccgaattcaagcaattcttctgcctcagccttaggagtagctgg

SEQ ID NO: 53527 - DNA, 1051 bp, Homo sapiens
tttactactgaaatgtaagcccctggggttgagtggagagcgcagagcactggaggggacgagacttggtttcggatttgagctcttctttttctctgtatgatctcttgctaacttcccagtttctctgaacctgtttcctcagcaataaaatgaggtcctacattagaactgtagcaagaattgagataaagctttgaaggcgcacagcgcatactaggtgatctgcaagttttaattgccatctttttgtttgctcacctatgtgctttttccagctgctccggctttcttatgcaggtgcagggatagttctcagaagtggggagaagtggggataattctcttacttagacacctgctttgggtctgagaaagtctgacatgttattctgttgccccagaactctgttaaagtaagacacagatctgaaccttcactggatgaggctactgttaattaactcttccccttcagatcgttcatactcagggctgcaggcctgttacttttccaagatctgtttccttatctttaatacaggagcaatctcagtatgattctatctggtccactgggattttttgccgagtatagtaaagtgctttgatattctccaagaggattcttttcaggttttccaacaggtaaaggaagaaggtgacagaggcagcgacttcctcaaatgtccttccagctggccaaactcaacctgtcaagatctctcccccataagctgtgtgtgtgtggtgtgtgtattgtgtacattgtatgtatgtatgtatgtatgtatgtatgtatgtatgtatgggacaggtactctaggagtgaggggttcaggcagatgacaggctcagacctcaaggagtagccaggtttgtgggggaaatttatatataaacagaaaaatgtagtgatgtgcacatgctatcagtacatggaagtagccatccatttatttatttatttattttctttttagagatggatgggggtctctcggtcttttgcccatgctggagtgtagtggtggaatccttgctcagtgca

SEQ ID NO: 53528 - DNA, 1021 bp, Homo sapiens
ccctgtctctgctgcctttgctcacaggcacatatataaccacgtgtttgtcctacacatctgtcccctcttcccggcccatgctttgtagtagtgagacagagtcttactctgtcacccaggctggagtgcagtggcgcaatctcagctaactgcaacctccacctcccaggttcaagtgattcttgtgcctcagccccccgagcagctgggactacaggtgcgcgccaccatgcctagataatttttgtatttttagtagagatggggttttaccatgttgacccaactggtcttgaactcttgacctcaggtgatctgcccgcctcagcctcccaaagtgctgggattacaggtgtgagccactgcacttggcgctttgcagtattcttgacagtggaaatctgagacctgaacaacagcactaaccccaacaccattctcttcccatctgtgtttcagggggcaatggcggcttcctgtgttctactgcacactgggcagaagatgcctctgattggtctgggtacctggaagagtgagcctggtcaggtgagggatgggggaagaaaaaagaaacttgttgagcctctgcctgcattttcctagcagccccacccccatactccccttccagcggggatgagccagtgggaagagataagagaagacaccaattatacatcctgggcttccccagctgactcagagagtgggctgaggggcccagcagggctgggggcataggaaggacatctttctctaactggatctgcactgagtgctgtggcaaacatggggcccctctgtgcccatccctatgctatgacccctaatatggcagttatcaccctgtgctgtgatcatgtctcctctcccacactgggttctttgagggctcagcctctccctactgctcagtccagaattaggcacatagcaggtgtcaaggtttgaagaataactaggtgaattgtatattgtatagaccaaaggtcagcaaattttttttttttttttt

SEQ ID NO: 53529 - DNA, 1065 bp, Homo sapiens
catcttccatcttttcacctccactgcatagatgtgcctgttatatttctgagcccccttcccccagcattgaccttggggtggtgacagtagaaggctgaaaccaacatagctgaaacctctgcttctctcacctggcaggtaaaagcagctgttaagtatgcccttagcgtaggctaccgccacattgattgtgctgctatctacggcaatgagcctgagattggggaggccctgaaggaggacgtgggaccaggcaaggtaaggactggggttgtaaatagaggtgggataagagaacttagaagctgaagctagggctggggcccagctggagggaatctggcatcagcttccttccagttcctctcccagagttgagggtgggtgagaccacgtgctcatggctcttctcactgtgggccctgccccctgcactaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagtgagccttgccagagcctcatctggggaatcagggggttgagcaggatggtgttagtaacttattgtaagtcacagcagcagagcaggataggaacactcatttgcatgccaagctgaggagcttgacatgggatcttagcctcttctgctacagcagcttagctgtagctacaggagtttaactctggaaaaaggaaggcagtctcacatggtgtgtaccccagggtatgcacctgtaaccctcctgctccctttattcatttagaaaaggtgctgacttttctgttgagcacctggggttacagtaataagtaagtctcagcagaagatgtgagaagagctcaccattagtgccgtgccctgtgctggaagaagggtggataactccctgaggatgagttaaggaagacttcctaggggagaggagatatctacgtctaggaagaggagggggcataggcattccatgt

SEQ ID NO: 53530 - DNA, 1018 bp, Homo sapiens
gatctccagctcagatcttgctcaggtatggggcagtcttagggagagggccctgggttgggaggcaagggttaagggatttcttatttcagtgtctgggtgaggctgaggatcttgccttgtgatctggagggaggccactgtaggcatatttcccatttcagcagggctcaggtgctccaggagcttagggaagctgcatggggaacaaaatagtgcttatgaatactgaccccttttcctcatctgtctaatcccccaacttaggtggcaggtccagcggaaagtgatctgcatccccaaaagtatcactccttctcgaatccttcagaacatcaaggtacttggtaatgggttctatcttctttagctctttgggacattttcttggccctgactctacctggctaaaaaggcagtgttgtggaaccccagcttctgctcacaaagctggctttcttgaaccccactctccatcctcaggtgtttgacttcacctttagcccagaagagatgaagcagctaaatgccctgaacaaaaattggagatatattgtgcctatgcttacggtgaggatgtatcagcctcctagacttggggaatgtgagatttggggtgggattctggcccaggtgtgacctaaggcttgctggttgtgagaaggacacaatgttgtgggtgggattgctatgctggacatagtgccctcatttctctttattgagctcagggaagtagtatggctcagggataaggcatataacctgtgagtcccagtcctgcttcttgatatcttgtaacctagagcaagttattaaacttctccaagcctcagcttcctatgtgtaaaatgagcccagttcctgacatgtagtagattctcagtaaatgatatgaggagagcccagaaggcgttgttgacctcactcgagggattggggttgggagggaagtcggctgtacttagggaaataaatggttcctggcctcttgatctcagttcagactgcaaactct

SEQ ID NO: 53531 - DNA, 1874 bp, Homo sapiens
gatcagttctagtcgctgctgcttgtacccgtcctcggcccttgcgtgtccgtccgttacgactcagaggacggagagaaagtctaagtcaccttcctcagtatccaggccggaaggagactctcagctactcgccctgaacatgcagagcagcactggcttccctgtctctggatgccgcaggggcgtcctgtcaggagttgtagtgtcaagattccagttcttcttatgcgacttgctggagaagcaggaagttgctgtttattggagaagtcgggctagggagggaaacaatcccgcggagccatatggagagggcaggaggtgtctagatagtggtaggccggcgggggacggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaagtaagcgggactgtggaaagcttaaggcactggccagtccgcggggagggctaatggacgggggctccggagaaggggcagaccggtgggcgggagtacttgccttcccaagagcagctgtcgctgttcgggaaggcctggtcactggagcagtccttcttttgctgagagcctcgcgcagcagcggtaacggcggtcggctggcgccccctgccccgcttttcgcggccgccatcttgccgggggcagcggcggctgtatccttcgcctgcccctctccttcctcccccagcccggggcggttggccgggaggcggggccctggcgcgcgggttggccttcacgccccttctgtccccagcgtgtgcctctggtagaacccctggataacccgggaatataaccaacgaagatttggcgccaaaagggaaaaaaaaccttgcacgaggaaggaggctggacctgaggggtcggggtgggcggggccttgctgagggcggggttttgcgcgcgtgcgttcgcttccctcgccggccctggggcagggggcggggccttgaggaggcgggaaaactccattgtttggggccgctgcggctccagcaggagctttggactatctccgtggggccggcgaggctagttccccccgacacctcgctcacgtcttgtgctgggagatagttatcgctccccgcgactccgtgagcccctgcctgtggtggggaggattgtcgttctttagactttggaggtggtgtctgtttggggggaacattaccggacgtaaagcgtcttcaggaagcgctgtctggagctctcaccagcactgtttggttgctaggtgaatcggcagtagtatgcacgaagtggagaaggactggagggaaacaagataggattgttttgaaagcggcacagtgccactcaggcgtaatctgttttttgaacagtggagggaaacactacacgagttcaaggaaacaagtgctgtttcccatacagtaggtctgatttcccaatcttgccatatttttttaggcatctggttctatttttttttctaatcttgtgcgctttagaggttagttgccttccctgtaaaaggaatggttgctgtgaagttttttaaattgatattctataggcttacactctgtcatgattatgtctttgtttgtttatagttagagatttacgtatatctctgcttaccaccttttctctctgcgttcttgtagag

SEQ ID NO: 53532 - DNA, 2235 bp, Homo sapiens
ttttttttttttttttttttgaggtggagtctcgctttgttgaccaggctggagtgcagtggcgcatctcagctcactgcaagctccgcctcctgggttcatgccattctactgcctcagcctcccgtagctgggactacaggcacccgccaccacgcccggctaattttttgtatttttagtagagacggggtttcaccatgttagccaggatggtctcgatctcctgacctcgtggtctgcccgcctcggcctcccaaagtgctgggattacaggcatgagtcaccgcacccaactgagaaaatactctagtcaggcttctgggaatgttgcctttaagatttcttttgattttgtgatggtaaataagtgtgttagccaggccttgccagagtagtccaaaagttttaaaaaatgaaactattgctcaaatgtagcaggtattcaaaaaatactgatttaaacagtacttgacactagaaaaaatcttttttttgcagtctggatgtggatagtgaagctaagaaactattgggtttaggacagaaacatctggtgatgggggatattccagcagctgtcaatgcattccaggaagcagctagtcttttgtaagtattgtatattttgctatgatgtaatattatgttctaataaaccttgagttatcaaaaattattttatggggaaaaagcatgaagagcaagagttttaaaacatttgattatttttcatgtggtttgtaccagtaactataagtgtaaaacttaaatatcaccaagcagttccaccctttcattttcctgagtatgtaatttgtattccagtcactactaatttgggtgaccacaccttgtcctggtttatctaggacccctctccccatctctccacccccgcttttttttgttgagacagggtctctgtcacccaggctggagtgcagtggcacaatctcatgctcactgcagcctcaacctcccaggctccccagtagctgggaccataggtgtgtgccaccatgcccagctaatttttgtatttcttttggtagagatggggtttccccacattgcccaggctggtctcgaactcttgggcttaagcgattcgtccaccttggcctcccagagtgctttgcaaagggattacaggcatgagccactgagccccagcctgactttccgagttttaacactagaagttctgtgtctgtggaaactctttaggtccaagcaagtcatgattgatagtgctattattagcacagcattttttcatacatttttagcacatttttcatacattcttagcactgttgttggatttgcttagaagttggtagctaccaccaggtagccatatagacctatatcctggaggaaaaggttagctttagtgccttaaagatcatttattttccccaaagactttaatgtacctccattatctgagagaaaaaaaagcaagttaaatcgtcaagcaacaggcttttggtctatggcgaggtttgagtttcctcaaatatagtattagcaattgcaattgaacttgaaggtcaatcattgcatacattacatacagttgattacattacatatagttaagttaaatcttccttataaaagaaatggttataacaaagcgtttgtgggtttcaggtttgacgcttaatatcaatccattcttttcctaaacccctactgcctctgccaacatccagaacagaatcttactcctggatatctgcaaaaatcttttgtctgattcctgtcctctttgttcctctctgtttgaccttaatgaattggggctctgagagactaaattttatctggtagtatttagagattttttttttttttttttttgagatgggagtttcgctcttgttgccctggctggagtgcgatggcgcgatgtcagctcactgcaacccccgcctccctggttcaagtgattctcctgcctctgcctcccaagtagctgggattacaggcatgcatcaccacgcctgcctaattttgtatttttagtagagatggggtttctccatgttggtcaggctggtctcgaacgcccgacctcaggtgattcacctacctcggcctcccaaagttctgggattacaggcgtgagccactgtgcccagctgtatttaggtatttttatttaaaaatgcatggttgtcttacaacataaaatgttacctaagtttttaagcacacataaat

SEQ ID NO: 53533 - DNA, 1004 bp, Homo sapiens
ctgtgagaataatttgtctaaggtctcacagctagttatgggttaaaggtaggatttgaatccagttagaagaactccagatattctgcgctttacatcatgcctttccatgggccttaatcatcctctaggtcccagccaaaggtcctttaactattctgatccatactgacatccatcttttagcaggaggaatacctattaataccttagggctgtttggccctacattatgtattactaattgtagcacatttatgtcacttaggatgtatatatattatatattgataaagagcatacaaaattttcatgcattgtttaatgtcactttgaccttgaaagcaagaggggtattggttttctaggagtatgttactggagaaatatcaatttataactgaagaactagaactaaatgttttagattagatggtaattcagattttagatgtttattctctttgtagaggtaagaagtatggagagacagctaatgagtgtggagaagccttctttttctatgggaaatcacttctggagttggcaaggtatggatgttgtatttaaaaactgaagtttccttgttaagattgtttactagctttgagatttcacaggagctaagcaagattggttttacctagagagttttgaaggagcttgaagtagtgatggaagttgtgaatggcacttgatacaattagtagttatatttaagttttgacttttggagtcagtagaagcaaagttctttccagtagtgaatgatccaaagttcagtgtagagaatctttaaaagcactgtgagctagctcaaaacaaggactgaatagaggacaactggaaagaattagcaagtgagactgtccagtaaaaaagacttttactattgaaaagttcttggctatgttctatcagaatttattaatcagaataagttctgtttagggtatacaaactagcaaatgatgtcatctatttaatctcagttctggtaaggt

SEQ ID NO: 53534 - DNA, 3974 bp, Homo sapiens
gtcaggctggtgttgaactcctgacctcaggtgatctgcctgcctccacctcccaaagtgatgggattataggcgtgagccaccgtgcctggtctctggtaagtttttaatctcgtaatcatacagaactttctcatgatttgccgtgaaaatcttgctagagtatttttggctatttagagaaatcgggtggatacaaagtttgggaaatagtatggtcctattacaaatggaatgcatataggtcttgttcttttgacaagagacatgcttttcaggcggctggatggaggaatatgcttatttccttcagtgctcttgcagtcttaatttatattactaaagttttgatcattgcttccttgaatatacatagttttgtattgcctgcgcttggcttacacttcttgcttttataatataggactgtattttctgtcttagaaaaaattgctaggttctagccatcaaacctttggtgctttcttttgttctcctagaatggagaatggtgtgttgggaaacgccttggaaggtgtgcatgtggaagaggaagaaggagaaaaaacagaagatgaatctctggtagaaaataatgataacatagatggtatgtggagttgcatgtgacattcaagagatgcgacgttgtatatttcttgtatacagtggtggaaacggggctctacctgtcctggatggtctctcctaagatgcttggggtgatgatgcctgcatctggtggagattgcagtggggatagctgtttactgaagctgacagcagatttttgaaagagaataacttattttctcaagtaaatccagttatttcgattggggttttttaaatcaaaaagataaaagcaagattaaattggtgttttaaatactattacaaccttaagtgtttttctgatgcaaatttttttaaacagcctgtgcagttcagttattttaatagcagtacttttagagcccttgtacattttttatgtgtgcgaaaattatataatttctaagctgaatttggctgctatagttttacatatcagatgggggagaatgaaaagcttggcatctcttacctaactggtaatcagaatgctcaagtaaaacaatacctagtgtaacaagcttgggtttcttttgcagtaagttgctctgctagccgggatgctccctttccttttctctagggggcagataatttttaggccatctgctgaaacttggtaggctttttgagggtttaaagggaatgtatttttagtttccatttatgcctttatcattaaactcgaagacatgtttatgcttcatgttctttaaccatgtagaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactgaaacctctgaagaggcaaaaggaggagcagcaccagaaggaccgaatgaagctgaggtcacttctgggaagccagaacaggaagtaccagatgctgaggaagaaaaatcagtttctggaactgatgtccaagaagagtgcagagaaaaaggaggtcaggagaagcagggagaggtaattgtgagcatagaggagaagccaaaagaagtttcagaagagcagcctgtggtgactctagaaaagcagggcactgcagtggaggtagaagcagagtctttagacccgacagtcaagccagtggatgtgggtggggacgagccagaggagaaggtagttacctctgaaaacgaggcaggaaaggcggttcttgaacaactggtaggtcaagaagtaccacctgctgaagagtcaccagaggtgacaacagaggctgcagaggcctcagctgtagaggctggatcagaagtctctgaaaagcctgggcaggaggctccagttctccctaaggatggtgcagtcaatggaccgtcagttgtaggagatcagactcctattgaaccacagacttctatagaaagactgacagaaacaaaagatggctcaggactagaggagaaggtcagggcaaagctggttcctagtcaggaggagactaagctgtctgtagaagagtctgaggcagctggagatggggttgataccaaggtagcccagggagctactgagaaatcacctgaagacaaagttcagatagctgctaatgaagagacacaagagagagaagaacagatgaaagagggtgaaggtaaccgggatatgcaagagctgcagtgggtggagtacattctggatttgactcactaattatgggtaaaagtcagccttccattcaggattttccgtctgcctttggattaggaaagggctaaatgaaaaggggggtagtttaacaaggtcgtgatagtcaagtaagttcaatcaaaagcagcaagtcttctttagctggcttataaactaacacttttactaactgcaaaataggccttctgtgtgatttctgagacttggctagctatcagtaacttgttgcagcatactagccaataaagtgggatggaaaaggtagatgaggggtggggtaggtagggaaatagtgggctaggctggcagagaatgctgaatggatgttcacttgcatgcctctggattttaaaattattgttcacatgactccttttctgtgcgttgggaagcagctacagagcagtagaatccactgaattggtacactgaagcaggcatgccatttaaatgaaggcagttaaccttgactgttgtatcaccagagttaaagaattctggtgcccctctttaagtcttcaggaagtgtttagaggcttattcacattagttaaaacaggccccccccaccttccccaaggcaacagaaaacataaccattagctctcttcctgttttccttcctcatttcatgcttgcttcggctgctaaactgaatttttgttacttagaatattataaagtgtggatgctttctataatgctattggtctaagtgtgattaaatttcattaaggtgtataagcctctaattattacataactggcacgtctgacttttgctatcatttgaggattctactgtatataagtttcatctaacattggcattaataaccacaggtatattccaactaattgttacttcttgtaattgccagactacttcaagagttctcgtaagttttagattttcagagacccatcttcaatactttgaactcattctggtaaacttccttctacctatgtgcaggtccctgtactccagccaacacaggctcagtaactggaaatgaattggctaaaatggtagcaccattgggtttcttaatggagctttaggagttctttatggaaaaaagcacagaactaaattcctcaaaaaacaaacaaacaaaaccacacacacaaaaaaacaaaactcccatgtcttgatcttaatgattgtgagcaaggatggtaaaaagctctgctggctgacccctaagaccttgaatggtaagctacaatacagatatcacagtcccttacagattgttcgaaaactcgttggatcataattaacattgttagaactctcatacattacatctgatcctaaaacaatactatgtgataggtagtattgcccaagttacagtgatgaggttgaggtttaaaggttacatgacttgtttagggtcataatactgaatctgaacccagatctgccttgaatatattattcttcccaagttaccacacattgaagaagacagtgttcatccttttcctacacccactgcttagaaattttgtcgtgggctgggcgcagtagcttcacacctgtatcccagcac

SEQ ID NO: 53535 - DNA, 3746 bp, Homo sapiens
tctctttgtggttgctgctgataaaactcctttgacctgacgattgctctaagtcctaattgccatatttatattcccatagtaagagtgtttggagatagtgtttgagcttttttgctggtgttaaaaatgcataatgaaagatggcagagagaggcatattatatccaattcatgagttgtttgtgttaacagaaagcttattttaatcacttaacattgttgatttgtctaatcacagtagcgctattgattaggagcctgacctttagatggttgacttgtgagtgtattcaatatggtgaaatatggtgttgatatatggctgcagattttagaggtgtcattagcaaaggtataggagtaaaataggggttatagtattccttactcaaattctgtatgtgctagagctggctggagtctgtggcatgctcattggtgtaagtcggtaaggactatgctttttgctccacatctctgttgtgggaaagctagtctcttgagcattcttgatcagaatggactggaataatttaactttcgtactttcccaggctattagtattatctaatgagtggcttaaagataccagaaacactgactgaggtctccacctgcttctggctgaatgaatgggagcttctagccattgaataagaggcagtagccaatgtttcttattctgaatggtccaggttgacttttataagagaaacactcagccttttaattgctgaaggtctgacccatagactaagattgcacattcttagtctaggttacacttgaactagactgcacccactgacgatatattcagttcaggtgttaactcacttggattagcatctggcctgtcctatctgaatataggttgagacgtgtattggaatctctgactagtcagaatacgttcttagttatattctcaatactgaggaatttttacttgtagaaactgaaggctcagaagaggatgataaagaaaatgataagaccgaagaaatgccaaatgattcagtccttgaaaacaaggtatgttgttagccactcagtactgttgtcagcctttttctgtttttgggagactggagctcactcttgttgcctaggctggattgcagtggggtgatcatgatcatggctcactgcagcctagacccgggcttaagtgatcgcctcacctcagcctctcaagtagctgggactacaggcttgtgccaacatgcccagctagtttgcaggactgtagcttacctagtttaggcacgattattatttttttaagagatagaatctctgtctctgcccaggccggagtgcactggcatgatcagggctcactgtatctttagcctcctgggttcaaggaatccttctgcctcatcttctcagatagctaggtctccagatgtctgccaccatgtctggctaatttgttctctaattttattttgtttagacggctgtcttgctgtgctgcccaggctggtctcaaacctggcttcaagttattctcctgcctcagcctcccaaagtgttgggattataggcataacccaccatgcccagccctaggcatgattattatagataactgtctcttgattatggattagggaccctttattcatgcctaggatgggtggatatatttgatcctggggttcttgtgtgttagtatgtgagccaacatttcactgttaaaatatcagtgacatggtcatgacttaagacagtatgtggacccattctctagattttagggagaaagtccaaattttgaatcgtatatcaactttttttaagctacgctaagttatacatttagatttgtatttgaaaaagatgcctatctttttattatttggttatactttagtctcttcaagaaaatgaggaggaggagattgggaacctagagcttgcctgggatatgctggatttagcaaagatcatttttaaaaggtaaaactcttggtgcttctaggcttgggttgggagtttggtggttaaatagaaaccagttagggttagacaggtactgttaaggtttttgatcaattttccttcttttaggcaagaaacaaaagaagcacagctttatgctgcccaggcacatcttaaactcggagaagttagtgttgaatctggtaatgcattttccattttatactctcctactctcttcagctccctcgttcttcctctaatagattctctggaaccgaacttgatctttaaaaagataggtctgtgttccctgtagaccctggaacaatgaacagtctcttccaagtggcactcagtcttccagtaggtttgttttgttttgttttttttgagatggggtcttgctgtgtcgcctaggctggagtgcaatggcgtaatctcggctcactgcaacctccgccacccgggttcaagcgattctcctgcctcaggctctcgagtagctgggattacaggcacccaccaccacgcccggttaatttttgtatttttagtagagacggggtttcaccatattggccaggctggtcttgaactcctgaccttgtgatctgcccgcctcagcctcccaaagtgctgggattacaggtgtgagccaccacgcccagcctcagtaggtttttaaaagtcattttgactttctttatagccaagggtcctggaaataactataaacaaaaatggaatgttaaatatgggtgcattcccataggatgggtctgaattctggaagtattttatgttgaatgctgtccatttacttgctcttctttttctctttgttagaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatgggtgagtgaagacgagctgcttcatggtgatgttggatccagcaattaacaaggaagaaaacagttcttttttgagccattactaatcactttattctttttagctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggttggttccgttaacattttgataatagcatgtttggtaccatttatgttaatgttctatttgccaggaacttttcatcatgacttggtttccagggagttggtgggctcatctaattattcctatcaagtaatgcagtggttaagaggaaataccctggagccccagactatctgggttttaattccatacttacgtgtggccatgggcctttctctccctcagttgaccgatttgtaaaatggggataatacaggttgagtatccttacctgaatgcttgagaccagaagtgttttgcatttcaaatgcttttggattttggaatatttgcatcatactcaacagttggatacccttaatctaaaatctgaaatgctccagagagcatttcctttgagtgtcagtcagtcctcaaaaagtttcagattgttggattaagggatgggatgcccgacctgtagtacatatgtgtaaaatatact

SEQ ID NO: 53536 - DNA, 1483 bp, Homo sapiens
tccccagtggaaatgaagtttcggaaaacatggaggaggaggtgggcagttaagcagggcttagcctcttgcctcattccttgttctcaggacctggggaaatcagtcctctcaagtgcatgctccccaccttgagcctgctaacgattgttgagtgcagtcctcacagaaaacggtacttgtgcaggaaaacagtttggttatgggagtataggatgactcactgacaaatggaacctgtatattataggtccctcgatgaatatatgagaaggcacttgatgggcaaaaccattaggtcacttccttccacgtgatgattattggctctgtcagccccattatcacagagtattcaagaaatactttgtggtcactgccctcttaatatagggagcaaagcagagtttgggtgacttgtatatgcttcctatgactgaggcctcagttatataagacagaatggcttaaactaggctcactcatgcccaggttctgtttgtcttccaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaaggttgaggctttgatggtttttttcttaattattggctgaatctgccttggagcactgctggttttatatattagccaaaggttttgttctggccttctgtactgatctgtgttcctgatcctaattcctatctgtctaacgtggaggtgatcaagtgtggctgtaggcctttgttttccaatggtgctatattctgttttcaaacacttcactgaacccagctgtcttgcaaactttcagtggtgctgtccctggatgggggctacaaaaacaagaattggtgaagatcttgctcttcagtgctgaaaatggatgatggactttggctgtgagccaggcctaggatggttcttgtcctatatccacctagtcttcacctggggctataattctgtcctggaaaaagaactctgaaaacctgggtcaggggaatgattcctaaggaaaacggtctgcatttgagctctggtttgaaagtagccaaggggactgatggtggacactccagatgtggttggaagcatatgtggggaggctggctggttgagttttgttattttctgtatagaaaggttgagatatatcaacacttggaattgttacccatctgcagaattgacttctcaaataaagatgctaaaaatctccttgtctggaattatgtttaaagatcttaagtggggtcttaggctgcttttttgagatgggatcttgctcttgtcgcccaggctggagtgcagtggcgtgatctcggctcactgcaacctctgtctcctgggttcaag

SEQ ID NO: 53537 - DNA, 1686 bp, Homo sapiens
gttgcaggatctctggcttatcctggctgtggagtttcttcctgatgttgcccttgcagtatatgttccaggtcctgaggcgctttgcccccttttcttggtcaggacagtcacgatgtagtttactcccaggcacttgaccttctctggttggcactgggatctagggctaggcacagtatctaagctagatctcacatgtgacccctggttgggggaacaaccttgggctggggacctatcccagaatcaaagtacataaggcctcaggagcttcctgtttatgggtacattgagaacctgaaaggtttcctggcagaaatactgaggaaacggatttaagtttggcaataaaactggctttaccaaaaaaagcagtgggaactagtgggaatttaaagttgctttagtgggaattaatgccccctagtcacctttcggagaacttcataagtgccagacaatatcacaaatacctgacaaactcatttaatccttaatctgttttacaaaaacagaagaggtacagaaaagttaaggacttaacgggaggtggtaaagctgtggttggaactggttttctgtactcaactgctagatgcttctagacccaatgtcagaacatggagtagtaaacctgtaggtctggaaataggccccagtcctgtgcatgttcagatgctcatctccacattcacttgggttcagaaactcactgggggcaagtcagaactgtggtgagggcccaaaccctcatctctatccttgactccactgaggggctcttctgtacgaggtgggggatcagcaaagccaactgcgggggtgaggaagctggcttccagtgaagatgtgctggacacctgtggaacaggagaaggcaggttttgagcaaaaatgtaaaggttaagcacacaggttttggagttagttaggcttccttagagtctcacttactgtgaaccaagttaacctgctcctgctttgatttccttatctgttacatagtaggacttcatagagatgtgaggatcaaacaagaaagcattggtaatgactggcacacagtggtcaataaaggctggccgttagccataccagccacaccggtatgtgtagctgtggtgtccctagctgcagctgggccctcaccggaggtgggtactggtactcatggacacttgctggattgatctctgccagtgtctgtacagctgcatctcttgcattcaccagccgcagaaagagctcagcctgacctgcctggggagagatgaaatggtattgcacttgtactttgctgtatgcccaatccctgcgcaccacactcacctgaggaatcccattcagctgcccaaggctaaggctggggtccagaggaagggcccgaagtgggaggcgccagcggccacttagcacccgctgatcttggtcaaatagtccaagtgagacccaagcctttggctgtggtgccctagcccatgctagcccctgccagacctgcagctcacagaccaaagatactgatgatgagggtggtagtctgtagaataaccaaaaagcagtgtcggaagccagagctacagtccctttctaggacttagccctttagagccagcggcctctgtatacagatgagaaaacttagcagaatggtggataagcctcaactgtggcagagtacca

SEQ ID NO: 53538 - DNA, 1050 bp, Homo sapiens
gacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttggattgtcttgtgtaagaagtatattttctttaaaattagatgagtggattcttttttaggggaaatatttttagaagttggggggaaatgtgaattcagacacaactgtttctctattttagcagatacttttttgatgcagaaaaacctgtgcaataaattaccagtaataaagtcagaaaccaagttttttttttttcctgaaactgttttttagtgcccatgtatttaccagtgtacgtattttaagggaagtctgttctgttttcctactaaataagaacttggagtgggggttgggggagagttg

SEQ ID NO: 53539 - DNA, 1246 bp, Homo sapiens
tctgttacctttattaccctcccggactatggaattgatctcctaatggtctcttagttgatgtttaaatacctcagatccatcctttaagctgctactagagtgacggttgtaagttgataattagataatgttaactgcatgaaagatggatcctcattacctgtagaataaaacttaatctcccctaagaaatcctccacaagctggctcttgcctgctttgccagatacctctttccccacagaagggtcccctccttccctagcactactcatgctgaactatttgcagacctgaatattctgttctttttaatgctttctgttcctggaattaccgtttttccagctttggaattcatctttaaggattcttaaatcacctgttagtaaagccttttctgatagcacttctctttcaagtagaattgatgtttcttactgagtactccttcttccctaatatgaatttttttcatcgtccttgtaaccttttattgtacttaacttgtctagaagtttttatagcaaaactgtgacccgtgtgaagacaggggctctttattgtatttctagcacagtccttggcatatggtctgcccctgccctacacccatcttagaaatgcagtgaatactatacatttcactgaccacattgtcctcctttaatctgaggaaaatgatccacattcttgttcatctaactttcagtgcctccttatttggcatacatatcctataggaaagtgggaattcgcacatttagtctgtttatttaaaataaatgaaatcccttatatcaaaggaaatgaaactcaggagaacctaatattaacataatacctattgattttgtgttttgatattttctgtttgttacgtttctgaatacagtgtcaaattagtaagtgttgctaatatgtaaaatatgtaattatttgataggttccatggtgatggctactttgtgaaaagtgccaaaatgatcagctttctgtatcaaccattcatatcccttttttcctagccttccttgaatccagaagctggcaaacagcatcagccatgcagacctattgggacaccttctggagtatggggtaggtagattttgccattttaaaggcacaactttaaaattttttcttagcagggaggggagcaaagattccttatctctttttatctcttgtttctcatctcatgcatttgcccatggtaactaacatctgactgtagcgg

SEQ ID NO: 53540 - DNA, 1684 bp, Homo sapiens
ccagaaatactaaaactttagaattatttttgaggcaatcatcttgattttcctctcctacaaggtaaatatttttaagtgtaaagttttggagcttatatttatgaatatttgcaaggcttttttcccctccgcctcctttcatgcaaacaattgaagtggctagcttttctcctctcctggaataaaggaagtgaattagcaattgaatatataacctaggacttctctaaattaggcacctgtgggtacccttagggtccatatgcttacaatatgagtttctatcaccattattacttgttttttgaaggcctgatgcaaagcctattaagatattgaaaaggactaatagctatttatccatttgcctctccatacttcatcatcttagtcacctactgccaccttcgaaaaacacggagagcacctacccagaggagaaggtagatttggagtaagccgccgtcgacataattcctctgatggtttttttaacaatggtcccctacgaactgcaggaggtgagccatgtccaactttcatgactatatttaagctactcatttaggacaagcccaggctgtgggtacatgtctgtaatcttgaaataggatcttttctgaacatagttttcatttagattctctagtagtcattacgcaactacattggctttctaggtctaactatgattatgattctcatgaatcatctgttcagttgaactgatttcagaaattacctcacaaagaaaagatacatttttttattttttttgtgtggactttttattaacgaggtctcctgaaggcctttggccaataccgtaaaccaaatcaggaagcaaacaatctaattagtccttttctttactattctagattcttggcaccagccctccctgttccgccatgattctgtggactctggtgtctctaagggagcatatgctggaatcacagggaacccatctggttggcatagctcttcccgaggtcatgatggcatgagccaacgtagtggaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttgtaagtatgaatctttagatgtgtggttagaagccaacaaataatgtctgaaatatgagaccctgttagtaatgagaacatttcagaaattacagaaaaaggaatttgtaagttgaggtttttattgttttagaggaaagaagttaagttgataatatttgaaaatggtgaccaaaactcctatgtaacttgtagcaaatttttcatctttgtgtctttggaatttagaaaaatatttaatttctcttaagtcttataaagtttactcaaatataattatgttaaaatgtactcttgcatgttaaattgtcttttttccaactatgataaaacattttttctcttgattttgttctctatcacataaaattactgtgacatgaacatgtaattgggagtatttcagctgttgcctatgcgttcagtaacacttgatgttattgtgtgttaaattacatgccttttggcctcttaaatcaaaggtagcattttcagagtatctttaaaatgttt

SEQ ID NO: 53541 - DNA, 1013 bp, Homo sapiens
ctttaggtatggagtacctgattgtcgtgcccttttgaacaagagactgtcttttgtttgctttttttttttaatcgatagatccagaagtttaaacaaaaagtcatagattggaaaccaaaaccaataaatttcaatatttggaaaggtgctgaagcctgtatctatttaaaagataaaagagtgaaatgctaattgtgaatgagaactttgaaattaatagtaaaataaactcatctttcctagggagtcagttttcaatgtaccttttgacgttttttcaaatacaaaagttggtttttgttaatacccctaggattttttgttgttgttgttaaattattttggtggttttacaggaaaaatatttaaagtttttaatagaaattacaagctagttgctttgtgttttgtcactgttaactactaaactggagtgagatattgattttttgggggggtactcagtggtttgtacatgttaatataaacattcagttgattctggatggtgtctttatcagagctcttgatttgtggtgtggggggaactcttggggaaacctttattttgagcgaattcaatttactagattgctcatcagtggctgttaaaatgcttagctgaggaggacacattcaaccatttaaatttagaatgataagaaatctggtgcacatttctgcttgtaattcatttttaattttgagttaaagataagacacaatcgtgaatcatacttcagaagattgcatatctttattttatggctataactctgatgtgccagggactgactgctgtttaaagtgctttgtatttgttacttacttttttttccttcttttcttttctttttctttttttttttttttttttgagacggagtttcgctcttgttgcccaggctggagtgcggtggcttgatttctgttcactgcaacctccgcctcctgggttcaagcgattcacctgtctcagcctcccgagtagctggtattacaggggctca

SEQ ID NO: 53542 - DNA, 1029 bp, Homo sapiens
aaaactaagttggaaggtagatttattttctccatataaaaacagcattcccacggtaattagtgctgctgcttttgctatttataaataaaagaggcagtttagaaggccaaattctgaagatctagtctttacctgctcctctttcagatatttttctcatggaataagattaagtggtaggttgaaatatatcactagtttgtgttcagtggtttcttttgtacattgtatagccatttaatactcttaccagcaataatatcacttcagagttattagttcatcctttctgtatagtttgatgtggtaatggaaagcagatcttttttgtttgctcctttcaaacaatccccattatttcatactgggattgactaaaatctgatgatacatatatatatttttaattttgtcttttggttctattttctttgtagatactgaagtactctttcccagtgggactaagaaccagcagaacagatatactttctctcaagatgtctctccagcaaaacttttccccatgtccaaggccttggctttcctcatcatttccagcgtatatgagcaagacacagtgctatcatacatccccctgcagctttaaaaagcagcagaagcaagcacttctagccagaccctcaagcaccatcacttacctaactgacagcccaaagccagcattatgtgtaactctggcaggactaatccccttcgttgctccaccactggtcatgctgatgacaaaaacttatattcccatattagcttttactcagatggcttatggagccagtttcctatctttcttgggtgggatcagatggggttttgctctaccagaaggtagtccagccaaaccagactaccttaatttagctagcagtgcagctcctcttttcttttcatggtttgccttccttatttctgaaagacttagtgaagccatagtcacagtaataatgggtatgggagtagcattccaccttgaactttttctcttaccacattatcccaactggt

SEQ ID NO: 53543 - DNA, 1066 bp, Homo sapiens
tagttaaaagtagttttccagaaaaaggacataagagacctggtcaagtataaaaaatataaaagtctgggaagtgaggagcacctctgcccagctgctgccccgtctgggaagtgaggagcgcctctgcctggccgcctgaccatctgggaagtgtgacaagcgcctctgcccggccgctgtgcaaccttccacgtgtgaagtgacagccttgtgtgtgatcttttctgtcttccccaagtttgcattttcgacattaaagtttactttttagttaaaagttttaaaaatatatatatataaatacactgtagataacatttgtatgccagctacacctttttctacttctgtttggctttttttccccacaccaatggtaatttatcttcacagattgttcttcatttctagaaattgttacttcatggtaattacttgagcaaaagcttgaaaatccctgacaagtacttttcatctcatagtatattagttttcactcagtcattttatgaataatatagttatccacttaaacatttcaatattttaaccatcttgaaaattaaagattaaaaatcccctttgttagagtcttgtgatcattgaaaagaatgcacatattctcccacttcaagcggaaaacctcgtatctgtgagtatctgaaaagaaaaggtagttccattgagttttcacaggagttaccactgggaaaggcatgtccaaacttatttcacatggtataacccaattatatgagctaaaaggatctatggctctaaagtcagtagggagcagtgtcatgagggaaagccacattcaaaggtaagttggacatgttttccagtttttattaggatatttggcatggtacagataacaacttgtcccttaccaccaaacacataatagctggtcaaaatgattattttcaaaggaaactatttaaaataaagccactagtacatataaattaggaaagaaaagtcaagctggagccatcttgatattctaatgagcaggcctatctagttctacatctttttttttgagatggagtttcat

SEQ ID NO: 53544 - DNA, 1046 bp, Homo sapiens
cagcaggcagtatgcacctagaaatttctcccttttttaggctgggcatggtggctcacacctgtaatcccagcactttgagaggccgaggtgagacgggaagatggcttgaactcaggagttcgagactagcctgggcaacgtgatgagactccgtctctaccaaaaaatatataaaaattagccgggcgttgtggcttgtacctgtggtcccatctgcttgggaggctgaggttgcaggatcacttgagcccaggaggtcaaggctgcagtgagccaagattgtgccactgcacaccggcctgggtgacagcatgagaacctgtctcaaaaaaaaaaaaaaaaaaagaaaaaaaaattcttccttttttgctagattgttgtcaccaaaattatctgtttggctttaggaagagggaattttattagattatcaagctttgtaaaatttatttgtacttgggcaaacctaagtaagagcatactgcaaagctactgcttggatgtagagggctaaattgtaggtacttctgaaactttttatagatactgactcataagtgtaatttgaaagtaccccttgacccaaacaaaactgcttctcaaaacttctcattttctccctgagaagcattctaaagaattgttctctgttcatttctaagagaaagatttactgggtgtatgatgcggttacttttaagttatttctactggccagttggagcaatatatattaaaggtcttgcatacagtaaaaaaaatttttttttgagatggaattttgctcttgttgcccaggctggagtgcaaaggcgtgatctcggctcactgcaacctccgcctcccggattcaagcgattctcctgcctcagcctcccaagtagctgggattacaggcgcccaccaccatgcctagctaatttttctgtatggggtttcaccatgttggccaggctggtctcgaactcctgacctcaggtgatccacctgccttggcctcctgaagtgctgggattacaggcatgggccagcgtgcccggctg

SEQ ID NO: 53545 - DNA, 2306 bp, Homo sapiens
ctgaatggaagccgtgggggaggggatcttcggcgggaggacccgggctggagctttggaggggtggggtctgagtagttcgcggggaggagtgggaggtctggggaggccgagaaatggggagtggagaaatggaagtggtggcctggggttgtattggaaatgggggtgtagaagaatgaaaaattggtgcaagagatagtcaggggttctggatggggcgaaaggacgctggaatgtgggctgagtgtgtgagctgcaacgagtaggcttactaaagaggcgttgaggagttatccataggagtaaatagagtaagatgtaagtcaatttgatgtagtgttatcctgttttctagaggttgtccttaaaattgtaaaaacggatgacactcccaagcattctctgatttggccatcattatacttttgtaccagtgtgttcacaatcattgttaaggctctctttaccaaccatctatttcacaagaaagcacttgtgaaacacctgcatgtgagcagtgttaagcccaattttgtgaacagaattcgtagatatatggtttgcctgctagttttccactgaaaacacattactgggaaaacacagcagcatacaaatattcatggagtttctgaatgaacaggatatgtttatgtaatttattagtcaagagtaggtgtatttatgagtaggggataaaggtcagttttatcaggcaggagaagctgccactagtagcggtaataagtttagtgaaaggagaataagtaatccttggtcttgttggatttacagaaaaatgttctgtagtaatgaactctagtgacagctttccttttgttcagctctattcgggatcctactgacttcatccatgaatgttttaagacttcttataggtctcttacctcttttctctcagataaattagcattttccttagacatttttttttttttttgagacgaagtctcgctctgtcgcccaggggagagtgcagtggcattatttcggctcactgcaacctccacctcctgggttcagcgattctcctgcctcagcctcccggctagctgggattacaggtgcctaccaccatgtccagctaatttttttgtatttttagcagagacagggtttcaccatgttggccaggctggtctggaactctgacctcaggtaatcgggattacaggcatgagccagtgtgcccggccctttagacagtttaaaaattatataccatgctaggtagcccttggacttttccccccttttgttcttccacctcttattccccactgagccctgaggagactgcaccattgaccatctctgccccgcttctagctgctgagcattgtcctcttgctgcaatttactcccccatgtgcctaatacttatcttttacattctctgcagtatcatctagtcaaaacttgtacaatgaacttcaagtccaggtcctttcctgtctcagtttacctgtccagttgaccttactgcgtatttcatggtagagttcaagattacttgatttttccctcctctttattttatgatttttgtgttttctcatccttagcttcagtctcagagaaaagtactcatcctcctctccgaggctaatttctctacttatgtccttgatttcatcctcttttgtttgccttagacccttgttactctctttgttttatatcacaaataaaaacaaaacaacataatttccctgaattgtgtaacctacccaaactactttgttatctcttctttgcttccccaacaaccttcttgaaaaatgagtttgtattcagtgtcttagcttcctcaccttgtatacatttctaatatggtttggcttcttcacttatgctttcccaaaactgatgtctttaaggtcaccgaaagctttttttgtgtgggattacttttttattgaggtttgacaaatcaaaggttcattcagtccatgaaatattacagaatgagtacctgtatgatcacaactcacatcaggatggagaacattcccagtaccctagaatgctccctgtgctttctcctagcactactcttttacagatgtaacctccctcaccacctctgtcactatagatttgttttgaactaatacttcatataaatggaatcatagtgtgtactgttttgtgaccagattctttcattcggatcatgtcttgagactcatccatgttgttgcttgtagaaacagttctttttcattgctgtgtaattttccattgtatgaatgtattgtgatggttactaaaacttattt

SEQ ID NO: 53546 - DNA, 1163 bp, Homo sapiens
caccctcctcagcctccctaagtgctgggattacaggtgtgagccaccgtgactggtcagactttctatctgttaggctttcaggaatgttttgaaaagcagaggatttagaaatagttgttaatagtttttttttaaagtccttaagttatttcataggggtgttaccaaggtgatttttgtttaaatgacccaggaacatttaagttctacctttaaccagtaagagaaagtgatactttgtgactagctcagtctttggtcttttatattaaagaacattacttgctgtaactgattcacaaggaccccttgattgaggtgcttccattttctacacatggcttccaagttcagctgaggaaagtggaggatgggccaatcctagaaatggattaatcacttccactcatattccattgccagaactcagtttcagggccatgcctaactactggagggctgggaaatgtcatgtggcctgtgcctaggaggaaggtgaatcatgcttgatcaacatctaactagtccctgccacaggactcaaaccccaatgtagtccttagcttagaaccatacagaaatccatttattttggttatagacagcctggaaccatagcctcctctttttccttgtagacacacagagttttgagttataacaattttgaatgcaagtaaaggcctttttcccaagcacagataggagatctggaaaagcttttctgcagcctgtggcagaggtagtctctggcaaccccaagaaaggcagcttggtattgggggtgggggggagagagagagagaaagagagagagagagagagagagacccaagtcccttcaaatacctggaaagtcttcccaagaataacagatgcaaacaagcccagatcgcaaaggctacaatgtatatttaactcttcaatgcccagacactgacaaatacccacaagcgttaagaccattcaggaaaacatgacatcaccaaacaaactacgtaaggcaccagggaccaatcctggagagatagagatacatgacctttcagacagagaattcaaaatacccattttgaggaaattcagagaaatacaggataacacagataaggaaatcagaatcccctaaggtaacttcagcaaagaaatggaaataatta

SEQ ID NO: 53547 - DNA, 1038 bp, Homo sapiens
tgggcaacatagttgagaccttgtctatacaaataataataatcataaaaaaaaaattagccgaggatggtggggtgtgcctgtagtcccagctactcagaaggctgaggtgggataatcgcttgagcctgagcagttgaagctgtagtgagttgtgattgtgccaccacactctggcgacagagtgagaccttgtctggaaaaaaaaaaaaaaaaaaagccttttgtttgtctaggctttgtgtgataggcagggccttacaaaattaaagctgtgtagcctgggcaggttgctttgtttctgcctgttgttacaaattatacccttttatcctcaaacttgcttttgtaccaaaggcacccactggctttctgctcatctcacactgttccctctatccttaggtctaggcacctactaatttgtagggtacaataacagaaacttgttactattaaagtctcatctacacttgaagatataagccttttgggtcaacatatgtggagtagaaagttttgtccatttgttcaatatgggaagtgggagtagcggggaggatgtctttgtgtagcaggtgggaggctaatttttggatcaaaggatatcctgataataccgaagtttgtgattctcaggccacagagagaatcaggatcatttgtgaaaattcctacctccttaattttttattttgaaattttgaaatctgcagaaaaatagacagaatggtacagtgaacacccatgtaagttttacctagactgactaatttgtacattttttccatatttgttttttctgtgtgtatatatgtatttttttcccgaagcatttcaaagcaagtcacagactaattacgatacctcatccttaagtatttctcctaaggtgaaggatactctcctaaataactacaatatatgaccagatctaagaagtttaatagtttttttttttttttttgagcctgagtctcgctctgtcacccaggctggagtgtagtggtgtgatcttggctcactgcaacctctgtc

SEQ ID NO: 53548 - DNA, 3743 bp, Homo sapiens
ttttttagatagtgaggactgaagattttttttttttttttttaaccttgagtggctggagtgcagtggcacgatctcagctctgcaacctctgcctcttgggtttgaatgatttttctgcctcagcctcccaagtagttgggattacagctgcctgccatcatgcctggctaatttttgtatttttagtagaaacacggttttgccttgttggccaggctggtctcgaactcctgacctcagatgatccacttgcctcggcctcccaaagtgctgggtgagccactgcacctggccaggttgaagatttttaagctgtgtacaacgttttgggaaaggaaacctgtcttggtgaaaggttgataatcccataacgttagttttagtgaccaaatggcacttccacttgaagcctttttgtaggctttccactataatgaattgagccttctttgacactcccatagcactttgtcataccttttagcacacttctcatgtgtcataattacttgtttgtatttggcttccccattggattttagctcttctagaataggattattagtttatggttaatgttgattttggtaatctttcctcatccctatctcagtggttggcaaaataaatggttcttgaattagtaaatgaataaagagtttgaattttgaatcttttgtctgaatagcttctcagaatgcatcttttttatatttttactgattaccgggttgaataaattagaagccactcctacttcctctctgctgatacatatgttttagctagttaaacctattttgatagaggagttctatgactttaaaggcctatgactttgcagacactcatacagtgtacagcataccctatgcaaatcagctgtctgttcaggtcttgtgtttgttttccccatagacataatccagccgttagttattcaaagcagcagatgggagaaggaatccgtggaaatgtggatttattagctctcacaatgaaagaccacactggttatgctaaggattagaagatttctgctgaatgaaagggacatggatcctgttttttgtgctattttcagcagtgtggcaatttcttatgactataatcagttgtaaaaagaccagaaaatgatcttgtaaatagactttccttcaagccctagactgttggttgcagctgtcataattataggagggactgcttttcttcctttttgggtgcagactgaatctggcctttagctattgctatatttacaccttaggtagtataactggctgattgtgtgctttatacatacctttatctgtcaaattagggaatttggattcgtgtctcctgaattttgtaggagagtaattattgtagcatgtcttatagtttggaaaaaatgattgaatttaatgtgttaaactcacttcctaaaaatataatgctgccttcactaacaattttgtgtgtgtgacttgttagaaagatcagcaactttcctttgtgtttactaagattctgacaattaccataaagttggaaagtttaaacgttgcttatggagtgtgtaaggaacagaatcatatcatgagaacaatctttcactcttaaaatctaaaagattatgtattttgagccatgaattaagaaacagaagcatctttaaacttggctgaagttctactttaaaaatggcagccagtaaccaaagaaacaattcttgagatcattaaagcttggataaaatgagactttttcatgctgtgcccttttagaagtctgggggaatggggagcgtttcctgtgacagcactgtaagtgataaacagctgaatgaatttgtccatgctcagaactcacaacacgtggactagccccctcctgcacataaaagagcagggaaaccgaccttagcaatgatctagctcctgaagaaagaggctttcgttactgtccaagaagtgaagaccagtgagtctagcgataaagaaacaaaagagcccctgacagtatcgaaagaatctgacatttgctttgtctgtacaaaggatgaaaggaattttgccgacttagtcaaaacaataactggttttatatcattttgagtctaaaatacaggcatcagaatcgtatgtttttctttgtatttctgaagaattgtcatctttttaaaaacgtatgtggagtggttttgtttctggaaaggaaaacgtgacatggattttataagcttagtagctgtaggtggagactcttgttttgtttgctaaacctttttaataagcagcaaagtcaggatatcaaagattggaatttttcccccggaaccttttgttcttttcttagtacttcaaataatttcaaccaaaggggtatgcatggaaaatgaaaacaaatatgaagtctttccgctatttggcagtgcttcagatgagatgtatctatacttctgtgaagaaagacgtgattctgatatgaggcagtgattgtatacttacgctggacagagggataactggtttagtggaacagtgggttagtggtgtgctgaaaggattgtttgcctctttatccagcagtaagtaggcactagtagttgactgtctggggagtggcttttttttgtctgatatctattatggatgattccagtattctgagaaggagagggttacaggtgagtaaaagaaaacctttttcactgatctccttccttttaatgtctcttgtaaatgtactgaacagattgttataatgtatttaattcatttgaggtaggaggcagagtggagtgcagctaagttcctctttattctttgatgtatagttataattagagaacttatctaaaatcttgctattttgatagaaaaatgctgcttgggcttatttacactgtatttagtgagtagagcaactaaatcagacctgtatgggatacaagcctaatttagaacattagacattactgctgacagattgtttacggtgaacatattctgttcctgaccaccatgcctgatctgcccaccattaagtcacatgtatggtagtatatgcttgattctatgcatagttttaagaacttttctaaattatcacttggcatatacacattccatccacttatctattgtctgtctgtgttgtctgtccatccatccgtctgtctgtctacctacctacctacctaccatcttttccttcttaaatcataggtagtttgttagatgaagaggtatgtaagatataacagtgaatgaaaatagactgataggcaaccttcaactgagttttaatgaatatccttagcactaaaagaatacatgccaaatttgatgattatttttttcatgctttgtagattatctcatcttagtcttgttagcaaagagcaagccagcttctagtctatcactaaatgtttttgagaattgacataatgaagattctagtgtaaatcactgagctaatcaatcaacctgtgatggtttagtcatgaaatgtagctatttctgttgttttcattttgtttatttgacattatttataaagcactttttttgtacaaaatacctaaggattttaaaattatcatgaattaacattattttagtttctttaaagttctcaggtagaaaatgtataggattagtaaacttaaaatataaatttaaacaaattgtattgtttctagttattatatgtacttcttattgatggtgctgtaaacattcagagcc

SEQ ID NO: 53549 - DNA, 1048 bp, Homo sapiens
acctaaaacatactcatatttaccatgatttactagtaaagtcacatctggggaaccctaaggaaatagagctgtgataaaacaatggcttttaaacttttccttaacaaaaaaagagatgtaattaaggaggagatcacaacagcattcatatttattaagtatactttatatacacatcatatgcaatttttaaatgtttaaatgaaacatgtagtaattctttctgttactgtccattttaggattttgttttgtgaaaaatgctctagtgattaaattttcctctgaggtttttgtgaagccttttgggctgtttacgaaaacttattttggtttgatatgaagaggcttgagtcagaaaactcataaggttcagtcttgaccatgccatttaactagctttgtaaacctagacaaatcactttatcttcttaaacctcagttgccttatctataaaatgaagataatgttacctgtgttttcttcttactaagcctgttagaaggatcacttaatatatgtatagtgctttattacttatagtttaattttaatatatattagttttagaattcttaatgggttaaatttggatgaattctattatttaagaggcacattttaaattttaaattcagtttctagcagtggatattcagtctagcttcacaagtgtcctgagtcttctgtaaatggcaagggctctaccaggactcttagaggaatgagacaccaaataggtatgcataactgaaaaggagtagcttttcagcatcatagtcaggaaatatttgtacttggtcatttttctactatttctgccccccccgcttttttttggttgcttctatttgaaaactgcctgagatttgccttttcttagtattaagtgaaataaattaaggcctgagacaggtagcttcttgcagaaatgtgtgtcctcaatgaatggagttgctgggaagaaggagaaggaggagtattcttatttttattttataccagaataattttttggtcattttagtgatatctaaagttagg

SEQ ID NO: 53550 - DNA, 1023 bp, Homo sapiens
ccctgtcaccagtcccagggaaatgttaggccttcctagtcctggcaaagtcacaggaatattggcacaaatggattctaatgccactaaagaaagtactctgtgtggggatgtgttacctggaggtaaaagtaatatcttctttggtcagataaaggatgtaaaatatggctttcattctctaaaaatcaaacaaatattttctcactttggcattatttaaggagctccgtgttctctctcctccacccaaggagtactgctctgcaatagtactgctcttcaatatatgcagagcaggctagaaagaatccatttgctgctgttgtcagaaatttctactgaaaggtaaagcgcagtgatttatagcattggaaacttgagttagactgctccagtttaccaacttggctgaagacacttctggctagtataattcatatataggtaaccaggtgccaacatattgaggaaatgctacttttctacttaccattggcatgatcttaacttctctgtgtctttaaaaaataataataattttaaaaataataataatggaataatagtacatatatcatatggctatgatgagtactacatgaatattaatgtgtaaaatgcttagaatagaacctaatagttaagcacttaataaatgttggttgctgttatgtcattattattattgttatattattattattattattattattattattattattattattattatgtagcctggtctcgggtattagagaattggagaatattgagtagaaacttaggattcagccataactgcaagccttagctggggatgggaggatagacccaaggttggggcttttggcaactgaccctgatatcatcacaaggctttccaaagtaggagccagtacttgttgagaactgttagatttctaaggtgttctagttatctttaggacctgctactgaactggggattctgaaaaaaagagggtgctgagagggctgaataattggactaataca

SEQ ID NO: 53551 - DNA, 2367 bp, Homo sapiens
cacaacctatatattaggtaccttaatgatcttcattttacaggtggggaaaccaaagcatacagaagtatgcttagcttacccttcaatagaggtcttctgcaacttaccttaaacattaatggatgaaattaagctagtttctgggcttattttcttaactttccttatggcttttcttaccacaagaatgattagagagtaatagaaattgaacaaaaaatggcactgaactttgtctgaaggagtacagtttagttaagttggtcagattcggcatttgaataatgactgtgctttgagccctaacattaaagccctgtagtcttccttcaggcttgggtttgagaatgaataatgctgcagaaacgcccacatagtcttcgctcattattttaccagtttcttccagtcccttgcccactgcaacagctgtttagcctggcccatgccttctgggttaatagtatttctgacacagtgtgagttttcaagttgctatgtataatttctgccagagtttttactgccgccaggcctcagggttggaggttgcaactgatttgtgggggagggagtttggtgcttgtcactgacgcaggaacaaggtgctttctgtagctctgatttgttgctggctgagtgtgaatgatgtcaggcagatcagaggacagctgattcatttgggatctggaacttgtcactgtcccactgctgcctcgtgggctcttaggtcttttgtggggggatgggaggggtgttctgaagatcatgtttttgaagaaaagtactttaatttttgccgtaagtttgggaagcttttataatttcctttggctgacagaactgcataccccttgtgtgagagaacttcctaccaagactccagtgtgagggcaaaacttgagtagccaggagaatgatgaaacggaggcaagagagactgggagcaccatgtctgcggattcagtaaggaggttggggtctctatggaaactggcagatgtcaggaaaaaaaactaatgccaactaacacagcttcgttcatttggatgaagactgttttggagatgcctgtcaggaagagggctgagctggcttgattaattcaaggtcaaaacagtggtccttggcaggggcatatgaggtttccaattccagaaactgaattagatgtcattttaggggttcctgaatacttggagaactgggtaaaaaaatgaagacaattattttcttcccttgaaagcaaatgtttatttaaagttagtgtcaaggctgcaaatacaaaccccgtgaatgtgagaaaccaatggaaacaaaaagtacctcctcctttgactagagagggtattgtatttctgcccatggcctgtcagctcaggacctcagatctgcccttgcagattcaagcatgggtcctttagggtgtgacctctattttatttctatattggccaatatagaaataaactttattaggtgagaatatcaaagctgggagtggaagaaggcttcctcttcagggtgacttttccaagagcagctcaggcttatttaatgaagaagtgccaagtgaattcatcagtaaattagagaaccagtgaaagaagagacctagaattcatttcacctcaattatctgtcttgaactgcctttgtttaacccacagggctaagggagtgtacttcagattttcttcctgagtcaaactgcttgccctgagacagacaggcttcttcagtgggcttcctttgtgatgttgcccttcagtgtctgtggatgcttattgattgaattaatgattctattagaccttaagaaacaggatttgtttgaagtatatagttgtagtattgacacactttaaaaaaaaccttttattaccatactgacacagaagtaaaagaccatttaaaaacagacttcatcaactaatgtgttatttaaagtaaaggtcacttgttaacaaaattaaaaatttttaaatggagtttgtagcttaagaaaacttaaatggtcaaaaatcatggttctgtttttgtttttgagagtgtcttactttatggcccaggcgggagggcagtggtgctatcacagctcactaaaccttgacctcctgggcccaagggatccttccacctcagcagctgggaccacaggcatgcaccaccaagcctggctaattttttaatttttttgtagaaataaggtctctctatgttgctcaggctggtctggaactcctgagctcaagtgatcctcttgcctcagcctcttagagtgctgagattaccatacctggcaaatcatgctcttcaaatgtgggtacactgctgttggtaatcattttctctgttttactg

SEQ ID NO: 53552 - DNA, 1448 bp, Homo sapiens
tacaaaaaatacaaaaattagctgggcatggtggcgcgtacctgtaatccctgctactctggcggctgaggtgggaggatggcttgagcctgggaggtggaggttgcagtgagctgagatcataccactgcactccagccttggagccagaccttgtcaaaaaaacaaaaactaacaaaaaaacacactctggttatagttagaaggccactaggtaagagacaatggttatttgaacccatgatgattcagataagaagtggtcagatttggggattattttaaaggtagaattgatagaggaggaagagatatccaaggattgagctctggggcaagttttagaggttggggcgatagtgaggaattagactaaaatgaattagctattcattcaggaacaaggactaggagaagtatcttagaagccagttgaaaaaaaaatgttaaaaaaggaaagcgtgattgatcagtaggtatttgttaagctttttgttagagaatagtaacctgaaaaactaaaagtttaagtgaaacacaatgtatcacacagatttaagtgacattatttgatacaggagcttaaattccacagacagtttgggacagtgatagactgacataggacaatgttagaggctaacttctctctgaaggcacctcttctagacgtactagcgcttggcgtatgaggctgagaaagattgtaagttgggtagcccccaagatgtacccagtcctggcacatggttttgagtatctcttgatgactatggtctcagaacacacaacctggagcaacatcttacagctttggagcttgttaaatttcatgtttttttttttttttttcatagacttactaacatgtgtggtcactgtattagtgcttcattccattcttcttttgtatccatgccatgcaaagtgccagttcattgatatgacaagattattttagcttgttgtttgctagatatttttatattcctttaaacattcttgagaatctgggatgcagttatttagaaattgtttgatcctttgaaggaatactttcaggctttgtttggtgagaccagggcagcacttgaggctaattttttcttactactgaggcaatactttgagtactctatttgatgcccatgtattgtgagttttttccactcaggctgatgggagcatgaacgattctgggtccttagtgagccctgaagagggtacctgctcatgttcttggatagtttccttatccacatatgctgatagatattcagctaaaaactcagaggaagcccctgcagatctccagagttcccctctgtatatctgtcttctctggtaccctgctttgaaaattctagccaccttagcctccccaagttctcaactctgtcttctcaactcagggagactgctggactctgtttgagtacccccttttg

SEQ ID NO: 53553 - DNA, 1013 bp, Homo sapiens
tgaggcagctgggcacagtggctcccgcctgtaatcccagcactttgggaagctgagatgggccaattgcttgagcttaggagtttgagaccagcctgggcaacatggcaaaaccccgtctctacaaaaaatacacaacttagctggacatggtggtgtacacatgtagttccagctacttgggaggctgaggtgggagcatcgcctgatcacctgagcccatggaggttgagatcataccactgcactccagcctgggcagcaacagaatgagaccccatctcaaaaagaaaaaaagaaaagaaaagaaatacgaggcttccattgattctggcacattgtccttcccagagaggggcagaagaaagacctcatcggagtcagccatgtgcttctgtgtagaaggtatattcttgtatcccaggggaaccaggccacgggactcagctttgctgaaagggctgcagcacttctgtgcagttcattgctacactctttataatggaagatctaaacctacagttagtggcaattgacagacttagaactgttcagagcttgctgcctgggcatagaaagccatggtcactgttgtcctaagcctggaccttgtctgtctttgggcgttaaagcaggatatcaaagcagtgaaatgggtcagcatcaagctgagtaagatgtgtatattctccatgaatttgtttccttgctcacagtttactgtctttggagggagaaagtgagggtacatgtggagtatttgagggtcctgagagtctggtgattctgaaactgaactttgtccttgggagaaggatctcaccttctttggctcagattctcttagcctagaagccagccttttagtgtgatgatggcccctttccaagaatcagtaaatctctcaatcacaagctgtcactttagaagataccaccaagagaacagggatcccagggaactggagacatacttgacctttaaagcaaagctctcattgtgcttaggtgctt

SEQ ID NO: 53554 - DNA, 1107 bp, Homo sapiens
tgttggccaggctgcttttgaactcctgacctcaggtgatccgcccacctcagcctcccaaattgctgggattacaggtgtgagccaccacacccggggaaaactaaatactctttaaggcttgaagaggcaaagtggtccgggcacagtgagtcacacttgtaatcccaacactttgggaggctgaggtgggcagatcacttgaggttaggaggtggagaccagcctggtcgacatgataaaaccccatctctattaaaaatacaaaaattatccaggcatagtggcacatgcctgtaatcccagctactcaggggccacaacatgtgagaagaatgcaaggaaaactctggaaacattaaaatcacattgttctagtggtgattacctgtggaaaaaagtaaaaaagcagctttaactttttattcaatttgctacggtttttggccataagaatttgtgaattgtacgataaaaatgttaaaataaaagttattaacagagggcagtgctggcagttggaagaccagttaagaggccattgccattatcaagatgttaggggaatgtttgaaataaagaaaatatatgactatgagaaaaatgtaagagattaaatcagtggcatgtggattgattgtcttcagattccctgagtgattaatgccatgtgttgatacccttaacttagataaggaatactaataggaagagaagagttagggggaggaagacgaacccaggatcaaatttacacgtattcagacacttgatttatgacaaaagtggcactatagagctgtaggcaaaatccattggatgtttgtatagagaaattggaaaacgtggctcttcacaagaaaatcaattccaggtgaattataattttaaatgtgaaaggtaatacagtaaaacttttagaaggtgtacagaagaaaatctgcatggccttaaaatagggaaattttttaaaaacaggatataaaggataagattcctaaatttgactacatttaaaatgaagaatttcaccgggcacgtggctcatgcctgtattcccagcactttgggaggccaaggcgggtggatcacctgaggtcaggagtt

SEQ ID NO: 53555 - DNA, 1074 bp, Homo sapiens
gttttaatacttagactactttttttttttttttgagacggagtctcactctgtcacccaggctggagtgctgtggcatgatctcggctcactgcaaactccgcctcccgggttcacgccattctcctgcctcagcctcccgagtagctgggactacaggcgcccgccatcattccgagctaatttctttttttgtatttttgatagagacggggttccaccgtgttagccaggatggtcttgatctcctgacctcgtgatccacccgcctcggcctcccaaagtgctgggattacaggcatgagccaccgtgcccggcctacttagactactttttaaaaaaagacatattaggaaaaagagaggctcctggaaatggtgttaactcactattccaatgataacccaaaataaatccatcctctttccaggattctttgcagctgaaaagaacatgaacaggttgggataagtttgatagctgacgtgggtttcctccttcaacccacttaccttattcaaaacaaattttatccaggtttgttccacgggctcatctctcctaccctatggaacttccaatttgttaagcaaggatccagataagatcacttacagtataagaatatgctggtttgatgcatttgtttgtccaacccagctggaaagacttatcccagacttcttgcctggactatatataaactgtactctcagagtaggtacgagctgggacaccaagacctgtggctagatccccataggtggcattgagttatttctcattcatttgataaatatttgctgagcaccaccaactagagtcaggcgcactcggctgggtgcttagttatgtagtggtaacaaaatagacatagtccctacttccctgaaactcaggatgtaggagagtctgtgtactggttgtttcctctgtaaggaatgctgttccctcagatcttcatttagctaactcattgttatgattcatatctcatcttaaatgtcacctcctcagagaggccttccctaaacattcaatctaaaggggccttcttgtctttctccatcaaa

SEQ ID NO: 53556 - DNA, 1073 bp, Homo sapiens
ctacagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaa

SEQ ID NO: 53557 - DNA, 1070 bp, Homo sapiens
ttcttttggagaatgttttagcctaaaacacaagagctgtactaattgctgctatgcacaattgacccttaagccctcattgagcaacttttttttttttgaaagagtgtcactgtcacccaggctggagtgcagtggcgcaatcacggctcgctgcagcttcaacctccccaggctcagatgatcctcccacctcattctcctaagtagactgggactgcaggggcatgccaccaccctgtagcaggctaattttttgtagagagggggtttcatcatgtttcccaggctggtcccaaatttctgggctcaagcgatccatctgccttggcttcccaaagtgctaggattacaggcgtgaactgccacacccagccgagcaactttttattaaaaccacagtgacaaggttggccaactttttctgtaaagagcccaacgtggagtaaatgttttagtctttgaaggccatacagaagcaggccgtagacctgctgaccccatccccattacttgcagcattcttcaggtcttccctgctcagtgtgcctttattcctgaatctcgagcagggaaaaggagtacatttcctctcccaacctagatactactatcacattaatccaaagatgtcattggtctttggcaactgttaagtttaagatctttctctaataaacattccccttcccgggccaggcgcagtggctcacacctgtaatcctggcactttgggaggctgaggcaggctgatcgcaaggtcaggagatcgagaccatcgtggctaacatggtgaaaccccgtctccactaaaaatacaaaaaattagctgggcgtggtggtgggcgcctgtagtcccagcgtctcaggaggctgaggcaggagaatcgcttgaacccaggaggcggagattgccatgagccgagatcacaccactgcactccagcctgggtgacagagcaagactatctcaaaaaaaaaaaaaaaaaaaaaatcccctttcccataactcttcactcaaacaagtgatttttttagaaccaaggtaagtctcatctgcaaattttaag

SEQ ID NO: 53558 - DNA, 1038 bp, Homo sapiens
aatgtcttcagttatcaggtttcccaaatggcagtttaaggaaaccaggatcagagggagcccattattttgctatttccaggtccttcaggcttagctccaactgagctggaactagaagggaagtgtttctttcttgcttttcttcccaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagataatttggagaaacttttacaagatgtgagtgtccttgtgctggggttctgaaaaaacctccacctggtattggatttgtaatcccaagctaagattagggcattagtggtattctcagtcttcacagactgcttgttacccaccctcaaaggtagagctgagggacttagattcctcctcagtcccctgcaatactgagagaagcctgcttggtatcaaaggaagtcacttctgttccttttctaaatccaaaattatattactttgttgtattacgcgaagctccaccatgggtagtagtcataagtatttgactaggaggtttgctacccaaagccaaaaagtggctccagtggctgtgacgggctttcttctactggaaatactggtttaagcagagccttcagactatttatcctcagccaagggaaaacaggtatgaggcttgcacaatgggtttagccatttgcatggtgagaagttctctagttgggacttacatgttttgagacctggtcctcgctggtgtgaaaaaatctctgggaggctaaaggtaaagtaatccagagatggccaagaccaaagcacatgagagttcttaagcactgcttcctgcacgagtgcttcctttgctatcagcctcttgattaaggtggccagatgccatctcactcagaccacagcggctccatgttatcca

SEQ ID NO: 53559 - DNA, 1712 bp, Homo sapiens
tggaaatgggagtagcagtaggatttggcttgtttcctgatccaaaagctgggactacattgggtatagtgccatgggactgaattcacatcctaggctgatgcaaaaagcattaatgactaccctacatgcacctgttgtgtgatctgaggatactgctgagatacctgacattgccacgcacattcttctcttgtatctttgtttccagaaatggcccagttgagcagctgtgacagtcctgacactccagagacagatgattctattgaggtaaaaaccctgagctcctaccccattcctggagcctgggccctatgaagcaaagagctatgaattctctttaagagaatatctgaggaagggatgggggagttggtgacagcaaacactgagaagtcattctactcccagaagaatgagcaggagactgcactagagctgacagctgagaagatgctagagccacagcttctgcaaggatatgggctctgagaagcatgcctgtctcctgccttttcccttgtcttccagggccatggggcatctctgccatctaaaaagacaccctctgaagaggacttcgagaccattaagctcatcagcaatggcgcctatgggtaaaggcaggggtcagggtgtggccaggactgaagccgggtcagcctttgatctcttccatgtgagagtgtatgctgcccagtcctctgggcagatgcctcggggtggaccttctcactcccagaagcctcctgggtgggcaggagttcagattcctctgacatccgatcattgttcctttcccagacaagattcccacgcctcttactaccacgcatcctccattccctgagctctggggaagcattgagccgtgtcatcaggacatggtctatcaagaagtttaagagttctatggaccagggggtcccagacccttctcactgatatgcatgcccttgcccccttgttctgtgcattaattaaggtgtgagagaaggcagtttgggtggcagagagcacagctcaggtgctgagggtccatgggggatgggccggactttgtttcccagggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaaggtactgaggcaaaggtggcctggcatggaggccaaggcacagtctgagacttagccttaaacagggaccagcagctttgtacagaggtgaagtttcagggcccagctttccagtccacctttggcattggtttctgcctcaggatcacagagaccatttggccacagtgggcacaaagctccctgcctctaccatgagaggcattctgggataggatgtagcaggccagcagctatagaatcttgcaccccaaagcctgcacgctctctactgctggtatcagacagcaacagaggaggcagcagagctacaaaagcccaggattaggtgctaggaggtttgcatctggaccctcagaagaaaggaaagccattaattaccctgactggcttgcaaaggggacaccccttaaaaccaagcaaaatgctct

SEQ ID NO: 53560 - DNA, 1008 bp, Homo sapiens
tgagctgatatcacaccactgcactctagcctgggtgacagagcaagactttgcctcaaaaaaataaataaataaaaataaccatcagatctcatgagacttattcactatcacgagaatagcatgggaaagacccacttccatgattcagttatctccctccaggtcccttcccacaacacatgggaattatgggagctgcaattcaagatgagctatgggtggggacacagccaaaccatatcaccctgtctcccacccatgccagcagcaaaggggctagaatcagagtctccagcaccaggatattccatgaagctgtctcctctgggacctcagaaactgccagatgggagctggctagctagagcagggaactgaatcctttcctcatggtagcctgggcttgttgcagggggagactgtgccactctgctgaagaatattggggccctgcctgtggacatggtgcgtctatactttgcggaaactgtgctggccctggagtacttacacaactatggcatcgtgcaccgtgacctcaagcctgacaagtatgtccacagtctgtgtcccttgtccagggtctccctcttgggtctccagataaaatgttggcaagcacagtagctctaaatctatccagatggctaccgggaaaacatgctcctgtgtgtgtccatctgggcctagttctctagccccccgaccaccccagatgcagatcattgcctcaaggtctggctggaacactataaggcttcggtgacatggaagagtcattgaggagccccactgaagaaaccaagcaagaacaaaagaataagcacatctagtagatggctaaacaagtgtcctgacgtttactgacatctactctgtgccagcactatattgtgggtttttaaatgtagtccctggcatgtagaacttaagtctacagtgggagacagaaatatatgtatataggcttcttctcagagggtattagtcaagtggaaaaaggaa

SEQ ID NO: 53561 - DNA, 1913 bp, Homo sapiens
aaccctcctcccaagaccagccatggacatggaacaaaattatgtgtgccccctgcccctctccctgaaacaggagtattatgggccactcagattgggagaggggactaggaatggctccagcagctgccttaggatgaggctgatctcagctctgtagaagaaactctgttcctcaactgaatgactcctgcccccaacatagaatacagttagggcaataagcagaaatggagttgtgggaatgggcaaaaggcaggttcgttgcttgtgcagaatgcagcactcacacagccagagcgatttacgtgtccacacctgcctgtccccccagctgaagctacccagcttgtgtctcacagtacccccatggaagcctgagtggggaaactgggcatatactaaaatcagtactctcagaaaaccaggaataacttcttaattttatttcttcgttcttccagcctcctaattacatccatggggcacatcaagctcacggactttggactgtccaaaattggcctcatgagtctgacaacgaacttgtatgagggtcatattgaaaaggatgcccgggaattcctggacaagcaggtaaggaagggtagttgatacactgggggttaaattctaggcccttgtcctggcgcagtgtcttacgcccgtaatcccaaccctttgggaggctgaggcaggaggatcgcttgaggccagcctgggcaacatagtgagaccccatctctacatttgtgtacacatacatagattccaggccctagaataaggccttggggccatatgcctaccttgtagctagatgttaagattgggaacccctatcttttctacctttgggttccagagaggcactgagataggtagcacatttggaaaacaggatgagccttgagaatcatatggatataaaatccaaagtcatcttcctcctcagggtttggggaaaataggtcatataactgttagcacagagtttcatatgagatcagtcctgaatctcccagcctgaatcaagggcaaggctctcctggagcctgaggttcttggaacacagctctgaatttccattgggctgtggcccagtgtcctgagaggcagcctctggatgttccctggtttgacatttcaggttgtgactgttcaccggtccctgtagttgttacatgactgatagggtctgttttgttagaggctggagtgcagaggcccattgtgggatcacatgccagaggtgggtgttgagggcttaagggatggtagttccgggctagaatgagacatttttgttaattaggaaatacctactgacagttccgactcttgttccctggggcttctgttgatcttgttcattaactaaggtgggctgagtcttcattcagagattcttctgctcgagatgggagcatcccccatctccggctgtcatgccagtcagcagcctcaggaggctgagccagcctggcttttctgtgcccaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtggtaggtactatgcccctggcccagtggggaaacagagtctgaatccacaaatatgatgtatgcaggcagctcgtgaggcctgtgagctcttgttctgaactcatcatgtgtgtttgtgatgtctgctgctttggggatgggtgtctctgtgtttctgcatgtacatacatgtgcacactgtgtcccttggggcttcacatgtctctcatagacacctggtctctcatatacacctgggtgttcctg

SEQ ID NO: 53562 - DNA, 1031 bp, Homo sapiens
cggagctgggtgattggctcccctgagatgtgagcacccagagttcacccagggtgggcgacacagctatccctgcattgtcacagatcatgggagagattccgatgccagggaggagtgcaggtggcagggagggggcattcacaagggtggctcctggaggaatgtctgcggaggaaagttctgttactataacccttgtgtgcccctaaggagacctggcaggaggagggggaccacctgggtcactcaccccaggccttgtgtctcatagattacggaagcggctgtcggtgtctgagtcatcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccaggtatggcccagtgggcggccaaacgacctaagctggaggatactgcagggcagggaggctcagcggcatcgcgggtctcactgcttacttgggcctacagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcgggtgaggcccctggggagctgggataaaactcacaggaagggccttgtaatctctaggccttgggagggttctgcacgtggcaggtgtgtgtgtgtgtgttaagcacagatctgactgtggtctctgaaggtgtgtattggtgtctggggttgtgtatacatgtgccagaaagcaggac

SEQ ID NO: 53563 - DNA, 1068 bp, Homo sapiens
tctccttctccagaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtgggtatgtctgaccatccagacctgctgtctccctgcttcatcatccttccagcttcccctttgtggagcccatctgtccctgctcgggggtcaaagggtggtggtgaaggggctcacagcttaatgtccagaaccaggccccatacttcgtgttcaggctccagtctgagtactgttctcttcctggcacagcacgtggaggatggaggtccggccagtgaggcagggcttcgtcaaggtgacctcatcacccatgtcaatggggaacctgtgcatggcctggtgcacacggaggtggtagagctgatcctgaaggttagtgctgggcgtgctgcctgcatggtccctgaatgacctcagcctgtgagtctgtgatggcagttaggggagtgggtgagttgggtgcacacacatctacaccgagtatggatgtaggtacacacaggccgggcgcggtggctcatgcctgtaaatcccaacactttaggaggctgaggcaggtggatcacttgagaccagaagtttgagaccagcctagccaacatggtgaaaccctgcctctactaaaaatacaaaaaaaaaaaaaaaaaaatgcctgggtgtggtggctcacgcctgtaatcccagcactttgggaggccgaggcgggtggatcacctgtggtcaggagtttgagaccagcctgcccagcatggcaaaactctactaaaaataacaaaaattagccaagcgtggtggtaggcacttgtaatcccggctactcgggaggctgaggaaggagaattgcttgaacctggaaggcagtttgcagtgagctgaggtcatacca

SEQ ID NO: 53564 - DNA, 2298 bp, Homo sapiens
ctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccatctttatgtcttttgcttgcttgttttccttcggtcaacccacatgtaactaggtcctgtgttgctgctgggaatatagtggtgaataaaacagtttccaccaccaggggagggccacctaacccagcttgacttcccaaaggctttgacatttgagctcaaacatgaagaatagatgataggtagtagtttgctgggtgtggaagagtggaggttggcataagaaaggctgtccaggcaacgtttagcacatgcagtatacctggcatagtcaaggaaccaaagataattcaaagtagaaacgggtctggcaagtgaggcaagggccatgtctaatggtcttccaggagatttgacttcgtgaaggtgatggggaaccagaaaataccatgtagcaactaaaattccttcatagataagggcactaagactttgatgcccatggtaatacagtagcttgggtagaacgggggttagaacgtaggtctcccttggactccggaactcacatctctcctaactaggattgcctcagccaggaaatgaggaggggaagaagtgagagaaggcaaagagtttaactttgggtgcgtttgagataaaagagaagacagaagcagcaaccagcagagtcataaagtctatgggaggagttttaaaatggacagagaagttaacgataaatgccgaggtgagggcgagattaaaacagctgccagtcgtatttagtaacaagcccttcataattgtagccagtgagctcttcctgggctgttgtaggtagaggcctcagcactggaggtggatggacatcgtgtgt

SEQ ID NO: 53565 - DNA, 1030 bp, Homo sapiens
caggcaaaaacaaatgttcaccacgcttaagatattaggacctcactgggtgcaatggctcacgcctgtaatcccagtactttgggagactgaggcaggcagatcacctgaggttagaagtttgagaccagcctggtcaacatggcaaaaccccatctctactaaaaatacaaaaattagccgggtgtggtggcatgcgcctgtaatcccagctactggggaggctgaggcaggagaattgcttgaacccgggaggcggaggttgcagtgagccgagatcatgccactacactccagcctgggtgacagagcgagactcaatctcaagggaaaaaaaaaaaggatattaggaccgtgctcacccagtaggatctgtctgcttgatttctattttagccttaacatgtcaaatatttttacagaattatgatgaattatgataaattgaaatcacgtctgggtgagattcatgatagcaaaatgcgtctagagcaggatttgaagaatcaagctttggacaaccgagaaatagataaaaaaatgaatagcatcaaacctgacctgatccagctgcgaaagatccgagatcaacaccttgtgtaagtagtctgggagtgtatggggagggagacgttagtgccaggttactaccagcactagagacactagaggtggaagaagagattagagatttgtaattgagaattggccagtaagatggtaagaatttaggaaagtgtccttggtagttgtagggggtaccagagttaatctgaagttaatatgtggagcaaaccagaatgtaggactcttgatccatacaaatgccttggaaatctcagaggctggctgtggcatgagtaaaatgctatatcttaacaagaacagattaatgtttgcctaaaacataaaaatcagaatctttgtttacatactagaactgagtggggaatttctatttcctctgaggggaagtaggttctaggctgggcactgtggcttacgcctgtaaccccagcactttgggagg

SEQ ID NO: 53566 - DNA, 1063 bp, Homo sapiens
ctcaggcttctgtctcacttttccgggggggggattagggcaaggagggcatgagggactgtctctccctaaaacccagacccctgttccccactcagttcttcttcatcctcctcctcatcttcattgctgaggttgcagctgctgtggtcgccttggtgtacaccacaatggtgagacactgggatggaggaagggaagaagattgggcaaaaccctgggagtgggctgtggcctgtgaatggccaccttctgtaccagcccctaaacactggcctgcctcacccaggctgagcacttcctgacgttgctggtagtgcctgccatcaagaaagattatggttcccaggaagacttcactcaagtgtggaacaccaccatgaaaggggtaaggttggctgggggaggttttagggtggagagaaagaagcaaggccccacctccaccctcatcttgtctccagctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagaggtgtgggctggcatgagtgggtggggactgttttcatggcctcagagtggcaaacggggatgggagtagggcagctgccaactataaatgctcttttctcttcctgaagggttgcttcaatcagcttttgtatgacatccgaactaatgcagtcaccgtgggtggtgtggcagctggaattgggggcctcgaggtaagcagatgaggaggctgggactgggacatgggcatgagaccagggctgctcaacccatctgaggcctctctggaggaaacagacttctaactgggcctcaggtagggtgtctgtgggacaggcttcaggatccctatcatgttccctcatctctccctgttcctccctctccagctggctgccatgattgtgtccatgtatctgtactgcaatctacaataagtccacttctgcctctgccactact

SEQ ID NO: 53567 - DNA, 1043 bp, Homo sapiens
ctcagaacctcctctttatactcttagaacacctcttccaacctccttgtccaaattcatattctaaaagatgctatctcttacaaattgaggtggtttctgaggaggggtgggggctgggccaaagggtcgtcagtgacccctccctacagctctctgacccatgtctctgtctccatcccaccctcactagtgcctccatatctgggacctggatgtgcgtggcaaccatcggggcctgtggagattgtttcggaagaagaaccacttcctgatggtgggggtcccggcttccccctactcgtgagtgacccttttctgccctgggaaacaggaggcctagtgagatccagggatatagctaatggcttcttctctatacattcttgtattattttcccagagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataag

SEQ ID NO: 53568 - DNA, 1772 bp, Homo sapiens
atgtcccccaggaacccatggatgtggtggcactgtttggtctgaggggcatccagcatactcccatcagcatcaagaatgcccgcgtgtctcaggtactgcataggcaagtggggatggggcagacacctggctctgccttctaccctaaagctcatgtgccctattcccaccccactcccagcactacaaggccagcctcactgccactttcaacctgtttccggtgagtactaaggatacaactcttgggcctgggaggggggaaacatgggcataaggtctgggcctgttacgtggcaagctcttcccctcactgggcctcatccttcacatctggaaaatgggggtaatgctgcctgcaagaagagggttgggggcaaaggagatcacaggatggagagacccctttgggaccatgatgtcccattccccttctaggaggccaagtttgctgtggttctggaagaggacctggacattgctgtggattttttcaggtgaggggagtctctaggtttcagttgaggtccctcagtctgcagggaaagagtcagtgaggtgtcctagagagctttctggaggacatgagctcacaagtgggggcgaagcctgggcaaaggtaggatggcaggtgttggggctgctgttgaaggtacagtggatgaatggagacagtggggatttgggggaaggaggtactccaggaaggaggtgctcctgagacccagctccagcaattctagcatctctgtgtgactagatttatccttgtccctccctgaactctttgaccctgcctctctcagtttcctgagccaatccatccacctactggaggaggatgacagcctgtactgcatctctgcctggaatgaccaggtaggctggaatgaccagggtttagcaggcgagtttatgaggcctcagctaatacctcccactatggcaccctgtccccaggggtatgaacacacggctgaggacccagcactactgtaccgtgtggagaccatgcctgggctgggctgggtgctcaggaggtccttgtacaaggaggagcttgagcccaagtggcctacaccggaaaaggtaactgtcagggtagggtgagggggctggagtcccctaccaactcgaaacatcttaaccttcatcgtggtccatgtctgccagctctgggattgggacatgtggatgcggatgcctgaacaacgccggggccgagagtgcatcatccctgacgtttcccgatcctaccactttggcatcgtcggcctcaacatgaatggctactttcacgtgagtgggaggcagggagcagggcacagtgtggcatgacagtcaagaacaagaacatggactctgaagcaatcttagctctgctacttgctagccatgtaaccttggggaaagagctatcctatttttgcctcagtttctttatctgaaaaatgaggataaagggctgggcgcggtggctcacgcctgtaatcccagcactttgggaggccgatgcgggtggatcacaaggtcaggagatcgagaccatcctggctaacatggtgaaaccccatctctactaaaaatacaaaaaattagccgggcctggtgatgggcgcctgtagtcccagctacttgggaggctgaggcaggagaatggcgtgaacccaggaggcgaagcttgctgtgagccaagatcacgccactgcactccagcctaggtgacagagcgagactccatctcaaaaaaaaagaggataaaatactac

SEQ ID NO: 53569 - DNA, 1040 bp, Homo sapiens
aggcaaatcccttgccccaccccttgtccttcctgggtgcaacccagtaggcagggcagagcacaagaagagattaatattaataacatcctggcctgaggaaggagaaaaaataggatggggatctctcctcattctggccccagaaggctccctcccttgtgccctttctcgggcagcctcaggccccaggcaagctgggtcaagaatacagagagacaaaatcaaaagttaaatgcagccccttaaagtttacagatagtttccaccaaggcagagaagagagccagagactgggcgtggctcttccactgactccctatgtgagttcagaatctgcaagcacgttttatctgtaagatgggagaaatgatgaccagttttctcatttcaatgacataaaatgttcagactatctggcacaaagcaggtctcaaagtaaagatgcaaagtgcagtcagatgatctgggttcaaatcatggccctgctttttgcgtgatgttgggcagttattaaactccctgtgcctctgttttcttttcttttctcctccctccctcccttcctcccttcctccccttcttccccttctttttttgagacagggtctagctctgagctctgtcacccaggctggagtgcagtggtgcgatttcagctcactgcaacctcctcttcctgggctcaagtgatcctcctgcctctgcctccagagtagctaggactacaggcacacaccacaacacccatctaatttttgtattttttgtagagacagggtcttgctttgttgcccaggctggtctcaaactcctgggctcaagcgatctgcctgcctcggcctcccaaagtgctgggattacaggcgtgagccaccatgcccaccctgtgcctcagtttctccatctataaaatatcacttaacagggttactgtggagatgaagagagcatcatgtaaagtgctcagcaagctgcctggcacatgcactgggtgaaagttttcaaagcaagtagacagtctagataggctcttacta

SEQ ID NO: 53570 - DNA, 1066 bp, Homo sapiens
acaatattctgatagtccccgctctgggagctcggactgggatttccaggcttttaccctagggcctgatttatattgagcaatgaggaaaccatacaggaccccagcgctgggcagagagtctggtatgtagatgttaaggagaggagtagggagcctgaatctccttggaaggagaattgggtttggagtcgcctctgaggctgcatctctcctgagctgtttatcctatactctattttcttcaagagatggtgtgaaaagagtgtttctttttctggcaagaaaaccttgctttcttctattctgggagtgatgctgtcacagtcagggaatcccactgccacaggattatagaatctgctctcagatttatttcccagcaacacactacaacccagacccctgaatcctgggaaccatcaaaggggtcaaggatagtaaaggcaagagaatcacagaactgaatgtgacctccttagcactgggccaagcaccagaaatggattgggcaggatctgctctcagggagctcacagtctggttagggaaggaggagacagaagaacatttctagtacaggatgataagtgctggtagaacccaggaagggcctcctggaagagtcttcactgtagagtgatgtggttgggtttgtgctctagaaagtcgatttcaaattggaaggaggcacaggctgtttcctctgcttgaaatgcttctctccacctctttgtctggctgagtccttctatttttttttttttgacacagggtttcactcccatcacccaggctggagtgcaatggtacaatgtcggttcactgcaacctctgccttccaagctcaagcggttctcctgcctcagcttcctgagtagctgggactatgggcatgtgccaccacacctagctagcttttgtatttttagtagagacgggattttgccatgttggccaggctggtttcgaagtcctgacctcaagtgatcttctgcctcagcctcccaaagtgctgggattacaggtgtgagccactgcgcccatcctagctgagtccttctta

SEQ ID NO: 53571 - DNA, 1214 bp, Homo sapiens
tgtaaaacaggattaaatcacttacctcacagggtagctgtgaggattctgaaatgctgtctattaagtactcagcacagtgcctagcacagaggaaggtctcagtaaatgttaagtattaaaatccaatcctattaagctttgaacttcatatttagggtacttctttttttttttttttgaaatggagtttcgctcttgttgtccaggatggagtgcaatggcgcgatctcagctcaccgcaacctccgcctcctgggttcaagcgattctcctgcctcagtctcccaattagctgggattacaggcgtgtaccaccacacccagctaattttgtatttttagtagagacaggtttcaccatgttggtcaggctggtctcaaacccttgaccttaggtgatccgcccacctcagcctcccaaagtgctggaattacaggcatgagccaccatgcccagccacagggtactgactattgagcctgcccatattcaccagaaagacatagaaacaaagaatagcaagatagggtgttaatcaggaagtagattgggccaaaaggaggcaggagctggggaataaagagagctaacctggttccctagtcttttcagggcattggtagcagccaccgagaggggaaagggttggccagagcttagaaggatcagaatcccactggctgggcattcaggccttcttgcctgtacacaccagtctacctgtctgtactggaagtaaatttgacttacagggtaatctcaagcgtccgttccagctcagatgcactgttaccttccctaagcacaagtctgaacctgtctctccctgctcaagagcctttataggcattgcactgctcttagagagtgccgaatccgaacatctacaatagcagggaactccgccctcctcttagagaatgaaatctaaacattttagcaactggcattcaaaagcctgtaacatgtggctctcgcccatctctatagtttcgcctctagcattctgctctgtgaacccaaggtgctgccacaaatgactttttaaaactagttttatttagttttacttttattattattttttgagacagggtcttgttctgtcactcaggctagagtgcagtggcacagtcatggctcactacagcctccatctcctggtctcaagcgattctctcacctcaacctcccaaggagctaagaccac

SEQ ID NO: 53572 - DNA, 1453 bp, Homo sapiens
gccccgtccagctcttctcgccccgccccgctcttctcgcccaactgctcctcgctgttggccccgcccctcccccgccacccccgcccccgccccgcccctctcttctcgcccaaccgcccacctctgttggccccgccctcccatctaagtcacgcctcctagtaggtcaatttagcttctccagctccagagcccagactcctcattgggcgcagcactattcccgcctcttccttgggtcgcgagcgccgaactcatcgaacgcagccaatgggtgatacgacggcagcgcggcgggaggttcgattgacccggtcttggcgggtcggtgagtcttggcggctgttaacgcgcgctttgggaacaggaaggttgagagagaggtgctggggtctgcgtctatctctgtcgctcttttcagcccctcctggtattcccctcctaacctgggttttttacacgcccgcgtggcttcctgctcgacctccctgagtctgatcctggtttccacctccagccctgggaaatttcctttctccagactcgccctccccacccgggcctcggactttcaccccagcttctctctcctggccagtgattacccacccccaatcccaccccgccccgccgcgcaactacctcctcccttcacccggactgggaccatcatccccactccactccgcccagtctgggactccacctgcctcctccccaatcccacactaatctctgcttggtctcttcctctttggcctaatctctcgtctcggcttattggggacggccactctcacagtttggttccaaacaccagttcctggatggattcccgccatccatgccccctctttaattagccggtcctctcaataatgtagcagccccctctacagattagaccctggtcctacactcttagccgctgcctgcttttgacctttggctcatgggtacttgacgttttaaactcctaggcccaggatggtaagtgtgggcctaggggagactgggaatagccctgggtcagggtctagtaggcctaggctgcaggatccttgcaggcactgtttctgttctccctttacagaggaggagcttggctcccagccagctggccaagagaaaacctgaaggcaggtcctgtgatgatgaagactggcaacctggcctagtggtgagcactcaaggggacagggaaggtgggtagagctgtttggacagaaaagaagccaggatttggtttctagggttacatagccaattccagatgcctcttttgtatgttcaataaacttttagtgagtacttactatgtgccaggcattgaacaagattagtaaaatctttatcctcagggtagtcactagaagctaatatagcctcagttttcctggtgggaaaagataagcaaaagagccagttggattggaccttttgactctgc

SEQ ID NO: 53573 - DNA, 1192 bp, Homo sapiens
attccatggagcttttggagtgaagctttgggccaccaggactccatgctgttggtagacttgctcttcagaggcccattttatttacctcttccattgccccgctcagtttaggcaggttatttaatctcattaagctctagttttctcacctcttaaataaggataataactctacataatagagttgctatgaagatgatacactatgacatgtgtgaagaatttagcacagtgcctggcacttaataagcacttcaagtgttagttgccattatggtgatttctgtggtcttctagacttcacctttcccaattctctctcctagactcctaggaaacggaaatccagcagtgagacccagatccaggagtgtttcctgtctccttttcggaaacctttgagtcagctaaccaatcaaccaccttgtctggacagcagtcagcatgtaagccagaactgcaacctgcatgtgtatgtctgtgcccagtcactcagcctaggtagactcctgtccctgtacactccctcagtgctttctagagtggccagaagacacacatctgtaggggctttggacctgcccacagctgctggggcctgcttagagaggtgtgcctgacttgtgcctggtttatagtagctacatgggcaccagatatcagatggttcagattcctgaggaaaggagggtaaaggaactaggatcctcatgtcagctcagactctgactctgtatatgactttaaggtgtaccagagtcatgtatttcctctagtaaagtcaaacttaatcaccaccatggcaggttctgtgcattgcctcatgtaattctcacgttttaagatgagaaaacagtctcagaagggttaagtaatttgctcagagtgggtggagcagatctgtctatctccaaagcttttccactaagctttatgaggaatgttttgaaggaaaagtaggaatacataatggagattagtcatttgtgcattcagcaaacatttaaaaacggttttgtggccgggtcgggtggttcacgcctgtaatcacagcactttggaaggctgagatgggtggatcaactgaggttaggagtttgagaccagcctggccaacatggtgaaaccccgtctctactaaaaatacaaaaattaactgggcatggtgtcatacccctgtagtcccagc

SEQ ID NO: 53574 - DNA, 1755 bp, Homo sapiens
caaactgagtttggaggcattctcagagagagagggtcatatgggagctcgggaaaggttatgtgaaggacaagtatttgagctgggcttgctggagctcctaaacatagattcaggtgacggaatgattattggtttgtaggtcctctgggctctcgagcattgggcctgaaaagggctggggtccgccgggccctccatgaccccctggaaaaagatgccttggttctgtatgagcctcccccgctgagcgctcatgaccagctgaagcttgacaagtatgtgcactggtatttcataagcagttttggttctctgtatatgcacgcatacttgggagggcagagggtattttggtgtgatttctttttaggattgacatatgttttcagagagtagatgattggggaaggagactgcctggggaagagcctgtggtcatgtccagtgagtgggcattcctcatcccctcctgccttcccaggatgctcactcaggaggaggagtgattgaggtgatgacacagggaacccatccctctctgagctaactttctaactcctaaagtaggaacttgctatggttttacgatttatcagccaagaaggtcttcttttaggcagctgcctctgttgcctccggatcagcaggacacagcttcctgagggtgctcccttgcccatgtctgagcacgctgttttctttgctgtgttttctcagggagaaactccctgtccatgtggttgttgaccctattctcagtaaggttttgcggcctcatcagagagaggtaaatgagggtgaggggaacgaggtatgggctatgggctgagcctgggagactaccatccctgggacagcagcagcgtaggtgccaaagtggactgaaggctgttattctctagggagtgaaattcctgtgggagtgtgtcaccagtcggcgcatccctggcagccatggctgcatcatggctgatgagatgggcctaggaaagacgctgcagtgcatcacattgatgtggacacttttacgccagagtccagagtgcaagccagaaattgacaaggcagtggtggtgtcgccttccagcctggtgaagaactggtacaatgaggttgggaaatggctcggagggaggatccaacctctggccatcgatggaggatctaaggatgaaatagaccaaaagctgggtacggagccctaacaaagatggctgcactctcctgcacagcctgctgctttcttacgtgtatgctcatttatggccagggtggagggcaatgcaggggtagaagaaaagagaatttccattgaaaatagttgaagtggagtcagttgtttccaggctaaattaaagaactgtctaattgttttttttgtttttttttttttcaaaagattctgaattgttccctttacaccttttctgttgtagaaggattcatgaaccagcgtggagccagggtgtcttctcccatcctcatcatttcctatgagaccttccgccttcatgttggagtcctccagaaaggaagtgttggtctggtcatatgtgacgaggtacttgactctcagcagtctgggtggtaggagaaaatctgtcaaaatctcttcactgagtattgccttccaagggctgtgctagtcactggggaatgctgaagacaggatgctgccttggagacaagtgacagggagagcctgtgataccaaaatacaagatactgtctgccaaaagagggctgaaacaa

SEQ ID NO: 53575 - DNA, 1063 bp, Homo sapiens
accctctctcatgctgccccctgcctagttcccaaggccctagaacctgtaatgtttttgttttttgttgagacagtttctcactatgtcactatagtggtggcatatgcctgtagtcccagctactcaggagactgaggtgggaggattgcagtgcactcacggctcactgaagcctcgacctcctggactcaagcgatcttcccatctcagcctcccaagtagctggggctatgggtgtaagctactatgcccagctaatttttgtatgttttgtagagatggggtttcaccacactggccaggctggtctggaactcctgggctcaagtgatccacctgtctcggcctcccaaagtgctgggattacaggcatgagccacggcgcccggcctggaatgtttttgactcctcttttcctgtctacatgagactttgctaccgtatagggaatgccacattgcgctctgaataaggattctcttgcagggacacaggctcaagaactctgagaatcagacttaccaagccctggacagcttgaacaccagccggcgggtgctcatctccggaactcccatccagaatgatctgcttgagtatttcagcttggtacattttgttaattccggcatcctaggtaagaatctagccttgtttgccacatcagagaggagccctgccttgtctttgggagtataactccagctgaggagagaaagaagagaatgctagttatatgtgggtcactaggcattcttgtaggaaggcttctcttgtcagggagtagcaaagccattgggaggccttggatctgctgagcaactcagcaaagcccatgttggccatttttccattgcagaggtggcaggggctatacagggaatggtgtcatgatgagctgagggtggaattattatttttgttcctcagatcctagctcccttagaagagttttggcctcagagcaagctctgtcttgggcagacgtgtgtgttttaaaaatcattttaaccatttttaaatgtaacaattcagtggtattaagtacattcactttgtg

SEQ ID NO: 53576 - DNA, 1068 bp, Homo sapiens
ccagtagttagcatggcaattttaccagcctcttgcctttttatcctgttttctctagatgcctgatacggaggacttctgatatcctttctaaatatctgcctgtgaagattgagcaggtcgtttgttgtaggtactgaactcaactgaaagatgtggagtgggtcaaagcctagctcctgaagcatggctgggctctcaaggtgttctcagagggcaggagggtggtctagctttttccactgacccagctgccttttttaggctgacaccccttcagactgagttatacaagaggtttctgagacaagccaaaccggcagaagaattgcttgagggcaagatgagtgtgtcttccctttcttccatcacctcgctaaagaagctttgtaatcgtgagttgggcttgtgtcctggtgtcctctgtgagagtgagcaagggagggtaggttcctgtagtggcctggcaaccctcactaaaactcgtccagagtcatcctcatagaggccacatgtgattccaaccctacccaaggcatgaaccctgcattgtggagtctgtttaccagaccctttgctttggaaaattgaactcatcttctgtccagcccatgcttgatgacctgggatgtgtcgactgtttgtgagtgcttgcatgtacacacgctcatatacaatgttgggcaggaggaaaaataacaaagaaaccttgcctgctctgttatagctcccttcttgttgggagaacacattagtgagtgagattgtccatccatcgtcccagatggcaccgactatatcctgttggaatttggtaggatgaagatcaagcaagtctgatgttgaggaaggccttttgggctaggcttctagagggagttctagtgaacactgaagtggaaacttcagaaagcaaagtatctgggttttgttttgttttctcccagatccagctctaatctatgataagtgtgtggaagaggaggatggctttgtgggtgccttggacctcttccctcctggttacagctctaaggccctggagccccagctgtcaggtgacccttt

SEQ ID NO: 53577 - DNA, 1176 bp, Homo sapiens
gggctgtcctgtttcaaggcaggatatcaagagtaagaagcctgggccattgggacagccagtaggggactgctggttgctgctcttcccaggtaagatgctggtcctggattatattctggcggtgacccgaagccgtagcagtgacaaagtagtgctggtgtcgaattacacccagactttggatctctttgagaagctgtgccgtgcccgaaggtagggaagatcctaaccaggatgccaaagggggatatacccctcccctactgtctgtctagttctgatttgtggatgtgggccaagatctgggcacataagggctttccctggagatatcttcccttattgctatgatggcctcagctctatctccaagtagaagatcccctagtccttcaggtactcccttaggaaagagtcttggcctctagctccctgcccctgcctttgggagcttagggcctcaagcatggttatttcagtcccttcagtggctctccaagggactctgctttcttgggtctttttaaaaaaatttttatttttaattttttttccccctaatcattgaagctttattttcttgggtctcgaatcccccttcaggtacttatacgtccgcctggatggcacgatgtccattaagaagcgagccaaggttgtagaacgcttcaatagtccatcggtaaatgcacatccccgtccccacaccaccaatgcagtatcatcagaattaaggaatgatagagaagctataaggggttaccttgattttttttttttttaattcccctagtggatatagtaggatttgtctggttggtgatggctgggctggaaactgactgtgtgtgttgggattggctggctggtgagcagataaactggtggttttcacaattggtactgagtagtatagaggcatgagggaggagctggttgggctgagcaggatcccagtttaggctataagaggttccttttctcctgtttcttctctttccagagccctgactttgtcttcatgctgagcagcaaagctgggggctgtggcctcaatctcattggggctaaccggctggtcatgtttgaccctgactggaacccagccaatgatgaacaagccatggcccgggtctggcgagatggtcaaaagaagacttgctatatctaccg

SEQ ID NO: 53578 - DNA, 1237 bp, Homo sapiens
gaactggtagggtgagatggattagatatccaggaagcagtgaattcctggtctatatctctgtagccccatcccttgtcttgcccctcccctcatgtacctgatgtccagctgacagagagaggaggatgaatcctctgagaaaacatctgccaaggccagcaggccagcattccctggagagaaggggagaacgcctatcacctccacccaagaacaggggacaagggtatcccaacccaactatggctggcagaaccagccctgctggttcctgaagccccagcacagaaatatctgtattccaactcccacgttcccagtggagaggtctttgcctttatccagtgagtttttaggtcaaaggcctagctcctttcccctctccctccccagggtctggcccccacccaggcggttccctggcagccggaggcccttcagtgtggagttgcccttcatagcagcaaccatctcaggcagaaattgggctgggcgcttctcaaacagacggcagaaggagaaggtaatctctgtcaagaaaaattatagtaaattctgatggctgcattaggactggtgctgcccctcctgccccagttggccctagcaaggggtattaacattatagaggcccaaaaagaggaaggaatttgtctagactccaagcaaggctggaactaaatcagaatccaaactaaagactgaacctaaatgttccctataagaaggttctctgcatggacaattctccattcacttccttctttccctaacactggccaccctctatgcgggggtggggatcagagaaaagtctatgaggggagcctggcacagtacatttattttgccccaccaccaccattttgtccacctctgaaaggtaagagcaacttttgggtgaagcactctaaaagagcgatttctcatgtttagtagaggaggaattgaggttggggcttttagaaggaaaatcatgcaggttctatatccattttatagctgaggacacaaggccaagaaaggaacagtggtttgctcactcagattatggcagaaccatagtgaagacccaggaaatgtccaggttctgaataaggaacttaccttgcagagtcagattctgtagcaaaaagagcacctcgctctgacagtcagcgagattcatgtcatggaagctcagtcttttcagggctaggttgtactctggataggaggcagagaccatggacca

SEQ ID NO: 53579 - DNA, 1040 bp, Homo sapiens
actcccacatggttctgacttaatctctttcttgccataggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaaccctggtgtgccagggaatgcagggccccctagccacataataggcgatgaggagataccaggtgaagcactgtgtgtgtgtttgtgtgtgtgcacgcacgtgtatccccacacaaaggtgcagatgcattcgtatggggaaaggggaaggacctcttctatcactcattcctggcttatctggaacctatcccccctttagagcctaccactaagatactcttgagctagacagggcctaaaccaccataagaccagcagagagtgaccaaggcagcttggtctccagaaaaggaaaagaactgatctttagactggattagttcccctgctgtatgttcccttagttcttgtatgtctcctatcccaccactctgcatactttatttgcttgtgtctgggtagcctgtcttcctggtctaaaatttctacaagggcaaggactaaatctcatatttagtgctcaattcctagaatctagcacagtgctgacatatggtaggcactcaacgacaagtgaatgaataaataattttttagatgaatcccttaagaacaggatgggacctgctatgggagtgaggtagagatggccagctggaatcttctttccccaccatatccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaaggtaggaccca

SEQ ID NO: 53580 - DNA, 1360 bp, Homo sapiens
gtaggcagatcacctgaggtcgggagcccaagaccagcctggccaacatagtgaaaccccgtctctactaaaaatacaaaaattagctgggcatggtggcatgtgcctgtaatcccagctactgagtcagtagaattgcttggacccgagaggcggaggttgcagtaagccaagattgcaccattgcactccagcctgggtgacaacagagactccctgtcaaaaaaaaaaaaaaaaaagatacaactatagagataaccaggagtaagaatatgaatgaccactaagtaaaattaagccattgaagggtgtttgcataaatgaatgacagggtcatttttgactgatttttttaaagaatcaagactgcatttttcaaaggatgcttgggctgcagtgcagataatggatttgtatggcaagagtaaggagtccggaggaactactgaaattagttcaggtagtgggtaatggtagcttgaattaaggatgtggagatagagaaataaatgtatttaacaaattgtaaagatagggctgggcttaatggctcatgactataatctcagcactgtaggaggccgaggttggtggatcacttgaggccaagagttcgagaccagcccggcctatatggggaaaccctgtccttactaaaaatataaaaatgcattcaagttggatgtaatgagttgggtggggtattgtgggttatgaagttgtcatgtctactagctggataaatgggtctggaagttcaagagaaagatctggggtaatgtcacataatggggagtctttagcatagttggcctttgaaaccacaggaatggatgaaattgtccaagaagcgtgcataaagtgggaaagctctgaggaactctgaataaacagaggaggagaaaactttttttttttttttgagatggagtctcactctgttgcccaggttaaagtgcagtagtgcagtggcacgatctccagtcactgagtagctgggattacaggcgcccaccatcacgcctggctaatttttgtatttttagtagagatggggtttcaccatcttggccaggctggtcttgaactcctgacctcgtgatccacccaccttgacctcccaaagtgctgggattacgggcgtgagccactgcgcccggccaagaaaacattttttaaggtagtgaaaaaaaatttaatgaacagcagtaaatcctgccaagaagagttactgaaaagtatacattggatctagtaacaaggaggaccctgatgacataggtccttgccagtgcagtggtaggggtataagaggctggaaggggctgtgagtaagagaagtggaaacagtacagataac

SEQ ID NO: 53581 - DNA, 1031 bp, Homo sapiens
tctcaaactggtaatttttatatactttgttgtgaagctctatgcatctagagcacaggtgggagaattagccttagaaaggatggtggtctcttctattctggtaaagaaggatgagtgcagatggagagtttataggctgcttagcaagctaaagaaactcatgtgtgatggcttctattttctctgtgaagtaggtgaggtcatccctgagaagggaaaaggagagtttggaagtggtaggaatgggagctgatgttgcaagcacagtgaaggttcatacgaggttagtgatcatatagtaacactgatttgcatagttgtatgatttgtctctagcagtgctcagcaacctaggcggattgctggatttagccagagttgaggttttgctagctggtcacaagcaggagggaaatgaggactgaggactgctttgcaggttgttggtctgataagaaattgtgtcccacaccttgtctggacagctactctgatatgactggtgaggtggtgaggtcaaactctagccctgcctgagcatgcatatactatactgctcccacctgcccttggactgccttccatatctaaaatgtattcattcttcagattccagctggcttgtctcactgcccctcaggaacccctgctttcaacaactaatcaagtgtatagactttatgttcctctcttctagcaatgacagtctcccctgctatgaggcatacaagccttcctctctaacctcctgatcatacccccaatttgcccctcccacctccctagaattaggcacacagctggtgctgctaggcaatctaagcccaatccctgccactccagggtgctcaccattgtaggagagtgtgaggctctccagtgacacccaggagctcagcaggtggcatagtgtcagggctgcctctgtggagagtggaactgtgaatagctccaaggtggagatgctgcggaatctttgtgaagcttccagtgctggaagccccaggcagctgggatctgatccatcc

SEQ ID NO: 53582 - DNA, 1120 bp, Homo sapiens
ccaggagcctcatgggaggtggctggggggtgcagctccctcttaaggtctgttccgcctgctgtcaggctctcctgtgtgctccggcgtgttacccgagtggcaggtgcagctctgggcatctgcttggcttcactcttacgccggctggccatcagggctgcagcacatcgctcagcagcatcccggcggggccgacgtgagcccaataagagggacccttcatctcgggatggggcccggcctcgggaggcctctccacagaggcggcagggtgggccaccaggccctggttgccagaagccagcactcatggtgagaataaggatgaaaagggctgactcaggcacaggccaggagtatagcgacacttgactgacagccccatggtgaatgagctgatgcaacagctgccgaagtgactgctgagcagccacatcagagaacagcaggtggcggaacttgagagtgtgcagggagctggccagggtctccagaaccctgcggttgggctcagccaccagctcggttgcaccctgcagcatgttacagatggtgagctgtcggacatggcgggagctgtgcagaagaggtgagaaccgctgatcacaaagacgcctgtcagaagacacatcaatggtcccacgtagaacatgggaaaaaaaggcctccataaacttggctcgccaacatgtcacactctgaaacgcagaaaacatgccagacagccatgatatatccatgaaactgtccaaatttccctctcttccaatagcacactatttactgagtcaggcaacactacaaattcatttaatcttcacatctctgaggtatgtattattattagccctattttacaggtaaaaccgaggcacaaagaggtggccacacaggtaagtggttggattatttgaaccctggaaatctggttccagagaccatgcttttattatagtgtctccactgaaacactcacccctgtaagttcttccatgtttgtttctagaaccttatcccaattttttttttctttttaagatagagtctcactttgtagcctaggctggagtgcagtggtgtgatctcagctcactgcaacctctgcctcccaggttca

SEQ ID NO: 53583 - DNA, 1054 bp, Homo sapiens
atgaggtgaagtgatgtttgcccaacaacacaatccttggcccatcctcagtgggctggtaggggaagaggaagtatttgtacaaactagggagggctaaacatcttgtgctaacttgttagagccaacaatattcagaaactatattttgttcattattttgctgataccagaaatactgtgtgtggatagagaagcaaatgaaaaatcatggacgaggcatggtgactcatgcatgtaatcgcagtacttggggatgccaaggtgggcagattgcttgagtccatgagtttgtgatcagcctgggcaatgtgacaaaaccctatctctactaaaaatagaaaaaatgtagctgggcatagtggtgcatgcctgtaatccagctacttgggaggctgaggtgggaggatcgcctgagcctgggaggttgaggctgcagtgagctaagatcgtgccactgcacttcagcctgggcaactggagtgagaccgtctcaaaagtgtaaactaactctggagtatttacatatatgagagtacctatatatatttgtttttacaacattgagacaattctgaacagtttcaaatgctgggcttttaaaacataccatgtattcaaatatttttagaatattttattttgaaaatgtgtaccatatgtaataatacttgctgtatttaatatttccattgtttctagcttttttttttttttttcctctgtcgccctggtctgggctggagtgcagtggtacaatattagctcactgaaacctctgcctcccgggttcaagcaattcttgtgcctcagccttccaagtagctgagactacaggcacacaacaccatgtccagctaattttttggtattttttagtagacagggtttcgccatgttggccaggctggtctcaaactcctgagctcaggtgatccacctgccttggcctcccaaagtgttgggattacaggcgtaagccaccatgcccggcctgtttctagttttttttttttttttttttttttttttaagacattcctgctctgttgcc

SEQ ID NO: 53584 - DNA, 1036 bp, Homo sapiens
tggagtttggggggactgaagctccgggataagctggagggtggtcggggaggcccttggctgtgggagtggagcccagtaccatgaggcctgagtgtcctgcatagtggtggtggaagaggcttttagaagtcggccggtgtgcggaggggacagtggaggccccaggccagccagcggctgagaagacaaggggcaggccgacccatggggaacaggaggaaaggctccgtagagctgagcagggagctcagaaaagtcctagggcatggggaagaaggcagagagggtctggcttttccgcctggagcttctgggatgctaagactggctaaaaaggaagatgactgggtgcggaggcccaggttgggaagcagcagcattaaaggtgcaggctagaaagaagcaaggaaaatcccggcttaagaagaatggagaaaggaagagaggagtttgtgggtaactggggatgagaattcctgtggctgcaagaagagatggctaactagaggggagcaggttggagggaaaaggggtaaggctctggaggaacttcttcccgtgtggcctcttccccctaaaacaattgacagtttactgaatctccctttccccttctccctcccctaccactgctgtacataccaccatcccattactggctgagcccccagccaagttgagaggagacaggggaggaagagctcctgtgggcctagaccagaaaaagctgaatcaagtgaggccttttaggagaatagccaaggaagaggcctgctaagcattgctattttagaggaaggtctgtgtgggctaacagccaggaaaggcttcctggaggtagtggactagcatcgctttgtgtaaggagttggggcagcgggtgtatagaggcagcaggaaagggtacaatgaggaaactttaaaataaggtatattataccttgaataccaggatatggagtttggactttatcatgaatgcagcagagagacctccaagggttttgaagagggtagtgtcatcaccaagagc

SEQ ID NO: 53585 - DNA, 1084 bp, Homo sapiens
cccgggacgtggcctccatggtcgttgccgccgctacctcacagaaccagcaactccgggcgcgccaggcctcgggcgccgccatcttggggaggtgcgcgagcccgagagtgtcgcccgcggaccgccatcttgaaaaggtcagcagttaggacggctccataagcgatatggggaagaatgtgaattattctaaagaaatttcgaagaaattagcacactttccaagtctcttaggagctactattttagataaactcctagatcaattatacttgggtgtggtatgactaaggggatgtttcttagcaaagcctcctcgggtgcaaacatcagctacccctaacctctgcctgcggctggtagtacatgccaatctgagcatgtgttcgcgaccacgatgagtgtgccgcacttccggccagatcgccggatttccgctgagtgacccttacaagtccttcttgatcctgaactgggttaggtgccgctgttgctgctcgtgttgaatctagaaccgtagccagacatgggactggaggacgagcaaaagatgcttaccgaatccggagatcctgaggaggtaaggcaaggcgatccactcggccctcttctctgccctgaagcccaggacctagcccgccaaaacacgcacggggccctcttagcccccagtttaccctctagggtttgcatagtcgggagctctagttccctcgacctttccccagaattcgtccggtgactttggacagatagatgactagtttttctctgggcctcggcttctgcattctgtgaatgtagtgaaggtttgagagcgaaaatgttttgtggactaaagtcttgtaaaaatatgacctatgtttgcagtcagtcagatgttctgaagcccgcgtttcacagatttggggagcaaacagaccgccttgccccagctcaggttaggaatccctaccacatcttctatggaggttcggaagacctggccttgtgttccttttctttgaggaaggtgtgtgtctttggggacaatgaaagaatgtacgatgtgattctgtgatggaagagggagctctttccc

SEQ ID NO: 53586 - DNA, 1027 bp, Homo sapiens
gaggccaaggtaggaggattgattgagcccaggagtttgagagcagcctgggcaacataatgagaccttgtctctaccacaaagaaaatttttaaattagccaggcatgtggcgtgtgcttatagtcctagctactcagaaggctgaggcaggaggatcacttgagcccaggagtttgtggctgcagtgagctatgacagagcaagactctgtctcttaaacaaaagataaaggaggcagtttgctacaagcactttggatagttacgttgcatatgaaaggtatgctcgcaggcaagtttgctgtctaaaaattagccctggaagagcaggattagctccaggattagcaaggcctctaaaatgtaaaaacatcataaaacacagaaaacaaaataacatcgttaatagtgtcagtgtctatcgtcagtaattacatcagtatgatcaggaataaatatgtcataaaattgctgctgacattaattttgttttccttttgtaggaggaagaggaagaggaggaattagtggtaagaactgtctcaggtttggaaacatctcagtaaaagcagggtttgagcttcatgaaattctaagggcattttaaggagtttttacttgataccttgtagataatgggggtggaataagctttgatacttcctgtgcagtggagagtttagggtgtgagccttggaagctgagtctgttctgggtttggggcttcttcagttgtggtaccagggagcagatggcatcttgagggcctggcactcaatcatctgctatttgtggtttaataaagaactttgggctaggcatggtggctcgtgcctgtaatctcagcactttgggaggccaaggcaggcggattaccagcctgaacaacgtagagaaaccccatctctactaaaaatacaaaattagccgggcgtggtggcacatgcctgtaatcccagctactcgagaggctgaggcaggagaattgctcgaacccgagaggcggaggttgtggtgagctgagat

SEQ ID NO: 53587 - DNA, 1090 bp, Homo sapiens
agcaaaactccgtcttaaaaaaaaaaaaaaaaagaactctgaaggaacctttgttagatagtccttctctatgttagcattgcctttctagttgggcagctggggtgcataggcctggttctcagacaaggggatttgaagtttcagacgtgtcatattccaaaatgctgtgttaacaagtaaggcctcctatagatctacttcaagtttggccaggtttcctttaccaccttgtttttcagataggactgaggctttcagtgcatactggcaaccttggaaggcaggaatgtgaaacttttccctactacttagcatcagaattgaatgggagaccgcattctgccatttctggcggcagtgtggctctgccagctggccttctgcacggtaattcagaggcagcaccttggtttggtggttgtgttaatcaaagcatatgtgtttggtgggtctctgctaaaaatgcccattttgttttttttctgtttctacatcaggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtaagtcagtgggaagtcaggaaggggaaaggttgcaatggtcagggaagacttggtgccaacaatctttccatgctagggaaaggcccatcagttactctgggcccaatatatgtgacatatggtgcgctgagcattttatgtaaataacctattctattttattgagagggtctcactatgttgtccaggctgaagtacagcggcatgatcgtagctcagtgccaaccttgaactcctgggcctaagtgatcctgccttggcctcccaagtagctgggactacaagtgcatgccaccatgagaggctaattttttattttttaattttttctagtgacggggccttgttatgttgcccaggctggtctcaaactcctgggctcaagcaatccttccttccatctcggccctctgaagtgctgggat

SEQ ID NO: 53588 - DNA, 1022 bp, Homo sapiens
cctgttgaattaatatgtaatgttaatgtcactgatggggaggtacaagtttttgtggaaagataggagggacagatttgtgtgtggataggggcttgtttagagaaggcttgcaggaaatgacagttatcagatctaaattctaaaggaagaataaaagatgaaaaaagtggggagttcactaggactcaagtgctgcttgcctatgtgagaaggggagtggtgagaagaggggcagtactgtttcaggtcttgaaggaccttgtaagccatgacattaaagctgccaattgattacctccttttctttcccccatctaggtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaacctgcccgtcttttttttttaattgagaatttttttttttaatttgatattttcttttagttttgagggggtggggagcggcaaggaggacagggtcttactttgttggctaggctggaatgcagtggcgcaaacagctcattgcagcctccacttcctgggctcaactgaccctctcaccgtggccccaagttgctgggactacagcatgcatcaccatgcccagctaattttaaaaatattttgggccgggcgcggtggctcacacctgtaatcccagcactttgggaggccgaggcgggtggatcacgaggtcaggggttcgagaccagcctgaccaacatggtgaaaccccgtctctactaaaaataagaatattagctgggcatggtggcgggcacctgtagttctagctactcaggaggcttaggcgggagaattgcttgaacccgggaggcagaagttgcagtgagcca

SEQ ID NO: 53589 - DNA, 1014 bp, Homo sapiens
atgctctgtggttccctccaccccccatccctgcccactgtctggctccctcaatcattcgacaggcccccctcccattgtgcccctgtgtgacacctatagcactcccaggggcccaccccaacctcgttgtcagcctgtgatgcctccttgttctacccacatctattcttttatccctttgagaacaccctttgatcctcaaagtttacccattgtcccccgagtccgggcctaccctgatactgtcccctgtggcctccatatctaccctgtggcctctcaaggcccttgcaaagagcctctgcagatcccctacagctgccctttgccttcatccaaggattccagctgtagcaccaatcccagctgtagttcgactattattagcaaatgccagagtagtgacagcgagagcaggagttcccaccaaagccaaagccggagccaaagcaagagtccccatgatggcagaagtcagagctggagcaagaggcatcatctgagcagaagtccaagtcagaaaagcagtccctatcctagcagaagctggggccggagcagtaatcctcaacaaaacacaagtcagggccagagtgagagtccccaacttagcataaatgagcaccagggtgagagtccccaaattagcagaggtcagggcaagagcaagagtctatgatggcaaaagtcggaaccggagcaagagtccccaacatggcaaaggtcaaggccagagcaagagtccccaacatagcaggagccagagcaagagtcccagcgaggcaaaagtcacagagcaagagtcctcaccataacaagaaatgagggccagagcaaaagttctgaccagaccaaaaatctaggccagagcaaggcatagatagtaacaagattgccagctatagcaagcatcccagctgcagcaaccaggaccgacttgtgcactcctcatctgaagtcttcatttctcttttactctgcctccttgttcttgtcctcttgtcccctgct

SEQ ID NO: 53590 - DNA, 1020 bp, Homo sapiens
tctcccactgggaactgcagtctgagggtggccaatctgcagccccatcccctgcctcctgggcctgcagtccgaaccttcgatgcttcacttttgacagaggggatatcagtcgcttccctcctgccaggtaggatctggagccatgactggagcggtcctgagtgtctgctggaagtagacatgttgagacccagcttctaccctctgtaataaggaccataatattgctaatatttatggcatgtttatacagactaggcatttttttgaggtgctgtacatatgttatctctttttgttctgtcagcagccttatgaagtaggtaatattattgctgttttacatttggagaaactgaggtacagagaagttaagattcttacttgctttaggtccctcagatggtaagtggtgtgactaatatttagacccagaacctgcactttgaacccactctgctctgtgcctctggtagaaaacagccaccttttacatgagcactcactgggccctctcaagttgaaatgtgttattcacagcagtcttctcattttgccctcacagccacccatcaaagtgaataggaaaagtaacttcatggtagcaaagaggtagtgggactttcctaggaaatagggctggtctaggggcacaaacttggtattagactgggaaaaagaaaggagaagttcagtttcttgattcaatcctcatgtatatgaagttgaatgagaaaagactgcagaatcaaatgctgaattatgctttaacaattaaggagagctcaatgttagttgtagggtatgggaattgatttttgaaagactgatttatttattaaaaaatattggccgggtgtggtggctcacgcctttaatcctagcactttgtgaggctgaggcgggcggattgcctgagctcaggagtttgagaccagcctgggcaacatgatgaaaccctgtctctactaaaatacaaaaaaattagctgggtgtggtggcgtgcgcctgtagtcc

SEQ ID NO: 53591 - DNA, 1049 bp, Homo sapiens
gaaaggaaagggaggaaaggggagagggaaaggagagaagaaaggcgaaagtaatggggaaaggaaaaggggaaaggggaaagaaaggggagaaaggggagagaggacaggaaaggagaaaggaaaggagtcttacttggtctgctttattcattgacttaaataactttgatactttctggcccatttaggtgtttgccattgtacccccactcagaatgactgatgctgtgccatgcacataataaatgttcctgatgctggggtttgcattggctgggactacctgagaattggtctgactccatcagcgccattgctggtggaatgtttcattgggtcatggcctctgaagtatctttatttccataggcaatcttgctgccaatgatctctccccgtcccgaatagccagactacagaagatccttcacagctatgtgcctgaagagatcagggatggaaatcaagttcgagttacctcatgggatggcaggaaatggggagaactggagggggacacctatgaccgggtgagtgattcttgatttaggacatgcatccagcttaatgcggcctccccatcctggttctagggcctgaggggttaggatccagcccctatgtttgagcatgtagagctgtttctggactggccagttctacattggtgatttgaccaaaagaaaaatcagcttagatgactggttattatctctattaaagatagttggcagcaaaaaagaatttgaaactatttgagtaggggaaaaatttactaggcttactttatttctcaagtcacttggttgctcagaaagcctcatgaaggtaagtaagaataagctcatttatttatttttgaatgttagtacagcacatggtacaaaattcagaaggcacaaaagagtatccaatgaaaagtgagtttttctcatctggcctgtagccccctacttccccaccctatagataacgattgtttcttttttttttttgagacggagtttcgcttttgttgcccaggctggagtgcaatggcgcgatct

SEQ ID NO: 53592 - DNA, 1038 bp, Homo sapiens
gggtttcaccatgttggtcagactggtctcgaacacctgacctcaagtgatccattagcctcagcctcccaaagtgctgggattataggcgtgagccactgcgcccggcctattcatttttcttgatatgagagcagtggaacatgatggagagagcatgacctctcctgtcagcctaaccagtttctacattacaggggtgctacttactaaccttaggcaaactgttgatcttgctgaacttcaacctcttcgtttgtgaaacagggtaatcctaccacttaggattattgtgaggattcagtgagagtatccagggaaagcacttagtatagtacctggcggtgaagattaggcaagcaggacccattatcattattcagcctatgcttaaacacatccgttgatgggtgcacactgagattctgttgttgaacacttacaatgttaggaagttctgcctcttactgcaatctgtagatagcatggtatatgggttagggcaaggattctggagtcagactgcttggattagtcctggttccattacttatcagccagagaagtttcggtgagttacttaactttcagttaagcttcagcttcttcatctgtaaaatgaggataatagtatagtgcctatcccgtaggtgaaaattaaataagaatgcatttggcacaatgtctggaatatagaaaacattcagtagtagtataatcatcacaatccttaccattattattattatttccattcattgatcctagctacttattttagaacaatatagaatgagtgacctgctatttcacttgacagctttaatgtttgaagatgtctttgttaacttgtttgttgaaaaactagttgtggccgggcacggtggctaacgactgtaatcccagcactttgggaggccaaggtgggtggatcacctgaggtcaggagtttgagaccagcctggccaacgtggtgaaaccccgtctctactaaaaatacaaaattagccgggtgtggtggcaggcacctgtaatccc

SEQ ID NO: 53593 - DNA, 2062 bp, Homo sapiens
ccggctctactaaaaatacaaaaaattagccgggcatggtggcaggcgcctgtagtcccagctactcgggaggctgaggcaggagaatggcgtaaacccgggaggcggagcttgcagtgagccgagattgcgccactgcactccagcctgggcgacagagcaagactccatctcaaaaaaaaaaaaaaaaaaaaaatatatatatatatatatatatatatatgtaaattagtctggagtggtggtttgcatctatggccccagctactcaggaggctgaggtgggaggattgcttgatcccagggagtttgaggctgcaatgacctatgatcacatcactgtactccagtctgggcaacagagcaagatttgtctctaaaaattaaaaaaaaaaaaaattatagttacttgtgtgttagttttgggtttttgaccagccatgaatattcccaaatatactattttccactcattatttcacaattgtctaccaagttaaaatgaagaactttgtcaggtactctgcaaaggagggatgggcagagggaatatttcacaaacttaggccaggggcctaaaacatctctggcctaaggaagagaagcctataaggatctttaatactttaccctttaacactctgggtaggtgctggtggatgtgccctgtaccacagaccgccactcccttcatgaggaggagaacaacatctttaagcggtcaaggaagaaggagcgacagatattgcctgtgctgcaagtgcagcttcttgcgtgagtgacagatttttaaactcaggactttgtgccagagtgctctgggagactgggggactggaagctcttaccaagaccataacccacacaagaatcttatggctggagatctgcctagaggagacagaaatgggatcatctctggaacataaaaaccctatttgaattagctgggtgtggagatgcacacctgtagtcccagctactcagggggctgagggaggagaatcacttgaacctaggaggtggaggctgcagtgagctgagatcgtgccactgcactccagcctgggtaacagagcaagactctgtctcaaaaaacaaaaacaaaaacaaaaaagcaaccctatctagtaggatatatatactagagtgggctgcacagattgactcatgctatttcatcctcagtaccagtgagtagcacatgtttgaaaaatagctgctagagtaaggactcattctatagccagcatagcaatttggtccataaacaagagctcagggggtcattgtaaggagacttcctagtgaagagctcatggagtaaggttgggttgctatctgccttgagagtgacttttcagacagtgtcattgtggaagggacttgagaggcagtctaaccagctacccatcctgtagtagccttcccttatccatgtttccagctccttatgttgctcttctactgctgggaagctcactagtaactgcttctgtctctttctggtttcagggctggactccttgccaccaaaccaggaggccatgttgtctattctacctgctcactctcacacttacagaacgagtatgtggtgcaaggtgccattgagctcctggccaatcaatacagcatccaggtacaggtggaagatctgactcacttccgaagggttttcatggacacattttgtttcttctcatcctgtcaggttggggagctggtaataccaaacctcatggccaattttggccccatgtacttctgcaaaatgcgtaggctgacatagtatcacccaatccctgaagcaagaatacaaagggtatactctgttggatgcaccagaaactggaaactgggaccagtggcagagatgcactctcggtcctgtctccatcctgttcgtgtctttctgcagttttcggcaataagaagtagaagatttgctgtcctgctgtccaattgtggagcatcagcaggtttccaactcactcattaacccctaccccatctccaggcctgtactaaagtttgctgcccgcttaggggcttagaagga

SEQ ID NO: 53594 - DNA, 1034 bp, Homo sapiens
cattgtaattgagggccctggaagatctctgagactcaaaatcaggtgaagctaggaagatggagctttaaggagcatggctagtgctctgagtaggaccgtaaccgcctccgtgcgtggcatatggtccctgcatgctgttcactctgtatagtacttagtattcgctgaggctaagaggcctcaggtgcctgggcttctgcccttggactcctggatatccagcctagtgctaattgaatgctaagcagtggtaattcaaaatgagagggtcccctgcctctagagtcatcatctaattggggacaggcagacctagataagaaaagcagagaactactttggaaaacagtttatctgctgtaattgaacattcagctaccctataacccagttaatccaatactggggataaatcctagagaaactcatacatgtacaccaggagatgtgtacaagaatattcatagcaaccctattcacaaaagcaaaagcctagaaataacccagatgcccatgagcaagagagtggacaagtaaactggaatattcacataatagaacattatacaattgtcaaatgaactataatgatacctaaccatatggatgaatctgagcaataaaataattaagtgaaaaaagtttaatcccagaagagtaaatgtagcatgatgccctttctaaatgaaaggttttttcttttctatggagttattctttacatacaatatagttcataaattttaaatatattgtttaataaattttgataattgtatataatagtatagtcaccatcaagatgtagaaaatagaaaataggctaggcacagtggctcacgcctgtaatctcaacactttgggaggccaaggtgggaagatcacttgatcccaggaattctagatcagcttggacaatgtagtgagacctggtctttaccaaaaaaaaaaaaaaaaaaattagctgggtgcgctggcatgtgcctgtggtcccagctactcaggaggctgaggcaggaggatcacttgag

SEQ ID NO: 53595 - DNA, 1042 bp, Homo sapiens
gggccatgttgctggttacccctctccctgggtatactttaaaaggccagttctacatgatgtatatttcaccacaatttcttaaaaaggccagcctccttttatcttatgtctacttccccttcctcaggcctgggaagtgaacaaagggaccaactgtgtgacctcctatctggctgactgtgagactcagctgtctcaggccccaaggcagggcctgctctatggcgtccctgtgagcctcaaggagtgcttcacctacaaggtatgctctgcctcagcgccaggcctccatcgtcccctccatccctgccagcctgctctgcatcttgggtcattttgggcccttagaggaggtatcaggtccagaggccttccgaggggacactggtatacctgttttggcctgtgtgacagttgttggagtggacccttggctgcccacgggccctgactcactcccttctggtgcccatccctcctcccagggccaggactccacgctgggcttgagcctgaatgaaggggtgccggcggagtgcgacagcgtagtggtgcatgtgctgaagctgcagggtgccgtgcccttcgtgcacaccaatgttccacagtccatgttcaggttgggtcttggggtggggcggggcggggcaggggcaccggtcccagcatggcacgggctgacccattcttggctcctccagctatgactgcagtaaccccctctttggccagaccgtgaacccatggaagtcctccaaaagcccagggggctcctcagggggtgaaggggccctcatcgggtctggaggctcccccctgggcttaggcactgatatcggaggcagcatccgcttcccctcctccttctgcggcatctgcggcctcaagcccacagggaaccgcctcaggtaaggtgggtggagggcgcttctgggcccctcgctgtgtgaccttggcctagcttccaacctctctgggctccaggcggggattcggtctccggggttttgctgggaggaagcattacagtaccactggc

SEQ ID NO: 53596 - DNA, 1050 bp, Homo sapiens
tataattatgattcttttgagatttgtatgcttcacaagtaaattttcctaataaccctttttttttttttttttttttgagacagagtcttgctctgttgcccaggctggaatgcagtggcgtgatctcggctcactgcaagctctgcctcctgggttcatgccatcctcctgcctcagcctcccgagtagctgggactacaggcgcccgccaccacgcctggctaattttttgtatttttagtagagacggggtttcaccatgttagccaggatggtctcgatctcctgaccttgtgaaccacccgcctcggcctcccaaagtgctgggattacaggcgtgagccaccacgcctggcccctaataacccttttaagacatgccctttaagggcatatttaatatgcctgtgttgtatcttattctaaacaacattatcaggaatgtttctttcttagcttctaacacactggactaccttgttttcaaagtcattaattctaattgacaataacaaagaaaatatcctctcttgagaacacttaccatctttcagtcaaattagttttgcagggtgtgtggaggcgggaggtggttgtttcttggtgagcctgaaataatgaagagtggagcaaaaagaacgtgttttattcctatcagccgctttctacacaagggtgagagaaaggaatattggattctggtcctagggctgccattgatgtgctcaaacagatccctgtcccgttcttggccttgcccttgccatctataaatgggaggggtgggaaggttggatttgttctaagagctttgtagctttgacggtctcttaattgttacacttcctgctctgagctagcaggggagcacgacaggattcactttaagaaatcttgctgtgtggaactggatctccttccagagccacattcttggtgcatttaagtacctgtacatgaaatatctgtttataggaagctgaagcagggggagattcctggaacttcttggccaagggtctttgcctactggaggaggaactggaa

SEQ ID NO: 53597 - DNA, 1033 bp, Homo sapiens
ctttgctctgctgctggcagggctgccttagacatgcaaagcaggtgagaagggaataggtcactttgggagatttggtaactaacacttgctcctctgaacattcagacagtcgcactgaaggaatttttttttttaaatcggccacacaagaagaaatgaggtagagcagttaagccccctgagatgctcttaaacaaggcactaattatttctgcattgctgttccaagcattgccgtttgcagagctctctgctctgctctgcattaggccttcttcttggtggtcactgtggtactgaggggtaggctggctgggattcatttagcccttcttatccctgccagacttctaaagcctcctcttcaaaagaacccgcagaatcaactgtgcttttggtttgtgtcgctggttacttctgcctcctgcagctcgttgattttttaatgtaccataattgggaattaatctgcgaactacagcatttggaaaaaattaattgtgtgtggaatgtttgataattatctgcatatgttaaccatttttttgctctttgtcatgtcaggcattgctcatcgtgatctgaaaccagaaaatatattgtgtgaatctccagaaaaggtactttgggcctgatttggaatgttatagtttatacttaccgaggaagccacccttgctttcaggatggattgttagcagttccgttggcctcagacaccaacttgaactgatcgtcttggacatgtgagaatgttacacttactgtgtgatgtttctgcccatcctcgtcctttcttcgctcttgatcatcagtgtgattgatgtaagcctgagagtttggaaaatatatgagacctgcacaaaattaatattttctagtccaatgcatctatctttatatcagttgatggaagtcgtaaatactttttttttttttttgagacggggtctcactttgccacccaagctggaatgcagtggcatgatcacagctcactgcagcctcgacttcccaggctcaagtggtt

SEQ ID NO: 53598 - DNA, 1067 bp, Homo sapiens
ctccccatcccccctaaaaaacagtagacatgtgccatttttaggacagagagataataccttcagcccagaaatgctggcttctagtagtaaacataaaccacatgaagccaagccacatgttcctgcctgtgtctgcccctgcaccacccaataacacatgactgactgttaattacatgtttgaaatgctacatgcagatgggatcctctgtcgccatatcagtaaacttaatgtagcttattgaggccagacccagtgtggttggctcaagagagtccatccctgcagcagtcagaccacaagtcctgctgggggatgtctgcacagactcggaggcctgactgacgccctgggcctaagtcctggcctcaccccttactggtgcgtaatcttgggcaagttgctcaaccatttttctttttggcttcaggatctccctctgtaaaacgagaataagtgtactacccattttgtccaattgtggtgagaataagacagtttatttcaagagtattccatagcacatggcactagtaactactcagtaaatgttagccattgccaacaaaacaataatgaatgggaaagctcaggcggaaaacccatttttccccccttttcccaggcctttacatgtctggcaagggtgtggcatttccatttgaaagtttgtgctcttgtttggatcagagatcagatgcaggggagaaaacgttgctgcagaaaggccccctcagctccaagtgccttcagttttattccttttgattgcagaagccaaatcagcctcagcatcattagtgttttttggccctatttatagttgttctctctcgcttctgagctcctcatagacaggtacagaagagagtagtccagttttgtttaacagacatacaagctggtacctcctccgtaccaggccccacacttggagctggacaggtagtgatgagtcagcgatgaatccctatgtccccaccccaagttttccaaacttgggaaaacttggcctctaagaagttatacggccaggcgcagtggctcacgcctgtaatcccaa

SEQ ID NO: 53599 - DNA, 1030 bp, Homo sapiens
aggacctttgtctcaaacagctccccagctagtttgacttcttgccagaagtaatacccctccccgaaatatgtgccatccctttgcttttacccaggtgtcacctggttcccaccctcccttccccaatcctgtcccagggttaccagagatgtgagaaaggacagtgctccagcgtcagaggtcaagcccaggctttggccataagcaagcctcagggtagggctaaaggctagagtcagggctcacacttgccagagcccaggtcagaggtcagccaggaaccagaatgcaattcttagcttatactcagccttagtgctcagtctaggggcaggggcagtgtgcttagtgggtggctaaattctagttttggtaggtacatgggtctgcatttcccagtagctcacacactcacagttgagatgagatgactcaggtcttagaaacctagctatagcagagtgacccaggacctggatgggctaaatccatggtgatacaggggtcacccagtaagccagtggtagagctgggactagaacccaggactcctgcctctgagcctagggccctgatcactgtctcccaaaatttgttctgaatctgggatccttaaattctaggaggcaaagtaaatttgcctgagctctagatgggccctcctgggtgcatctgactatactcttctacctcccagtgccaggcacatagtagttgctagaggaatgtctactgagtgtcaggtgcaacgggaggagccagtggcttgttcagatttggggctggaggaggctggcttgaggggaaggatctccagctgttgtcagaggaagcgacgccctcattggcctgccgccctccccctcctccagtgcttgcagccacactcagaagccgcccagctggcagcgggagggccctttcctctttcagggtgaaaaaaaaggaaaggacatttttggtagaaaagttccctgctgctccctgggaatccccggtggccggatggactacgggatatcccaga

SEQ ID NO: 53600 - DNA, 1043 bp, Homo sapiens
tgttactgaacacacttggagaaaggatgctgtgctgtggaggaaggaggagggtgcatccagactggggcaatctgagggctttctatagaagagctttgaactaagtgggggttgctccaggcggcagccccagaggctgacatggaggcaccccagcagcagagaaggggctaggttggacagaatttcctgggcagccttcatagtgggttccatggaaagctgagcctggaacactggtgaaaccacccctcccccacaactatcacctccactcgtggggcaccccaggctgggaactaacccaagtggttggaggggacaatgcctactggggccatgttgagggtgaggtctgagggctgtgaaattgtcttcaggcacttatacacactaggcttccacccagcctccagaggtctccttcccaagatggaagagatgagaggaatgcctctaccttaaggggagatggctgggaaggaggaggagcttggagcagagaacactggagcctgaggttcttagaggcaagacggccctccccgtctctggagggactgaaaccctctgaagtccatgtcacccgggactggtaacttctgcttgcaccactccctcttgagagaacagcacagccatcccggctgcatggttggacagctctgatgtgccaagcgccccttcatattgtcctgggtgtctgcccactgctctccaggaccctggaacaagctcagtccctcttccacacaaacacctgctgggtgtttgaaggcagtacccctgaaacagactgaccacagccttctactgtttacaagtgctatcacatttgattctctcagctcttctgtggggcagatgttgttgttgttgtctttactttagagaaggtgaaataggctcagagaacaagtgccttgtccatggtcacacagaattttagtgcatgtccttgtcaaccttgtcttcccctgccatcttcccttgaaccttgtcttcttcaagtgaaaggaagtttaacctcaattcctctg

SEQ ID NO: 53601 - DNA, 1070 bp, Homo sapiens
acttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccaggcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatcagtgcagtataaataaaattcttttgtaaggagaagattaatcctggtttgcatgatttttttaaaaacaactctaaacatgatacgaaaaagtggatgaaagcaaatgttcccagattggatgtggggaaaatatagcaataattttttttttaagtctggcttacaatgtttgttatacaaaataatgaaatctgagttatgtactgtccattgtgtcagggctatgggctgattttatcaaaactcatcttgggactgaaaaattgtttggaatgccagaaataagaaagttgttctccagagctggaaacccatctttcgtttgtagtgtcactgttgtggctccaagctcagtgataggaaaggacggtggttacacaccagccttctgaacccaaggcccccagtattgttgtcagctgcctttaccatggcatttctttctctttctttttttcctgagatgaagtcttgctctgtcttgcccaggctggagtacagtagcgtgatctcagctcgctgcaacctctacctccctggttcaagtgattctgctgcgtcagcctcctgaggagctaggattacaggcgcatgccaccatacctggcttatttttgtattgttgtagagacagggtttcactttgttggc

SEQ ID NO: 53602 - DNA, 1289 bp, Homo sapiens
agttataaatggctgcataacaaattatacaaaatctagtggcttaaaacaacaaacatttattacctcgcagtttctgtagtagcagcttagctgagtggttctggctcagggtctcacaaggttgctgtcaagatgttatctaggggtatagtcatccgaaggttgattgggcttgagcgtctgcatccagccccactcacatggctcttggcagaggcctcatgtctttgtcgtgtttctccatagggctgcatgaatgtcctcactacatggcaactgacttttcccagagcaagaaaattagcaagagaaaagttacaacctttatggcttgatagcagaactcattctccatcatttttcattttttcatagtctttttttttttttaaggggctcactacattacccagacaggctcaagcaatcctcctacctcagcctcctgagtagctgggactacaggctcacaccaatgcccccaaccattttgtcatagtctacttgttagaaggaagtcactgagtatagccattacccaaggaaagggaaattaggctccatcaaagggaggaatatcttaaaatttgtgggcaaattttaaaaccatcacagctggctctgggagtacttttctgaccaaggtagtatcataacaggttttattcaagtgtatatctggttagtcaagaacttagttctcactcacaaactggttcttagagctgggtaactgttgctgtcttattccccccttgaaatatatttaacagttattagggaactggatgaagaggaataatgtgaacatgtacattaatttattcagtaaacattcaccagatgtcactctgcagagatataaaacaaaccacggtctatgtctttgaggaatttgtactagggaaaatagacaaaaaaagaaaaggaaaaatacaatacagtgtgataaatactatgacagtggtaagcacaggatgatttggtacacagagaaggggcacctaaccaagactagggacttcaagaagttaaggaaactttctggaagtggtgactcctgggcgagggcccccacccaccacacaattcagacaagagctttgtggccctgtgcaagaaaggacctcattattctttttaccttacagaatgttgctgaggcacagtgcatcgccaaccaagttcagctcttctacgctactgatcggaaagagacctacgggttagtggagacctttaacctcagaccaaatgagttcaaatatatgtctgtcatcgctgaa

SEQ ID NO: 53603 - DNA, 1001 bp, Homo sapiens
ggaactgtgctaagacttggagatctgtgagacaaggtccctgccttcatggagctaatattcagctttaggagaaagatccagaaacataattacaataaaagtgattagtataatattagaatgatgaccaaaatgatcagtgtaacattagaagtatgttcaagaaaaatgagatgctgaactattacaagtaccctagtgatagttggatatttataattaaaaagactcgctgaaattttagagataaagtctaggaatcttcttttgaatgtagttgtttccacctgtgctatgtaggggctttagctttgaacccatcctctctacctagtctagacttgagatttagtaaccactgccctgatcattcttcataaaatcatggtgtttccatccttcttctccccttcaccccccaccaacccagattatattttagagctgcacattacaaatctggctcatgtgcaaactctgcagctcctgctacagcttaaaagagctcagtcttcagagccagccaaggggagtagatttcaactgtgaaatgcactagtccatgaaagtggcaattacacaggcacattgctttctttagaacttgatttggtagctgcttgtgccattttgtttttaaatgtatggtcacaatgatggattcactgcctactgtaaacattttctgggaaaaaagccaaaccttttccagttgaagacacaaataacactgtgcaaactgtcagtttcactgtgcctttgcaggcctgaccttaccaccacataccagtcctccaactcactagccacccaaggggctgttaagagccagaatttcctctagactgtctattgctttgaaattgcagtttgttgtgatggtaccttattgagccttgataagtgttccaccttgcagacccgaggggaagctgcagccagccagctgattttatatcactatcctgaacttaaggaagaaaagggcatagtgctga

SEQ ID NO: 53604 - DNA, 1035 bp, Homo sapiens
gatcaagactgcggtgagctgtgatcatgcctgcactgcagcctggacaacagagcgagaacctgtctcaaaaaaataaaaaaatattttaaaaaccaaatatggaggaaatggaatgaatgttacaggtggttggatatagagcaaataatttcatttattcatctgtctccttgtatatctgtttttcacagtttctatgtgctctgccaagaagggaaggttatgagttttttgtaggacaatggacaggtactgaactccacttcactgcacttataaatattcaggtaggtggcttgtgcccttcctctagaggaaagaggactaccccttggtaggactagaaacccttgctgaggctcaaggacacagaatagctgcttactcccagcatttattattgtggcgcagatgaattgtcatactttttgtgttggactagttttctaggccctcctcaatacctagaaattggaaaagactccaaaacaccttctctgactacttctggttctcttttgtctcttccccagacctctagttgtatatactgcatgtgcctcacttaacaaacatgcctgagttatgatggctatctttttaacccaagctagaagccccttgaggaaagctccaagtcttaaatgtgttttattacctaagtcaacaccttccaacatgctaagtgaatagtttctgtttaatgttattttgtttgctttcttcctttatttctttatttccaataaaacaatattaacttttaaatattatatttaaaagttagattcaaaacatttaaaacttttaaaataaaagtcaatattttaaatcataactaggattggcattctatatttggaggtcaaatgtggcaaaaaacaagcacgaattatattggctttgaagttggggtaaagaatgcaaaatagaatgaaggaacagctttttactttgctattttgtaatatgtctaacaaccctttattgagtacatactttaataaccaacaatttgatgtacttactatg

SEQ ID NO: 53605 - DNA, 1047 bp, Homo sapiens
gaagtagcatatcctaggcatcttaagagagatataaaatatgaaagcaagggggaggaaataaataaaatagaaaagcagctcataggaaaacttctgactgtaatatcaagggaaactgcatggaagaagaagcatataggctcagcttcagagtacaggaagaatttgggaggtcagaggtaggagagagaggctttctagtcagagccaataacatgtaaaaaggcatgggaaggcaaaaaaaaggtagtaaaaaataagaacacagagcatccatatgatattaatggtaaataatgaaaagacacaatattgcatatatgctacatctatgtatactataaaagacatgctagaaagaaataaagtaacagtggtctttgttagggtggtaggactatgggcattttttccttttccctgttttctaattttcaaattttattatataatttttttattccccaccttttggtatttgcatcatgaaggtcaactgtagcttccttgttcgttagtgtcaagcagaggtaggacttctgattggtatataccatagtcagatccaacagaccttatctcttccacatgtagaagactttctggaagcaggattttaagagctgcctataacatgccaataatatctaatatggttttgctgtgtccccacccaaatctcatcttgaattgtagttcccataatccccacacatcatgggagggacacaatgggaggtaattgaatcataggggcagttacctccatgctgttcccatgataatgagttctcacgagatctgatggttttatagggggcttttcccccttttgctcattcttcttcctgtcaccatgtgaagaaggatgtgtttgcttccccttccaccatgattgtaagattcttaacgccttcccagccctgtggaactgtgagtcacttaaacctctttccattataaattacccagtctctggattaagaaaatatggcacatttacaccatggaatactatgcagccataaaaaagcatgagttcat

SEQ ID NO: 53606 - DNA, 1686 bp, Homo sapiens
tttatgagctagctcctatcacataactcattaggcctctgcattccttttcaccccttcaacataagaataaattcaggaaaatctaaagggaagacgctggacagagagaagatgagaccattcattctcctgcgattatctgtcactgcttctactttggcagtgtctcactgtgttgcccaggctggtctcaaattcctggcctcaagcaatcctcctgcctcagcctcccagagtgttgggattataggcataagccactgcacccagccttttttttttttttttttttaatatatttttaagggatcaaaaattagtcttcctgatttagtgaaatcctaaactttaccatttggaaacaaaatttgcggagtagcttttcttttagtgttttaaattcagttgagactacttttaactaaatttagctgtatgtttagacgtatacattttttgtaattcatttttgacagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggtatccctcaaaggcccaggcgctgccagggggtttgtcctggtagctggaggaaccgatttcagggagtagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccatacccc

SEQ ID NO: 53607 - DNA, 1074 bp, Homo sapiens
tcctttaagagattgagaaatagactaggaggatctcagttccctaatgtaatcttggtgctgctggcctagtgcatgctcaagctgggttctctcagaacctagcacaagactggttagcctgtacattccctggcaatacttactgattaatctgtggatgcattctgggggaggctagaatgttctaggacaatctcagatagttaagtagacctaataattccttgttgcctacactaaacttctttcctcttaacagaatcagcacttcttgaaggagactcctggaagcaaccagatcattccgtcaccttcagccacatcagaacttgacaataaaacccacagtgagaatttgaaacaggtgctttttatctctggcttaactccctgtgaccacagtgcactgcagaggcagccaaatagtttgggcttagtgtttggtgtctcagcaggtgcatcctgtatttatttgcctgcctgggagctgagcagagaggaatgtgtgttggtatctcggggatccatattgctgtcctttcccttctttggcactttgcagtttttccctgcatgtcagtcagtggagtaaattccttttcttatcttgaaagacatagaatgagcagattatcctgaaactctttatgaaaaaatagctatctgggcaggttaaagatgaatggatagctaagtaatccagagtgatggctattttgagccacagtaaattctaagaatgttagaaagcatatccttgaaaatcaggattttctaaagtctaaagacgaaaaggcaagagggggaaaaaagactttgagttcagaatcacattaaagagaatagaggaaatcttcactcagaagaattcctgtcctgagtttaatgccctttaaaacctatagttatcattctttttaaagtagcaatcagtactggaggatgtcagtaaaaataattgaatcttatactaaacaatgcactacttgttatggtattgttacatgagccaattcagtaatcggtattgttcctgaggtaggtttgttctgacaaattaggttaatggac

SEQ ID NO: 53608 - DNA, 1033 bp, Homo sapiens
tgacagaatcaaacccctgcagtgcctaggaattgttttcaaatatctctggatcacttagtgctgctgcagatgtaagctgtctgcagtcatttggaggccttaatcaatcacttaatgggtgacagccccgtgaaggatttatgaagagtaaaaaaaggatggtgcagcccttgccatcttgctggggagatgagttatatgtaactcatctgaaatcaggactattcaaggcacacaaaagttccctagtctctctgccaatttctggatctgccctcccacccccacctgctctttgcaagcttcagaatttcaagtttaaattgggaagtttgtaccaaggagacctgggctatattagagagctctagaagagagtttttttccattttcttcaggactggcacacctcactgttacttagtggggctaacccagaggaaaaaacattgatctgggtgtcaagacccttggttctggttctaactgccgctgagtaactgtgtgacccatagtaacaaagacccctctaattcagcaattcttttattattttaatatcttgattatgctctcaagtaattcactattttctaaaataatttttcctaactaaaaaatttcctgccttctagaaccatggattcccccctccttctctcctccttttctctttattgttgccttttggttttcttataaaaacagggttgatttcagatttcaaggaaaacaacttattttcaccagttgcattctgttataattaaatctacttcttttaaatttccatagctgccaatggtaatcctcctactgtcattctttgtgctagataagtcatagttatgggctctgaagggttaagccatgcaaagttttcctcactaaaggaaaagtgtatataaacatgttatacttcagtctctggaaagaaacttgagcagtgggaagggaatgggaaaggaaagataaccctcaaacataagtcttacttagcataatgctataagggaaaaactaataatgc

SEQ ID NO: 53609 - DNA, 1032 bp, Homo sapiens
ggaatgctgctcggcagcctgccaagtagcctcaacatggatgaatcccaattctgctgagtagaagcagccacactttaaaaagcactacttgctcactggttctacttatataaaatctagaaaatgaagactgatttattgtgacagaaagtggatcagtggttgcctgggaacgatcggcaagggagtgattacagagagtcatgaggaaactttcagaggtgatgagtgtttattatcttgattgtagtactggtttcacaattgtttatgtgtcaaaacattcaaattatacatttttgaatatgtacagtttattgcatgtcagttgtctcttaaagcttttttacaccttcctatatgtttccattcagagtgtagcttccattggcaatactttaaacagcgtccatcttgctgtggaagcactacagaaaactgtggatgaacacaagaaaacgatggaattactgcagagtgatatggtaaggagacccagcaagtcagcatgctcctgctcacccttttttgtgtaagagtcatgttgccaactttccactaatctgaaaaggccctgctatgcatctgttcaaaagatctaataagcagtatacattgattgttctacaatttgttaataaagcaattatggtagataaaattaaaagccaaatcttttgcaaacatagtactggaggaggtaaggtaataagacacagttcctgaggatggaatgggtaggacagaaaatggaaaagaaggaaaggaagtggaaaagtgtctcattgtttattactacataacaaagcacccccagaagtttgtggcttaaaacaagtaattatttctcactattctgtgcatcaggaatttgagcaaggctcttagactcccaaatgctgaaacatgtgctcgtggatgaaaggcaggctgtctagcatgttccagctccagccaggctgtcagttaaatgcagcctacaacacatggaacagcaccacccccatccctcaacccccagctgagccc

SEQ ID NO: 53610 - DNA, 1032 bp, Homo sapiens
gtgctctggtagagctattgagtttgaaatattagtcacatttttaaaccaaaaccaaatccccaagtagttgaaagtgctgttcaaattgtcagagtgcagttcctgtagactgtattttgtgagatgggcttttactttatatgttcccacttgggcaggaacaaaagtttggtaaattactgaggtattacattttaccaaaatgaaattttgaagtgatccttcatcattagctttcttcctgtccaattgttgagggagtgtgtgataattacagcatcttttgagtaatttaagattttgggatcttgtgctgccaggacagggtaaagaataacacttgccttcactctttgacactagtgttcaaattgggcagggaaagaaggggtattattgttgcctcccagatcccaactctatccaaagtactgtctcctttacttctgtgagctgacagggttgcagaaacacataaaatcctagactatcttgacatcaccaaccgtagagtttgtgaaggtaacgtgtcctctacaaattctcatttgttttcattgtttgttactcttttttgttcagatttctctgttgacttctgcagtgaaccacctcaaagccaatgttaagtcagctgcagacttgattagcctgcctaccactgtagagggacttcagaaggtaggtgccatgtgtgggtacagagacttcagaaggtaggtgccatgtgtgggtactatttgccataattctagcttcttataagttttcattgaaagcctagcatttgaaatcagctgctccaagagggcagtaatggagtgtatcactgtgtcctaaagaattcagaacaattttgttttggtctggttagttaggcctttaatttgcaacaggttacctcagctgtgatttatatgggttcatacctttttatttggctctctgagtcccagaattgctctgctggcactcttgtgttagcatatatgggttcgcttttcagcttgctttttcagttcaccactc

SEQ ID NO: 53611 - DNA, 1051 bp, Homo sapiens
tagtgatatacatttaaattgtttctagtattttgctgttacaaataaggaaaaattattttaaaaaatatatcatgtacatgagctattttataagatttctagacatgaaattgctaaaataaagaatataaacatttcaaattttgatggatattcctagataaacttcttacaagtcttctctaatttatactcccataagcagagcatgaaaatgcctgtttctatatgtccttttcaaacctggatatcattcatatctttttaaaggcatgagtgaaaacctccttaatgtaattgcttctcttaggaagtttatggtttgctgagagtatctctgtggactgaggtttctcacccatcttgtttttaaatgaacagagttacaatgttgatgattagtctggttattctggagtccttatgtagaattgcatgttttagtgcttattaatttcactattaaagaactgtcacttatttgatatttcatctgtaccaggtactatgctaagagctttgattatatgtctcatttaattctcatagcctgtattgatcatctgttccttggttacaaattaccccaaaacttagtggcctaaaacaacagtcatttagtatcttacggtttctatatgtcaggaatttgggagcagcttagcagactggttctggccaagatctctaaggttgcaattaagatgtcatccgggtctttataacctggaggtctgactggggctggaggttcctcactcacatggcttttggtaggaggcctcagttcctcccaacatggacttgtcattctggggctactcgagtgtcctcacagcatggcagctcccttccccagagtgactaatccaaggagagcaaagaagaaggcataggaccttttgtgacctaatttctaaagttgccagttgtcacttccactttattctcttctgtagaagcaagttacttatgtcaggctacactctagggaaggggaagtaggtttcacctcttgaagggaagaagactatcaaagaatttgtag

SEQ ID NO: 53612 - DNA, 1021 bp, Homo sapiens
atcttaattgactaatctaaaagctccttaattgagctggtcagtacttagcatttatcatctatgaccagctgtcttaagtgctttgcagccattctctcacttaatattaacagtcctgtgaaagtatattttatcgctgtattacagatgaggaaactgagctctaagaatttgagtaatttgctcaagatcatagtgagtcacaaaattgagattcaaagccaactctttctgctcacattctgttatgatttttagttggctaacttttaaaagttgcattgccagcagtgaaatagccccagttaaaatgggagctttagtgtgaaagatatatatttacataaataaaagaacaatgtcagaattaacttttattaatccatcttctttcctactgtttgatgattttttcatcttaggaccatgagggcactttatgctagttatgattgttcttattttgtctttttagtggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcaggtactaaaagtttgatttttgctgtgtaagctatgaatatttgtttggttgtttagtatgaataggatatagagaattgtaggtatagggaattcatttcagtttgttttactttttgaaatggggttttgcatactgtaatcccagcatgttaaagtcaggtaaaatagttatgcatttaccagatatttaaaatgttaatcctttctgcaaaagaaaataattctactaaatacagcagttgagagaaagttggaagtttcttgaatcaccctttcctacatagtagaataggtgtcagataaaaaaggagtgtcatctaacccccaagaaaagtagataacccatttttattagctaatgagagcttatttcatttgagtttacaaaatctgga

SEQ ID NO: 53613 - DNA, 1044 bp, Homo sapiens
gtttctatatttatcgaagtgatcaactagagggtgcccagtgacttgatttattgtgacattaacaatacaaggttaaacttgctatcatcaggtaaatagggtagtttattaaggctggctggtccagcttccctggtcaactaacactggcctgaaaaataaaataatttgtggttgtcagatactaaattaaatgatctgagtactactgcaacttattaaaggactttattcaatttctagaagaaagaaaacactggattaccaaaggcttttctggtctccccttctattctttaggtcttcccaaaagttatcttctgggaagatgccaatacatgatcacgactctggtgttgaagatgaagatttttctccaagaccaattcctagtcctcatccagtgagtcagaaggtatcactgattttaaaatgcattcacttttgtggttagagacctaagtctcttcatggttaaaacactaaataatactacctgaaacctaagtatcattcttagatatatctagctatttctatctctatggttatatctatatatagagatataagtatttcacagttatatataataattcatattatatgtaatgatatatacatatgtgtaatatctatgtaataagcatgtatggttattcctagagtaaactgagacatagattggttaagttacctacccaagacacacaactagtaagtagtaaagctgggattctatttcaggaggtttggttttagaatctggtacttttaataaccatatagactcaacattatatactatcactagagcttgacattggtttttatcactatattctgagaaaacattatacttgctttcagaggttaattgctaaaattcttgtcataatttttttattgctaccaacctgtgggtcattttagaattgtttaattcttattttagaagaaaaaggaatgggaaggattttttaaagctaatatcaaattataaccaaattcatcacagcgagtattttgtttactcttttt

SEQ ID NO: 53614 - DNA, 1081 bp, Homo sapiens
ttttctcttagattgtgtatcttttctttttttttttttttgagacggagtcttgctctgttgcccgggctggagtgctgtggcgcgatctcggctcactgcaagctccacctcccgggttcacgccattctcctgcctcagcctcccgagtagctgggactacaggtgcccgccaccatgcctggctgatgttttgtatttttagtagacagggtttcactgtggtagccaggatggtctcgatctcctggcctcgtgatccgcctgcctcggcctcccgaagtgctgggattacaggcgtgagccactgcgcccggcctgtgcatcttttcatattgcttgtgctagcaagctctctctctatatatataatgtaaaatacatagagaaacacatattgatgatatatagtaacggttttccccccagattgtcatttaagtttaacaatatttttcccaaacagacttactgttttttagtcatatttattaatctttttcatatcgtgtttagaaaagattcacccactccaggtgtatttactgaagtaaaaaaatcacttgtattttcttcagatgcttttggagttctacttttaacattttgttttaacttttcaagataattagttatatttagatagcagaaattaaatgttagttttagatcctttgctatgatttagtacaattatgttttattatcaattactgatcatgctttaagttcatattgacagtaaatcctcagtaaaattaattttgaattgctctcttattccttttttttttttttttttttggagacggagtcttgctctgtcgcccaggctggagtgcagtggcgcgatcttggctcattacaagctccgcctcccgggttcacgccattctcctgcctcagcctcctgaataaaataaaattttgttttgtagagaggaagggtctcactatgttgacaaggctggtctcaaactcctggcctcaagcgatcctcccaccttttgccttcctaagtggtggaccccagtttttgaacaaaaattgcaccttttagtcattttgttaactagattg

SEQ ID NO: 53615 - DNA, 1042 bp, Homo sapiens
gaagggaacccatgtaagggaatggcacatgcaaagtgaatgagaatgcatgaatgttctctggaccatgaaatctacttatagtttgctacagtcctaatataggcaatggattgttgatgcttaagtaaatattaagagccttctctctttctgactacctgtatatattacagcatttaatcctcagcaactctgtgaagtagttttaggctgcaaattagtctgtactaccttagcccattctttccagtccaagctaattcattctagtatactgctttcatctctgttaaccattttctttcccacatctcaggtaaaagaggacagagatacgcgtgcttgctctctttctctctctctctctcgatatatatctatatgtctgtctatatatatcaatatagttatatatatacaaatgtctatatattcttccttttaattatcagcacgtttttagatttcttattactaaggctttttaatgtatggctgataaaagccatacgtctactttgttatcttaggaagaatgtaaattatgctatatatgtaagtgactatggtttttaatttctatctttttcttttagttggctgtctggaattacacatatctatagtcctcaggtatgggcttgctgtttgcgatacatattcaattcttctgttcaagaaaggcaagtgatattttattctgtagtactttatttcgatcctttcccccattcatagtttatggtcccatttaaaattcatgtaatgccgtaaccttttacaatacttataaataaacacgtacattaagaaaaaacaaaccttatattaaatgagaataaaaccagattaaaaaaagatgaggttgcagtatacctggaaataccaaggaattcacttgcctaaccacagaacacaaaccttttgggggtggaaaaaaactgtggagattgtctactgtagcatcctatttaataattaaggaggttaactttcagtgaaatgactgcaaatgagtttggatttgttaccttacaga

SEQ ID NO: 53616 - DNA, 1917 bp, Homo sapiens
caagaatcaaactatgtttagtatgctgtattttagtaaaaccatatttgagaatgatttacaataatttggttgaattattgtgaacctaaaatccaactaaatgtgtttgtgagggcaaaaactctaggtaagcgatatgagtagcctttcagaagaagcagtgtaaccgagataagaaagttcaagatgtacttagggtagtgtttagagtatacatttttgctgaatttgtgggcagtcagactggagtattaatttggtcagattatagagaggcttggctgggcatggtggctcctgtctttaatcccaacacttcgggaagctgaggcaggtggattgcttgagcccgggaggttgagccgtgatcacaccactgcactccagccttggtgggagcaagaccctgtctcaagaaagaagagccttgtctgccagcctgatgaatttgaactttgtcatatgggccatgtagaaattgaaggttcttgaaaaaagaaaacactgtcaaatcagaaatagttaatctgatagggtaggctgaccgaagttagagtagccattgtagaagttgggcaggtgtgtattatagagggatgtattaacctatagtacaatggtagcagtgaaactaggaaggacacagtgggcatgggcaaatacagagggagaactaacttgacaatttgtggtaacaagaaaggaatcaaagaggaatggactttagattctctgaggctcaatcggaattattttatgaggccaggcacggtggcttacgcctgtaatcccagcactttgagaggctgaggtgggctgatcaggaggagttcaagaccagcctggccaacatggtgaaaccttgtctctactaaaaatataaaaaattagctgggtgtggtggcacacacctgtaatcccagctacttgggaggttgaggcaggagaatcgcttgaaccgggaggtggagtttgtggtgagctgagatcgcaccactgcactccagcctgggcaaaaagaacgagactccttctcaaaaaaaaaaaaattattttatgtccattttttcccatgtggtaaatatttattgggggtgactccccaataagactgaagtgctgctgggatatctacattgaaaatgtgtagtggagcttgggacagtaaatcttacttgctttgatataattattcacataatcttttggtcacatggaataaacgagaactgaaatgctgtaaatcagaactcatttaattttatttgtgcaagatattatatatgtatatgtatcagtataaaataaactttggcgatatgggcacatttcaaagttttaaaataattatttaatattgatttctcaggctctacagtgccatatatgtagcaaagattccttggactgtggtaagctgctttccctaagagttcatatcacttccagggagagtttggacagtgtggaatttgacttgcattgggcagcagtaactctagcaaataactttaaatgcacacctgtgaagcccatccccattattccaacagctctggcaagaaacttgagcagtaatctgaatatttctcaagttcaagggacttataaatatgggtaagtaaaagatacattaatctaaatgttagttgcattagtatattttcagaatgtccatgtaatgtgaaagaattgtccagtcaatttatatgccagagatatggtggcttggttaataaccagggaaagtaaaaaatgaaatggtttattttcgttgaatatgaaattttctttaagttgtgccaccacctacaaaaaattggtggtagggcctggcgcagtggctcacacctgtaatcccagtactttgggaggcctaggcgggcagatcacctgaggtcaggagttgcagat

SEQ ID NO: 53617 - DNA, 1125 bp, Homo sapiens
gaatactgggctgggcatggtggctcacacctgtaatcctagcactttgggaggccaaggtgggcggatcacgaggtcaagagattgagaccatcctggccaacatggtgaaaccccgtctctactaaaaatacaaaaattagctgggcatggtggtgcgcacctgcagtctcagctactcaggaggctgaggcaggagaatcgcttgaacccaggaggcggaggtgcagtgagctgagatcgcactgctgcactccagcctagcaacagaacaagactccatctcaaaaaaaaagaacactgatttttcactgacacaagtcagtttgtgggaatgcatgcagtactgttttttttccaatgaagattctttaatgacttcattataggccccaaataaatatctagcccaaatcatttttttctgctgcttcatggttttatgagggttgtaaggtttttggtcaaaatctcatacatttgatactacctgccttaccgagctcactaagttgatacaaaggttttggggcagaatccgagctttccttaagggatagatatattggtagattttgctgcctagaataaatattaacagtaatttattggcagaatgactctaacgtatgaaaatgattggcagaatctacaagcatttaatcttattaatctatagtcacacttcatataagtaatctaattttgcctgtaattttaatatgtggttaaatcatatttttcttctttgtttttatcattcattagtaatattctctttaattctttaggatactgaggatttggaattaaagaaatcattcaccagacatcatggagcctatatatccttttgcacggccccagatgaataccaggtatagaagtatatttacaaatatttgtcttacagcttttcacataacttgggaaggtaggttggaagagaaaaaagaatataatctttagaatcaggaaattctgggttcatatcctagctctaccacttgttaggtgggtgaccgtgatcaagttaattaactaagcctcagttcttcatctgtaaaatgaggatggtaatctctgtctcacagaagattattgtgtggggttgaataagattac

SEQ ID NO: 53618 - DNA, 1026 bp, Homo sapiens
accccatctctattcattataaaatataatttttaaaaacaaacaaaaatccttccagtaagagacaatagccaaaaaaaaagtgttttagaggcaaattttttttttgaaacggaatcttgctctgttgcccaggctgaagtgcagtggctggacctcagctcactgcaacctccacttcctaggttcaagcaattctccctgcctcagcctcccaagtagctgggattacaggtgcctgccaccacacctggctaatttttgtattttcagtagagacggggtttcaggatgttggccaggctggtcttgaactcctgacctcaggtgatccgcccacctcggcctcccaaagtgctgggattacaggtgtgagccaccgtgcctgactgaggcaaattcttaggattaaaaaaattaaagagtctattacaaagaaaaaaggaaagtacaaggtgagagctgaggcatgtgctaatctttagaacaactaaaatagcatgtcttcctttttgcttagtaataactcaaataccaatgagagttcaattaaacattttattaacactggactttttttttatggagtctcgctctgtctcccaggctggaatgcagtggcatgatctcggttcaagcaattctccctgcctcagcctcccaagtagctgggattataggcaaccgacaccactcccagctaatttttgaatttttagtagagacagggtttcaccattttggccaggctggtctcgaacttctgaccttgtgatccgcctgcttcggcctcccaaagtgctgggattacaggcgtgagccaccatgcctggcctaccactggacttctaagcaggatatacacttaacactatgcataaatactttttgactgaaatgaaaagtaattattgacttcattttaggataggaatgattcagcattatatttaggagagcttggaagtgactaaagagcttatttccccagatgttttctttttttttttgaattataatgcaata

SEQ ID NO: 53619 - DNA, 1053 bp, Homo sapiens
attgctattccctagctggctagacagacactggaatatctattttttttttttttttgagacgaagtgtcacgctgtcggccaggctggtgtgcagtggggcaatcttggctcgctgcagcctccatcttctggattcaagcgattctctgcctcagcctcccgagtagcttggactacaggtgcgcgccaccatgcccggctaatttttgtatttttagtagagacggggtttcactatgttggccaggctggtctcgaactcctgacctcgtgatccacccaccttggcctcccaaagtgctgggattacaggtgtgagccactgtgcccggcctggaatatctattgttagtgaagtcagcggtatgttgtttttttcctttgtgaatctctttattttgactcaatatttttttatacaggcaattataaactaaattccaaaataatgtaagttttggaggtttttttcctgtaggaaaaaaattacataaatccacggtaaattctccaattaatctggctgaagctaatgcagctcacagggcacctgaaattgttactttagtatgttgatttccaactcaggctgccagaagtacatatttgagtcctagctacagaatcttcagttgacaggaagagaagaaaaagagaaaaccaaaaacccttagggatatcttgctctctaaggcactgaaattagtgaagtgggtattgttagagggaagctggtattttttctctggaggtgaattctgctctgcaaattgctcctggagacctagagaaggtaaaggcaaatctgatacagtgtcttctgagagtgttctgtactgggaaggaaagattggagggaggttttgggattgattttgcacatttatttgtactgatgtttttcagttttgtttgcttttctccttccttccttccttccctccctccctccctctctccttccctccctccctctctccttccctccctccctctctccttccctccctccctccttcctgttctttctttttcttcttttcttttttt

SEQ ID NO: 53620 - DNA, 1056 bp, Homo sapiens
aagcagaggttgcagtgagcagagatggtgctccagcctaggcgacagagcaagaccctgtctgaacaacaacaacaaaaagccacgatttttagttcaatagtagcttgtaattgtagttatagtatttgtaagttgctatggttttgagtgttgcttttaagactgttgttagttacccactaagttttaattgcaaggaaatttcagagaatgtgaaaaagttttggttaagactggaaaatatctattcttgctttcctcaaaactggcttcagtgattacttaatgacagcagaatgctttgaaaatatgctctttaaagtctagctgttactaaaataccataataacttatatgtaagtgatagttgcttttttgttgttgctgcaactgtggtaagaggaaagcattattagcaaaatccttaagaaaaatatagtataaaaaactggtaaatagagaatttacaaaaatggaatgtgggtgagaacatgagacacatgtgtataggtttgacatctttatattcatttgaattctttgtttccttggactttgcaggtaaggttgttttttctttttgacaaactgtataataataataattatttttatttgagatggagtctcactctgtcacccaggctggagtgcagtggtgtgatcttggctcactgcaacttctgctgcctgagttcaagtgattctcctgcctcagcctcctgagtagctgggattacaggcacctgcaaccacacctggctaattttttgtatttttagtagagacagggtttcgccatgttggccaggctggtctcaaactcctgacctcaggtgatccacccgccttggcctcccaaagtgctgggattataggtgtgagccaccgcacccagcctttttttctttcttttaaaaaaaaagtttaatagagatgaggtctgtgttgcttaggctggtcttgaactcctgggctcaagccatccttctgcatcagcctcccaaagtgctaggattacaagcatgatctaccttgcccagcctgaccat

SEQ ID NO: 53621 - DNA, 1018 bp, Homo sapiens
tccataccaaacaagatagggatgggaaccggcactagtgccaaggacagccccataaacgtccttaatacagcaacctacctgctgtaatgaagatgcacagaggatttctttcgaagctgttgcctttttgaagttgggaattatattcttcttcttcagggcctacagtaggctccagtgaatatttgttgaatgaacgttaaagggacaatggaggaaaaaacacctaactttgctcaggagattctcaaaggctcctaggggtgaccatgtgagaaggcatttggcagatgagaggcctgcagcatcaggtctgtggatcctttggcccacctgtcagtgctcagtcacctgtggacacctgggcccccccagcagtaggaagctgaagaaatgctctttcactgcctggtcaccctgtagaacactgatgcccaggaagttgcagcatctccccaagcagcaggctccatgggcctggtaacagaaaggaggccagcaaggcttgagcacaatgactacctctgtcacctcttctgccaccagcctatcactgctgctactgttactgtacctgccacctccatgaccacgctggtcatggccattgctactaactggggcagtgttaggcattggccaccctcactgctattacatccatcacagccactgctgctattaccacctgaccccgatcctgttacccaagtctgttgtagttacttctaccatttccaaccacagctactgatattattattactagtactaatagttgtagctattattaacaacctacctgtgtagcatactctgcagtgtacaaagcagagtgacatccatgcttgctttgactgtcacagcaggtgggtgaggcaggcagggtaacctgtgccagatgagaaaaaggagactcagccagagatattcagcaacttcattccatccaggtagcaaaaagctcagtgaacaaagggagctaataatttactttggcttcctctagatgaga

SEQ ID NO: 53622 - DNA, 1011 bp, Homo sapiens
ggaggcctgaagtagcctggcattcttctgtttgtggccattgtgggcttggctgccctctgcaccttatctaaaggccaccagatgtctgctcagggtcttagtggagcccagctatcagaatgggcagcagaggctgtaagaagggctagatgagcagaggcaggagggagcaagggaggattcctggaggagatgtacctggggcctcaatgaaggagcacatttggacaggtaggaaggaaagcaggataggagctcaacaggagcaaagaaccaggggcaggatgggaacctgacatggagggggcctcagactgtaggtgccttggagtgtggcacatggcataatgcctggctcctttaggtgaggctgtagcttacttctcccaactgcagtgagtgccagggaggaagctttgggtcagaagaaggcttctgcaatagaagtcgctgctccctcttcagggcactgagggtgctgagcgatgcaggggtcagaactcccagctcctatgggatcaggcaatgcctttgactgctttatgcctcagtttgaccatctagaaaaaaaggacacgggagggaacctctggcattctgtgattatctcactttgtgacattgagcggggcacatcacttttgggacttgttccctagtatataaagtggggagaagcatgggccactgctgtcacctcactgagagtttcagaggactgtgcagatggtctctccagaccaagcctctggaccaaggtgaggggtcagaggacaccgggctactagggactgctcagcctgcttccctgcagccaggcccccatcttttcctctgctgccccaccctctctaccttgggtatgagatggcacagccaaccagctgtgccccacatctggagggacttcctcaggccgcagcagcctagcctggagcctgcccctctgcaaactcacccacatacctggcagcaggagtgtaggcgggcccacctgacaaaggaact

SEQ ID NO: 53623 - DNA, 1038 bp, Homo sapiens
agttagaaatcaccacccacccactcgcatgcatggaagggccaggggagtggtgcagtattgtaaaagtccaggcaaagtcagtgagctgaagactctcaccttcgtatagaactactaaatgatcctggcggaggcaggatttgaattaggctataaaggaaaagtaggatttaaatcgatgtaaagggccttgcttgcattccagataatgggaatgaggaaagtgaaagggccaacatggggtagggaaaagaaggttctggttagagtagaaggggtgaatattgagatagcaggctgaagtcgggactgggctggggtgcagtttggccatgaaggaggaaaaggagctgggggttattgcagaccaattctgtgaaagaccctgtatctaaaggattgtaatgatgttgtgagacagatatttttatccccattttaaagatgaggaaactgggtctcagaggggaggcatgacacattcaagtcatatagctgataattagaagaactggactgtctagctctttccactaaagcatttgcttcctttaagacatgaatgggaaggtagcacagatagcacaggccagatggtatggctagtaaacacacacacacacacacacacacacaccacacacacactggggggcacatacataccaaatatggcaattcctgtgctgtggctcccaatctaattagtgggatgattgccatttaggagacttttgcctttcactttagcccaagctgtgtgaggctccactcctctatttgggattcaataggagtatggaaagggaaaaaagaaatgtgatgcttgaaacaaaataccccgtcgagctgaccactaaatagcacttagaccccaagtatacacacagctgctttatgtaatgaaggctgtggaccatgttcctggatataaaataacaaaccacatataaagttttatgttgctgtgtaattagcacagatctgtgagtgagcatgcaggcccgggtgaggggaggggtgcttaggccccgg

SEQ ID NO: 53624 - DNA, 1085 bp, Homo sapiens
tctagggccataccttttggtgcaaccagaatcagaaaatggcctctgttagtaagcttatagaaacctaaaaataataatggaattatattgtaatttgactgcttggaatttgtgtaagtaccatatggcccaaggcactattatagtatcctcactttaaaaaaaaaaacacttggaaccacaatgtgagtaaaatattatagcagaacgctttgtggtagacactgaaaatgttgttgattgatggatagaattaacttctcctcccccaccccagcacacacctgtgaagccaatgatactataaagacataaagaaatcagctactttatatttaatagagagtgaggggagggaaaggagagtgtaggaataagtgaactgggcttatagtcttgaagagttgcctaaaagataatattttctcattgactctgtttttgattaattttacagttatgattgaaaaagaacaaaatgaacttcctttaaaatgaaattaaaatgtgaaacttgctgacttatttttgtagtagaacttgttaacatcatgttaagggtgctttagtatcacagtctgtgatatatcagaaagggcattagagctatctctatgagccaggagtcctaggctttagtatcccatgtctgccgttttctagctgagtctatttaattctcagatcctttgtttcctcagctatcaaatgataagaatgtagtagaccccaaactatgttctgtggaccaagatcactgttttaggagataatcgtaggaatgtaggtataagtatgtaattggccatctaagtttaggaaaatctgtttgctacacacatacacacacacacacacacacacacacacacacacacacctcttagagagtcatatgtaggattatagaggtaaaaagagatgatattaatgctggaatagcgcctgtaaactggggctgtctacagcaaattaggatatatggtcactgtgctcattgtgaacagtagcttgttcgaggctttaagaaaattctggtataaatctgtcttactctgcatctagtagacagcctggcatgt

SEQ ID NO: 53625 - DNA, 1046 bp, Homo sapiens
aaagatgtattctctctggtacactaagagccttcttaagaatgtttacctgttggttcataatagtgaaaaattgaaataattgatatgtctgttagtaggagtttagatagattaattgtaaaatatgtatataatggaaatatatattcatacacctaaaattaaaagctgcatcaagtgacagcttactctctatcctttactataacttccttcaagttctgtggatgatttgaaaatattttattgctgaaagtaagtcttccatgcagagaaactgagagaagcccatgccatttcaaaagaggaaaagcaaaaattgtccagcttgaaattatttggatagacctttaaaactaattgtataaaatattagagtagtccgaataaggagagtgttgatatatgaacaaatatagttaactaagtaatttctcctatagatttatgatatgccctattccaagaaaaagcagcttcatctttatgaaagtataaaagttgactaagtagcaagtctataaaactatactttctttggggatatttcagtgtccattagcatgcttctgtactatgaaagtcttcaaagagtatttcaagatctgtgtggaaacatacaatgaacaaataatcacattttaaaattatggtctctttaatgtaatttaaaattctgtattataccaatgtggtaatataaactcaagagtatggaacattaagagggatttacttttcatcatttaatttgagttacttttgcatttatttggaagatgatggattattaaaacaaaaatatataaaaattaggacttctacgaatggcagtttgaagagattgagagttcttataaaactagacaaaattttcacaaacaatgaattcaggatactggaaactgacaaggtaagacgaagaagttttcatgcttgaaaaactgctaaagctttgggaaaaactggcgagactattaacattcttgcctgggatgctcttatattctgtttggtaagtgagaactaaagtttatctattc

SEQ ID NO: 53626 - DNA, 1048 bp, Homo sapiens
tgcaaaaaaaaaaaaaaaaaaaagtatccgggcgtggtggcgcatacctgtagtcccagctactcgggaggctgaggcaggggaattgctcgaatccgggaggcggaggttgcagtgagccaagattgcgccactgcactccagcctggcgacagagtgagaccctgtctcaaaaaaaaaaaaagaagtgtacattatatactaatatataaacatatatgtagtctacctagtgattactttggcttttagacactcccatggtaaattaagtaatttttttgttattaatttgtttatttaaggaaatttttctttaaacttttagatgatacagcagtgttcgagttgatacagctagttccaccaggtaatatatattgatgtaatatatacaatataagatatcataaattgatgtaatatataatatattatatattgattatactatattatttgataaggatataatatagtgtattatatactgataaagtaaattgacttgggaactcatgtgagtgacatttttttttacttcaaaatctcatcttttcaggccgggcatagtggctcatgcctgcaatcccagcactttgggaggctgaggcaggcggatcacctgaggtcaggagttcaagactagcctgaccaacatggtgaaaccccgtctctactaaaaatagaaaaattatccaggtgtggtggtgggcatctgtaatcccaactactcgggaggctgagacagaagaatcacttgaacccgggaggcagaggttgcagtgagccaagatcatgccattgcactccagcctgggtgacagagcgagactccgtctcaaaaaaaaaatctcatctatcctcctcttcccaagttgagaacagtgtcagatttctattgttgatctactatgtgtaaaatgtcagtagaccaaaataatatatacagaaagattgtcataaatgtcactttaatacattgttctaaaattgaatagtaataattgaaaatggaaactaacttatcattctaaaatattttgtg

SEQ ID NO: 53627 - DNA, 1036 bp, Homo sapiens
tttttaaaaaactggcttattttacatagcgtaatgttttctaggttcatccatgttgtaacgtgtcagaatttcatttctttttaaagatgaatgatattccattgtatgcatacatcacatttagcctatcacttcatgtgttgatagacacttgggttgcttccacgttttagttattgtgactaatgctgctatgaacatgggagtacagatatctgtttgtgatcctactttccatgcttttgaatatatatccagatgtggaattgctggatcatatggtaattatacttttaatttttttcagaaattaccatactgttccattgtagctgtatcattttacattttcttcaactgcacaaggattccaatttcttcacatcctcaccaacacttgttgttttctgttgttttgatagccctttcaatgagtgtgagatggtatctcattttagttgtaatttgcattttcctaattattagtgatcttgagcatcttttcttgtgcttattagccatttatgtatcctctatggagaaatgtctatttaagtattttacccatttttgaatttttttttggtttcgttttaggaattttctgtgtattctagattgtaattttttatcagatatattatttgcaaatgttttctcccattgtttggattgcctttttactgcattgataactgcctttttatgcacgaaattttaacattttcatggagtcctatttgtgtatttttttaaattgcttttgccttggttgtgttatccaagaaatcattgctaaatccagtgtcctgaagcctttgttctatatatttttaggagttttatgcttttctaggtccttaaattgtaaagttagtttgttgatttgaggtcttttttattatttatttatttatttttgagacaaggtctggctctattgcccaggctggagtgcagtggtgtgttctcagctcactgcagcctctgcctcccaggcttaagccattctcccacctcaggctcccacata

SEQ ID NO: 53628 - DNA, 1066 bp, Homo sapiens
aaagattgaaaatggaaaataaactattttatttaaggatacatacatgtgttaacactaaaagaaaaaaaaaaaggcaaaagttcaggagaatggttatctctggtggagaggaaagaattagggaggggcctgcaggtgcttgggaggaaccaatagtatcctgctccactgagtggtggacacgtggacactttatcattacttttaaagagtacatttacagtgtatatctgctcttttctaagtacattctatgatgcaaattttaaaatatagctatgccagatacataagctggtatttgggaagtatgttgggaggtacattttcttttaccctccttaaaagatttttacttgaattcaccattaatccttggccttgtttcttctccccgtctagagtgtttgtatgacagaatagcacaagaaactgtggatgaaactgaaattgcacagagactctccaaagtcaacaagtacatctgtgaaaaaatcatggatatcaataaatcctgtaaaaatgaagaacgaagggaagcaaaatacaatttgcaataaactttggatttttcataaagctttcgtgttttccttgtgtggcatgtgatttgcgagcgatggtgccgtccaaatcagaccccaccgtgcatggtggtgtgtgtgcagggatccatcgggttctggggtcagcggcttgttctgaatgtggacactccaaagacgacagatggctttgctgagactcaggagcagcctggcactggtgtccttctgggaatggggaaaacactcttcttggagggggataaggttgcctgagttgcctgtcacttgactggggtttgaatggatatttttactatccaaggacttctttgttgctctattttgttctataataaattttcattaattctttgatgtagatagtctttatcctcatttctttagtatattacatatacagtgggggtgaccagagtgttgtgccgcctggcatgcccttcctttcagggaaggaatattccggctgaaggagagaaaattcctaagagatgtgg

SEQ ID NO: 53629 - DNA, 1027 bp, Homo sapiens
tcttagaccagggacctctccagagatgtctctgaccatgtgatattggcaaactgcaggcctttctgaaaacaaggacctttggcaggtccttctcatgtcccttagaaagtttagctcattagcagctgccgccctctgtccccacagaggccatttcgtcccttcacagactcagcagaagcatgacataaatggcaatgtcaaagtgaacactgtttttttaatgattaatgttagtaaatgacttgtgagatctaaattttatactcttttttcttttttagatttactaaagatgcagaaaggagaacaaattaaaatcttatagcttattgctggaacattctgggtcttattggctctgcactgaaactcatagggagcataagattgtgttttgttctttgtgccgtcggaatcaaactgggtaccttgtggttgtgtttaaaatcataggtgttttgagccagaaggaactttgagatgaaatccagctccaccacttcataggtagggaaatgaagctcagaggtgggaaaggactggcacagccctactccaattggcagggcagctgctctccttacttgagctggcagaggttttcacacttagccatacactggaattatttaggccacacccagcccaaataaatcagaatctctaggagtggggcccacgaactgatgatttttttttcttttctttttttcttttttctttttgagacggagtctcgctctgtctcccagactggagtgcagtggcacgatctcggctcactgcaacctcttcctcccaggttcaagcgattctcttgcctcagcctcccaagcagctgggactacaggtgcgtgccaccacacctggctaatttttttgtatttttagtagagatggagttttaccatgttagccaggatggtcccaatctcctgatctcgtgatccgcccacctctgcctcccaaagtgctgggattacaggtgtgagccaccatgcctggctgtcactggtgattt

SEQ ID NO: 53630 - DNA, 1123 bp, Homo sapiens
atgtgacaagcttatgttttttttggatttgccaggcaggaaatggaggtgggaaagtgttcattacaggcaaagcctggtttctaggaatacctgctttgggccagacactaaatactttccatatataaaacaacctcagcagtggataaaacaggctcagagagattaggtaacttgcctgaggccacacacccaggaaagggtagaaccaggtttcaaaactgaggcccctcttgctttgccatgcgtcaggcagtctgatcacagagtcccttagccatgtgcttctgtggcaccatcccttttgcctgcctcctgattaggccttcattgctggccattagaccatccagtactgcagtgcattctgtgactgcaggacccttgagcttttagatgaatatttcctgcttaatttaaaagcccaccatgtcttcatagtttcagccttaccaggcaacatggcctcaagataccaattggacaattcctggagttttcttagaaattgtctctttagagagaacccagttcagcctttcacccctatcttatagatggacaactgaggcccagagaggggaaaagacatatctatgccatgtggaatcagaatatataggatttcatgaatgctatatcatgaagcagtggaaggtttgtgttcagccaacatggatggatgtttgtttggatgccaggattcagcaggtcccagaggctggccataccctcccttgctgctccagggggtactctgagtgtggggggtaattcttagagtcctaggaccttagtcctataaggaaccccagagttcacctcgtctagcctcctatacaggacaagaagctttctgctgtctccctgccatgcaatcacccagcctccagtaacattccactagagacaagaagctcactcactgccttccagtgcagcctatctcattattggatagctctgaccgtagggaaatgtttttgtgcagggaacattattggatccttcctctgttccgagccctgtgctaggcacggagaaatcaaattgttaagccccccttgccaccttaaagaagtcacagtctcaacagcagacagttgggatgcagggtgag

SEQ ID NO: 53631 - DNA, 1051 bp, Homo sapiens
gatcctgcccccgcgctgcccagacctgagggctcctggcgaccccacccgcagcccatctggcggctctggccccgcaggtcagggtcacacccctgccggcctcctgagacttcccggccccaggggagagagctgaaacttgggttgacgcgcgccccctccccagcgacaggcgaccccgcagcagccccgcgccactcctctctgcgcctttccgtagttgtcctcgaggtggctttgttgaacgtcctggtggcgccaaaaagtccaggcagcttcgggcgatcagggtcccgaggcgctgggcgcgcggacttggatcctcagggggcccctctgtgtgactttcgctaattgtctcacagggagggcagcaccctcccctatctttcctctattacaccccgctgtggacctgggacttgggtatttctagacgagattgggaaggcgcgtgtgttacactaagcagtgctcatgtttagctgaggaagaaggagcctcaagtgttcgtagggtgtacctgtgtatgttgtaattgttgtctctctttgggctgggggctgttatacatgtaggatttagtaaacacaggtcttgaagtcttgaacctgcaggagactcatttgtttctacaaggagagaacctcccctcccccaacatatgttaagggacttgaggagaccacagggaaaccgaagggagggacttctagaaaacaattccaggtttgggggaaaatgagtcatattgattcccaagctgttagccaataccactcaagggtaataattttcataaaatcttcccactggggacttaaatacagggctccacaacacagtttgttgagagctctctggtgcctttaagcctatccatgccccttacctaaatgctttaatttagtagagctccttgagaagctgcctcacattatcctcctgcatttgtgcgcctagcttttaatattttataatacttgcaaattgacactgaacaagctttaacctccatcatttcagaataagtttgatgttttaagtg

SEQ ID NO: 53632 - DNA, 1050 bp, Homo sapiens
gctacttacagttttgcctttcttttcttccgatgactcttctcaccatatttcctggtcattgtctactgttgttttgtttgttgctttaaagctgcctgtacctttctcctatgctactgccactgtaggaaacacgtacatgttatattacctgatggttttttagcttcctctatggccactgtctccagatctctgttcctatatcagcatttgcactcatctattttgataagcttatctctctggctaaccaccctctttctgtaagacctcttcgagcgtttccaccatcacttggggacttttgccatttttcctgcttccagatctcaggtgctcctctcttcccagttcttggtgaagcattttcttcttgtctggactgccttcatggtagtcccatagcattgtgacatgcgaccctagtaacagaattatttcattctttatcacactgccttccttttctcagactgttaaatgtggctttcagttagaacctcttactggacctggaaccaccaatctcatctagcttcaggcccactgtatcagcctctttcctcatgtatggtcttttcccacccagggattcctgttttccctattttcaactggaagtgacatttaaactaaggaataaaggaaaattaggaattatctaggggaagagggaaggcaggattgagtatggtacatagaacaaatgaggaatcccagagaaggaaaagcttgtgccaagtcccagaggccaggagcagcatgggtgtgtaatagagaaaggtgtgctgagaaactgcagtcattacaatgtgtctggtgtgtcatagagtgcaagggcataggtggcaagaggtacccctgggaagttaggttgtgttagatcaaggtgggtctttcctgggtattgagaacagaaagaaaataatctggaagtgaaactggttgaattttctcaagtgcaggtgttttattcttaccgattttttccctggcccctaagggctagaacaccacctgctgacattctgtatgtatgatgca

SEQ ID NO: 53633 - DNA, 1008 bp, Homo sapiens
atttggacataaggcttctagggggtaattaaggttaaatgaggttataagggtagggtcctagtctgataggattgttggccttataagaagaggaagagagagatctttctctccaccatgcaaggacacagtgagaaggcagtcacctgcaaactaggaggagagtcccctctagaacccaaccatgctggcacccttatctcagacttccagcctccacaactacaagaaaatacatttcttttgtttaaaccacccagtctatggcattttgctatggcagcccaagttgactaatataaaagctttattgcctcactaaattctggtttctagacccagtagacatacaaattacaagatcattgaggctgatctgtgttttagaaaaatcattctgatagttcctttgaggctctgtgtgccttttgtgtgattgagttgtgagtgcttcagagcacttgctttaattgtaaggaatagcttattgttgactggaaacatcctggctcacaaatgaaattgatgaaagctggcctgtccttcactgaaccaggagtgaaggatatattagcattgtgatgtcactgtggccagaggcctttgctggactgggaactcacttctgagttcctgaaatcacttaattataggcgaatacacataatacctgaacagcatcactgcactatttttgtcttcccttccatgctgacttattcattaacatttgtgtaaaccatctgaaccatagaatccttttgggaggtcctccagctcatctcttctatctgtagaccaacttttcctcgagcatctctaacaaaactcagaggctctcatcttccccactgaagagttggtgcccttgaactgatggattcagctgatgtcaaaattggaaacaaatattaacgaatatttaattcaatctcggacaaagtaagagatctaaaaatgtgtggtcccaagcctcttaaacttcttgaaatcaaagaaagccaa

SEQ ID NO: 53634 - DNA, 1040 bp, Homo sapiens
gtactatgcacaaggtacaaaattcaaaaagtacaaaagagatacagaagatgtttttaaagcatatcatgtggtcagagttcacttttcaaatagattgcacactagctacatgtggaggacacatgagaagactagaaactggacagtgagtgatcagttatagtaacttttgggaggtgatgatggggcagagcagtgatagaggactagaggggccagatgcaagagagccctgtgttctgtggctgggaggcatcagtccagagccatgatagcaggaatgcaggtaaacgtgttttgattggtgagagagatcagggagctgggctcagccctggcaccacaggtgggcttactcctcacacaatatccacaggacccatctcttcccaaagatgtttaccagtttggtgtgttcactctttacaaaggctctttctctttccccaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccccaaccggcgctacccaggtccacttcaccaccaggctcagaggttcaggtaggcatgcccaaagaggaagaagccctgctacaggggttcatagctgggcaagagccagggaagcccatggtcctgacaaatggggcaagggtaaaagcttccacccccaggaatcactgtgcaaaactccccccgagcctcagtttccattcctgtaaaatgagacagttggagcagatgcccttctaagccctcttccaatttactactgtgactgtataaactttagattctttggtagaaacaaaatgtctgtatttaaccaaacatgaaggttcagtttcaacaagagttaatcacagatcagtgaccacattcagcagattagacttaaggctggacagtggcttttaataaa

SEQ ID NO: 53635 - DNA, 1046 bp, Homo sapiens
aggcaaaatatcaatttcaaaacagcatcaaaaagtgagcaggccaggcatggtggccatgcctgcaatccccagcaccctaggaggccaaggcatatttttctgtactaaaaatacaaaaatatttgtctctactaaaaaataccaaaaaaagaaaaaaaaaagcccactgggcatggtggtgcatgcctgcaatcccagccacttgggaggctgaggcaggagaaccgcccgcacctgggaggcagaggctgcagtgagccaagatcacgccactgcaccccagcctgggcaacaagagcgaaacttcatctcaaaaaaaaaaaaaaaaaaaaagagtcagcgtatttaaccatccccatctgataatagagcaaataggtcaacagaataataattcatgctattgcatgagtaatgaactggcaacaagagaaagttggtggaaggaaaggcagaggaaatgtgtcttgtaagaattagaatcaaggggctccataatcatcggacatccattcaatgttgtatctatggttagaaatgtacatgataggaactccaggaatcttacagattcttcttttaaggtcccagtcaactgtggcaataatgtaacacttatgctgagttatttctgtactaagcagtcatctgcataggttccttggtgtgcacatggtaatagttcaaatcttggatccttggtgatccttagagccactctatacttctgccccaatttctcaatttcagccattacacaatcagttatacaagggatacacttggcatacagacagtccatcattgactgcattaagtccagtttggcttttatggaaaagttgataaagttggtatcaatgaggatgtggtaaggtgggccgagctgtgtattatattggaaaaataagtgggaagggtgttggggaacttccctttcctttaatgtgttgggatccttcttttctttctttttaggttttaatctatccttttctttaagcctctgatctctgagactaaggatttgcttcatggttgcg

SEQ ID NO: 53636 - DNA, 1053 bp, Homo sapiens
tctacccaaacgcaggcaggtccctgcttctttgcttcgtcttctccccaggtggaaacctgcgcatcttcgttcgctctgcgcttctccacaggccctttccctctgctccttcccaactcccttaaggaatccccccccctttaactgacaccctaggttttgagacgccctaggttctgagacgccctagtttcttttccccttctcgcgttcctaacgccctctggacaaccgcttgctgcgccctccctccttctagtttcttccgcaccctccctggtttctcaggtctgctttcctatgtcttttcctcttcgcttcctactgcctgcctagcaccaccctctttttctggacccccgtggctttttgtggggagggaagaaattaggccagagccgttgagggaaaggagggatccgctctaaacttgggagggaagaacttctcaggtctcaattttggaaagggtggattagaaacaggggctgtacttctgcctgtagagaagcttgggacctcctagataaccaaggcgcctttccttacaggctgcactgccagggcaggcattttctatacagtgggctcttctgtacagcgtggttaggcagaagttatgttgtctcttgtttgaaccctggacctggccacttctccacggcagggcaggactggaagggcagttaagggtggaggtgttggggcacagacgtggggaaagcagcactgaacatcgagtttacagggcacaggtagttggggttctgaggagtacagaaagagagggagccctggggtcagggctgtaggggctcagagcggaaggaatgctagagcaaaaagaaagaggggcactggagcctagtgaataagggctgtggggctgagggagaggaaactgagatccaaagggccgaggtgctgtgactgctgtcttctagctaaccgctcctcacgacacgttttctcccctcccagaggccaagttgcagaagtttgacctgtttcctaagacgctgctgcaggcaggccgcccgggcagcccgc

SEQ ID NO: 53637 - DNA, 1058 bp, Homo sapiens
cgcagtccctttggacgccaccagttcctgggcgtgggcgtgggggatggggccgggggcgaatagggatggggtggattttcttggctgggccctctcacccgggcccccagcccctggcacagcagaggcgtcagcaaatgattctgagctaagagtacgcgtgtggatgtgtgaggaagaccctctgctctcagccgcctcatttgtcccggagggttttggctttttctgcccggggcccaactgtagaagtaagactggagctccgcgcataaaccagggcatacctgcgtaagaatgtgctcctgtcggcgtgtgctatcaccgaggtggaaatctgtgggagtctgggaatgtcacacaccaagtggatggcccaggatggggacatgcttataagaacactgtgaggtcaaactcactgaaggggtccccttgagccggagggtagcatcagagttgagcctgggcccggtggtgctctctgaatgctggcgtgagagtgtgtcccaaactttgcagagagtggtcacacgcacgtgggagggggtgtgtccaagtgtgaagctacactcaggttgggaagggggtagaccctgctgcctcaacctgggcgtgctctactagtgctggtggctcagttgggccatgcccttgctttcccctccgaccaacccaatccaaatcaggaggaactggccctggagcggcctgggaagctgggcagaggatatcctgccctgtcgaagtgtgggtgagatgaccttgggtttatttgccctccctccataacgggtttattttgcctccctccataacacattcactcacatgaacaccctaacctccggggagtgggagaaaaggctgtgggtctcagacctgtggggatgtgaatgccagaaaagaggagcgagagaagagtgagatgccgccactaggggttgggcggattccctctggttgggctgtgttagatgccaggatgctcctcctcccactcctgagaaaatgaagttcctcacgcatctgctgggccgcctcgggttcccgag

SEQ ID NO: 53638 - DNA, 1078 bp, Homo sapiens
atggagaaaccccgtctctactaaaaatacaaaattagctgggcatgatggcgcatgcctgaaatcccagctactcaggaggctgaagcagaagagtcgcttgaacccaggagacggaggttgcggtgagctgagatcatgccattgcactacagcctgggtaacaaaagtgaaactccatctcaaaaaaaaaaaaaaaaaaaaaactgcatcctaattgatctccctttctccagtcccttctattatagaccggtcaccacacaactgccaaaaagagctttctaaaacacctgcttcactgtgtcacaccctgctttgatcctctcaaaggcttgctgttgccctccaaataaaatccaaactcttggcttggatttaaaactctgtcatctggccgctacctccctccccatctgtatctccagccatgccctcaacacacatcctgagctacctgcagtttcctgaaagtgccagttctctgtcatctctggccttgcacactgtgtcctctgccctaatagattcctaccatccatccatccttcactttcagtttatacttcacttccttcaagatggtttcttgaccattgccacaccctcctcacactcctcgggttagacacaggagtgctgtgagtcttcagacttgttgctgcccttttcatagcactggatcactctgagctgtaactctcagcttgcatactctttctcccctaacccccagactgggacccccgcaaatggcctgagttacttcatattcttgaagcctaatcaaatggctagtacataataagcacacagtaagtttggatttattaacttaatttataaaaataaataatggcatccatgtactaattagatgtccacttccatctctagcatccaactcgtgggaacattgagagggcagagaccagatcttaatcatccgtttatttccagagtcagcccagggtctggcacataacagtcacacacccaatggttactgaactattaattaattggagctgaagcaaaaccaattggagctgctgaggaaagaaaaagactaaaggaa

SEQ ID NO: 53639 - DNA, 1045 bp, Homo sapiens
tctccatatctgtttttgtgtcacctgtgggttttatcctaggggttgggatcctgattttaacattttgtacttgtccaaaaaagagttcaaatgctgggtttgttcccccagcctcggccaaggggttctcagaagattctaaccaaagctggagataggtctgctcattttccttctgcccagaagtggatgttggccaggaaaattacaccttgtgtcttctctgatgctccaaccagggacctctccagattactatctagcacagactagtgctacatctgcctaggtatgggctttctctggcagcaggggtctctctagggaggctgagagacccatgggtctcccttcaggggaagtgttcaggggagttcaaactgaacacttctctccagctctattcctatcttcctaatctaatggctctacaagatagtcatttccagtgctacagatgcaccagggcaccacctctttttttttctaggtagaccttgttctgtagctgctgtgaagaagctgcagccctgaactcaggtcatactcaggaacagcagcaggggtgtgggtggggtttgagggaaggtactctgaattcaccttcatgtttaacctgttccatctgacttgggtttcttcattatattgttccctcccactcaccttcacttctgtattacaacaatatagactttactctaaagccaatttcatggaagttattaaatgctacttgaatgtgtgtgaagttgatacaacctttttcaacctgccttagaaagttcttttggcctactcagccccatgatttcctatgctctaggcctcataactgggaaaggcctcagctaattgtcactgttcactcaggacatgatggtctactaagcttcagacaaaaggccaaagcaattttatccttttcatacaagcagagcattaaaatgacttcccatcaccacagaaatagcagtgtcctctgcagttcttcctcctaccattaggcttccttgggctttacatcccagcctccaggccc

SEQ ID NO: 53640 - DNA, 1017 bp, Homo sapiens
gagcataccaggtttccatctagatacagctgaagatagtttccccttccccttgccagcctgcctttgatacttggccttggcccccagggcctccacttccccatatcccccacccctccatggaagaagacaccagaaccatcttattaggagcagcttgagttaagcagaagataagattgcctgcctcaggtgctgcagtcaggcccagagcagcagagcagcagcctcaggcctgactagagattgcttgccctcccatcacacacttggagttgcccatttatctgtgtgtccaccatctttacagttgctctcacacacagcagtcattatggaacacctgttctgggcaagacactttgctaattatatattttttctcatttaattctcacaatgagtcctgcaagattgatactaactccaaagccacaaagctgatagccaacacagctgtaatttaaagtagagtctttctaattccaaagcctgtgtcgtttccactaaaccagtattactcaacttttaaacattgtgacctcttttgataaacaggaaagttttgtttcttctctcactcgcagattcagaagaccttcatgtcccatccctgcccgttgcctaggagggcataaacctaatttaggatccctgtatgattaacgtatcccactcagccaagattttgtctagcttgactttcaatagttcatattacaaaattatgattttttttaatttttaaaatataaagttgtattatgacattgcctgttttttttccaaactaaatataccatcaacaagggtatgatatgcctcccctcaccaggggagatcttcatcgttgggcatggtggaatggccattctacagtttataatgtagttctaagaggaagatcagccccaaaggcttagctgtagtcccaccaagcagaagagtccctcccctctattaggggctaaccaagcagaggtctctaggaatgccagtcagttgttaaccagc

SEQ ID NO: 53641 - DNA, 1048 bp, Homo sapiens
tcccatggattcacatttttctcaacagcagtgataggctttttagaaaaggaactgaagcccagggaagtaatagaaacagtatatgaaatttcagtctgctaagaaaattgatctagaaaggaatagctctgtttggcaaagaacacctgtcccatttttgttacataaacatgtttcacaaagccaatttgctaaatgattaagctaatgagaaaatatatccattcaggttttctaagtatagtgaagaaaatgtcaagatggttgactttccttttctaactatagacaaaatcaagccatacctcttatctgagaatgacccttctcccccaaggagtcccaaaaggtgggcttctttgttgatttagagagtcgataattcagtaaagtcccaagtaaatggcacaacacaagctcagattgggtttttgtattcatattttataaacatttcaggacttttttcctgacccttgacctattgccattcttaaagtgaagatcttatatcccggaagcttggttagaaacaacttcaggatcatctcatccaacttctttctctatatagaaactactctcagcaatatctctgaaaatgtaatgtagcgggttccaaatctagactgccttgattcacagcctggctctgcccttaatagctctgagaccttgggcaagttacttaatctgctccagggctcaatttctccattggctttttggcttaatggggataataattgtccttacctcaatgcaaaggcataaaaatgatataatggactttggggactcagcgggaaggttgcaggggatgagggataaaacactatacattgggtacaatatacagtgcctgggtgacgggtgcaccaaagtcttagaaattaccattaaagaacatacccatgtaacaaaaaccacctgttccccaaaaactattgaaataaaataaaaataattgtccctacctcagataacctaccttttatattaaagtgcttggactatacctggcacaaagtaaatgctcaataaa

SEQ ID NO: 53642 - DNA, 1058 bp, Homo sapiens
ttttctctgtttagagtattaagattttttaaatccttctaattagccaattccaacagcagtttagggaaaattctgtcccctctgaaagggcaactgatgcagacttactgtcagcccctgtatctgtgtagcagaactgacagaagctagagccagagagcttccagagccaagggagctgctggaatgacctgctgatggtatcaccaacggagtctgcctgctgtaggaatgaggctgggggaagaggtctgaggatgcagctcctctagactccatttctttgaattcatggaggctctagggaggagtggggagtttccatttagtcattcagtagatcagtctttcagcaaacatgtagtgaacttacactgtttccagcagtatgctaggacctggggataggtagccagtaaaatctcttatgtgccctcagaattcaacctggctggagagacagactcataaacaaataatcaaaaggcacaacagataactcagtgtgaaactgtggctgatcccttgagctagatcctctaggatctcttgcctggtcaaagtataagaatgctgttttagcaaaagacagggttggcattgccagtacctgcattccactttaaacactgaccttatgtcagccagcagaccttggcaactgccttgtctgaggatcctaaggtgaaataaaggtattagtccggtaaacatggattgaccacatgcaggataatgggataggcatatgagggagagaccacaatgaacatatatggtcactgtgttccatgagccgatggcctagtgaatgattccagctatgattaactctgttacaggaataggagaaagattaatttaggctctgtcactcaggcctgattttatggagaaagtagcatctgagctgagccttgaaggacatataggttgggacaggtagaactggagagggaggacagtctaggtggaggaaacaacatagcaaaggttcagggaggaaaagcacaagacatatttgaggaatagcaaactgctctaattgtctggca

SEQ ID NO: 53643 - DNA, 1037 bp, Homo sapiens
ctcaacctccccagtagctgggactataagtgcacaccaccatgcctggataatttttgtattttttttttttttttttttttgcagagatggggtttcaccgaattgcccaggctggtctcaaactcctgacctcaagcagtctgcctgcctcagactcccaaagtgctgggattacaggcatgagccaccacacctgaccaagaaatcaaataagcttttgaaggctgtacatacaatctaatctgattttatccagccataaattaaaaattgttagttctgtgctccgtattctagttgctttcgcagacacgctttgctcacttaaagtctgtataataaccccattgtaaacacaaacaactgcaaatgtgtatgtgcgcagattaaccttttctagacactccttgtaattttcaaagccagtactggagttctagagtgcattagcacatgcatcaaatggtagattccccaggacctcaccgcagtgccaactgcagccccagcctacttcaccaaaaccacaccctgttcttcgtccagaaccaggacctcaagccttcaggtttaatgtctaaatctgaatcttcaggtttggctgaatcccaaacctgaagattcttttgctatttccatttttttttttttttcactttccctcctctaattggctttatgtgagaccttgtgtgaacaagccttcctcatgcatgcattctttactgtgaaaactaggggaaaaaaacctattttctagatgaaaaaactgagatgcagaaatgggaagtaacttgcccaaggcttaggaaaaccaaaagcagaaatggctggttcaagtttacatagtcacaaagtgaaggtaagatatacattttttaaacaaaaaattgtacacacgaagtttgagacaaggaggaaagaaaaatgtggaactaattgacaccctagggctgagccaggcatttgccttccttgtagtttcctggtacccttttccctcttgtggccctttactgttctgaatttcagtg

SEQ ID NO: 53644 - DNA, 1396 bp, Homo sapiens
aaatcaaaagctcaaagaagcagatttcaaactcatgtccaaaaccttttataccaggcagatattatctccattttatagcttcaaaactgaaactgcaaattaagtgttttaaccaagatcacgtagccaagcagtggcagagctggcacttaaatgtgacggtagtgattctttctgttatatctcactgttaacctggaaagatgaattaacatggaatgaagaccaaagccagaagaataattaagggtgttgtagtctttaaaatgagatgatagaaataccaccaggcaggggaagattggagagatgattggatgtaaaggttaccaatgcctagactaagtatttggtaaatggcccatagattctcctgtcctctgtatacttggagtcagacagatctttgttctaatgctggcacttccacctgttagctgaggtactctgagtacatcatttctcttttctgtatttcagctacttcatctttcaagtgaggataatgtcatgtgtcctcacagataaattgtgatgataagatcaaaagtgataatgaaaatacttggtaactggcagagggccatgccatttgagttggtaatggctaaacttctttaatccatgtcccaaaattcactacttttgacctgtctctggccttttaaaaaataagtttttagacacattcttcattcttaatatgacagtgacttgcactttgccagttgcattataacagactcttccttggaagaaagtccactgtttattgcattccccttagtaaaatgcagtaaaaatgtgttctgagtcttggcaatgacagggagacagcatgatgatataacacaaagaaccaactattaggggggccttgggcaagtcacataaccacactaaactggttctttcacctgtaaaaggcagataataataaccacctttgcgctggatataagaattaagtgaaggccaggtgcagtggctcacacctataatctcaactctttgagaggccagggcaggaggatcgcttgggcccaggagttcaagaccagcctgggcaacatagagagacacccccatctctataaaaaataaaaatttaaaaataaagaattaagtgaggtaatgtgaggacacagacatggcacatggtacattcaagacatgtgaggctttaagatgtgtagaccttgtgctgggaaagaatagcacagctcaccaactagacctacctctgggtgtataggatgacatcacaccatctcactttcactcctactttcctctaaggaagcatattctgtcttctctcaacattacttttttccacaaagcaaaatcctctcagctagggttacatggaaatgtgaccaaacatccaaga

SEQ ID NO: 53645 - DNA, 2956 bp, Homo sapiens
cttctttgttctgcacaccattctctccttagcttttggagaaagtatggcttcccaggccagcagatatgtacccagtagcctatgtaagaaattaggtactagatcttccttcctagctgttttccctattccagcattccagtctttgctgatgtctcatctgtattcctcaaatgagatatatctgtagccctcagaatatacctgagaattgtatgtttaacagcttaacagttagatatcagggtcaatgaatgtaggttcactaagaatgagtcatgcaaaacaaacagtgttttgtgatttgatagtcttactaccctgggaagttacagagggtgacctgtattcactgtgtgcttgcattacagcacaatatttgatagtctctcatagtattctggggcaaagtagagagatatagatgtgttagattcattgctgattaaatggttgtgtccaaaaaatgttaaccaccatttccttgtagggaaccaagaggctctgtatttaatcttttattacttaccatatttgttggcaacctaaatgaagactttatcagatttatagattatgaaaaataagattcaagaaaaacttaaaatactgaaacttacacaaaatgaagctgcagaaatttcacagaaatgtgtagaaatagattcctttagtagaggttatggtcgaattaagctgaatacacgttaataacgcgttgtggctgccaacaaaaaagctagctcctgttttagaggtgtaatcccaaccagagattaacttaatggtcctgtttaactctgcactaagataaactacccactgggtgatgggtacaccaaaatctcacaaatcaccactaaagaacttactcatgtaaccaaatacctgttccccaaaaacccatggaaataaaaaatttaaaaaaaaaacaaactacccctgaaatagtctttaggcttcatgctgaaaaacgaagcctgaagaaataggagcatgtctggagcagggctggtaggaaggtgagggagctggaaatcatgtcatttaaggaacattacctctaaagaaggaaggaccatgagagatgtgattgttgtcttcagctacttgaaggcgtgccttgtaaaagagggatctgattttttgaggctgcaggggcagaactgggaccaatgagttgaaagttacacgagacaaatttggcatagtgtaacaaagcattttctaagaaaggaatatcttgtgtcgtgaagtgttaattttcctatcattggagattaccaaatactactcttttcagtaataacagatatatatatggagagggattcatctctggtattcctgctttatatggaatgggacttggacttgcttagctctgaaatatacaataaatcttctgtgattccattgtgatctaggtatagtaacctagcataccaaaacccagagtttcattaaggtacatctaagtccctcacattggctgtcaggtttgcaggatagagacagaaactagtaatatcccctctgggtggaatgaggatcttgccacttatttctaagcccaggagactgtagtggatcccaggtgctgactattgttccttttctcactggccctgcctactgctccaaggtcatcccctttatttgtatataaggcacacaaacatgcacaagggaacacatgcctgcatatgttcttaccacacagccaagtatgaaaactaccttaacttctgtcactgaagttgaactctcagtgtgtgaacatttaacaaagaaccattatcaaagtgttcaagatcagccttgttctcatactttatgttctgtgatgaaaatctcacctcagagaacttaaaaaacttaggagctaagtttgcccttcccaacccttagttttaagtcactccctttctgaacgggtctcatctttaaaaatggaagtactgaaagaaatagagtttaaggactttgcattttaaaattaaactttattttctttcaaattaatttttaaagcttattactgacagggatggggtgaaaatatcttaaaaggagctaggctttttgatcattattaagaacctctttccacagggtaaaactctggactgtggaaagttgctgttgaaaggaaactggggaaatgtgatgtgaaatgtagagtgttcttgggcctgctactatctccctgtggttgccagcatagtgcttcatatataagcatcagtaactgttgttgaatgttaataacctcaggctcccctaatctctggttccagaatgaacagaggctggtccaaatgagaacagatgctctaggcccacccagattccagacctaaactaagaaagcccacccaggactctttaggcctcctagagccaggggtggggtgagagttaaaggcccttcattcttctctgaattctctttcaagtcaaatgactagtgtttttgcaaggctattctgtaacagccatctgtgtctgcaaggattaggatctaatttgtaaaagtcatcttaaattacagccaaactaaagactgttaaaaagcacatcttaaggccttgcctctttaataacaaataatataagccttaactctaggagtcttaattgtgtcttcagccttttctccacaaagcagagactggtttctcagcagaggacctggtaagtgttcttctgtacctcccatgcctgccacccgcccccaaccaaaacaatacttcatgttaagatttccgagctgtctaaccatttactaaatgtctgctgagcataattccctgaactgagcactgtaggacaaccaaaatagccgcagacataggccttccccagaaaactgattcaagttgtggaagcattgagttacttggttttggggtttgtgtgtgtgtgtgtgtgtgtgtgtgtgtgtgtgtgt

SEQ ID NO: 53646 - DNA, 1034 bp, Homo sapiens
tagtgacagtcttttgtgggtatctattttcactgcctaatttcacttcaaaaaatagccccatttctcatccctcagatatgctttaaatactcacatatttttagtagaaaaaaaagtaccagatcagttcatatttctaacttataccaggtttccttgttttattacaaaccaaaaataatgcaaataaactatatttgttgagcaaatcaaactgaagtttaacactggtgttaaccatgactcgtttgagtgtaggtgtcctttatgttgttgttttacaacagtgtttgcttacaggaggcccttgctcttagccagtatgtttgaaactgaactactgatgtatttttgttatttttttggcagtagaactgttggatattcaaatctcaaggttgctgatttacctcgtatctcttcattgttttccacattggtccattggtgtgggatgtatgaggtctgttttctttctggggaaaagccctggagactgtatacattgaggagcagacattgtctgtataatgaatgaagtaacgagctactgttgtttattcttctgtaatataattggttgaattcagacaataatgtagcatctgttatactatgcagggaaatgtcaaaacagaaagcaagcagacaggtggattaaagggagaaaaggagagaaaaccaagaaatatcacattaagttctgatttaaagtaggcgaaaaggaataatcataacaaaaatgataacaccaacagctgtcatatgttgatcacagtattacatatagcatgaggatcaatgctcagcacttgtcactgagtgctgaccaagtgtcagcatttgctaagtggcgtcagggacagcgccaagatggccgattagaagcagagtctcccatcaaaaagaaccataattagcatgtgaatcctgcaccagcaaccaagtattcaggttctctcatcagaactgactaggcagctggcgtgatccagagaggaaggtagagcagtgtggtgtggcggcccacc

SEQ ID NO: 53647 - DNA, 1057 bp, Homo sapiens
ttttgaagaagacctgtgctgagcactgccagggaaacaaaggataataaaacgttttctgcctataagaagatattacatcttagagggaatatacagcctgtctaggagtaacagcaaatcaagaaaaaatgtgctaaatgacatagaaataaaagcaaaatacttagagagttcaaggccaaaggaaaaatcttttacagctgagataatcagacaatgtacagatgaagtaatatttgagtcaggtcttaaaagataagtgaaacttaactgtttggaaatcaaagtttattcatgtcaaaactgttgtgagtatctatcacatatatacaagatattatgcctgacaaaccctagtctgcactctgaggactgtcaataatggaaggtagaaaatattttgttgaatgtcttctgtgtattaaatagtttgctagctgctttacgtatgcttatcaattaaccattaaaacaagctacaaggttagagatttatctttataagtgaaaaaaactgaagttcattgaggagttacacatacaaaaatgagaacagctgagattctcatccaggactttatgactataaagctgtttctcatactccattccagtacaaaaccctatatcattgtgtccacaggagtcatatatgccaagtttcacaaaagtttagataagggagaaattagtcactatccttttaggctatttcaagaaatatagtttaggattcttgctcctttatgctgtcgttcacacatgcacacactctctagctctgtgtgtgtttgtgtgtgtattagtgtatcgtcaaccatactggcttgctaaaatgtcaagggtacacaattaactcagtgttctggatctaaagcttggcagcgtatgtaatttcatctgatgatttatctaatttaccatgagctgaaactttctttctttccaaatgtagataaaagcccatcatcttacagaagaccctataaacataattcagtatatgcattccagctgttaacatgtgagaggttggggtacagtgggggagagg

SEQ ID NO: 53648 - DNA, 1031 bp, Homo sapiens
atgcacaagatgtttaaaattttaatttgaccttactttcctgacttcatcctttcaaattaaagtttctcacaacattctgtactttccctttaaagcacttaccataattgtaattaattatcacataattatttatttaatgctaaactaccccatgacactgtaagctccacaaaggcagggaacttgtctatattatatatctctgtattccacatactgcctagttttgggaggtgtttaataagcatatgttaaataaattatctttccaggcataaaatacttattgtttacagcaacaattaaagaaaaagacatagctcatccacaaaatggctggcccaatctgagcctgaaattgactggctgggcaggaatgacttgttatgccactatgtacacgtaaaaaacggaccttctaaaagcaatcacagctggaagccctatgatcacaaatacagtttataataaaagagggtaaacagctctgttgtaaaacagactgtaggagatatgaaaggccatcaaatacagggatcttggcacctgttgtgtgttctttcccttactcacagctctctctgaccatcctgacagatgggctggcttgggcatgtggctcaggatgaattttcccaaatttatcatggtcatagcttcttgtatgtttggtagttgttggtgaatggttatcatttcttcttatctgttcctcagattttatacttgcctctccaactgtcctcttcagagtcatctccaattttgagagagaaaactgcttatgtgtttcccccatattattctatattatcagattttttagaaaatcccaggtattgtggttaacacttcatgtataaatttgttctcataacctgtagatgtgcctctggaacttctcttgtattctacaaatactgtccttgtagaggttccctttgctaaatctaagaggacacatcaaagtaactagaaatttttacacatcgattgggtggaggtagaacaactggattatgaga

SEQ ID NO: 53649 - DNA, 1931 bp, Homo sapiens
gaagaataagagatgaggataggctaggtgaatctaaagagagatagggtttgaattaggccctgggtaaatggaagagtccatgactcatgagagataactgtaagttggtggttaagagtttgcagtgctatattgcctgaattcaaatcctagctcttccacctagcagctgtataatcttgagaaaaatcacttaatctttctgtgcctcacgtacttcagttagtagccacttgataagattgttgtgaagattaaatcagttgatacatgtaaagtgcttagactggtgcctgacatctagtaaataatcaggaaatattatctgcagtaatactaataatataaactaagtttggaagaatgagtaggaagaatcatttggattaagaaagaagaacataaaaatttgggtatgtgatacagcttggaagtgtcaaatggcttgggatatgtgggaaagaagtaattcaataaggcaagaaggggttgtttatagacagaagtgaggagggagaaggctgaaaatgtgcattagggcacatttttttgaaggtatgtctatgttctgctataaagcttgaaccttaaactgtgggcagtaagtattcatcgcttctcttaagcaggaaattagcaagattagatttgcaatttaggaaactaatttgataggtatgacatttgcttactcactttgttcctatctttatgataataccattttgttataatttctgttattttgtttgctgtctgaactaccgtgcttttcaaactatggtctttgagcatacctttggcttccaagctagacctactgaatcagaatctctgcaggtgggccagagagtctgtgttttcacaaatttcctgtataacaagtgatttctatgtatcttaaaatttaagaaccactggtttagtggaaagaacataggctttagaatacatacaaaacctgattcagttccttatgagatatacaccattggcaagttacatagccaattcaagtctcagtttccccatctgtcaagtagaagtaataccccattgtggtattgtgggaatgaaaagaaagagcatatgtaaaatgactaaaccataatagaccctcctatatattgacttcctttctaagcttatatatgtatctcatacaactaatgagagaaggaaactgtcttactcatcttatctccagtttctaacacagggcctacatcttgtaggtgtgcagtaaatattttataaatgtgtaagtggatgaacaaattgtatggggaaaaactggaagttaggagacttgattaacaggttaatgccataatctgtgagttagtgatgaccggatctaaactgaggcatcgttcttgaaaaatgtacaggctccatcctaggttaccaggcagatgtgtacattgtctctggattggtttagccttaacataaactctcactagttagccagtttcatctaaagcagacactgagatggcaatccatagtttgaaattctgtcactaaagaaattagtaagccagtcctaaatccagctttttagctgactcccacataccacttctatccagatgaaaaagaatcttttctaaacatctccatcagaaattccagagacttacattctagcaaagcaagacaatctcagttaggacttggaagttacttgctacttgtgaattcatctctgtttttatagtcctacacaaactattttgaaatttctctgtttaaaactgttgattactggagtttacaaaaataaccaggtagtctaacattatattaaaggctcaatctttgatataataagtagtaacctgaaagagtgtcatgtcagatttgccataatccttatttcactgtttttgagcaccagcagataatgattttacagacaaatc

SEQ ID NO: 53650 - DNA, 1043 bp, Homo sapiens
caaggtaatacaactgtgtaaaggccagaatacacacttacaggcttttgatacctcatgatcccttgtaaaactgaggtacaattatattaaagatttatgggataaactgaatcagtgctcttaccaagattaggtaggatctgagtgggatgatctgaagagcagatgagacattgccatattcgcaaatattatattcactagattagaataagaaagtttctcttaattgcgtacttctacttttgtgcatggaataatgctcacttttaaaaagatatatccataccgtccctgtttacatttgttgttcttaaagtgcctgctgatagatcagtttatccatgtctgacacctcacagtagaagttaataattgtcatatatgaaactgatgtaaagagatttgtgactcaacattggcgttacaattcagcacacctgttcagagccagccctccacatttttcccttttgcctgaggtgaagacttcttcgtggattacagtaacactttttgacaagcttagactgggtggagttgccatgtaatgacagaacacaattgatgatatctcagtaatgcattcttttttgatttgggctgtcaccatttattactgtaaaagcattcattgttaaatagctggcccaacctgtccactttttgttttcagtaatggcaaggcctaagaaagtatgtttaattttctagttatgaaatattagctgactttgggggtaatatatctagttgtattttcttttatgtaacatttaaaaagtagccatcttagtattttccaaataaaaattgaaaccttctaaagccttctcaagaggctattgagaccttcccaatgtcttaaacctgacaggcacctagaaacattttttcttcttatacagattcttttaaaaagaattggaagaaactgttcttgccttaaatataacactaacttgaattcctatgtttggagacagtcatattcctcatgaatttttatttcccatggggccttatatggccatgtttgc

SEQ ID NO: 53651 - DNA, 1817 bp, Homo sapiens
aacatacatttcagaggagttgttacctaaaatattatcataaggcataagaaaacacacgatttaagttgcctttcatgaacataattaagaattaataagccagtaccagtggctagtccccagaatttccactgttttgccttttgtgacctgtgttattaaaagtccattatttttacagactttattaaattggatcttattaaagcattctatatttgcatttggtctttcataattcattattattatgacatttactttttaccatcagatctgaaaacatatcataagctacccttttctcttgaaagaaatgctaatttcaaacagtcctctaatagaagagaaaagctttatcagttttttcatttattccagatcgtgttaagaatactaatgctagacttcagtatgctaatatctcagagctttttttggtcaaaagcttagaattattatttttatctcatgctaagtatgaaactagaagacctactactactggagaaaacataattgtaaagtacagttgttgattctgaagacttgtgaaaacgttgctaaattctgttttttaggatgatgctagtcaatttatctttgcacaacactatattattctatttaagaaattttatcctcttgaaattaatgtagtttgtttttctcatagtttaaaggtagtgttgtagtgtttaaggctaagaatcctgccgggtgcagtggctcacacctctaatcccagcactttgggaggccgaggcaggtggatcacaaggtcaggagttcaagaccatcctggccaagatggtcaaaccctgtctctactaaaaatacaaaaaaaattagccaggtgtggtggcgggagcttgtaatcacagctactcaggaggctgaggcagaaaattgcttgaacccgggaggcgggggtttcagtgagccgagatcacaacactgcactccagcctgggtgacagagagagactctgtctcaaaaaaaaagactaagaaaagaatcctatgctgtcagccccagacagcatttagggtatgcttcctgcttttctatatgataatcacttctgtattatgtcagatatgtttgaaaactcaatatagcaagattttacatattgatatcaggcaggctgtctaatttaacataactaataacacaatgagttctttgttgaagtactagtaaatctattaaactacaaagcaaaacttactttgtattttgtctccttttagatttctcactatgtgcaatagacactttggcagtgttgtggcacaaaccattcggactcaaaaaacggatcagtttccgcttttcctgattattatgggaaagcgatcatctaatgaagtgttgaatgtgatacaaggtaaagtacatgtcacaaggagagtaaagccttcctggtatgtgataactttatagtttttccacccaagctgacaatatttctattagtaaatatctttgcatttgaaaatatagaatatcctgaaaaatgtcttcaaaaaatataggtgctataaaaaataatatgctgcatgaaaatctaaaagaaacatcttaataaaattgcacaacccttggggcacaggatgttcaagttaaatgttcagaattgctaaattgtataatctatcaattaggacataatcagttgtcaagtgtgacatttctatttatattgatttattgttataatgttgattaattggaagaagtacttatctttagttatctagaaaatccagtcactgtatattgaagattgaatttttcacagtgacaa

SEQ ID NO: 53652 - DNA, 1098 bp, Homo sapiens
ggaggctgaggcaggagaatcactcgggaggcggaggttgcagtaagccaagatggcatcactgcactccagcctgggtgacagagcaagactccatctcgaatatatatatatatgtagctataattaggagcaaattcaatatgtgtaattttgcatatctttttaacatgcttatgtgctattactatttccatttctagaaactttattttttgttgatcttttacttactagtttgtaagaattctatatataatgagtaaattagcctcttttttgtggtttggaattcagaaaatttccccgtttgttatttatcttttggcctagttatggtgtttttgtttttgtttttttctgtggtgtgtgtgtgtgttttaccatgtaagtttaataaaactcatcaatttttgtcttttatgcttcactctgctccaactatagtaacctccttgttacctttcaaatatgctagatactttccaacttcaatgtcttttatttcctgttctctacacctgaaattctcttccctgagataaatatttcatttcctccttcacctcttttgagtctttgatcaaatgtcagcgtttcattgagactttccctgaccactctattttatattacaacctccccttccctgctttgttttccctccatcacatggagctcacagacttttgagatatttattagtatttttttcagatcagattggagtttacccatacaaatgaagcaagtgggaattaatatttttaaagtggttgactcaggagactagacacttggtccagtgaagctatcattgcccaaaatatttttatgatgatttcttttaagaactgccttcagagacagattaaagtcttacaaagagagtcctgtgtccagaaagcaatgtgtctcaaagtgtggccattaatcacttgcatcaaaattacctggggtggggttggagacgtattaaaaaggctgtttcctgactcaaatctattgaatcaccttctctgtgggaatggggctgaggaacttgccttttaaataaattccctaggtgatttataggccactaaaggtttaggatca

SEQ ID NO: 53653 - DNA, 1049 bp, Homo sapiens
gccaaaatagattatccttttaaaaatgttctttgagataatttaaaattaccaatttacgagccttttttactctgatttggatacttcctacactcctacctagtactacagttataactgcctggttgcacatgcatcgtatttgaatcaaagcatttgtttttaaaaaagagctcattttcctctgcactaatctaattaatgctattcaggaaatatgcatttaactcagatacagttgtcaataaatagcctatgaaaactgttgttagaagctaagatacaaaggtgatattattggcaagccattccaaaagaataacattttaagtttctatcacattctatttttctcatgcactagatctttcttataagtctgttggtgttctccttggtcatctcccaattactctgtgttttgaatattttttgaatattctaggtatcttgattatgagagtcacagaattaaaagaatcatcactgtctcaagatgaagtttgaggttaattccaaacctttccctgtttgtgatctgttgctgaatccttccccattctgtaacccgtcccccgaccccaccagtgtactcatgtatagttatatgcaaatagttactcccaatagctggttatgcttgtattttagaacatacagtttttatattgatataaaacatgagtaatctaatgacacattccaaaaataagataaatatcttattctaaaaataagataaatatcttattctaaaaataagatatttaggctggatgcggcggctcacacctgtaaccccagtgctttgggagtctgaggcaggtggatcacttaaggcaaggagttcaagaccagcctggccaacatagtgaaaccctgtctgtactaaaaatacaaaaactagcctggcatggtggcacatgcctgtagtcccagctacttgggaggctgcttgagcccaggagccagaggttgcagtgagccgagattgcaccactgcactccagcctgggcaacagagcaagaccctgtatctaaataaa

SEQ ID NO: 53654 - DNA, 1076 bp, Homo sapiens
atgacaaggaaaaagtgtacatgttcagtatagacacaatttttttctgaatatttttgatacttggctagttgaatcaacagatgcagaacccacagatgcagaacccacagatgcagaagaccaactgtgtttcttatgtttgttcattgagtaaacactgaatatttaatatgaaccaggaatggtgctgtcatctgagaatgaaaggtggaacaagacacaatcctaaccctcaaaacacatatagtctagtaggcaaaacagacataagagctaatatataatatgaggtatgtacaaggtactttaggagtatagatgaactttatacagagttgctgtacccaagggggtcaaagagggacttgaaagagatgatacacataaagatgaagttagaactttactctttctatttagagatttttatattaccatagtagcattcctagtcttttgggtggcagattttgctcttctttactaaagggcattggtgtttaaagcctcataattacgtatggggaacaaagggtcagtggttgaaataattgaggagagaaggaatagagggagctggctagctaatataatcctctataatctgaaccagattgagaattaaagtcaaccagccaacatggacaaatccaaagaagatgttttgttaatgattcatccagcattggcatatgtctacaggcagacagtgaagcagggataagatattcttttggatatgtaacatgtagaaaaccatcatagatttaactaataaaaatattgttagtacaatgtattcttaatgaatgagtgcttagctatgaaagaataatttcttaaaattcaggacaggtatcacttctgggaagtcttgcctctccccatccttctcttgcctcagtcagggttaaaatgcatattctgtatgctcccataatatatctgtactaacttgtactaatagcactcattacattgtatggtcattgtctatctccctgctaggttgtcagctccctgagggagctatgtctgtaatcccattggtttacacaacttccttccttcct

SEQ ID NO: 53655 - DNA, 2365 bp, Homo sapiens
gagccacagtggacattttctgaaatataaactagaaagaatgcatgtgaactgaatatttttctatctcttcaaatgtcaattacatgtcacatgctgataaataagggcttaatatgagaatacattaaggactttaaaattatctatagaacaaaaagaaaacttgatttcagaccttttcctttcaaatggaagagactatccattgttcagattaaaaccataaaaaatatgtaagaggaattttgtcattctgttttaaagaatattttttctctgtattgttgaacagttcaaagttaatatttctctttacatatatctattaaatgaaaagaatagtaaatccatttcctttaagcaaaatacaattcctttgcaacttcatttgagataggcttgcacatgtcaacagaaatctgcaatagcagtctgcagaattagatataatcatcccagcctttttaaagtgtaagaaagtaaaattttttgatattttagatgctttaggaactccaaaatgtaaagtactctcttagggaatagcatttaatttttgtctttgctgttcatatagactaattatgcctctctaaaatttaagaaatcttacattagtggatattttaattgatcagatttttctcctcttttcagagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaaggtaatactgttgttcacaagttacaagttgggcttctattaaaaaaaaaatcattgtgtttatcatcatcataaacatttttcatcctcagcattaaactctctaccattgcatttcattagacaaaagctgctcgttgcagctaacacatgcagttatttgcaattgtgaaaatgtaccttaacttataaaaactttttaaattcaagaataacctgaaaacaaaaatacatttctcatcttatatttgcagtgcaacagacatttctaatatgtttttgaacttttagagaaacctgatgtttttaatgatgttcagaaaaggcaaaacaagtctaatatataatcctagtagtaagtttattttttaataacttcagtgaagaaggcaggactttctgcacaagtccagtggagttggtaatagcttaactctagcatatgctaattgatgtaatcgctttattgcacacattcttttgcacacagccaacaatacatccatattctcaatagggaaaaaaaaattcctttcctagttgtcaggatgagtttacttagtttgttaatcatagtatcttcaagtgattaacacttcttcatattttgcctatttcagtttcccatctgaaatatatttcatcatgtttaattacacatgtggccgtaacatcccatgatgctactttgggtgtgttaacacaatcataatcacaggctgctggttcatgaacagggagattaaattaattcatttcaaggcaagcatattttagtcacctaatttaaacgattatagaacaattagaaaccatctgatttgtctttttgttattttatggctcactgaatttttggtcatcattcagactttgttttatttaatctgaatcagaaaagaacatgattctttccttaaatgtgaggcaaaataatgttgaagctatttcataatctaatacttcatttctttaagcaaatggttaggaaatttcatgagatgacttcgttttgccttggaaatattccctgttatacataaataaagaatctttagcacctgtatttgtttaaattaaatcaggttattattcacactcagttaaaggtgatgaaaagcagtgccaaaaacagataaaaatgccacatcgaaggtctttcatgaggcaaaatacagagactggagacttggctaaatcttttgccattcactggcagtaaggaatctcctcctttccttttatccacaacttgatggagaaggaaacactatttctaaaccatctgtagtggctaagttcagtgggctacctgctgttattttgttctatcctccatttaattccttagttccttttattttacaatgacaaaaaattgcagtgtagtttcttttgaaaaacagtgtttgagggtttcttttttttatgatggcaatcaacagccatgtaattgctttgttatgttttactaaagaagtctgttaagtagcacaactttgatacactagtaataagagtttgcaggttacagagacacctgtggtgacc

SEQ ID NO: 53656 - DNA, 2402 bp, Homo sapiens
tcatttgttagatggtatacaattaaacgtttgcctccgcacattctttcccacaactttttgagggtaaggaaactgtttcattcatctttatagtctcaatcgctaatacataggtactcttcaaatgttattgaactaaattattaaatgggccaaaggaaaaactggttatagtaatagaaatcaaaacattttcttactcgttttctgtggtactgctttcttcacgaaagcagttttctgattagtttgccatttcaactcttccaaattggttgatatgcttaatccagttctcactcttttggcctgtgcttaattgagctcagtaagataatcagaaatctgagtctggagtccatttatctgtgactgtaatttaatcagatttatatagcctaaatttactagcacttccatactattgagtctttatattttgcttatttattgttataaaagcagcagaaaattttttgttgaaagcttatgtcagagaaaagattattttaaaattattagttttccttttgaaagctactttggggtacccacagcctgaagattctcttgtgatactctttttatcatctcctttctcacattcagtctaaagcttaaagtgggaattttttttttaagtgtgttttcctggcatctcatgtttaacagtgtcaggggtttgtgtccctggaacgaaaactgtttctccagagtcttttttctctcagcttccagtgaaaagaggggcgaggcgagccagtcgcttaccacaaagcagtgccaccacaaaggaaagattaagggtttagagagaggtcaatgtgggtttttctctaactaaacactttcctaaagtttccttgtggaaaaataatgaagtcatctcagagtttttaaagaatttttatttctttttcaccgtctgcattcgcttgtcttctcagcatggatgtttaatcttcctaggctttgtgaattggcccaaatgaataagtggtgagctgtctctctaggagctagaggcttattctaagggcctaatcactgagtaaacacatctttgccctccctctcacaactgcgatataatagtcgagattctagcacagtaacctggatattgcagggaccaatgctttgaaatgcagaatggttgatcctccaaaacagacagtgcctgatcttcgcctgtctctttcttcttttttaaattaaatattgccaaagagatgccgttttattgcttgatattgtgcattagtgccctggatttccaagtttagtttcagtcaacactgtcggctgcacttatagagaactctgcatgttgggtttcttagtagcctcttcggcacatgtgtgtttggtttggaagagcatttaaattaaatcagtgagatagcaatgtaaatcactaatctctttcccaaagtctaaatgttccattgcagtgttcttgagagaaataggcattttaaagatttagccattgccattgtttagttagaaatatgctgatttaaaagtggacagctctctttttcccactgtctcattaaatgtagttgctgagatacgatcaagctgaattaggggttgacatccctctgtctgttcagttagagagctcctaagaagaagagttctgaatttgttaatggtgccaggttcacattactttccctaaagcatcagaattcttgattcatttactaaaactgattttacattgccattgctattgggtatcttttttgccaaggggctgtggcttgtatcagtgttcttgtttctttcatcaaacaggctgggacccaggctagtttaaagatgcaaagaagactgaaagagacctcattctctcttttgagaaatttagtctagaggggaaactggtaaacagttataatactaatggaaggagatagaggcccaggaaaggaagctcttaactctgcctgagggaatcacggaaggtttcatagaggcatttgttttgagccttataggatgagtaggaatttactagataagtatctctctaacaatgtatctgattacaaacttcctagaaggctgatactgttctctgcagacatcaacatagatgaagaaaccccgagtctttcttgttcaccattttattgccactgcttcctgctgagcctgacacaaagagcatttcaacaaatgcttgttgaatgaatgaataaatgaattaacacatagaagcagggtgggatcagctgagctacttatacccaggagtcctgcccttattcccattacaagctgtctctgagtctcagcccaaagcagtctggcatcttcatgttatatgagtgcttccataagccttgactacagtgtggttgatttccctgctaccactgtag

SEQ ID NO: 53657 - DNA, 1088 bp, Homo sapiens
actaaatagtatatttgttagtaccacttagaatttgcctttaattctccaattatcagatctgcctaattaaaattgcaaaaatctttagtgcccatattaaaattatttcttaaattagttcaaaacttactagtttagacatacactgccatttggctgggcgcagtggctcacgcctgtaatcccagcactttgggaggccgaggcgggtggatcacgaggtcaagagatcaagatcatcctggctaacacggtgaaaccccgtctctattaaaaatacaaaaaattagccgggcgtggtggcgggtgcctgtagtcccagctacttgggaggctgaggcaggagaatggcgtgaacccaggaggcggagcttgcagtgagccgagatcatgccactgcactccagcctgggtgacagagcgagaccctgtctcaaaaaaaaaaaaaaaaaaaaaaaaaaaagagttaatacaactctatatgcttaaacacagcttgtttttatgatatataatattctacttagaaacctgtttgtcagacaatatttgatggtattaaaaagctactgaacatgtatacccataaatcattgtaattcttatgattttcagtaagaatgcattattaatatatttttaatgaaaaattattaatttatcttcaagtctttactgctatactctgtcaccttttggaatgtggaagtagatataagtaggctatgggttcttgttctcttcctcagtgtcctaaaagtgggggcgaggagtacacttgacattcgcactccttttgtcatgcttgtttaacaggcctattgctgactaggagtagtgttatccctccccatagagaatagtaaagggttagaaaaatccttcctgcacttttaagagactactgtaccaaagtccttagtactgtgtctaaatgtttacctggaaaaccaatgagagttggcctgacactgcctacttccttgcctacccagtccctcttccagcctccccaaagagcatgcctgcttctctgtaacttgctgtaagagccaatcgtttcagcttctcatgtccttattcat

SEQ ID NO: 53658 - DNA, 1072 bp, Homo sapiens
aaaaaaaaaaagaaaaacgaacaaacaaaaacagttagtcaggtgcggtggcatgtgcttatggtcccagttactcaagaggctgaatcaggagcatcacttgagcccagaaggtctagcctgcagtgagccatgtttgtgccactgcactccagcctgggcaagagaacaagatcatatcttggtgcaggggtggtggcggggggggggcggtgcggagatgagtcttttttttccttggggcctccccacctctcatgcctactgtccctgaattctcttcttctacaccaccaaaagtaccctggagaatcattagacatttatagtaactaaaaatcaacaggaataaaaatctcaatggcagggcttatctcccatgtgaaggattgttcctttcccaagcatccctttgggagtctgagctttgatattagtaatttcattacagctccaaagatctgacttcacaccagtgctttttccaaatattatacataaattaagggactcagtactcaattgctgatttcccacttagtagctctgtggccctaaacaagtaatgagcctatgtctaatatggaaaaaacatgatgatgatagtatttactttatagaggttgttttgagacttaagtgggatgctacccataaatgcacccagcactgtggataagacagatggtgccattaagcagttttggacaaatttgagaaatgtttgtaaaataacaaaactgattttctcattcaattatgaactagttctaggaacagtttcagaaaggaattttgagaaccccatgaacatttctaccacaaaaattagtagttcacgtttaacagtgctcttagttatcaaattttattatatttattttttaaatcagcccattttaaagtcatgctatttctactgcttcgtgttgaaagaaatctaaatgccatcattgctcattgtcttttaagaaaaataagttctatacaaatttgaggccacagctgtagttggtaagtttctagctcaccacacaatatccagaaaaccaggcaaacaaacttctttgtg

SEQ ID NO: 53659 - DNA, 1850 bp, Homo sapiens
tatttttctgatttcctgaaaaatggatattaggtctaaaagctttgttagatttaggtgacatgctttgtaaaataatgctgaatattttattttaacaggatttttaatggttatggagtctcattgtatggccatgttgttatatttaaacaatcacttattagacataaatatgtttgaaagaatatctaattatagtttcaaaataatgtatttttcaacttattctttgataatagtgcatttctctgcttaccagtagttgaagtaaccagaaaatgtcacagccttttgtaacttaaactgtagctcccaaaataggtatagatatttttaaaagcccatttccaaagcttctgtaagatatactatgtatacctcacacattttagctttaaatgcagataacttacacttaaaaatacagtatatcgtagacaaaagaacttttactaagtgtcttgtacagtaaattggcatttggatttattcagactgataatcccctgaggaatataagctcttgtttattaactcctggatatttctaatgaaacaattgattgtttgcttttcttagtgtctaggtgttttagcagatgaaaaattattggttcatgtaattaaatattttgcttcctattagatttgtaaccaaaatccactgacctctctggactgataaaaatgtctttatttctttgtccagggctttcttctttcctcatttctcttttccaagttacagatcaacagtttatgtacagtttattacatttctataaactaaagtttaactccatgagagataaattattcaaaattaaatctaaacaggttcatttattgaagtcatcaagcagattgtatacatcttcttttaactgtgtacgtatagtaattgtaatgttacctcagaattctgtgatgctctgtggtttataaaacatgttcctatacatatctcatttgaactccacaaccaaacagtgaaatagggatatataatcctcatattcccattttagagatgagaaagtccagaaaagctacatgacttgcctacaacacactgatagtaagtagtagggaccaaataagagctcacatgttccatgacaggtaaatatggtttacactatcccaccacacttgagttttcattgctaactgctgtacttcaggatttaataatcaaacttcatctctccttttcatatttcacacttgagagttaaaacagattttgctcaagattattttttaaaatttttgaatgaatcgtttttcagaaaacagtttgctcatgttcaaacattttaaggcaaatatgacggatactgtggcactcttactaaattttcttcatcttaaatatcacatgtttaatttaaactgtgggaggggaggtacattaattttaccagggcaacagatgagcctcaaacaccagcattcttcacttgaagtgagaaattgagttccaagagtaaataaaaacaagattgaaggtttaaatcctctgctaggctttttgaacttatatactcattaaatgtttattggagtggtgggattacaaaggatttggggagcttcatcaactggtatatagttaatcactaagtaaaacactacatttgataaagtgtttctcacgatgccacattcaatccatcttaatgaaaactgcttcaaactgatttcatttgagagcacttggtggtgagagtactcatcgttctttttgccttttttcttgaggaatttacagtactgtacgaagcagagcttccaactttggtaaagtagttattctaagttttcatgtttcttttaagtatatc

SEQ ID NO: 53660 - DNA, 1090 bp, Homo sapiens
aacggtacccatctttggaaggaaaaaagtaaactaaatgtaccatctctttcacttccacttacaagatgtgtactatagaataacaagacatgctacgtgcaaaatgaccactaaaataataatggcctatttactttgtgaaattagagaactcctgtgggcagaaatagatgtgatgtttacataaaattggttattttcccaattaatgaagtctttaaaataatatcagacccatttaatataatttagtcacaagatgtctatttcaagaaaacattgaaatcctaaatgacaactgggcacatattttaaatgcttagcaggattgtgtccattggtttttcaaaatttatgagcttggaatattttaaggttctttttgattctggtttgatgagatctaatatatgttgagttaaactatcccctcagatatatcacagaagctaaaatttaattttatttcctctttattgattgaatatatttcttatatgtgggattagatgttatgtggtttgtttttgtgtctatttgttttgtttttttgtttttgttttttcttttgtttgttttttagtgccagaaaacgcagaaaatgaaggagatgccttattacaatttacagcagagttttcttcaaggtagggttaggacattaactatataaatttgatgctgttttatgctactgtgatttttcttgggcaattttaattatagattgtttaaagtttctccttaaagtattcaaaggatatacttgttaatttatatagtcctaatagtgaaacacataaataaccagtaaaccatttatgccactttagagatagattcaacttatttctgtatgtttatggacgttcaataaatggatcctaatttaatatttttattatattcccaaaggactaggatataggatagtaatttttagtatatcttaggacagtcaaatggaaaatcctttaaaataatattaaatttaaaaatactttaaacattttaaatccaagtgaattttttcctttatttttttcttttggaattgctttacatttcttccttaagtgtcaaatat

SEQ ID NO: 53661 - DNA, 1003 bp, Homo sapiens
cactgtaaaagaacatgtggtatatcttgtaaatcttgagcctttacctatttaagactaagcctcaaatttaaaggcaacttcattctccagatatttgactacctgaaacacagcgggaactcaagcactgttgtcctagtaaatgtgttgttttgtggaggaggctctttcactgctctaaaatgagaaagcattgtggatttttaagctgttgactagcttaaaccaggagatcttagatctacgaacaaactattaagggaggaggaccagtgtttccgtgagaagtagagttaagatggcaggtaaatgcttcagggaaggaccatttatttattcatgcaacaaatgtatcttcattatcttgtctattcaaagcattagaaagattgtcttaaagttgagagggaaaatatgattatgattctctgcattaatgcttgggtatgcccaaggaggaaatgctgacatttgacactaagtcaaatgagaaacatcttgactttctcatttggaactcttagaatcactagatgagcagttttaaaaagtgtttcatggggtcctgagatcctctggctataccccaggtgtcaacagatacaaggaagaaaaggccaactccaagagcattaagctccccattgacctctccctgtatcaaccagagtagtcctacttttatgtattgtaatattttgtttgggcctaggggagggaggaaaccctatgaaaataagttagaaaaccgccgatgacagatttttaagatccttccagctttaaaatctatgattcaacaactgtctaacctctgacattccctctagctaaatttttatgagtcttttatttttgagccagggtctcactctgtcactcaggctagagtgcagtggtgcaaacaaggctcactgcaaccttgacctcgtgggctcaagtgatcctcctgcctcagcctcccaagtaactaagaccagcggcacaccatcatgccaga

SEQ ID NO: 53662 - DNA, 1086 bp, Homo sapiens
aggagaacttttgtaactactcaaatataaggcagcttcctttatgataaaacctaaacttagatttttgtatatttctgatatatgtatcttatggaaattttaaattttgtatctcacctacaattttatatttctatccctactgccttcggagttaggaaaatgaggtattattctgctaatcagaaaagtagcagacgcacattgaggcagtgggggattgggggcaagtatgtatgatttgccttattttgggctcataccagtttcctagaacctcagtctatcatctaatgaaaattagccttagctaccataacatcccatgtgtggaaaaatttcaaattttcaaagccttcctggtaatgtaatacccaggatactagagttagctttctaatctagcttcagcaataatagaaaatacctgaaaagtcaaatccttttgtgaaacatggccgtattttgtttacaaatgatggattctactttttgcagatgtgtcttgctgaatcagggctctcttatccctgccatcgacttacagtgggaagaagatcttcacctgcacagacccgggaacagtcggaagaagtaagcctgtttgccagcttttctttgaacagaaggcccatcccccacctacctgcgcacttccctttttttttatctgccagagcaatgaacagataaagttaatgtagcattaattaaatctcggtaaattcttgaaggcagaaactgtccatgcaaggttactactaatgtgctccttctcgctctgttagtttcatgtttcaacagacggaattcagatggattggttgaaatgatttttacttagaaccatcaggctaacaaagaactttctaggctgggcacagtcactcacgcctgtaatcccagcactttggatggccgagacaggcagagcacatgaggccaggagttcgagaccagcctggccaacatagtaaaaccccgtctctactaaaaatacaaaaattagccaggtgtggtggcagacacctataatcccagctacttgggaggctgaggcatgagaattgcttgaatccagca

SEQ ID NO: 53663 - DNA, 1791 bp, Homo sapiens
aaaaaagtaagtcaggagcatttaaaattactatatatatttccaaaagcttttaaaaagaaaatatgagataattaaatcaagatatttgttagtattttacaattaactgtaacatctttaaaaaacacatagctggctgggtgtggtggctcacacctgtaatcccagcactttgagaggccaaaagggggagcccaggagctcaagaccagcctgggcaacatgatgagactccatctctacaaaaaataaggagaccctcatttctacaaaaaattaaagaattagctgggcatggcagcatgcacctgcagactcagccacacaggaggctgaggtgggaggattgcttgatgctgggagatcgaggtggcagtcggccgtgattgtaccactgcactccagtctgggtaacaaagcaagactgtctcaaaaaacaaaaaaagaagaaaaagaaaaaccgagattaggagtcaagaagagaacatgcttgtgctatcattaagcagatgtgagacttgggacaaacactttacctctctatacctcagtttcttttcctgttaagtgagaggattagacccttatcttgtgaggagaaactgcctttcatttggaatctgttggggatggtgggatcactgatagaagtttaagagaaggctgctgataccttctctctggaaattcttattactagcttggaatggggcaagggagatgctgagtggtggaagatatggcagtagcacttgactcagctaaggcttcaagatctcctggttgggatacaagcaactgatgaattctgaggactcttccaaatctagtatcttgtgtgtaaaatgaagccatgtatagcagccatccttgtttcttccagctccggttgcttacatggtagtgtttgtgtttatgtacatagcaaaaagcctgagaacttgtaactgttggtgtttatttcattaaactttaccaacttgccaaatcaattgaggactataacgcagcaaggccaggcagagaacacagttttttgagctatttacacaggagttttgttgataattgatcttgacctgcacatgtcttttaatattctgttggttccagaatattattagtcacttcctttttaacagtgtgcttttttatgaggtgactaaactgctgtttaaccctgctacaagaatgtggcagtgggctagtccagacaagtgcatgtacacttggtaactagcattcttgataagcttgcttcaacctgccacaaattaaagctctgtgtgacttttctagcacataagtgacaaaaaaaatggctgggggaagggcagaagaaacctcggattgtgaataaaaataagctttttagagttgcgctttggttggcagtaaatgaaattttagcctcatgactcagttcggtttaaaactacctcagtaatctatttagctgaacagtaagcatctgaaaatttaaaaggggtattctagaagtcatcttcaggactccttactataaaaaaccttatctacgttggaaatgtgatgtaatagaaaactccatggcttttggagttaaatctggtttgccatctggtacctgatttatcttggacaggttactccactactctaaggttgttttatgatttgtacaatcacgatagtctttaatttacagagttgtcatgtatggtagacatatgttaagcacttactatgtagtttctgactaatggatggtatctaggagtagctgttttaattaagccaaagaaagta

SEQ ID NO: 53664 - DNA, 1050 bp, Homo sapiens
tgcctaagaaatagacagatggaaaagaatggtgagggaaacccaggcaagagtaatggactgagcagaagcctaagagtaggcacatgcaaggcacatttttggatcattgagcaaagaaacctgtatacaaaaatagtgggaggtaatggctggaaaggtgggcagggttatggccttgaacatcagactgaaaaagttttcagggtgagagaaaacatgagaatcatctagtccaattttttcatcatacaggtgataaaacttagagaagaaagtcgatcaaggtcacagaatgaataagaggcagatttagagttttaacccaggtcctttgctctatatatagtgtttttcccaagtatttacacacctggaatcataccacaggctgacttatggcagaaaggagtcatacaagggcaccatgaagcctaaagatgtaaaagaacaatttttgctttgctttaatggtggcaacaggaaaaaaaaaggtggcttacaggctagttaaatgtttttaagctaaatgttctcaggaggcttaactggtccctcaaagtcattgcagcagacagagatacctttttagtttttcatttgtttgtttgtttgtttttgttgttgttatttttgcctccaatagcctgttgttctttctctcaattttggtttagttcctctcgcaggaattgaatgggaaacctggagcaagttccacttttggacatggctatgtaatgtatcctttcgaaattcccagtcgtaagcaggtaatgagtgatataagatatgggcccttagaaaccctcacagctcagccaggcgcggtggctcacgcctgtaataccagcactttgggaggccgaggtgggcggatcacctgaggtcagaagtccgagaccagcctgaccaacatggagaaactccgtctctactaaaatacaaaaaaattagccaggtgtggtggcgcatccctataatcccagctactcgggaggctgaagcaggagaatcgcttgaacctgggaggcggaggttgtggtgagc

SEQ ID NO: 53665 - DNA, 1073 bp, Homo sapiens
tcactgaggcccagatgtcaatcagatagttatttaaactctaatgatagtttttagtgtttatctcactttggagtggtttccaggccttggattataggactaggtaggttatatatttctctagaaaattacaagtctttcatattttatcttggcaaggaaagtaggaaaagtacccatataagttagagcattagacatttattgcatggcatatacaaagcaacctactaagagccccatggcagctaaaaatgagaatataagatccaggctgtgtcttcaaggaccttagagtcacctaaacacagatacaatgaaagttgtagttcttttaaatcacaaaacactaattctagagcttcacaataacggttttaagagttgagcagaaggaaaaaaattacttggctaggctgagccagcaaggattaactggcaaggtgaaattactttttcttgtttctagatagtacccatttatgctggtgtgcctaacatggtatagttaattcagactcttttttcctaggaggaaaagccaggacaagatgcccagcagcactatgtccatgtcccgagaccaaagttgttagcatgactgcctaggttttgccaaggaattagatgctgctggaaaaatatccagagctcttatatttgctatccaaagagttccacagtgttgaggggtaaatggcatctcactattgactagacatgagccaagtggctcgttggtacccttcatgcatacaaagcaggcttgagatgtatccttgcatatttgaaggttctgtggttatgatgagctgaaatgaccactgattaatacagtagctctctaaaataatgaggtttctccactaacggaacctctttatttatcaaacttataataaaatgaggaatctgcttgaggtaaaataaccttttcattgtaactgaagatttcgtcttgattctctgaatttgttgtgattgtagaataaggcaaagggcttgttttgataagatcctagactgttataatcaatatatcatgtgttgactttatatgcttttgttaa

SEQ ID NO: 53666 - DNA, 1888 bp, Homo sapiens
gttattagacgctttttccataattgctgacatttatccagtgtttcacagtatttgctaatgtattaatgcagtcaatctctgagaggctgcacatgcctttttagccctggcttttatgggattctgaaattcatagacccacagatacttattccctgctggttgccgtagtgacagagctcagagataagccaagacagagcccttttgtgattgcttttcaggtgacattcagcggcagcttgagtagagtgtccttttatagttcctgtaattcagaaaatgataacagctttttgctgcttagaagagaagtctgtggactgctccccttgggattttgttttgctgtgccacttcataccaacaccagcctgataaagttcttattattgtggagatttcaaagtgcaaggagatggaattaattatgacaggttagaagatacaggactgattttacgaataaaactttaaagaatcaatacatgttcgccaaccatatgtaacaagttaatttggacattttaagctattagtggcaatacagttagccacttgtttaataagtaaatgcacccaacttctaaattgcttgtgaaccctgctggctgttccatccaaagtgcagaaattatctttcagttctgttaccattttctcatttgaaactattgcttcaacattttgttgtttagaggcaagtagctttattttaacattttcttggttggggtatttataatttcactattctcagcattgcaataattaaaaatagataatttaaaaatagcaccttatctgaattgcttcaaattcagaagaaaacacctgtgatgatggagaagaacactgagaaggaaagcagttcgagaaataactagagaaaatagaattttacctggaaagatcatagaggaggtcataagaagccaatactttcacctagactgttaaagctaggagagttattaatcttaattctggaagaagaagaacaccacaaacaatgcataagtgtgggacaccttgagagctggaaaccactgtctgggtagctgatgttattgagaaagaggcaaaagaccaaaaacaaaataaaacaaaaaatgtcaagaagaatcggagacactaccccaaattgaaccatgcgaatctgctgggagataggaagcatttagatatcttacccctaaagtgtaaatgtaattcacagttaaactggaagcaagtagaatgaactaaatagagaagtaacttgagaatctgaagagattaaaaagaatagatgtgttcccaatttctaatagatgtgttcctgatttattgatgaacaagcatatggattgcacatgaatgagggttcagaagagcaatttggcttaataaaagccaatcagttatcttgaattagatgttcagttgaaaactggagatctgatttgtgttactcgtttctaacctttcagtcttatttagaatagatgtaagctaaactctcataaaattcaaatatttgtaattcagactaagaaaggtaaccttcagactagtgacaaatatgacattttcaaatgatatttagtagacctttattaacactctgttaccctatagtgttcatcgtaccccttacttcttattgttaacttaatcatcagtcatttgctttgatatacagtagtcccccttattctcaggtgatagatttaaagactgtagtgaatgcctgaaactactgataataccaacctctgtatatactatgttttttcatatacatgtacatctgtagtaaagtttaatttgtaaattaggcacaataagaaatttgcaacaataatagtaaaacaggacaatcattttaataataaaatcaaac

SEQ ID NO: 53667 - DNA, 1043 bp, Homo sapiens
ttcttgtacatgatcttatctgagccaagtagtagattataagtgactaatttttaatagaaattatatacagtagaatatagttactatctgttatcctaaattttccttagggttgcttgaaaccacccttttctgcctagtgcttgtaatcattttccttctatgagactgtgaactccttgagggcaggaaacaggtcttagtcatctttgtttctaaagtgcccagaatgcctctggagtaaaatgaatagtaaaagtttcttgcattatattaagcatggcactgaaaaatcagtgattggctctaaattgcatttaataactgctagcccagtattctaatacatattactgctttctccagagacacccctgctctttaaaacaaacaaaaaccacaaacaggttcttttttgttacagagaaaggtcttgttggcagccttgtacccaaccctattttataactgaaaaatggaaagttgtttataatacatatgtgcactacttaatctctggcatttgtgtttgcaagctaacatgctgtctattgcatttgaacagctgtaacatatgtgatacgatttcttaataagtcattttcttgagcaatggaaatattgctgaagtagtagtccagcttattaagttgtacttttagacccttgggttttaaacataatcaattacctataattctgtatttgagaaagattgtgaagatagcattataaactgttttggaggtaacagaaattctttttttttttgatgtgcaaaaatagaggggtgcttacaactgtgtttaattggctgtaaagtcttacaaattttctcacccaaaaggaaggctgaaaatgaacatttatgcatggtaagtagccttttgaacccaaggtgacttaatcaacagtcaaatcaattgttgcttcgcatcatgacattgtttaatattctacatgtagaatatatatagtttttaaaaaataaatatccacaggagattgctggtactgattgttcccagagccaatgaaag

SEQ ID NO: 53668 - DNA, 1154 bp, Homo sapiens
caactgttttcagatattagccaacaggactctgaagaaggaaacaagagttctatgagagtcttaaattctgcctggaggcaacttctggatcccatagcaggaaagggaaagtaaaacagaacttggtaatttcgctgagttgaagggacagagattggagttttgggaggctccagcggctatattttgcaaagcagactaccagcagagaaaaatctccagaaatctgcatggggttccccaagtctttagctgaataccagtctctgtgcatgcatagggtgaaaatccagaaggctaagcaaagagaaattgttaggaaaaagagtagttaactggagctataaggtaaacaatccccagagtttacacaaaactaaaactgcttcaagtttcttccaactacacattgtagagacacctcagtgaatacacagggcattcagtagctatcttcagaagagttaacaccttagtggagtggataaattggccctagaatgaaggctactccaggactttttaaaagcttaaaaagaagcctgaataaggaataagctgattaataggtaactgcctctaaaaacaaagtccagcatccaattaaaagttactgcacatacgaacaagcaggaaaatctgacccataaccagaaaagaagtcagtcaaaagaaacagacatggaagttacttagataatgaaattggcagacatggactttaaagtagcttttataaatgctatgaaagtgctcaaggacttaagtgaaaacataagaggaaataataaaatatataaaagagaacaaagtatcatggcagggtgggagtgggggcagcgatggctcttgtctgtaatcccagcactttgggaagctgaggcgggaggatcacttgagctctggagtttgagaccagcctggccaacatggcgaaaccccagctctactaaaactacaaaaattagccaggcatggtggtgcatgcttgtaatcccaactactcaggacactgaggcaggagaattgcttgaatctgggaggcggaggttgctgtgagctgagatcgtgccactgcactctagcctgggtgacagagtgagactgtgtctcaaataaaagaaaaattttttttaaaagaacaaagtaac

SEQ ID NO: 53669 - DNA, 1009 bp, Homo sapiens
atgggatcatagaagagggaacaaccaattttgctaacagttagtggtagtgaaaaaatgacttctcagtgaaagggacatttgattatgttttaatttgtatacttgtattcctccttttgtaaattataagcattggaagtaagaaatgtcttcacatttatatcaaagagtgttttaggcatttatttaaattgcattcatttatttaaattgttcagtgctccacaaagttgacatctatggcaataaacaactaaaggatcgatttgtatgagtatagtaattggataaacattttgagaatcatttatttctaataaaaattaagttatcaaaactaagcattttatagcagcaagtagaataacagatttaggagtgtgcagagctacattgtgagccgatttttaccaatgtgtgtgtgtgtatatatgtatgggtgggaggcagaggaaatggaggtggaggagaatgcaattgagcaaaccagtccaagtttgttgaatcctaacattactattatttagatgttacttaatgtttgagcttcagtttctttatctacaaaatggagatgatattaacacacttgaaaacctattgtgaagattacatgggttaacatattattaggtgggaccatatgaagttgccattttttagggacaaaaatggttgcagattagaagtttcatacaattatatctaatatgtaaagcacataatataatgcaggggttgacagttatgactgtgagcccaaatctcactcagcatctgtttttgtcaatagtattttcttgggacacattcacaccgatttattttttttcttccttttttttttctttttttagacggagtctcactctgtcccccaggctggactgcagtggcgtgatctcagctcaccgcaacctccgcctcctgggttcaagagattctccttcctcagcctcccgagtagagtagctgggactacaggcaggtgccaccacgcctggct

SEQ ID NO: 53670 - DNA, 1045 bp, Homo sapiens
aatcccagcactttgggaggccaaggcagacggatcacgaggtcaggagttcgagaccagcctggccaacgtattgaaacctgtctctactaaagttacaaacaattagggccaggccccctaacttttgagatggagtttcgctcttgttacccaggctggagtgcaatggcacgatcttggctcaccgcaacctccgcctcctgggttcaagtgattctcctacctcagcttcccgagtagctgggattacaggcatgcgccaccacacccagctgattttatatttttagtagagctggggcttctccatgttggtcaggctggtcttgaacttcctacctcaggtgatccgcctacctcggcttcccaaagtgctgggattgcaggcatgagccaccgcgcccagccaaagttaatatttctaaatagaagtacaacatgaatcacattcagccttgcttacttattttcaatggctcctttatgtacagatttttatgctggcattcaaaacccttcattctttagtctgaaacttcccttccaggtttgttttcccatacaggctctgagtaaatacttgataaatatttgttgaatgaatgattgaatattacaccatatgtgtctcagctttagctaaatacttatcttactatttttcgaatatacttggtactctcccactctgtcatttaatcatactcttccttccacctagaatacctacaacaattatctccttccttgaagacctttttgtttttttgttttgttttgttttgttttgttttgagacggagtttcactcttgtcacccaggctggagtgcaatggcacgatctcggctcactgcaacctctgtctccggggttcgagcaattcttctgcctcagcctcctcatagctgggattacaggcgtgtgccactgtgcctagctaatttttgtattattagtagagacggggtttcactatgtcggccaggctggtctctaactcctgacctcaggttatccacctgcctcggcctcccaaagtg

SEQ ID NO: 53671 - DNA, 1314 bp, Homo sapiens
gacagtgtgccataacttaatacttagaatggtttaactttcagagaaagcacctgaacatttgcttcctagtgccagagtagaggattggttataaaggtcattaaaagtgaggtcattttgtacttttattgctcagttgaagaaatttgtgtggctttaaatatacagtagccttagatatcattggattctgtgaatttatgaaaataccatagatcaagaaattaatggatttggggtgatgaaaatgttctaaaaattagattgtggtaaaggttgcacatctctaaagttttaaaaaataattgaacatttaaaatgagtgaattttatggcatataaattatgcctcagtgaagctatttttttaaaaaagaagttaattaactagattaaaatactttttcacttacatttttatcctgcatgagaaatactttgcagtaacacaagagatgttttgttcagtatacttctcattaacctttgactcacccaacaggagaaagaaatagacctcttgtaatcaattcttttataatcttgagtctcttatgaacctaatagacttcagtcttgggcattttcaggttactcagtgaagtcaacactcatttacaacattgttgcccatctcccttcagagttaacgtattttctttgcttgtggttgtactcgaatagggtgtgggatactgtatgaattgtcagtaactccgttccttttgtactctttgatcagggaaataggtatctaaagctttaccagtaggaaaatgttttcatgctgtgacagttcagctgtgagaacaaggagttacaagtaggcaaaatctcattttacactttaacaaggaagctcttggtttctagataggagaaataattttaacactgtgaattatgtttagataccttattacaatgcagacaatatgaatacatgtagttctttttaaattcctggatttaataatgcttatacaaagaaaactctttcagttttttgtttttatttttatttatatatttttttgagacagtcttgctctgtcacccagggtggagtgcggtggtgagatctcagctgactgcaacctctgcctcccaggttcaagtgattcttatgcctcagcatcccaagtagctgggattacaggcgtataccaccatgcccagctcatttttgtatttttagtagagacagggtttcgctgtgttggccaggctggtcttgaacttttggcctcgaactcttggcctcaagtgatcctcacctcggcctcccaaagtgctgggattacaagccta

SEQ ID NO: 53672 - DNA, 1222 bp, Homo sapiens
gcagaactattatgaagataagtgataatataaatacagtacctggctcatagtagacactcagtaaatgagtcgacattataattaagataactgcaaaaaaagttattgtaattacagattacaattacaggcaagaattggctggtttaaagaaatgaagtgatgtctgagacttgcttcagaataacctatgtgtggcagagtgagtgaggatagagctaatttagattaggcatctatcaatcattgttgaatctaggtgatacatatattgggtttattatactgttctctcaacttttgtatatatttgaaaattttcataataaaaagtttaaagcaaaaatagttgtcttgtttaagagcagggacataagataatagagaaactctggaaatgtggggcttcacagggttggaaaagccaactgcttttgcaccccacccttgtagaaaccagactgaaattggcttatcaggtacaagttccaagaatgataggcaaagtcgatgaaatatgatcaattcttctgcctgtaaaatagtgccttatacattttaggtgctaattcattgaattgagttggcatggtcttttatgagacccatgttttaatggtttttataacatttaattttttgccaaagagttgtcatgcagtctaattactataggaaaatatggaaagcagctaaaactgtttgtttccaagactgtaatactacttggtgctcttaagtcacagcaaacacaagagggaatccctattaagaggcttgattcttttagcctcattattgccatttgcaccttgtcccagaacctgtgaagtggtgcctgcccacacctccccagagcaaatgttgcggcattggcagggtgttgccttgagcttgcatgatttgatacaacaaagatgtttagggccaggctgcttttaactgatgccacagcagattcactagctccagtgcttgaatttagccaaaaatggcttataactagtattctgaggagatcctggccaaataatatgtcgtaaaacctttttcattaggagtataaaaactcataaaactggtacttgtagtctatatttgttgcaggcggtggtgtttttatacttactgaaatcattcaagtggaggcatctgctacaaaacaaaatagtcctcacagcttagggcatgaattgggtacagctgagaaatgtcagct

SEQ ID NO: 53673 - DNA, 1573 bp, Homo sapiens
aaaactaagttacagttattagaatgaagaattcatttagaggcaaaagattttttaaaactgcagaatccagtcagttcaaagcctgattgaaagcaacttcaattttatagatttcttgaaacagatcttcattgttttctggaaagatagtatttgagaaaaagaaatgtctccagttactgtttttatgaggagagaatagcttggtctttttaatggttaatgagaagaagtaatagttaaacacttagagcattgatttctgatttgaattctccaacacaggccagccctgggggaagggggaagaaaaaaaaagcttgctaattaacatttgattactgatgccaccttctcattccccttgcaccatccggtttcaagcgttttttgttcagaaaggattttaaggagggttttaacttgcatcttagtaaaacaaatccatgtgcaactgcaacgtgtatacaatacttttaaaaacaagaggaaaagaaggccttaggtatgaagtatgtgttcagaacgcattctgaatcacttctgattcagaagtgactgctttcttaactataagcctttcagagtgccagtgattgctaggatactggaattaagcctagtttgtatgccttattttgatttaaacacacacacatacaaatacttatttgctcaatgcagttatttaacaaactcttaaccagaacatctgataatgcgatgcactgggagcttaagtttgatatatttaaaattcggtctaagctcaggttttcatatgaccagagtcctttttcttctaagaatgataaaagaatgagatggatggctgtagtttcagggtacttttttgtaagggctgtactatgatgtgcgatagtatcttaattcagaaaatctagaaactaaagcactgattactgaacattttgtttttgtattttgccatatcaaaatgtttgatatgtgaagaatcgtgggccagatttcaaaaaattttaaatgttgagataaattaataaaacttgaaaactatatcacagtagcgttctggcaaaatcatataaccactttgatgacattagattgatagaatagttttctgggaaaccagtgtgacaggctttatttttaaatgagatctcataaggggaaaatattagtgttttttaaaaagtataataaaagtaaatgccaaatctcatgcaaaaaaaagtactaaaatgcttattatctttatttctcatgtgaaattatttgccatttttctttttgatgtctgttatatttttttctattgtttctccattttgtagcattaatagttttaaattttctctcattacttccttgtcttgtatatgtttagcacctcttttcctgtacctaggattaactccagtattttcacgaaataataacattttggagctttgaaaatcagaaacgatcatgttttattctcttctaaggtggagtacatgaggtctcagaatggctccaccaattttcccacagtaacagttgagcagaactaggattagaaatctagttctctggctgggta

SEQ ID NO: 53674 - DNA, 1075 bp, Homo sapiens
tagaaatactaacttttgctttcttgaaatcttattttcccccaattttttttatcaactatatgtttaaatcaacatttttttcctttgttgttccattaagatagtcaacatctgacaatttttaccttaaaacttttaagttctgtgatcaatacagtcaaagtaatgcctctaggtattattcatttttaagacaacacagtctatgacagtgtctctccatgtgccttttttaccatgtacagtgaaaaactacttattaaatggtgattttcccccctttatcttattaagtaaattatatggtctttttttttatggaagcctccatagttagagatgtaaaacagcaatttcttggttctatagcatgacatagttcagagctgagattagagaaaccccgtagagttgttaatacttgagggcatccccaactagaaaagtatgtgaatttaggcatgggaggaaggaaggatctgctttaaatttagtgtagggtcactgagtcttaatgatagattaaacaagggaggtagaataatgaataggggtatactgtgtgtagcactaataccagaagtccatggtttgtggcggttttttaatgtcctttcccatatggttttgaatagagcaggttatggcagggatgagctaaggaatagctttgttaatggataaataggagtaattttttaacaggagacttcaggcagtttattcagaatgcctccttatttaatgaatcatgtggttaaattttttttcctgatcttaataatacattaagtgggattgctaaggtattcctggtattttctttctaaaatagctatatctacatttcagagccagccctaacagtgaatccttgggttgggttttactttcttaattaaaggccagtcgtatggagcttttgagcattggcagcatcagtccttagggtttggtgtgcagtagtagactttctttcatagtgtcaattcatttgatacgatttaattaaattgtcatttggagccagtttccaactctactgtattcacctaaacttaactaggtgtgt

SEQ ID NO: 53675 - DNA, 1276 bp, Homo sapiens
taaaaatacaaaaattagccaggtatggtggtgggcacttgtaatccctgctacttgggaggctgagacaggagaattggttgaacccaggaggcggaggttgcagttagccaagatcgcgccactgcactccagcctgggcaacaaagagcgaaactgcatctcaaaataaaataaaataaaataaaataaaataaaataaaataaaatagtacaaggtgacaggggtttagcattgctctagcaatagctgttctcatcttttctttttcaatatagagtatgaagcatgagtgataatgttggggaattgagagaatgatgctctgaaataagtgactttcattggctatgattgccaggctgtgacaattttcaaggatagacaacctcaaatttacttattactgtcataatgcagtaaaacacgccaaaaaataaaatatgatcaaatgcagttaccgtttattttggactgcatgacaatattcacttgcacaaaaccatataaacaacacccacctgtgtttgaaggcaaggtatctttgatcagaatctctgaaatatccctttgagttagctatcactatagcaaactttattaatttgtacctgacagtaatttaggatttatgattatttagttgaactaaagcataaatatatgaaggaagagttagccaagtaagtgaatagtgtgagtaacaatttctttggcaaggagtgaggggaggggatgatctacagaaaaagaacagagttttccagtttcagtttttagggatgtgtcatggtacaataaaaaaaaaaaattgccttggggcccggagcaatggctcacgcctgtaatcccagcactttgggaggcccaagtgggtggatcaggaggtcaggagttcgagaccaacctgaccaacatggtgaaaccccgtctctactaaaaatacagaaaaattagctgggtgtggtggcggacgcctgtaaccccagctacttgggaggctgaggcaggagaatcacttgcacctggctggcggaggttgcagtgagccgagatcatgccactgcactccagcctgggtgacagagcaagactccatgtcaaaaaaaaaaaagcctcagagtcacatagatttccttttgaattctgcttctgctacttactttggagagtttgggaccctcagtttattttttaaagagagaataaaagctgcattgaacttgatgatggtattagagaatatatatgtaatgtatatatgttacttgatat

SEQ ID NO: 53676 - DNA, 1038 bp, Homo sapiens
ccacacctggctaatttttctatctttagcagagacggggtttcaccaggttgtccaagctggacttgaactcctgacctgaggtgatctgctggcctcggcctcccgaagtgctgggattacaggcatgagccactgtgcctggccctagtttcattttcaaatgttcatatgattgatttccaaacattaagacttggttggaggaatggctggcagtgtgaaatgttaggaaaaagacccactgatttttgaagtcacaaagaataggggttcaaattcacattcagctctaccacataataaagcaatttctatacccatagaattgatgtgagcatgaaatagagtaacatgcacagtacctggaccagtgcctctgctactcaataaatggtagtttcagctactataatggcctcttataccttattgatatctttatcattataactatcacattgtatcataaacatttgtttctggatatgacttttagaggactgtgtgttcctttaaggcaagactattgtgtctttatctatctttgtatttctcctgcagaggttgcaaactggcaaccacaagattattttatttgcaaccagtttgggtcccagcatgttttaaatgtgcactggttgccaacatttaaaagttaggaggtttcacatttaaaataaaatgaaacaggattcctgacttctggcttcttgcaaagaatcagaaaatcctggtaatgctgaaccctacattttctataacagcaatcagctagtctggagcagcatctgcctctttggataggcaatgctctctaatttgccatcgtccctaacattccaatattgtatcctcgaaacaaaggctgaatgccatttgcccatcacatttcattcatttgtgttacttactgggcggctcttgaaatttgcattttcgactgctgctctagtgactgccagagagtctggaactcaaggaagcactcaataaatgtttgttgaaaggaagaaagaagaaacattaatatatgca

SEQ ID NO: 53677 - DNA, 1036 bp, Homo sapiens
tctttagtaattaaaaaagtaaacactgtgatggaaaattgttatacttctgaatgtcaatctgaataaatgaaataatttcattttagttcttattactaagttttaaaaatatgaattggggctggacacggtggctgacgcctgtaatcccagcactttgggaggccaaggtgggtgggtcacctgaggtcaggagttcgagactagcctgaccaacatggagaaaccctgtctctactaaaaatacaaaattagctgggcatggtgggcgcatgcctgtaatcccagctactcaggaggctgaggcaggagaatcgcttgaacccaggaggcggaggttgtggtgagccgagattacaccattgcactccagtctgcgcaacaagaacaaaactctgcctcaaaaaaaaaaaaaaaaaaaaaagagcaactagtttttatcgaattatgcagttcttgccatcttccttgtattctatttacaaaaatggtgagttttgtgagatatgtaggctagaggcaaaacagattctctacagtaccctagtcagtcaatgaacttacccttccatatatgcttggcactgacactaatgaacttgccccattaatatatgcttgacattgcctgacccatgagttaataaaactgacattgtggtttcaatagagtacagttgcctggttacccagtctctatacacttgcctatgaggctgatgctgtttgaacttatgaaagattggagaaattcctatgcagtttttagattctatattatgggatagttcaaggggggtgggagtagttaaagctgggtggagcaggtaagggcctaaagtctagagttagttttgaatgaaaagtggttatatcacacagtcttaagttatccaaaacatacaaattagtactttccctttgtaatttacacatttggccagattttcttctccagatctttcttctgtgcctagccactagttgctttttaaaaaatacattttttggtcaggtgtggtggctcacatat

SEQ ID NO: 53678 - DNA, 1344 bp, Homo sapiens
ggcaaatgtttgttggggttgattaaaaagaatctaatgaagaaataaatgtgatttgactaattccagaagaagctgagacaggaacctagtaaagcttttgacatgactgtaggcacccaagagaacattttctccctccaaaacaaggaaagactgtataaaggaaaattaggcctgtttctgggaggatatgtagcattaagttacctttgcttgggaaagtgtaaaccttattttttatgtattttgggagaggagcataagatatactccagaggaaatccaggattacactatggaatgagagagctaggcaatgttcaaaataagattctatcttacacatgtaatacctcttccattgttagaaatcaaggtgccatgatttcctatttgacttatataatttgaattgttttcaagttgtccatgtggagaatcttaaataatattgatagaatttcccttgcctagccatttaataccaagtagttaaaaaaaaaaaaaaaaaaaaaggccaagcacggtgactcacgcctgtaatcccagtactttgggaggacgaggcgaatggatcacctgaggtcaggagttcaagaccagcctggccaacatggcaaaaccctgtctctactaaaagtacaaaaattagccaggtgtggtcgtgggttcctgtaatcccagctactcaggaggctgagacaggagaatcacttgaacccaggaggcggaggttgcaagtgagccgagatcgcgccactgcactccagcctgggtgacaagagcgagactctgtctcagggaaaacaaaatcaaaaacaaaaaactttgtcttatagagagaaatcatatatattataaaagagatgggccctccattttatagattttaaagataagcaactctagaatttttatatacctgtgggacctcttaaatgtatagttaaatgacacatttccagaggattaatttgtattcatttatataattccccttttgttctctgctggaaataagcctcctttagatgttaatacagtggatgtctatccaaggtggcaccactggatgattttttttttttagtgcaatggtgcaatctctgctcgctgcaacctccacctcccaggttcaagcgattctcctgcctcagcctcctgagtagctggggttgcaggtgcatgcaaccatgcctggctaatttttgtatttttggtagagatggggtttcaccatgttgggcaggttggtctcgaactcctgacctctggtgatccacctgcctcaacctcccaaagtgctgggattacagacttgagccaccgtgcccaaccaac

SEQ ID NO: 53679 - DNA, 1050 bp, Homo sapiens
tttcttttgtctaatgtgtcttgtgtatgactcagtgttatacagttaaggagtttttctttttcaaacatactttttgtgataaatattcttttaaaaaatcctgctgctcaatatagggctatagtatagtaccttattaccctcaatgtactcctattattattttgaaaaactttttttttagagaaaaaagattttaaaagcttgtagtaaacattttatataaatgacaaaatgtattccttgctttgtggtcattgcgtgaccagacagtagagtactggattgttctagggttttacagctgcaaggcaaaagcatctgctcattgcaaagccggcattgtttaattttgacactgacttttccatgagtcttgtaccaagcactggattagatgccactaagatgaaatttgttttaagttgctcccaaagtgcagctgttcctatatacggccctgtagcttaaccaaaacagacagacataggatcaatcagaatctttgtacagggtcacctcagtatgctaggggggcccagagagagaatgttaatgatattatttatcatgaataactgcaaaattagtttctgggcttatttaatgtctatagtacagccccccaccttttaaaagcaatagaactgttattaaatatttagctttttaaactggattatcatggctaagtattagagtgtccctgtatgcattaggcactattcttccacaatcaattgcaagaaaaattagtttattggtcactaaagtagtgattggctgaaaataagacctattctaaaattgtttgcggaaatcttgaaaagtggacatttttatagaatgataatttttctttaatgtttcaagtgaatgaaaaatgaaagagcacctcacatcccaggtttcctgggattgtgtgaatttctacccagctggtccaaattgattgatacagggccaaatatttgtctgcctacatttcaaagtctataatttgctaatgaattgtggtaataatctttcatcctacatgaaagattt

SEQ ID NO: 53680 - DNA, 1253 bp, Homo sapiens
ttgaagagactaattcacacttgcttcattctattcaaaggcaaaatcagcagcttgttttgcttttgaccagatggtcctcatgaacacctactgtgcactttaagtgctttactagaattacaaaggccgggggctgcgttcgactccaaatgatttgagaagagagagagagaggggggaaaagaacctctgtgctcaatggatttggtgcaagtaaattaattctagtggacccattacacacagcccccttttcaaagctctgagcctcctcgcttgctctgtagcaatgagaaagagaaaggcagattactgcaaacagaaataaaaaaaaaaaggggggtatgaaagggagaaaagaggccttgaagcctttcatatcatttgagtttttcaagtgcgttatttttggggagggtggatgtatgaaaagccaattggagttttttttgttttaaagtgcgctatttaagcaccatgaatataggcgcaagagcaacagttgactgagtttactgtggtgaagctttgtgtccgaggatgaatcaaattcattatattcaactctttgtgttttaacatgaatgtagggttagtttcacaagactgtgtctgtttaggataattataatttaatattttcctttcataaagttatcactgtagatgtctaaaattttaatcaaagcagattttgtacattgactttgaagcaccctgacagtttaaaattcaaaggaaagcttttttagttttcaaaagaaaaggaaggctcattctaatggcattgaagcagagattattataactaattagaagtcacacatctgttagcttttggtttctgacttacttatgtattttttgagtaaaatatatactttaaaaatatattgctgttattgtgtgaacctaaagggataaaatgcacttaaaagagaaccatttatttgagccaaccattttttgcaaatctctagatggtcctataaaaatatgtaatgtaataaagtacattaagtgtgaattgcagttgtataattaataatcttactttggaatatgctttcaaacaatattttcacacagttctgttgtcataattctgattattaaccaaagttatgagattaaaaaaacctgtccagtttgtacaaatttatagttattccttatccttaaagctgttcatgtatagtactgtaatttggaatactaagactgtgaaataattagttcttattgtaaac

SEQ ID NO: 53681 - DNA, 1122 bp, Homo sapiens
ttgtttttttaaaactctgtacaaatccttccagttacattatcctcctggttggggagaaagcagtgacagtataaaaaggtcagaatggagagagttgcaagtagtcttaaagacgaaaaatcttttctgttttccattatgaccaaacagcttgtaaaaaatatcaaagaatgtgacagtaactctgtgatagtctgtcttttcaacctttttgggtcctaaattaactatttgtcacactttaaaattgtgagtttccttaaatttaaacaggcttaccttattttaatgaattttttttacgctgagaattcagatttgtcaacagtttattgtgcagattctagtaattctcactaatactattaaagatctgtggttacaaatgcacttggggtgggttaaattaaggggaaaaaagattgatttgctttcagcaaatccaaaacccaggtgtggaaaaggatatgaagtctctgaaatcaagccaacttttcttggaaactgattctttgttatcggccttactactgcagaagcttctgttaggcaaaatattgttttctttgtagatgtcatataaatttaaggaatatacacatgacccagaataacaataagaaacctaagtatttttagtgcagaattatggagtattacttatctgttacaacaagaagcatgatgaatagctattggaattatttaaatcctcttccaagtttcactttacctcagaaatctcactgttcttattattgttgatttagttcttaatggcatgaaaggggaaaattggcaacctataaagatatatcttgcagggagtagtaaaacatttcagtactattacagtttgtacaaagtagtgattaaatgggaagccaatagagttgaataagtctcaggaactgaatgaactaaatacacagattataccaatccttaaaaataatctgggctaaataatgataaggctaactctgattctgagcatttgaacctaacgtcggattttgtatgttgtgtctattattctacttgctactttcttaacttgcttgactagcgtatattttggactattctcctttaatgctggtggccagtaacagtaat

SEQ ID NO: 53682 - DNA, 1009 bp, Homo sapiens
aaatatttccgaaatcgagttggccatactgacaagttgaaatgtttaagcagcgttaatgcaatctgctcacacctgatatcctatgcagaatgattcaaaatgactacatcaattattaaaagaaatatttaaaattctgtaaatgtgccattgtgtgccacagttggctgaaactgttctccgtggcctgctatgtagattatcaaatatatcttaagcttcaaggacttaaaacagtaaatcttttttataccattttctaaatgtcattttaaaaatgttccagaaatatttttgcaaagacagatattcttatgtatttcttgtcaagaatttggtttcttctcctttttcctttttttccctttaagttaatttaaaataatatttttaaatgctagtttgccaggaacaaataaatgcagttgctacttatgtcacttgcttctctgtgagtagacaggtacacataggctgttttattctgtacaacttagataaaggatgtgggacctctctgggcctagttctgtgacttttctgcttcaacttgtgcaacacctgtgatggagggggtagtttcaggtgaaggacaaggtgcccttatctacagctattcaatccacaatgacacttaagtatgtacattttttcttgttgcatgattggaaagttagtttgattgcatcaagataaaaatataattgtgaaactattttgtagttttattttataatgctagtatttgtcttttattaatgtgaaagcttaatgataccatatgtgctaaattgtaaattaatctatctcaccagtttcaggaatttcttttcagtattaataggtccaagaataaatcctgactaatataattgagggaaaggaaaaaatgttcaaaacacaaaggttcctggtcatttttttagtgtattttatatatatattttttttaatttttgaaagccttgcatttttaaaagaaaactttgcactatttttcacccag

SEQ ID NO: 53683 - DNA, 2338 bp, Homo sapiens
tcttttctttcttttcctttttttcttttttcttttcttttttctttcttttttttgggacagcgtctccctctatcgcccaggctggagtgcagtggtgccatctcagctcactgcaacctccaccttctgggttcaagtgattctcctgcctcagcctcccgagtagctgggagcccagcacgacgcccagctaatttttttttgtattttaatagagacgaggtttcaccatgttacccggggtggtctcgaactcctgagtccaggcaatccacccgccttggcctcccaaagtgctgggattgcaggtgtgcaccagtgcacccagcccattatgcttaatttttatggatataatgacaaaggtccttgcttcaagaaattctattttagttgggtgtgattttcttttattttggttactaatatttcatgttacatatattggtgctcgctaagtatagtctacaattaacctgtgaacgctatggaagacaatagggcagacagattatctgcctaattcttttttttttttttttttgacacagagtctcgctgtgtcacccaggctggagtgcagtggcacaatctcagctcactgcaacctccacctcccaggttcatgccattcctctgcctcagcctcccaagtagctgggactacaggtgcccgccaccacacctggctaatgttttgcatttttagtagagacggggttttaccgtgttagccaggatggtcttgatctcctgacctcgtgatccactggcctcggcctgccaaagtgctgggattacaggcgtgagccaccgtgcccgtcctatctgtctaattctgatctttatgttgtgtgtgtatttgtcacatagttacagatgggcaaaggaggaaagttgaaggttaaaaccatggagcacacccaaaatattttcctggtaccataggcatggcaaaattacacttgagacagacagtagaaattattcaggcatactgatgataggtctttattttcaatactgatgaaaataatatttctaatattagtttaatactcatttaatattagtttaatacttctgtatttcacttgtaattgaaccagagtctttgagtatacattttagtagcatatttggaatttgatataattgacagttccaggaggagataaaaatagaaccatgacttacatttcttgattttttcactaatttcaaatactcttcatggttctgataaatttctaaattttggaactttgttataggctttacaaaatgttgctatgatttctccagtttctaaattctgtgtattactgagtcctaagtgaaagcacaattattttgaatgaatttttacataacaattgaagttctgtagatttcaatatcttctgaattttgactgaaatcagattcatgaatataaataatagtttcatacttctgttattctagaacagctgtttcacttggaattgaaccagagtctttgaatatacattttagtagcatatttggagttgatataattgacagctttgttggaggagatacgtatgcagatattatgaattagcctatgacttgtagaaaattcttaagtatacaaagcatttagacttgaaatttaaaaacaccttggtagagaaagagttaacaggttagctccccttggttgttctcagtgtgttctcttgcctttaggagctgaaaatatgataacattgggcccagacatgcctgtgtggaggttagggtactcctggggtttttgcagctagctgtaaagcaagctagaacttgttcatctctgagttccttgtttttctttcaaccctttcagtgccctgcaggagtcattaaatcaaaacttcatgctgatcatcacccaccgagaagtccagcgggagtacaacctgaacttctcaggaagcagtactattcaagaggtgagttatgtctcacagctaagaaataaaggtagctcattatagctaatgttgaccctgttaaagagggcttatctgttctggttggaaattctctttatgtttcattattgggttcttaaattttaattaactggagcatcaatgattactgtagatatactaaatgacttgacctagaaagatgtaaatgggaactcttgataatttttaaactagtcaacttgaaacgctgcttaaaaataactgattattatgtaatatatttcatggttttatagtcattattcaaaatactatggaaattgttgacaacattcattttggaggatgcttatattttatttgaaaggttgctctcaaataattattta

SEQ ID NO: 53684 - DNA, 1071 bp, Homo sapiens
ttgcctattgatagttcagtgactactgagattagcttgttagcatcacattttgaaaaagaactgcgggtattctctacggttgatttaatggatagtcagaaacttggtcactactctaggaaacaaaaattgatatgtctataaatatttctttgcttttttcaaattttgtctagatggttagaattgtgttttgacagttttgccatgtactacttgatgcatcacaatatatcactatcatcactaattaccacattttgattaattttacatactttggttaatacattttgatgtatccaatatatcactatattgattaaacagtaattatagacctgaggccacctgaactttgaaatcatcatgaaaaatgttattagaaattatgtgaaaccaaatgtttatttatctagacatgtttaattgccagcaaagaaagcaattaaaagtagctgtagagtaagaggccaaccttcgttaaacatggttttaagattgttacagaacttgtggtgatgataacatggtgtcttggaggatgttaacaactgtagcagggtgttaattaagaatgatgtaatctgcagctcagaattattagtatatgttagtttagctggacaggagcaaaacctagtttcagttgtgatgagagctcaaatcatatttatagtggaaagattaacattttatttttatgctgttcctgagacaatttaaaaatcctgaatgaaatacaatctaatgtaaacatcaaggccctagctcatttacatatgtgccagattttcaaactgattgctatttgaacctaatctgtcattgctagctgcattagctacaacaaacattacatttacatattgatttcttattttgttttagtgtaaataacccataattatggtaaatttggtcttttgttgacaagaactcatatgactctgtaagtttagaatggaaatttaaattgccatgtgtcacgctttttaatttaaaatcttgatgtagctaaagagataaaaataatattgtagatcacaaagtattcctaaagagaca

SEQ ID NO: 53685 - DNA, 1504 bp, Homo sapiens
agaatcgaagagcaaactcttaatcataatctttgtaacagttgaaaagcattttaagcccttttaaaaaagaaatcagatttcactaattaattgaaagggtgaagcagtactccagtggcctctgtgatacaactataaattctattataaatcacagtaaaattaggaaggagaaaacaaactgttaattatactgtttcatattattacaggaaagattcagttcatcaatgacttattgattacttaataaaaacaagctgtgtcctcaggtagcctgtaacctatttattaagatgattaggccttttcttaagttattcctgtatagaaaatattcttagataccaactcattcctggtgttctttttgattgcttcacccagattccttcctaaactcttcatttcttcacctgctctaaatgttggtattctggagagttctcttctcagcagtctttcttattgtaccttctccctgatatctaccctcaactcttcaatttctaaatatgtatagataacttacaaatctctatttagcaactcacatgtcccagttgcctgtggagtttttcatttgtgtgtgtcctatctgtaattcaaaatcatatgtctctgtactactacatgtgtttttctttttctttttttttttttttgagatggagtctcgctctatcgcccaggctggagtgcagtggcgtgatctcggctcaatgcaagctccgccccctgggttcacgccattctcctgcctcagcctcccgagtagctgggaatacaggcgcccgccaatacgcccggctaattttttgtatatttagtagagacagggtttcaccatgttagccaggatggtctcaatctcctgacctcgtgatccacccgcctcggcttcccaaagtgctgggattacaggcttgagccatcttggccggcctacatgtgtttttcgtttcaaatgtccaacagtataaaatactgaagtgtattctaaccaagatgctgattattaaaaaagccattgggttgggaatataagtaattaataactttgttaaaatcatttttggtagaatggtgagaatgagaactcgattatagtagattttcatggataaacaagaaatgaagaaatgattactgttattttcagaaaacttgatggtgaaggaaggagaagttgagggagaagtcaaggtaagatacttgagaagtattggaagcacaaggagtaagagacagcaagtaggaaaaatgtaaacaagtgaaaccaaaatagaaaatgtggccaaagactgagtgcagtggctcacgcctgtattcccaacactttgagaggccgaggtgagtggattgcttgaggtcaagagtttgagaccaggctggccaatatggtgaaaccccatctctactaaaaatacaaaaattatctgggtgtggtggtgcacgcctgtaacccgagctactcaggaggctgaggcaggagaattgc

SEQ ID NO: 53686 - DNA, 1043 bp, Homo sapiens
acagttacaaaattacaaactacaaacttatggtccatgtgtttataataatgttgatgtgaacctcagatgaaattaagttaaatagttataggtatggttctgtatctagtcatgtagaacattattttgtaggttagttaacaaagtgtaatcactgtcataaaataggtaatccacataattaaaagcagacaggagatgtcattgtttataatctgttgctttccagtagcgtgattaaatggatttatcaaaatgtctacctgggctaatggaaacgttcttcattgccatgtagctgaccttagtttgattgccagtcactcactccctaggcaagcaggagtctacagtgctgctgaaatgcagtgtttattggagaatgagtactttatctagcattaaaatatacttctctatttggctttgtggatttttaccaagttataatgattctttttttgtattggaagaataagagagaaaagttcaaaggtgaacaaaaaacatagtgggaggagggacaaatggagactcctgctaatgtaaaagttatgttaatgtactttttattaacacataacttaaaagctagggtttacttcttttagtatgtttattcaatgtatctttctataaaactagagatttttaaaatagcatatatattgaaagctgattttgtgggagacaatttaaaaaacaaaacaaaatccatgcagaaccttaaaagttgatggtaataattatttttaagttgtgagttttattttgtgactcatcaaataaaaatattttgacatcttttttttttctttctttctttttttggagacggagtttcgctcttgttgcccaggctggagtacaatggcatgatctcagctcactgcaacctccgcctcctgggttcaagcaattctcctgtctcagcctcctgagtagctgggattacaggtgcccaccactacgcctggctaatttttggtatttttagtagagatggggtttcaccatgttggacaggctggtctcaaacc

SEQ ID NO: 53687 - DNA, 2798 bp, Homo sapiens
ttaactctatagagataactcatcaatttcaaaaggatatcacatatttgacataaagtttcaggatgtccatgtctcctggtaaattgtaaagttataggtaattgccaaatgcaatgtttttttcaaactatggaccataaaccattagtggattgggaagttaatcgagtgggttatagtcagcagcattaaacaaaaacaaacaaacaaaacagaagaagaaagaaatgaaaaaagagaaatagaatacaataggaaacgccagagtgtatttcaaataataagggtaattatgtatttcttttcatttaacacataactaatatgagtcaagagtaagtctcaatacccttggattaagactgcacacttaataagctgggtcctctcatggaggggttaagaataagttccatatgttccatgcttgtgtaagattgcccctccccaggaaggaatatattctttctctatatattctcatggtttgcttccttcaccttttaagtttttgctcaaatgtcacattctccaagtgagacccaccttgatggccctgtttaaaattgctaagctcaaccccacattctttatccccccttccctgctttatttttagtcaaaaaattgtcactttcaacattcaactatatagggttacttatttattcctactcaaatgtaagctccctaagatcagagaattttattttaggctgttctgttcaatgctatattctcagtggctagagtagtcctgatacagagtaggtggctcaaaaaatatctgttgataagtgcatttcctggcttatgatgtaaaggtatacaatgtatttcttaatgtgtattggtttcaagaaacatttgaagtacttcagcaagtttttaccttcaggttaggagtttgaaatgtatgtgaattttctggcaaagaaatttggtgaatgaaattttctgtgcttatcaagatagtaggtcatatgtagtacaatagtaatttattcatttcaaagagtgagagctttaacaaaaaagatatctggagtaaaagatatataggtaacaccagagacctcatccaagttacctaacctctcaggctatatagcttcccatctataaaatcgttggcttgaggtgctctcagtgatcttttcaaggtctaatgatctctgaaaacctatattgccaatttttgccatgatgaccctgaaacgaagtatatattatttgcaaggatatacttcttcagtgaaaaagtaattgagtcccaactgtgttcttatctgtttgtgttgcttcatgagctaaagagtttatatattaacattcaggtttatgctagttcattttatatatgtgtatgtgtgtatacacatatatacacacatacacatacactcacatgtatacacatacacataaacacacatatatgtatatgtatgtacgtgtacacatgtacacatgtatatgcatgtacgtgtacacatgtacacatgtatatgcatgtacgtgtacacatgtacatatgtatatgtatgcacatgtacacatgcacatatatagacacacatatatatgtatgcatatacatatataaaataaactagcataaacctgaatgttgtatacatacaatatatataggtatacaaccatatttcccctatatatgtatatattatatatatgggcaataaggttacttggattcagtagttcttttgcattaccctatttaggaaattatcaaaagataaaaaaaactacaaaattaacaatttttcaagaattacaggaaaaatcaataatgaataatcaacatcaacattcattttttgctgtgttttttctttttcagacggtcctaaaatctctacacttgccaaaaaacaacagtctttatgtccttacaccagatttgccaccaccttcatcatctagtcatgctgggtaagttgtttatatttcctgggaacatgaaatgaaaaactcagttgttaaaattgctttaagttgtatataaacctcaaaattaaatcaaatacaagtcttgttgaaattgaccttaccaactactatgaagtatatcaggtttgaaacagtttgttctggatagtttgttttaacggtatagtcctcttataccactttaaagtctttagcataactccagtataatttttaaaaattgtcaaaatggtacttctctgactgaagggaaaggatccaagttggaaggaagagaaagtataaatggagttccaatctctctcattgctaaagaaagcatacctttgaggaaaattcattgagctctgcagagtaaagcttgaaaaacactgatataatttttttttttttttttttttgcgacggagtttcactcttgttgcccagactgaggtgcaatggtacgatcttggctcaccgcaacctctgcctcccggattcaagtgattcccctccctcagcctcctgagtagctgggattataggcatgtgccaccatgcccagctaattttgcatttttagtagagatggggtttctccatgttggtcgggctggtcttgaactcctgaccttaggtgatctgcccacctcggcctcccaaagtgctgggattacaggcatgagccactgtgcctggtgatgtaaattttttattaagattttctctctggaatagagggtctcattgttttttcagttttcacagtggaactcaatacatttatacaatgatcacatgattttaatttttaattatacattacgttttttatt

SEQ ID NO: 53688 - DNA, 1024 bp, Homo sapiens
tgcctcagcctcttgagtagctgggattacaggtgtgtgccaccacgcttggctaatttttttgtatttttaatagagacagggtttcaacagagtttcaccatgttggtcagaccagtcttgaactcctggtctcaggtgatctgcccaccttggcctctcaaagtgctgggattacaggcatgagcaaccacacccagcctagctttattttttagtttcattaatgtatgctatcttttgtcatcctcagatcctaaggcaagataagataaataatattatttcccattttatagatacagaaatattcatcagacaaatgtcattgactgtacactgtatgccacatattagtgttagctctggatatggacaaatgttaactgtgttattttgttagtaatatttgatctcttcttatttatacaggagagattaaacagattctagaaaatgaacttcagatacctgtgtccaaaatgctgttaaaaggctggaagacgggagatgtggaagacagtgtgagtttcttaattgcatagaaataaaagaaaattaagttatgccattgattaaatgatatgtaaaaattggttttaattaatgttgttacatatggcagtagtagatttggcaatagtaatttagtttaaggaatcagcaagtagtgttttctaagctaaaatatttcatgataaaccaataacaattgtaaatgagtagatttgtaaatgaaaacagtatatggcatgtttttcctatttctaacttttaaaggagtttggccctttttttgagaggctttacctttttctcaaacctcctagagtatcagtgaatgccctggaataataattttctgagcaattacatattggtccgaaagaagtcacatgcagcgtatacatttatgtcaagtattgattatggaacaaagataataggaaattttttaaacttggagaatttaaataaggatgttgttttccttgttgacttggatagtggcaggtgcatggaa

SEQ ID NO: 53689 - DNA, 1037 bp, Homo sapiens
ttaattgtaataataataatacaactcaaaataacattttttgagttccttagtatgtattaggcactctgcaaaacatttttcgtgaattatgtcacttaatacagcaacccaacgaagtgtttgttctacggttgtcatttccactttgcagaagaagagattgaggctgagaatcgtgtttttttttttttctctgagacaggttctcactctgtcatccaggatagagtgcagtggcaacgatcatggctcactgcagcctccatctcctggtctcaagcagtactcctgcctcagtctcctgaatagctgggactacatgcatgtaccaccatgcctagctaattattaaaaattttttgcagtggtggtgtcttgctgtgttgctcatgttggtctcaaacttctgagctcaagctgtccttctaccttggcttcccaaagtgctgggattataggcatgagccaccttgcaatagagagtaatttttaaaatatgaggaactcaggttgctgtcatgattccagctttttttctattcctctctttctgtggaacaaaaggctatttgtctcatgtgttacccaggctttctgcaagagtaactgggactttaagttaaagtcccttcttgtttttcctttaagaaacttcttttaagtcatgagggctcagagtgttttcaagagtgtaagaaggtggtgtcaggtcttggagattggtttctgagcactggacagacttgcaaatgcataagctcagttccagacaggtacagctctagaaatatcaacctcagccacaagcaaaaaggcaatgtttatatgtgtttggtataaaaactgtgacttatttttctactctttccataaacagaatgattctttgtcagcagtgacatttttgaaggccaagattgattaaagtttttgcttccacaactatagtgttgaaccagaattatttttatgatagttaatcactatccaaagtgctcagatagggatctttttaaggaaagttaaaaagtatc

SEQ ID NO: 53690 - DNA, 1419 bp, Homo sapiens
aaagtttcaaaataatccgtggaaagcagagttaatgagtcaaataatgatccagtgagtaaatgagagtgagtgaagaagacactgttcttaatttaccgagttaaaaatgatgttttaccaatattataacaacacaaggtaaaaatctgattaaatgctaaatgatatgatactgctaataaacatagaaaggcaaggatgggaaggagagtaatgtggccttcagtcaatgggaaagattttatggaggaagtagaactcaagtctggccttgacacacatgtaggtaaacttacttgataggaagaacaacacaagccaagtatggagagggtccctagtagtattctgtaatgatttagttgacaataatccttcttttatgtcaacattttagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggtaaggtttttcctgccataaagccttcacaaataaataattaggtaaacattcaggttatattttttttatttctagttgactaccagtgcaagaagggaaaaaaagcaagttgaaactggtaactttccaatactgattattatgctttatttttaaatactgtgttgagattgaggtaagtttgagaataattttttttgttccatgcaagtagaatggtatacaatgctgttttagggctgatgcaaatcaaacatctaagagctttaaaaaaataccctaatcaagtacattgcatatcacactttacaactgagacttactcatttttcataggatatatcttgatcctttttgtgctgctataacaatacctgagactgggtaatttataaggaacagaaatttattttctcacatttctggaggctaagaagtctaagattaaggcttagaaggtttgatgtctggtgagggctgctcactgtttacaatatggcacgttgatgctgtatccgcctaagtggggaacattgtgtcctcacatgacagaaaccagaagggcaaaagggacagactcccttcatcaaactctttttataagggcatctaatcccattaacaaagctctcattgcctaatcaccttttaaaggacctgcgtcttaatactaccacatagacaatacctgaatttgggtggggatacattcaaaccatcacactatgtttaatgagaaatcagacatgagacatgtttccatcacttttctctctgccagttgaaaaaatgctgtttttcaaaaggagg

SEQ ID NO: 53691 - DNA, 1123 bp, Homo sapiens
gaagagtaaaggagagtagggttgagaaagagaatgatatgaagacatttgtgtctttaatttcactctaggggcatgatggaatggaattcagtgttgcaggagtacatataaagggattagttaggaggcaattgcattagttcatacaggaggtaattgtggcttggactagagtggcagcatcagagggtaaaggtggatgacttatacaaaacatacttaggagatataatttaaaggactgattaggtatgtgggatgaaagagaagaagggatcaaggataacaccacaggtttctggattgagttgatactaggagtaatggaggagggtcagacttgaggaaatactaatgaactaagctgtggacatactgagttgggggtccgggatcttactaagtaccagatgttgtgcaaatataattattgttcccattttacaaacgggacagctattaagtgggtagagccaggatttcatttttactttttaagaagggagagatttgaacatttttaagtgttactcaaaagaatccagaagagaaagagatgtcaaagatactggatataaaagggataatacttagtgtagagctaatgaggagattattttagcctgggtacagtggctcatgcctgtaatcccagcactttgggagtcagaagtgagaggatcacttgaggccacgagttgaagactagcccgggcaacattaacaagactccgtttctacaaaaaaatacaaaaatgagctggggcttggtggcatgcatgtgtagtcccagctacttgggaggctggggtggattgattgctggagtccaggagtttgaggctgcaatgagccaagattgtgccactgctgtccagcctggataacagagagagaccccatctcaaacaaacaaacaaaaagaattgttttagattttgaacagattaaaaaaatgatatcccctctattttataggaagtgagaaagagagagtgcttatgtgggcttgtttgtggatttgatgttaagaagataagggaaatttctcttgatggcttttgttttcttggcaaaatggaaaaagataccttttaacactgagatgtgagatagggag

SEQ ID NO: 53692 - DNA, 1045 bp, Homo sapiens
atgtggccaagagaattataatagttgcaatgtaattgcttgagttaaaaataaattcataacttttgtctccttaaaattggagactctggttctgaattaaagaacactttataaagtcttaggaggtaaaaccattctcccttccaagtgtagtttaattacttgattttcccccctttcctctcaattcaaacattggcttgaattttggtggctgggatttctaagtcactgaagcatgatctggtaagtgcggatgaggcgaacagaaacagcagattaggaatgaggtcgttttggagagcaagaaaagtactcttgcagaaacatcaggaagttcaccatgaactgcaagacatgctgttcttgataagaaaccatatatttaggatggaagcaaaatttgtttgatacctgtaccacctttaatggttgatggtttttagatgaaagcaatgataaaatagacctatacccccgttcctctcttctaaactgtcagaaagattttcatccagagtaaatgtggcagatttctagagtttctaccaacttctgtttgtttaatctttagtttgttgttgtttgttccagagcattcaattctatcgaagcccttgtctagaaagcaaaccagatgaacttcctttatggctatttttttcttagtttagaaagtttcacactgctaaatatcactccagttttatttttgagtaaatgttattgccactttttgtgccaaaatttttgctatgcaaaatctgtgggttcagctactggattctgagtacatattggatatatcatccaattaatagcatttgccataggtgaactgtagaaacttcttctcccctggaaacattccatctttcctgtcacagattatactttttatttaatatattttatgactagaaattcagtattaaactgatttctcataaagttactataatatttggggttgaactgtgatcagagtaggattttgttggttttgtttgctttttttgaaggaatgaaacatatgtctaca

SEQ ID NO: 53693 - DNA, 1333 bp, Homo sapiens
attccagattatcttctataattatgtgattaaatttaaaaaatagacaactgagattgttttataccttctgttctgtaatctgcatttttcacttaattgtggctgttcatcattctttttaatgtttgcatagtatttcatagtgtcactgtaacataattaaccaactagtcctatgctgttgggtatttaagatttttgcagcattttgctattatgaacattactgtagagaacattcctgcatatacatgttacatatttaacctatttttttcagaagaaattgaataaattcaattcataattgaatttctgaggcaaattacatgcatatttttggagttttgaatacttttaaccaaatggacttccagattggttttactaatttaaaattctaccaactatgtatatttttgatatttccatttcattaaaccaatgcttccttatcttttttgtgttttggtacttgtcaaaatttacaaatatttgtatagcttgactctaaattcatgcttttaaccattgttgctatactccaacaaagcatgatataggtgacagctccatgattgccatgtagaggaagggagaaagagcagtggcttaatcgaaacgatgctcccaagtttcttgtcttgagtcttcttttgcaataataagtgctttgctttatttagttgtatattttgggagtgtctattagagaggctgatggaagttattggggtggttaaaaattcctccaagcccctcttgcatgatacttgtaagagggatatggaatagaggaaagggtgatggtgggctgggagtacaagtctttaatggaggaattaccagttttggggatggatatatgttctttccttatctgcttcctattggttcgtgtccactaattttgaaggttaaaacacttactggtagtgaatatttttatcagtacagcctatgcagaatattgtaaaaggagaattttcccagataatgttgaataattgaatggtaaggtactcttccactatttctgagttattttattttggagaatattctaacaacacttggggttaaaacactggtgttatatttgtgcagaaatgcaatcatacactgtatcaggcccaagcaaaaacatcaggctatctttcagaaccttaaattttggctttcttttgagatatgtctatctcctagctggcttttcttcacaaataattcacttttattcacagtaaagatttattgtgctttgtaactatcttgctgtttacattttatcatttatcctgttttcatgcagcattcactttgttgtttt

SEQ ID NO: 53694 - DNA, 1014 bp, Homo sapiens
agagcagcaatcctgacacttggtggagggaccatcttagaccccaggaggtttagagaaggtaaagacattaatgttcattttctttcagaatcgcccttgaagccttcctcataaagaaaacactctggtgcagctcctccaaattgttgttatcacattaaatttagctgactgctgggtctgccatccctgctgggtctgccatcccccatggctctgatcatgatttgtcattccctgtaaacttactgggaggtctactggaaacagcagtggttggctccaggtcatgtaccttccatgcaaaacacctgtgaacacttctttactcccatctcatcaacttcactcagattctgtggggtagattttggccacctggcttatggcctggacaaatgggacagattggactgactgccatcattcagtcctttcaaaaacaaggactagactcactgttctgaactgaactgagtgggaaccttgtgctgcgacacaatttgacaatgcctccttgactgatgtaggttctccttagaaagacctagtgattctgaacaaccctctcttttccgatgtaccatgtgtgtccttgggactgtacttcttttgtgtaacccaggtattagcttatctccctcctagaaacatggaccttcctctacctttgaatgtttaaggaaacaccattaaatcttgttgcctttagataactgtgtagagctctctaaaatgaggccatgcttgcttgcttggggaaacttcctggaatgataactgattagttatttaggcacaccctgtgaagaattatctttataaggggagtcattcaattagactaggcagtgcaaaattcattcctgactttttaactgaactaaccaatgacaacaccttggccctggaaggcattaaggtctgcctcaattcactgacaagagttattatggatgataaaattgccctggacttttttcttgtgagccaaggcagagtctgtacaat

SEQ ID NO: 53695 - DNA, 1044 bp, Homo sapiens
aaactggcaggctaagttgttagcttgctagcaggataaaactcagatcctttagtttttaagttttggcagcaaggatggatgttgacagacacgtgacattctggaagaagaaagatgagggtgtcttcataggttggttaacagaatttgagggaagtccttgggaattggtagaaacatgttgcccaaattaagtggttctctactttattgcctattaatgacgagatattggggaagtggttacagactgagttccaggacataggttcaaagatagctgcctgaacattcctctggttgttgccaactctcctttgggtggggaggatatttttcaccaatctggaggtcaccctcaaatcctccccagtgtaacaacttagggagatttgtcctgattgggcaaaagcttctgttccctttcagacaagacttacagatgtatgtgtacctacactgagtgtgaaaggaggcaaatttgtaacttaacgtgggcagaaaagaaagttgttagaattttgctttgcctgagagatggagtgcataatgtcttatggctcagcccgtcctctggaggaaactttagttcccacttcactgtctgaagcaaagccgtcagctcagtggggtcattaattcatagaggtttcaccctaaacctggtcctggtttgctgatggtttagtcaagctgaaagcttactgtgtctgcttgacttctagggctgttcagcctctgtactagctatgcagactgataatggatgtgattgctctgttctctggacagaactcaaggcttttcttatagctctgattggtactcttcttgatgaaacttgttgtatttctacggacctttgcctgttgctaatggcctagctctttggtctgccacttggaaagctatagactggcaagttaaagatagctcttgttaaagctgtgaactatgaaaacaaattatacttgctgatcaaaccatctggatcactcatctagatgcccttagtaagggcctgtcttctgatgaagccca

SEQ ID NO: 53696 - DNA, 1546 bp, Homo sapiens
gttaccgagtgcatgagcgcctagcgcttcccgcgctgccccgcccgctggcccgccgacccgcccgccggctcgcccgccagcccctcggcgcccggcggcggcggcggcggtggcggcgacggtcgcaggaggtgccgtctgcctcccaggtgcgcgcttcgctcccggagccgcggaactcggcggccgccatggcgtccaacatggaccgggagatgatcctggcggattttcaggtgaagtatctggccctcttcccctcccacttccaacctcgtgggtttccggtgccacaagggagtcttcttcccagcgtttgaacgctgcagtggtgtgtcatttaggcttttatacggtgcgtggcgtgtgtgtgtgtgtgtggcgagctatggagaagcgtataatttatatgctatcatgagtgtgtagaatgtgttaagtacgggttgaatgggattggaggtattaatgacttgggttacaatgtgtgtggaatgtgtagtgtttcctgtattatatggggggacgtgtagagtttttgttttaattggtgttggaccattaagtatgggatgttttgggtggttctgtggggagagatgtatggagtgtgagcgtggagcgtgtggtgttatgggcgtggtgtatttatattgtattaagggaagagtaaaaaagcagaatgatgagatggcgagggcaatgacaatggggtactgaggtccttttcaaagaggagtaaacatttgagactttgcctaattggaatctttggagggtaagaagataacaaggagacagataagactatatattccagagtatctctgcaatgaattcacaagcttaataaattacctattcatatttgcggattcccctcccctacagacttgaattgcttggttggtgtcctttctccaggaatactttaaaggataagtaaaggctgttctcttaataaacccagtcgtagtgccactgacatgtaagtatcttaggaaggccctttgaaagtagaactgtatgcattgtgaaagacttggagctagaactaatatcctgtgagtgctacctttgccttttgatgtttggtgaaggaattattttagtgagatatttttggccattttggcatcaacttagaagctactgtcaagtataggcagacttttccctcttttttaatactcacattgcacaggttctaacactagcttagtaggcagtatttttccttgctgaaattttgttgggcttttctctctctctgttctattaagttccttattttttttaaaattaattaatttttttttttttttgagacggagtctcgctctgtcgcccaggctggagtgcagtggcgcgatctcggctcattgcaagctccgcctcccaggttcacgccattctcctgcctcagcctcccgagtagctgggactacaggcgccggccaccacgcctggctaatatttttgtatttttagtagagacagggtttcgccgtgttagtcaggatggtcttgatctcctgacctc

SEQ ID NO: 53697 - DNA, 1038 bp, Homo sapiens
gatttttgacgaacaggaagactgggaaattaataatattcttttaaaaagttttgacaaacatttttaatacaactttgcaatcttgtttatattaaacatacttatcaagatactaacacccacttattgtggcttagtccttgtacatataacgaaacacacacacagaaactggagtttcaaggcttattttcaatatgtataatcctgactctgaagttgtgtcataagtcaagaaataactttcttcaaaaccgtttccaatattgctattattttctgtgaaaaaaggtgaattttcttctacaattatgtttatttaactcaatttcaaaagccttttccaccttcctagtgtacatttttctatcaggttaatatcaaaggccttaatcgtatgtttgctttacgaagatccaaggtatctgtctcttatttttctcattccaggtccttaaatatgactaaatctttagggacagttgtggtcgtatcaatttttaataaccaaaaagtatgtttcattgaagttcttgaaatataaattatgtatcactgtttaccactgctccaaaggaagagctaaaaatcaacagttttatcaacaggggagcttaatatcttgtccatctatgtagtttgcatttacaaaatattactcattttaaatatattttgttatttaatgtgtgattagatttttttaaacaaacatttaaaaaagatagaacgactttgtattttccattagcatttaatttcataaacattgagtgtctattatacaagatatttattataaatttagattattatggatatacctagatataaataaaccagtgtaaattctgaaaatgtgtggcatgttaatgaaagtaatattttttcacaactaaattatatgtattttatatttgcatgctgttctacaagatactttataagagaccactgttagagtgaaatatattcaaacaatagtagataatctttgttatgtgaattatttgtatgttgatagcaagtgttaat

SEQ ID NO: 53698 - DNA, 1016 bp, Homo sapiens
aaatcattggtctgctaagggacttgtgtccaggagataacaaaaagataatttgctatcagagagggcaaatcaaaatcacaatgagatatcacatcttatccacttgaatggttataataaaaagattaagtttaagcaatgctgtagagaaactggaacattctatttccctttttaaaatgcacacttcattgatttccagtgtgttcagagttacacaaccatcacttaccaatacagctctcgatgggattgtaagatggtgcaggtgctttggaaaagtttggcagttctacaaaaggttttgcagagttccattcattggtttatatacccaataaaatgaaaacatgtacaaaaacttatacatgtattttcataacactgttattcacagtagctaacaagtagaaacaacccatgtccatcagtgactaaacaaaatggtggtggactattcagtgataaaaaggaatgcaattctgataaatgctgcatcatgggtgaactttgaaaacatgctaagtgaaagtcgagccacaaaagaccacatattagtatgattccatacacaggcataccttgttttattgcacttcacagggttgtgtgtgtgtgtgtgtttacacaacttgaaggtttgtggcagctctgcatgaaacaattcttttggcaccattttcccagcagctcatttcatttctctgctacatttggtaattctcgtgctttcagactctttcattatatcttttacagtgatctgtgatcagttttattagggtggtctggaacgaaacccacacatctgaataatgcttatctatgaaatgcccagaataggcaaatctatagagacaaaaagcaaattagttagtagtagcctagggccggggagtttgggggagtgactgttaatgagtacactttcttttgggggtaatgaaaatgttctaaaattgataagtgatggttgcatagctctgaacacactggaaaccattgaagtgtgt

SEQ ID NO: 53699 - DNA, 1018 bp, Homo sapiens
ttaaaactttaataggccgggcgtggtggctcacgcctgtaatcccagcactttgggaggccgaggcgggcggatcacaaggtcaggagatcaagaccatcctggccaacatgatgaaaccccgtctctattgaaagtacaaaaattagctgggcgtagtggcgcacacctgtaatcccagctacttgggaggctgaggcaggagaatcgcttgaacccgggaggcagaggttgcagtgagccgggattgtgccactacactccagcctggtgacagagtgggactccatctcaaaaaaaactttaatagcttcctgtaatgcggagcataaaactcaaactccttaacagggatgagttggttttctgccttttcatttgaatcaaccatttagccccatgggccgtctgtgtgccttctaaaatggcaagttctttcctgtctcaagtctttttgtgctattctgccctgcagctctcttctccacattgttcagatagctgacttcttatcctctagaccagatacatcccacttacaagcatgaattaggaattttgtcctcatggaacatcatagaatgtacttgcacaaacctagatggtattgttgctcctaggctacagacctggccagcgtgttactgtgctgaatatcctgggcaattgtaacacagtgcttgtatctgtgcatctaaacatagaaaactgtaaaagataaaacagtatacctgtagttaccatgaagggagcttgcagggctggaggttgctctgggtgaatcagtgagtgagtggtgcacgaatgtgaagcccttaagacattactgtacactactgtagactttataaacgccacacctgggccacattgtttatgatttaaaatattcttttttcaataattaacagcttactgtacttttataaactttctaaattttttaacttttaaacttttgtaatatgtaccatatataattgtatgtgctataattgtatacaactgggccgggcgt

SEQ ID NO: 53700 - DNA, 1008 bp, Homo sapiens
tccctcgatgattttctgagcaaatactgttgtttaaggattgcttttcttttggctttttgcaagttaggccctctccctacttcatgatgccaagtgccaaagggagccatgccacaaagacatgctccatgtgtttgcagccaagcatctccagcggttgagctattagtcagtacttcttccattttcacagtggcccaagagtcagtataagctgggtctaactttacacaggattttacagcttgaccaacagtgtagcaaagtacaggctttagagttcagcagcctgtcttcaaatcttactgctgcataatcgttgtgtgatcttaggcaacttatttacctgtgcctcagttttgccatctgcaaaatgacaatggccccacttcataggattatgtaaatattatgaggattaaataaatgtaaagtacttagaatagcaactggcacataatgagtatttaataaatactagcttttattcttttccccagagcatattggtgtctgatgttctggagtgtttaatgtggaggaagaaaaacaaacctgatctagtcatttgtgagacattagctgtgatgtctctgattaaacatccacttttttttcttttttagacagagtctcgctctgtcacccaggctggagtgcagaggcgcgatctcggctcactgcaagctccaccaaccgggttcaagcaattctgcctcagcctcctgagtagcagggactacaggtgcctgccaccacgcccacttaatttttgtatttgtagtagagaccgagtttcaccatgttggccaggatggtctcaatctcctgaccttgtgatccacctgcctcggcgtcccaaagtgctgggattacaggcgtgaaccaccacgcccagccaaacatgaacttttaacagtccatagagaccttcaatagttcattctatgtcttcccaaagggctctattcttattttgtcacttaacagttgactttatacagt

SEQ ID NO: 53701 - DNA, 1032 bp, Homo sapiens
cccaaatgaggtttcttgtttgtggacctagcctattaatcagtaatgaactttgcactggaattcaaaggagccgtgctaacccgagcagaaggcactttccgaccttggaaggctgcatctgagggtgggcgtgagaagttcccatttgctgcttggattgcagaatccagacacctctcatttattactgaattagtgtgatgatgctgaggatgttgagaaggcactgttaggctttaaatttgaagtaaacaaggaaaagactgttgactcccatcatcttagaagaaatgatcttgggagtaactccagaggaaagggtctggatttgattccttgaatggttctagtactcagcacactggggctttcttaaaacctcttggtgccattcttcacttgggaatctcccacctggacctcagccaaatcttgagttggtgttggccttttaggatcctggctttgatgtcaggttgtggctttctgctgtgaatgataactgtcttggaaacactcccattctggctcaagagataaggaatagggcaacctgccaacccatgggagagctgagggcccagcacactgctagaagccactctgccattctgagggcctgtgatcagtgagaggctgaggtagactttctgttgccaaggacctgttcagatcatgttacatcattgctacttccctaacaactgaattcatcttggggcacaggatttagactttctctaaatgaggattacttgctctctgggtgttctggctactgtagagcccctaagaagtctattatttctggttgaattgcttagggacacaaggctttggcagaaaggtagggaagtgtatctgttgcctcattttgcagatgaaaacccataaagaaactgtagaaggcaggaaagagccttaatcttgtccaaattgctcatttttagaggatctgtgactttcccaaggttactttgaaaatcagtagcaaagtcaggactggaattcaggtctccttatttccag

SEQ ID NO: 53702 - DNA, 1006 bp, Homo sapiens
tgaagaaagtcaaagggctccaaccaccagcagcagcagcatggggtggtgatgggaggggaggacacgcagggggggcagtccgcgggtgggggcagggagccaccctactcctccctccccagtgcccacagctcagggtggcctggctggtctgtccatagcggcctacacggtgggagtggcctacacagtgggagcacgatgtgggacccaccgaaataattccacttcgtcgtccccgaacggcttgtggtcctccttcccaaacatgctgaggtaggcggccttcatgtaaatgtaggtggcctgtgcgagacagagcaacagccaggtgtgagcagccctcctccagccccagccgggctggaatctgcagacggacctcacgtggcccagcacaggagctcccgttgtctccaagccccaggggagaaatgaaggtaagaagctgaagcaacttgaagacctgaatccaggacaacccatgtcaaagcagccaccttcttctccacttgaagcagtggcaagaagaacccatgcaactagtaataggcaggacagactggggctgcggcagagacacaaggacaggggcgcactcggggcttccgggaagcaacagcttcacagtgggcccctgaagggcaatggggaaattccctgaggccccagacaggccttccagccaggaggaagaggctgagcaaagccaggaggtggcaggatgtgtgtggactaccaataggaggatgaagcacgggctgtaaaaagaagaggcttgagccagaaacgtgagcagggcctgggtcgggtcagctcgggccaccctggtagaactaactgccttgctgtgtgtgccaggcacaccacatccagcacctcgcttgatcccaaagccaatgccagaaaggagtccgtaccccacctctgcttcctgggaccccagagctactggggcagagccgggagtcaaccccagcaccttgcccactaaatgcacagc

SEQ ID NO: 53703 - DNA, 1055 bp, Homo sapiens
tgaaggtacccagagtgggcaggggccacccccactgtcccaagtctagctctttaacaggctttacctggaggggagagggccacccctctaactttgaaagcctctagccaatgttttccaaagctcgggcagtagatggcagctaagatatcaggggtccatgggcaggtgccaggaagcctagccaggaaacccctggccacctaggttcctgaggctaaatcttccctgggaagctcctcctcccttgatcaggcagttttcccagccttcctgctccctctgcctggaagcccctccccagctgggaaactcctagggatccttcaggagccagcacagatgctcaccccctcccgtaggaaaccttcccccactccatgcaggaacaagacttagttctctgtcccctctaagtcatcagctggtttcaggactgtctccttccctgacactggtaaatgtttaaccagcagctctccagggcagagaaagccctgatttattgtgtgtgccaaggtcgggtgctgtgaaggttccaccatggtggatttcaagctactggcctgacttgggaagaaatgcaccgatggactctggagctggctccagcgcccacaccacccccaccccagctgtgagcccctgaaggctggccacatgtctggtcacctctggatcctggtgcccagcacacagccaggtgcaggggcacttggcagtgaccacacatgagtcagggacagaaggggagactgagctcaagccaggtgctgtggaaatggaggaggagcactcaccaggttgaaggcccctacaccaagcttcactcctccttcaaagtgcgggtggttctcacccttgcagtattgtgaggactgaacaaggctgtccagctccctgcagagagatgccaagtcctgtttcagccactgctgggggtggggggtaggggctgggaccccttccagctgggcctcaggtaaactccctggtggtggattcatacagttctggtaatcctgagagctggtatttgaggaatttcgaac

SEQ ID NO: 53704 - DNA, 1055 bp, Homo sapiens
agcctttcctatccccagactaagtcaggcccaaggactcttctccttggagcctgtcatcaccctcatagtgactcaatcggggggcggggggggggggtctgtcccttaaagtgagaatgctgtgggggcaatggcttggtggttttggtccctgctgtcttccagtgcctggcacagagaagcttcaagcttgctaattgaaagccttcaaaatgctgtcagcccaggaaggaggcagacacatcattaaaagcctctgtcctgccccaggtggctgggctaggggctctgtgcagttggtaaccaggagaaatagagttgaattccaaccaggagactccaggaagacttcctgaaggaggaggtgttttggttagcccagtggttttcagctaggggtgacttccccctgtgagacttttggcagtgtctggagacattctggatgtccagctagggagacgatgctactggcatctggtgctcaggggccatggatgctgctaaacatcctacaatgcacagaacagctcccctgccacccccaccaacaaagaattatccagcccaaaatgtcagtagcgcggaggctgagaaaacctcttttagataggatgtggaatacgaacaaatgtccagaagctgcccatggctgagtgtgccagggcccatacggctgaaattcagggggtgaggagtgtgttatcatggtgggagatggggttcgaaattcctcaaataccagctctcaggattaccagaactgtatgaatccaccaccagggagtttacctgaggcccagctggaaggggtcccagcccctaccccccacccccagcagtggctgaaacaggacttggcatctctctgcagggagctggacagccttgttcagtcctcacaatactgcaagggtgagaaccacccgcactttgaaggaggagtgaagcttggtgtaggggccttcaacctggtgagtgctcctcctccatttccacagcacctggcttgagctcagtctccccttctgtccctgactcatgtgtggtca

SEQ ID NO: 53705 - DNA, 1032 bp, Homo sapiens
taatgtacatcacagtacttaactcacaggattgttgtaaaggatttagctttgataactttttattatttattttaaataagcaaattcaaccacagtattactaatagtgaaaagagctgttggttgttgaatgtacattatatatgaagcactctactaggcattttatgtgtgtcttcttgtttcttgtttaatcttcacaatacctctaagtagtagatattgttgttagcccctgttttagaaatggagaaactgagtctcaaaaaccttaaaataatgtgcttcaaatcatccagctgatgagaagatgagccaggaactgaacctggtctgtctagtcctaagtgtgatactctcagtttaccatgctttgttttattttgtgtgaaaaaaaaatttacttataggaaatggtaggaacaggacatcataaataacaataaataacatttattaagctccaggcatgatcctaaatgctttactattaatttatttaatcctcacaatagtaaccatgaaaggtacaggtactattatcttctccattttacagaggaggaacccaaactaggccacagttatgcagctagtaagtggtagagctggaatttgaacctaggagatgggctccagagttttaaccactactctgtattcctgttaatgatgagtagtcagaggagcagtgtcacaaaagaaataatccatgtaatcactgttcttgaggattaatggaataaacctatattatacatggcatcttataaaacattttcccattcattcttgtatttaactcgtatgagggtttagaacagtttctgacacatgaaagcacttacgattattagtgttatcataagtgataagtatatggggggagtagccagccttgcttttagtttttctttttttgtagagacagagtcacattctgttgcccaggctagagtgcagtggcacagtcatagctcactgtaactgtgaactcctgagctcaagggatcctcccgcctcagccac

SEQ ID NO: 53706 - DNA, 1183 bp, Homo sapiens
tcaacaagtcaaggtggtattgatctgtgttaatctgagtaacttattgcctagcctataaataaattccaaaatatccaattcatttcttcttgaaatggtgcttgttttgttttctttccattacacaattagactcctacagtttaaaacaaactttaaaccactatcttgcactgctaacttttttctacctttgtaaatagaaacatttctgcataaaagtcatacatatgaagcaagggctgaatcataatcacaaggcttaattttgataaacgaatccagtgacctaaggattttctgcaaaatttgactgggagttgtgataggtggtatttttgtttattttcttcctcttactccttaggataaaggtaagttgacttgaacaactttcttttgcactgggaaaataagcaaatgtttaaatgcttcaaaaaaattttcaattaaactcaaatattaaatatctataacttataaacaccaactttcaatgtaataaatgtatcctaatcttatgtatgtttaactggattacatagatttttatcttttgttaaaatgtgtataccccgtggaccaacataatattaaagtatgtatatattatataaatatatatgtatatgtgctcgcttgtgtaggatgaatgtcttagagtcgtttgtggtattttatgttgttgactctggctccagggcctgtgcttgaaaaggacagataagtattgcccagagctaagtggcactacttacaaagttttaaatgtcttctacatactgattcatgtttatttgagctctctttatagaattttctcttaaagtttcaaacctctaagttgtagcctgtaattatgagaacagtaaactttaagtaataataaagaatcccatccatatatccaatttgcaattgagttttgcatggttctctgattatgtccatgctgtgtccaaggaggagtaggtacatacaatcagcacagattaatatatgtaaagggtttgggacagcacctggtatagaataaataataaatgtaaactattatttttggttatcatgtcgtgcttttatgaaagaaatgaaatgtatatgcataaagacagtgcctaaaacataagaatttgtaggcaggacacagtggctcgcgcctgtaatcccagcactttgg

SEQ ID NO: 53707 - DNA, 1046 bp, Homo sapiens
aggtcatttgctcttactgccactagtggataactgttatcaggctgagggctgtaacagcagaggcaggccatttctgtctttattctttattattctccttctgtttaatccattcgtctctccttttgggaacatgctgcttgggtgtggctaggggatggtgggattcagtctttggacaaaaatatgattcctggcccatccttactttgctatttgtttcattagctgcacatagctggaatctatttgagagatcatgtgtgaagaatttgaggacaaattgttggtgtagctatttaagacaatattcagaatgtgttttaggtactcaatcatcctctacccacagtactttaatgctatctgtgtacatgttcttgtgtgcttgtatttgctgtatttactggttgaattaattgtaatgattttgatccagggaaaagatccatcaacaaattggattctcctgatccctttaaactgaatgatccatttcagcctttcccaggcaacgatagccccaaagaaaaagatcctgaaatattttgtgatccattcacttctgctactaccactaccaataaagaggctgatccaagcaattttgccaacttcagtgctgtaagtactgtgaatgagctgtttgggggagaaatctttaaagagttttcagagattattttggagtctgccaagtttgcatcattttaactaaatttaccaagatactaaaaatgatctttcattcttcccccaagcaaaacctctgtttgatcctgttttgacagttctacggttgttccatcgcacagatgattttagtagtcccagttcttgtcatatacacaagttgttttgtaaatctttctcttagtcttggtaatgtaagtaaaatcctaacagttattattttgtggatggttatgggtgatggtgatttaatgaacaattacagagtcattgctctctgcccactagatgaataatgccagtaataagtttgtgtatttgcagctgtgtatgtgtgtttgtgtataaag

SEQ ID NO: 53708 - DNA, 1019 bp, Homo sapiens
gcatgcgccaccacgcccagctaaatttttttttttttttttgcatttttgttagagacagggtttctccatgtggggtttttttttgaccagagaatctgagaggggaaagattgagcttaaaacagatttgtggggaaattccaggagttctattttcaacatgttagcaaagcccatcacatgtccaaggacagatttgagttagcaaattgaatatctaaatatggattctaggaaagatgtcttcaagtaaagattgtatttaaagctgttaagtaccctagtctcatcaacacagtatactcagtaagactttattctttcttaaggtagatttaaaattactaacttaaccctcccctgcccgcaaagaaaataaatatattaattttcttggattttaggatcttcaagatgaagttcaaagggagaatactaatctgcaaaaactacaggcccagaaacagcaggtacaggaactccttgatgaactggatgagcagaaagcccagctggaggagcaactcaaggaagtcagaaagaaatgtgctgaggaggcccaactggtaatgtctggctgtttcctgctgcctgcacctatacattagttgcttttcctggcttaagatgaaaacattctctactttttgttattgatggtggtggttggcaatccagtcagcatttgggttcatgggggcgatggagcaaggttcatccagaaattacaggccttctttagaggaaatagaagggcagttaatgaactgtttttccaaatttttgttggaaatatggtgcctataccttcaactctcctctgtccctcccccagttacccttctttacgaaaaccatacatcaaaaaacatcataattggctgggcacagtggctcacacctgtaatcccaacactttgggagtctgaggcggggggaattgctggagcccaggagttggagaccagcctgggaaacatggagaaatcccatctctacaaaaaatatgaaagctg

SEQ ID NO: 53709 - DNA, 1743 bp, Homo sapiens
gaaaagaataatgtggaacaggaccttaaggagaaggaagatactattaaacagaggacaagtgaggttcaggtaagtgaccataaaatttagtgttccactgctgatttaggactattcattttaaatttatatggttatttactatttgctggatgtagtattaggtcaagagaatgcctaatgtttatattatataaatgtttatcttttccaagatgattgttcttgcttggaattctggcctgcaaagattatactgcaatgagaaagcagtatttttcagcatagatttctagttttgaaagtattttttaaatggtacttacctgcatattatatcattaaaggggtaagtttgcatgacttacaatgttaatatttttgcaccagtaaaattagagtgagatcatcatctcatcatcatcatcatcatcatcatcaaaaaccagtatgctttttcatgcatgtgaggtttttgttagctaggagacctagtatgttaaaggactgtttctcataatacttgtagggtgggagatgatacagaacaatttaaagtagcattttatgagtagcttagtaaccagcatatcttaaactttggcataaagagctttagttcattttcattaggtgttgtgttaaattgtttcattttacaaagagaaaggatgacaaaaacctcagtttttgtttgggaaatgataaaaataagggagtagcagtgtttctaacgttagaaatagagaaaactgggcagtgcctcacttagagcagtaagcaatgcatgtggccatgttattggggtactgtttccttagtgctgcaccggcacatagaggagattggatatagaagcactggtagcagttgctagtaagaactcttggatgggcatttcttaatgtgttgcttgtatgttggattttcctgcttttcctaatagttttaagtagggaaaaactctaaattgtgttaggcccattgttttgttttgatgcaggacattcattagagattgtctgtctggtggactgtgctagggtggggagaatgatttactgaagaattgaggaagaagccagagagacttcttgttggaagttgattctctgattgggtgactacatttattatatttacttgaattttcctgaaggcagtgcaagttaagagatcatcatcaatataattctctctctggcagtgaggttaggtgggcataagagggtaagttatctgaattacattattttgtgcagtttttgagcttcttaggaaatgcaaaagagccacacattctaagcagttattactaaaaatagtttaaaatggaagataaaataatctacacaagttttcataatttgaagaaataggtgtagctactgatacaattttggacagcttctaaatttagccagttactgctttaaagtacataggttcttgtgatagacagtattttgttgagtatatctacctgttggtttttccctgctgcattttttgaggatgtgaatttaaatacccagtttagaagagtgctgaaatttacattgtttccttcagtttaaataggctatccctgaacatttggtgtcttataattatagaagttttgttgtccatcagaatttctccgtgatttgcttgcccttcttacttagtggcaatggtaaggtgtatgtctaaccttaagctttgcaaaatccaaaatgtgtgattggcacaggaagt

SEQ ID NO: 53710 - DNA, 1032 bp, Homo sapiens
tggtcaactaatctttcaataacttttagtaactataatgttaagttgtaccagtggcagtcttatatagtaaatggcagctgacagcatgaaaataacatatctaatattttgtgactatcttattaggaaaatcagagaatttcaaaaccttgttagtttttagggtatagtcacattttataaatgtgcggtatatttatacatgatttgacgtttgtgaaaatattttccctggacttttattttagatgagatctacagtgtaggcaaacttatataatctgtcaactccattagtgtcatagtcagactcatccccatgctaaaattatagttgttaaaatacgcttttgtaaatagttgtgttaggtcattatcaccaagtcttcaaggtattacattataaaaaccttggtttttattcttgtgaataaccgttttttccatgcaaagttaaaattcttcagcctttaatttttttattaatatataaggatgtgatgagtatgactacaaaacaggaaaaaataaacagatttcgtttgtggcttttgctaaattgttacctgacaaaatcttagccagttcttcattttcgttttgagatgaagatacttagttttagtccaggggctgggcgcgatagctgatgcctgtaatcccagtactttgcggggccgaggcaggtggatcacttaaggtcaggagtttgagaccagcctgcccaacatggtgaaacgttgtctctactaaaaatacaaaaattagacaggcgtggtggcacacatctgtaattccagctactcaggaggctaacacaggaaaattccttgaacctgggaggcagaggttgcagtgagccattgcactccagcctgggcaacacagtgagactcttgtctcaaaaaaaaaaaaaaaaaattttttttttttagtccagggatcaaacctctaagtaagcagcatgtatgatgtgaaattgtaattactgtataatgaatgtagtactttataatacttttttcttaa

SEQ ID NO: 53711 - DNA, 1057 bp, Homo sapiens
ttttttctgcccccagcctgcctcttgtcagattgagtaaaggaagataatgacaggatatgcaaatcagccagtttggctatggttaacactgctgggtcaaactataaaaaataaagattgagaattatctgagtattttgtttatacagactttcagttacctatattaatgtgggcattagtcaagagttaactatgtttgaatttactcatttcttaaaaaaaagtaaaaatgtgcacctatggataagtcctaactgacctgtattttcttctgttattttctcttccccacagcattttgattgagatgtcatatggaagtgatacattgttgctctgagttagtagggtagaattgttcagaatttgtgatggatattgtaatggattgaaagagtgacacttcaaagtttgtttcattttggcagaaatactgttttttttcctccctgtagtgggttgtatcccctgcagaaaaagctaaatatgatgaaatcttcctgaaaactgataaagatatggacggatttgtgtctggattggaggtccgtgaaatattcttgaaaacaggtttaccttctaccttactagcccatatatggtaagactttatttgaattgattttttaaaaatatggttttgtatcaattccagtttctgcattttgatttttagtcatttgtaaataggacagtttttgtttcagaattttttatagagaaaatcagaatctgaagaattcttctggctaatggacaaaagcttgagaatgggttacctgaagctttataagattgacagcatccgctgggcatggtggctcacgcctgtaatcccagcactttgggaggccgaggtgggtggatcacctgaggtcgggagtttgagaccagcttggccaacatggtgaaaagctgtctctactaaaaacacaaaaaattagccagacatggtggtgtgcgcctgtagttccagctactcgggagggtgaggcaggagaattgcttgaacctgggaggtggaggttgcagtgagctgagatcacgccat

SEQ ID NO: 53712 - DNA, 1053 bp, Homo sapiens
caatatttgatagtttaagcccagtgaatggatttctgtctggtgataaagtgaaaccagtgttgctcaactctaagttacctgtggatatccttggaagagtaagatattatttactccgaaatgtaatttttatgtattttaattttatatctattatgccaggagcatgtataactctttgttaaaaatatacaaatcttattttaaagttgtatcattataggattttttgttttctgacttaatgtataaaattattgccagcatatttctgtatttggttattccctgtaaaaatgagtggttgaaatgaattacatatgtaagccccttaagtaggtccttttttagtttgtgctgtacactcttgacctcctatttgcttgagttaatttctagagaccatcagtattttatgtctgccacttactctgtggctgtatcatggtgtcttgttgtaaggaatagttttatctctgaaatcataaattcttctctctaacttgtacttcctgtctttatagagctcttttccagaaactagcaagactaattctttgactggttttactaagacctttaaatctgacttcttggctgggcatggtggctcacacctataatcccagcactttcggaggctgaggcgggtggatcacgaggtcaggagttcgagaccagcctggccaatatggtgaaaccccatctctactaaaaatacaaaaattagccgggcgtggtggtgcgcagtctgtggtcccagctactcaggaggctgaggcagaagaatcgcgtgaacccaggaggcagtggttgcagtgagccgagatcgcaccactacactccagcctgggcgacaagcaagactgtcttagaaaaaaaaaaaaaaaaaaaaaaaaatctgacttttttacttttcctctttttttcaatttttttactgtgataaatatgcatatcatgaaatttaacatcttaaccaattttaagtgtacaattcagtggtattaactacatttacattattatgcaactatccccaatatccat

SEQ ID NO: 53713 - DNA, 1180 bp, Homo sapiens
tgatccttcaaaccttttttttcttttttgagacagggtctcagtctgttaaccagacttgagtacagtcacagagtcacagctcaccgcagccacaactgcctgggctgaggcagttctcccacctcagcctcccaagtagctgggactacaggcatgtgccaccacacctggccaatttttaaattatttgtaaagacgaggtctcactgtgatgcccaggctggtctcaaactcttgggttcaagcagtcctcctgcctcagcctcccaaagtgctgagattactggtgtgagccactgcacccagtcgatccttcaaacattgaatttcagatgagtctgttcataagctgaccaaggaactctttgaactgtagtgtgaatttaatggaactgcctttctgcaagcagtttatatctgatgacatcactacctttctgtatgtcagtttgtatattcatttaattgttttattgaagtggtttttgaaatgtattcataggtactttgggtacttgggtagaggatgaattcttggggatttgggcctctcaactggctttagagaaagcatttcattctcaatttgttacatattgggtttctgggtaaaatattagatgaagaggagttttgatgtcaaaaacaaaatttaagattcttgtttcatttcttgtctacctgattcttagtaacccatgtgactatctttatctattctctgtctcacgctccccaagaagaaacaaaatctaacccctgaaatcaaggatattttatcttattcatctttgtttctcaaatatctgttgaatgaatgccaaatatgttaatagaagttaatgaatagcatctaatttttattaatgtgtttatttcagttatcaagtgggaatcctgtatatgaaaaatactatagacaggtaagatttttgtttcattgtttgcctggattgaacattaaatgtactgtcaactcttgattgtatgcctgtagattaccagctagctcgataaatttgatgtgtcttgttttcaacatcttgtttacagcctccactttgagtacttaatgcatttgacaatcccagagaaatgaaggaaagataattaagtccaagtacttagttgtcttaaatatctatgttgaaaatgtatacatttgatagatttatcc

SEQ ID NO: 53714 - DNA, 1033 bp, Homo sapiens
agcttgtctctctatgatgttaaaattgatcagtaggttcaggtgaaatgtgtgtttttttttttattttaaagaatatggttgcggagaagtaatcaggaggttgcttttgatgggatttagtgattggatgtgagtgaaaggggaagagtctgaagacatccaggttttcagcttgagctggttgaatgataaaaaggaagataggaagaacaggttgggggagagaagtggttgctttggggcatgttgaaattgacataaagatgtgttacagtctggagcttgggacaaaaatctgggctgcatatcctcttatcagtcagtaaaacataaaataaatctgggctgcagataaatattagtttttcatatatggagagttgagagagtgagtagaatagagatctttggataggactctggaaaataccactggatttagttatctattgcgttatgacagattactccaaaatgtagcaatttaaaacaacagtttgttacctcatagttttcgtgggtcagaactttgagttctggctcagggtctcttatgaagttgtagtcaatatattagccagtgctgcagtcatctgaaaggcttgactggagcaggaagatcagcttccacgatgactcacatggctgttgtcagaaagtggcagttccttgctggctgttggaaggtggcctcattcctcaccaggtagcctctccattgagctgcttaagtgtcatcatgacagagcagctggctgtgatccaagtgagagcaaagaggaagcctcaatcccttttatgacctagtcagagaccaccacttctgccttattctgttcattagagacaagccattaaattccactcatgctcctggggatgggaatttcagacatgaggagggaaattaggctttatcttttgaaaagaatttgtggacaaattttaaaccaccacaatcacaatttaagggattggcagaggaaaaaagcttgcacaggagagtgaaaagggatgccagagatgtaag

SEQ ID NO: 53715 - DNA, 1056 bp, Homo sapiens
agcctcctgagagctgggactataggtgtgtaccaccacacctagctaatattttgtattttttgtagagatagagtttcgccatgttgcccaggccgacctcaaactcctgggcccaagtgaccctcttgccttggactcccaaagtgctggattaggaaattaggaaacgactaggattataattggccctcttaatgttgtttaatttgtaaccctaatagttgtattaccactgggacctgtcttgccttttttctgtttactgtaattttatttaaaaaattgtgttatagtagaagaggatcaaggatgaatatattcttaccttgtttgggttaattttgcattctaacctcatcagggattttcaaatctaattattatttttgtgtatttcctttacacttgaagggaagataagtatagggtacagtaaaagggcgactaaatgcttaaggaatgttttcatcaactgttttctttcactgtgttattagtaaagaactcttttcaactctgcttggtattgagaaatttttttcctaaaatatatgattcctgatatttatagttagaacaaaaagaatactctgtttagtatctcggtaatcacttctgaacatgaattcttacggctcaagactttggatgtagggcatctatagtttcatgtgggataatcatctttaaaacataatcattcaatattggcttgttttgctgctttctcacacaggtggagtacaggaaaataccagttgttcaagtattaagtatttgttcaacttccattatttgagatgttactttgttgtattgcacatgactaatttactcttaggaatatttactgaatgtaaacatagcacttttgcataacataggctttgcttggctcagtttagtaagagacacagaaaggctaagttacatttcatcagtaaatgttttttgagcacctgatgtgtaccagacactgttctgaggcataagtcagatacaattcctaccccctaaggtatgtgtagtcttgtgggtgaagtaaaccagcaa

SEQ ID NO: 53716 - DNA, 1029 bp, Homo sapiens
gatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttg

SEQ ID NO: 53717 - DNA, 1054 bp, Homo sapiens
ctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagt

SEQ ID NO: 53718 - DNA, 1058 bp, Homo sapiens
ttaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagt

SEQ ID NO: 53719 - DNA, 1033 bp, Homo sapiens
agtactgctttacccctcccatttctgtccaaatcctacactctaaattgcatcctctgtgaaagctttctcgtccttataactttctcctttgaatttcttcgtgcttttctgataacattttaccatgcttgaatcaattatttgtagacagatatatattccctctaatagaatgaaactcttttagatctgtgtctgcttcatcttggcatccccaaaggatccggcacagggccatagtcataagagatgctcagtgaataagtaattattgtaacactgaattctaaggtccagcatagtatgtgtaaaaatgtgctcaggataagatttagtgtgagataacgagtttttagagagacaagaagattgtcattgcctcatcttgtttcttgttttactaccatttatttcaatgtgtttttctcctagttagtttctctttcttcttaaaaacgtttagccttggaaaaattcagcagccatacattacagcaaccaactaatataataaatcccttaaaataactctatgagttatttatgatttttccacgaatattctgatttataatctgcaagaactagttccttgattactttttgtgtttaaatgttaacaggtgggcacattgcagaattccttaattcatttacaaaatttttattgaggacttgctacaaaccaaacactagcccggtggagatagtagagaataaaacgaagtcctgttttcattggcttgtattttatatcatcttgatagattctgacaattaaactaaatcagtaattttgtatgcactttttaacaactttagcgaaaaccgaatctgttttcttctggtactcattggcagctaaaattagatatacgaagacagctttggcatatataatttctaagagataaatgtcagaacaattgttgagtctattcaagtcagggtcgttgttttattttgtttgcctgtgactgatcatctatctgttagtcctgactagctatcaccttgagtgttaatttgt

SEQ ID NO: 53720 - DNA, 1012 bp, Homo sapiens
aaaacttcagagatcatggggtgggttgaggaatgggagaactaaacagtgagaatatgaagttaacattaagggaagggaggaatgaactgaatgaaaaaggggaaaatagaagtaacctaggtgggttttgtttatgttcctttgttaaattactgttgttctagtggtgactgggagccaattacagggtttgggggagataagaaagtgattctggagagaagagtaaatccaatttgagcagcagcatgtgtaactgctgagaagggaagcagtgctccaagttaatgaggaagattgatgtaccactgtttaaatagacctaactgttaaatagacctattatttgtgtcaaaatagaactgtattttaaaaattgaaatgtcttcatgtatgaagggaaaagtattttttgtactattaaactttgcttgggttctggtagatttattgcaaattctctttctctagggtttggattcaggatttgttcctagtgtccaagattttgataagaaacttacagaagctgatgcttacctacaaatcttgattgaacaattaaaggtatggcattagtttgtatattaaatttatataaatagaaaatgttactgagcttgatttttgagtaaaaacagttacttgatgttaatttacagccctcatgtggttcttcagcagtttttaaagcagacttaaaagatctagctgacttattcaaaggtctttatctctaattatattggtaaatagcatatttacataatgcttttttggtcattaagaaaaaaaaggtaaatatgtaggcataattagaaaaaaataaggcaagatttggttcatattctgtttaaaatttccatgaaactgtgttttagtggctcaatttctttttttgtttgtttgttttttgagacagagtctcactctgtcacccaggctggagtgcagtggcacgatctcagctcactgcaacctccgcctcccgggttcaagcaattgttct

SEQ ID NO: 53721 - DNA, 1158 bp, Homo sapiens
aacatttttagtgtaatttgtacttgctacctgtctgtgttagcccagcttaataaaactacgttttagggttcttcgcaatggataacttggatcacgtaaatgaaatttggccttttatttattccagaaggaagttttattgttgttaagtcttcttatgtacaaatacaatcctcaattatatttgtactgtatatggactctgtatctttaaacttaatttaaatgtaaatgagaccgtgtcacttgcctgctcaaatacccctgatgttttccatctcatttggaatgaaatagaaactacttacgttcactgccctcttacctgtctcctacccttgcttggtcacaccattccagtaacattggctcatttctttttctcaggcaagacaagcttcccccctccacccccgcccccggctttagggatttttacttgctgttccctccacgtggagggcatttaccacagattgccactaggctcactctctcactttattcatatttctgccacaaggaacatctttggaaagacttttcctgactcctgtatctaaaatagcctatacctcccactggtttctttttcttcgtggcctcgtatcactagtcaagtttacacgatatatttgtttgtttatctctttattgactgtctaccctagagtacaatcttggtgaggaatttgctcgtcttaccacttgtattagtctgcatgggctgccataacaaaataccatagactgggtggcttaaagaacagaagtttattttctcaccgttctggaagccagaagtccaagatcaacattctggcctgttcagtttctgatgagggtccttctcttggcctgtagatagccatgtcttcacatagtctttccttggtgagtatgcacagagagagggagcgtgcacgtgtgagatagcaagctgtttggtttctcttcttacaaggacactaatcttattgaatcagggccccacccttatgatcccatttaaccttagttacttctgtagaggtctcatctccaaatatagccacctttggggttagggcttcaacacaggaatttggggagggacacaaacattcagtccataaccccattgtatcctcagtgcctacagttgcttaccatata

SEQ ID NO: 53722 - DNA, 1055 bp, Homo sapiens
aacactttagagtagatttaaagaaaaatttaaaattaaattcctgtgatttatatcttatttgatttttcatcctaacttcattttctccacttttctttcccttacttctcttgttaatacaaaaaagaaataaaggaataagataaaatgtttgctctcctaagtaaatctcagatcttttgtttgcagttcccactcaaacttttcttcttagatacagtttcacttgtgtgatcacctggaatatttgcatgctacttaatcatttgcaattcttgatcaattttttttttattccaataagaaaaagctgcttttctctcttactttttctgttgggtaataaaaagaatatgaagttatttactaataaggtgagctacctttggaatttccaaaataagcattaccttttaggggttaaactttttgtgttatctttttaaaatacctttgtgaatatgatgactaaatgtggcaaactgatgtgctttttttcacaactattgaaccatacatataggaatgggcaaaaaatccgtaagtgactctggattcttttttttttttttttgagacaaggtctcactctgtttacccaggctgtaatgcaatggcacaaacacaactcactgcagcctcgacctcctcagattaagtgatcctgccccagcctgtcgtgtagctgagaccacaggcacatgccaccatgcccagctaatttatttatctatttttttaagagatggggctctcactttgttgcacaggctggtcttgaactcctggcctcaagcagtcctcccaactggtcctcccaaagtgctggaattacaggcatgagccattgtgcctagcctggattcatttttattgctgtcttcaatttcttccagaactgtggccctggctttcagattgccatcagtgtcttaataaactttagtcttcaccagacatctgtagattagtataaattgcctgactgacagcccttaaatgctcagtaagttaaattgatcttaatactccatttgtcgattggtttgata

SEQ ID NO: 53723 - DNA, 1039 bp, Homo sapiens
gctccactactcaccagctgtatgacttcagaccagtcattgaacctccgagcgtctgtgtattatgagcgtcattgtgttttccttagggttgtaatgtagatatagacataccgtgtatggtgcatacaaggtactcgataaattattattataattcatagctttaaattgtttttgcatactttatgattttatgcctaaattctagacaacttagcccattgcagataaaactttcctgtatacataggtgttgtttttaactgttttctttatatcatttgttctgaacaaggtaaattatgaaatggctgaaaatttatcccattttttttcaatttacagtcttactgagtatttcacttggctcagacatggtttctaatcatgggtaaggagaaaaaacacagcataaataggacctttgaaattacatctaaaataagattcatatgttataggatttggggtttttaggtcaattgatttaaaagattgactctattttgagatacatcacagaggcacaaagcattttaaaggtaactttcatgcttttttttgagacagagggtctcactctatcactcaggctagagtgcagtggcacgaacacagctcactatagcctcaacctcatgggctcaagtgatcctcccacctcagccgccccagtagctggaaccacaggcacacaccaccatgcccagctaattttttttttttttttgagacagaatctcactctgtcgcccaaactggagctggagtgcagaggtgcgatgtcggcttattgcaacctccacctcccaggttcaaacgattctcatgtctcagtctccaaagtagctgggactacaggcgcatgccaccacgctcggctaactttttgtatttttagtagagatggggcttcaccatgttaaccaggctggtcttgaactcctcacctcaagtgatctgcccaccttggctttacaaagtgctgggattacaagcctgagccaccatgcccagcctaattttttattttttg

SEQ ID NO: 53724 - DNA, 1070 bp, Homo sapiens
attagaatacatgttttcgcacgtgtagagttgtaataagactcatgtgtactgttttataaatatctaaagcgtgagaaatttgatttcaatttttacatttaataagtaaattgtgtgccttttttatttttcctttatttatatacaaataccaactgggtgtggtggctcacacctgtaaacccagtgacttgggtggctgaggtgggaggatcacttgaggccaggagttcgagtccatcctgggcaacataaggagaccttgtctcttaagaaaaatataaatatacgtgcgtgtgcgcgcacacacacacacttccatcggtaaattatgatcacaggtatgataatctattaataatagaataatctttctttagacctgttaactggctcataaaagccagttagcatgaatttacttgcataaataagatgtttttttattttataatttcaagtacagttttttaatgattaggaagagtgttaataccaatgtgggcttttattaaaggatctcaaacataaagacaagacatgtttctgagacttgccgtttctggaattgttgccaagaattgtgacatatttagatttatacccagtaacaaaatcataaaaggaactctagttttaaacttaaatgcagaggcaaagatctcactaatttttgatgacttctaggtcttgactatcaacatggctttgttgagcacatcctgtgcataaaggataagacaagagaccttgtcatcaagagaattctaaagcatatatatgcatgcatgtaaccagctaactgtacgagtctagcttactatgattctaaattgctttctttagcttaaataaggtaattaatgtttttatagttcttctggatctgcctcagtcctgacacacagcagctcgggaaatagtctaaaacgcccagataccacagaatcacttaattcttccttgtccaatggaacaagtgatgctggtaagtgacctttgataatttaacttttttttctttaaaaatatttgtggccagatgtggtggctcatgccgtaatccc

SEQ ID NO: 53725 - DNA, 1065 bp, Homo sapiens
ttgaattccacattaataatgggacaattaatagtgggacgctgagcttcatatttcttcactgtaataatttcttcatcatagggctattgtaatataatatgtatgtaatatacaaataataaaataatgtatatgtaatgtccagcagataggaggcatcaaaggattcctctgagtgagtttgttgagtagtttgttgttgttactatacttagggagaaaaaggaagtttcacagaggaagtgacatttgaacattcaaaagtctttctctgtttttgatctgctaggcaggttaatggtcatttctgaatctgacaggttgagaattagtttttggagcatgcctgggcaatatgtggtggatgttaccatgatttgaatgaggtggtgttttgttttgttttcttttttttttttttagtctgtttatctgaagagaaatttgatcttcaagggtcaaatgtgtatgtttttcaggtagttcttccaacgtttattcttgaaagaagatctcttttagaaatgtatgcagacttttttgcacatccggacctgtttgtgaggtatttgactgaacatggtagtttccaacgtttacagatgttactcagcagctttctgccttttattttgcaggatagatggattccttgtcacctttcaaacatttctgggtattctgtggtattgaataatgtgtttacactggttgcctgtttgcttaaagttatatggtggcgatgttaggcaaccaagtttaacactttaaaaaattctcaagagcccgttaataggtagccaatattcacaaggccaatggtataagtttatttaatccaggcactggcaatcactgtcaaattatttgtactatatcctaatgaagcttaattttctgagttcagcaaacctttccaaagcacctgttgtttgctaggcactttcttacaagttggagaaaggaaaagtcatgtctgcccttgagcttacaatatagtatccaaattatagatgatttataaattttaaatataaagcttgcaatattatatatgtgtat

SEQ ID NO: 53726 - DNA, 1049 bp, Homo sapiens
ctcaaagtttaaattctcacacataaaaactacccttaaatctcaaatctatacccaatgaacaactggtacgttccatttttgcttacacgttactaataaatgcttaaattttacttcttaaattatctgttaatttaaacactgccatatttatttaaatttctgcctttggggaattggttattcttttaaatcttcatcaagaaaaaaaaaatatatatttatcaatgtcagccaatgtatccacccagcaagaaacttcagtgatatgtatctagcttcagtaaaccacagtctgagactaaggaatgcagagaagacgaactaacaacattccccattacaaaaaaatttcctgctaccagcgaaaggcaatgtgaactcacctccttgtaaatcaatttcacctttacattacttctatctcatacatatacacatatataatattgcaagctttatatttaaaatttataaatcatctataatttggatactatattgtaagctcaagggcagacatgacttttcctttctccaacttgtaagaaagtgcctagcaaacaacaggtgctttggaaaggtttgctgaactcagaaaattaagcttcattaggatatagtacaaataatttgacagtgattgccagtgcctggattaaataaacttataccattggccttgtgaatattggctacctattaacgggctcttgagaattttttaaagtgttaaacttggttgcctaacatcgccaccatataactttaagcaaacaggcaaccagtgtaaacacattattcaataccacagaatacccagaaatgtttgaaaggtgacaaggaatccatctatcctgcaaaataaaaggcagaaagctgctgagtaacatctgtaaacgttggaaactaccatgttcagtcaaatacctcacaaacaggtccggatgtgcaaaaaagtctgcatacatttctaaaagagatcttctttcaagaataaacgttggaagaactacctgaaaaacatacacatttgacccttgaag

SEQ ID NO: 53727 - DNA, 1071 bp, Homo sapiens
aggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaaccttttttttaaaaatgtgcatcttttattatcttttatggttaaacttggaagccaattatttggcaaccttgaatacaagagctagcttttcaaagaaagacacttgaaataatggaggatccattcttttcctctgtcagattgtatgttctgtctttagcccctgccaggcaattccccagaatcttcacttaactcatattgcacatgtagggctgcctaccaacattttatccaaaaatgttttattgccttagagggtttgggaagagtgtgtatttatagatccccaccccacagtgaacaaaaatagatagatagatagaataaaatgaatgccacagcagcagatggctcattctgaagggaaatacagaactatatctatctatctatctatcatcttttttatttaaaaatacattaaaaaaacaggtattagt

SEQ ID NO: 53728 - DNA, 1050 bp, Homo sapiens
aaacactttagctttttttcctggatatatgtcttagtcttaattccttcttttgccttctgcctgagatcgggtttctgatgacttaattgaagatgttttgttttagttctgattgaagatgttttgtttcagttctgaagttgttgataagaagatagaagagtttctttctagctttgaggagaagattgagaacctcactgaagaggcattcaacacccaggtgactgtgccagcctggtcttttggcctttggcccacacaagcccccagatacaaatcttaacagggcttcgccggccagtttttgagctttgcagccccaccttcctcttacaatagtgtctccctagcttcatccgtgcctcttatactggcatgtccatcacaagccgggctggacagggcccagtgtgttctgtgggaagtggtatgttgcctcacctgagcatctttctttttggtgggaacaggtcacagctctcatcaagctgaaggagtgtgaggatacccaccttggggaggaggtggataggaactggaatgaagtggttacacagcagtacctctttgaccgccttgcccacgaggtaacatggttttcagagtaagacagctcaaactggtcaaggttcctgattctacaggcatcacaggtctgtgcacaccagcattgtgtggaagagaaactcgaaacactagtcctggcctgattactcgctcacttcctgagttttcagactggcctctctagcaccttaggtggccacgtgagctgggtgctaatccttaccacaccaccaccaatttcaatcagagcagctctatttttatgctatatattgaggtctacaagattttgtggagaaaaagagttttgccgtttaaagaaaattgaggactctttgtctttacggagttcattattccaagtgcatgtgttttgacaacttctattccaaagtagtaaaacctatgaaaaagatctggatcttgtactccagtgtgactttggttaatacatagcccctacatggtgaattacca

SEQ ID NO: 53729 - DNA, 1111 bp, Homo sapiens
ttctttcctaaaggggaagctgtagttttggcaggccagcattatcatattctgtttagaagggaacctgacccctctgatgctgggcagctttcttcttaagatgaagactgctgggctgggaatgatggctcacgcctgtaatttcagcattttgggaggccaaggcagaagcattacttaaggtcaggatttcgagaccagtccaggcaacacagtgagaactcatccctacaaaaaataaaaaattagccaggcatggtggcacatgcctatagtctccgctacttgggaggctgaggtggaaggatcatttgagcccaggagtttggggctacagcatgctatgattgcaccacagtattccagcctgggcaacagagtaagaccctgtctcaaaagaaaagaaataaagaaagagagagagaaaaatagattgctggtaatagactaggattttgagtgaaatgggtttggcgtatctatactgtttgttacctttgttgaagattgtatgtggaaaccatgaacagtttagtatagaggctaaaatgggaggaaggaaatggtgagggatgtgtgtgcatacatacggatacatacatagatacatacatacatagccagaactagtatgtcaagcctgtttgtgaagctaaggtgctgggctttatcctgtagaaatggagaaccattaaaggatttaagaagatttgtggttaagaaatatccagagagacaagttatgaagctgttttaaagtacagatatgattccactcataggagttatctaaagtagtcaaattcatagaagcagaaaatataatggtggtttccagtagttggggagaagagggaagagacaagttattttatgggtacagaattttggttttgcaagatgaaaaagttctgaaaatctaatctactgcacaacagtgtgaatatagttaacattattgaactgtaccccttttttttctgagacagagtctcgctctgtcacccaggctggagtccagtggcgtgatcttggcccaactgcaacctccacctcttcggttcacgccattctcctgcctcagcctcccaagtagctgggactacag

SEQ ID NO: 53730 - DNA, 1104 bp, Homo sapiens
ggaagaattgttccaaatttgacaattatttagaattttggacccttaagattctttgaggctaggaggctgaggcaggaggatcacttgaggccacgagtttgagaccagcctggcaacataagaagaccttgtctgtacaaaagcaaaaaaattagccgggcatggtggcccctgtctgtagtcccagctactcaggaggctgaggtgggagtatggctagagcctaggcattcgaggttataatgaattacagtcgatagtaccactgcactccagcctgggtgaccagtgatatcctgtctccaggtaacacccaaacaaacaaacgaacaaattgagttgttagtaattttcttatgtccccccacaatgcctagttccatgctgggtacctggtaaaaaccaaagagaaacatttccctccctaatacctagtggatttccatgcttcttaaaatgcttccttctttttcttttagctactgtttcagctcattattgactacttagctgagttcaattccacaccagctgtctttacaatgataactgagcagttgaagaagacctactttaacatcctcatcaagcccgagactttggccaagtgggtataaatgagatgagcttatattttgaggacctgaaagtattactctccctagtgggtgggtgtgggggttaaggctatagttgcagtgctaattttcatccgtgtttgaatcgtgctctagtttaggagacccgtgcatagcgttacggtatttctaaacccagcttatgtagctagctgtgaatgggactgaaagcagcttactgtagagactaaaagtaaggaagggtgttttcaccaatcattatacctgaatgttaaagaagtgctagttttaggccgggcatggtagcttatatctgtaatcccagcactttgagaagctgaggtgggaggatcacaagcctagaagttcaagactagcctgggcaatatagcaagacttcatctctacaaaaaattaaaaaattagctgggtgtggtggcacatgcctgtagtcccagctacttggcagactgaggtgggaggattgcttgagcccaggagg

SEQ ID NO: 53731 - DNA, 1025 bp, Homo sapiens
aaaatccaaacttaaaatgacaagcagcactagaatttgttaatattcactctaaaaaatgcattcccaaactcatatttttaattagtcagaatgcctagacttggagggtagacagagccttcaggccagtgctgctgatgcctattccatttacctcattgtacaatataaatattatcattttgcatgtgtacatgacatgaaaaagattgggaaacactgctgaaggtaggaattctgtaatacacctctgaaactgaatcctgagtaagctgtattaccttttacattctggagtagagaatttatactttctaaaaatgaagctgcttactctaaattgaagcaaatctatttcatgtgtctttcttaccaattaaagatgccatttgcattttgtacttcttagtgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctgtaagtacaagtactctgttttccttatagagagcattaaaataccatatttatttagaggtttgtgcatgggatgctgtatagagaaataaatgtttattaatgtggattatcttgaatattcttggctgatgacagctattctaactgtgactgactatccataagaacaacatatgtttcattaattactggcagtgcatgggattatagcccatgctttaggattgatttcacttccctttgctgtcagtttctccacaaccaacactggcatttaggattggttctagctaaattttttaccatacaggaataaccttttttttttttttttttgagacagatactcactccatcacccagactggaatgcagtggtgtgatcttggttcactgcaacctccgcctcccgggttcaatcagttctcatgcctcagcctgctgagtagctgggactac

SEQ ID NO: 53732 - DNA, 1004 bp, Homo sapiens
gtactcaaattttaaaaattagctatttttcatctatgtgataatgaaactgttgttttaattaaccaaaaggacaagtttgactttgagcagaactattttgtaacttttcaaatgtatagcataaggttggtaaaaggcattctcatgaattaatggattgtttaataaattggtttatgaaactatcctgactaaaggctcctctctcagttaaaattgtctgtaagaaagggaatgaagcagaatgtgtagcaaccagaatcagttcttgggaaattccagatctttagaatttatttactttaagaccaacatagttttccctttggtattggtctactaatttaatgtattccaacatttgaatttggcttatttttgccacagagaaaagttacttagacttctgaagccaataacagattactggggctcctgctgaaatacttgagtgaattattattatcttcttttattagccacggactttacgttgaaggctttcgattgcccggaaacagaatacccagttaaaattgtgaatactccacaaggttgcctgtggtataagaaagacaacaaattcaaaatccccaaaggtaaaatgttgccctcctgttacttccctgctgaattccagtgttctctttagatgctctgtttcacatgtgattatctacttgctattttgatcttcctttgtggaggaggctggggctgggtgcctctatcagccaccttgatgccctctcaccctccctaaaaggagtaaaataagtaaaacaaatatttctccactttgctgtaacttgcttcccctgtgtatatcacctacttctctttccttttccccttccgtttgaagactttttctaggcttatctaccagatttatactgtcctcctatgctgtcacagaaatccttatggacactccagtgtccaggaaatgaaaatttaaggctagaatgaaatcgtttttagatttttttctttcagtt

SEQ ID NO: 53733 - DNA, 1049 bp, Homo sapiens
aattctgtttagtccttattgtagctggaggattactgaaggaggccctatcttggcagtgttttactgattcctggatatgaagtgatacaaaacatagctgttaggagcatagtccttggtagcatgtacaaatttagttagaactccacttttgccacttctagctgtattattctgtacaagttacataatctttaacctgagcaaattacttaaccatcacccaaagctgactgttattttgtgtaaataagtatatcttaggattgtttttaggaataaatgaaataatgtatgttaaatacttcctggctcacagtagaagcttagtagtaaaggatagctatttttactgctaatgctgttaatatgtaggatttaagataaacactgtttaaagcattatcaagaatatacttgatatttgtcaactatacctcaataaagtaggaaaaaagtttttgaaacactgttgagactttgtaaattagggtgttcatgaactgtaggtatttttatgagcatagatcttggaggtgcctaacaatgtgatttttgcctttttaacagagatgtattaggttaaaattgtgtgtatctctttcccctcttcccactttactaggtcattggtgaagccttgaatcagctagttcctcaaaaagcaaatcttgttttactgtctggtgctaatgagggaaaatgtgacctcaaggagaaatggtttggaactcaatatagtatagaaggtaaaatattttaacaattgtcttacatttaggtatatttaacttacctggaaatgtttattctttaataatttaatggttctagagggggaaaaagtataattttttaaaaagttcactttgaaatgaaaattacttatactactgcacaggaagttattttctgctatgtttatatttactaactagtgaaaaaattctgttatcttggtattttgggggcagagttttgacttagttttagaagaatgcttctcaaatgtagtgtgcatttttgtcacttggagatcttactaa

SEQ ID NO: 53734 - DNA, 1009 bp, Homo sapiens
gtagctatggctatattttcttagaattttttttttttggagatagggtcttgctttgttgcccatgctggagtatggtggcacgatctcagctcactgcagcttcaacctcctgggctcaagcatccctcccacctcagctccccaaggagctgacactacaggcgtgtactgccacacctggcttatttttgcattttttgtaaagacagggtttcgccatgttgcccaggctggtctcaagtaatctaaccacctctgtctcccaaatgctgggattacaggcgtgagccactatgtccagcctactgagcatcagattcttaagctgcaattatatctcgttgtatctgttcagaagcttttggttttattgttaataagaaagggagaaagtatttgtatgttgtggtaaatcaaatataataatggagaagttctggtgtgaaataatttacctctttacagacagatccagttgagtatgtggaaaacatgtgtgagaacatgcagctgtacccattgcaggacattctcactggagatcagcttctttttgaatacaagccagaagtaaggaggtttatacgtctaaaacttacttttaggggaagaggagggtgagaaagtacgaagatgtatttaagaaccatgggaacgaagaaaacttagttatatttagtcaggatttttgtttgtttaaacagaagtatcaacagttttgtgaataatttctcatggttcttttacataattaagttttaatataaggagaaaatcaaactcagtacttgttaggtcctattttaataattttcaaatgttgaaacatctactgcaatagatgaagtgattcctaagaattatgtggtttccctgtgaaaaatacgtagttgtttagcttaccttttaattcagttggagagtcaggacaattaaatttttaatcattttgaaaatatttattaaaaaaatgtaaggttcccgaattagaaacatatgacttagg

SEQ ID NO: 53735 - DNA, 1525 bp, Homo sapiens
tcaaaggctgagatttccacattttacatagaaagcctctatattttgttaatttgaatgtctgtagactgtcaatccaggaacattgattgggttaattttttccccacctgtagatgctgggctcttgcactgtttggtggaaatggtgagacaggatttgagcaaaattctacttattcagtgttcagcatttctattacattgactgatgagggttatgaacatttttatgaggtaaataattcaaattcagttgttttttccttttacgtagatatcactttatgcaaaagactaattggatgttttgttttcaggttgcttacactgtctttcagtatttaaaaatgctgcagaagctaggcccagaaaaaaggtaataaacacttcctggaatgaggccaggagccagtcctggtatatttgaggcttcaggctgccggtagacatgctttagtcttgccttgatggtttttcaggcattttctgctctatttcctttattgactccatatccttatccctctacatgtgattgtatactaaggctttacacatatgtgggcagtccctttattttcacgcttctcttttattgttgatgcttctattgagaattttttaaacttttattctaggttcaggggtatatgtgcaggtttgttatgtaggtaaacttgtgtcacggtggtttgttgtacagattattttgtcacccaggtactaagcctactacccaatagttaccttttctgatcctctccctcctcccgcccttctccctcaagtaggcagaaattttaatgtatcttctaattatagttttctccttcacagaatttttgaagagattcggaaaattgaggataatgaatttcattaccaagaacaggtactggaagtcaaattctttttgcatgttatctgtgactgagttgaagctggtgtagacattgttcctctttttgaaagtgtcggtggagttttaattctgtcattctgtgtcatgtgagtctccaggtggccttgaagctatctgaaaattaactattgggtttttgagtatttatattgagtaagataaggcagtgagaggattaagcagatgacacagatgatgttgtgtggtaatcatttatctacatagtcatccatctatcccttcaataaacattcatggagacttgttatggtatttaatattttgggaattcaaatattgtgaagacattctataaggtaatttatatttaccatgtataatgttagaaacattgtgctttggaattcaggggaaggagagcattttccttgattgaaataggctcacaggctgggcactgtggctcatgcctgtaatccaagcattttgggaggtcgagcaggcaggttgcttgagcccaggcatctagtaaaggactgggcagtgtggtgttttgggaagcgtatgggatatgttatgaggtcagagttctgatgtccgctctgcctgtcgtttactcactgtgtgaccttaggcaag

SEQ ID NO: 53736 - DNA, 1046 bp, Homo sapiens
catgatttacttaaaggaaaaactaaaactagaaccaagattttctgaccctctgaacaacacatttcattttaccacagaacccaatgtggtaccaaaagcttttacagacagtaattcatacctatattaggttctagactgataaggaatctacatttcatattgggtgaagcaaaaagatttatcatgagagcagataagtttggtgtccaagagaaaaagtagtgcccttaaattttgggatgattgtactcttcagtaatctcaaatgaaagagttaattttactatattttctgtttttatcttcctgctactaaattaattataatttcatgtttagtggacatatgtgagaataagtttgtgattatattttcaattattgtagccttagaggtaagattttctggtgtatttataccttttgtttttttcttctgaccattaaatttttttaaaagggtgaagccacttcattatatatcctggctggttggacatgaaggcaaaggcagcattctttctttccttaggaaaaagcaagtattcaattaataagtattttcagtatagcaatctctgaaaaatagtagacaataagtattatataatgcattcttttactttagctgccaggaagcctagaataaaatttaatgcttaattatagttattttaataacttacattattttaatggccatattatatttgtgtatttccttgtaagccaccttttagcccattgttggaagttatttgtacacaaaattttaaaaaatcataaatgaaattaatagattccagaattacataaaagaattagctctaatcaagaatttatatttgactgaatggtaaagaaatcaattatttaaatgccatggatctccaggctttcctaacccccaaggctagactttaatgaaaacttcattgggtaggtaaatcatagttaataggtgggactgcaaatggtatatgcagccatgttagcagaatgtttcctaagcattaaagcacctgtttaagtcacctata

SEQ ID NO: 53737 - DNA, 1032 bp, Homo sapiens
tcgcttgaacccaggaggtggaggttgccatgagctaagatcgtgctattgcactccagcctgggcgacaagagcgaaactccgtctttaaaaaaaaaaaaaaaaaaagaattaggcaaaaatattattaaaataattagaaagaacctggattgaatactgctagactaattattaagcaaggaagcttagggagttattgtctgtttttttaaggttttcccagagattaattccttggatattaaaatatacttcagaattgtttcttatgcatttttgtcttattaatattaatacattattgcacactggttcaatattcttgagtcccttgggttatttcattaatcatgtatggtagcaaaatatgcattgatgatgtagaagacttttaacaaagttaacttagttatatctataatttttttcattcttttataggaaatgctgagacgctcaagcatgagccaagaaagaataatattgatacacatgctagattgagagaattctggatgcgttactactcttctcattacatgactttagtggttcaatccaaaggtaactattaattatggctcttagagttaccttgaagtagcgctttcttaggatttgtttgcctgtatcagtgttgtagtgtactattaattactttagtgcttgaccttaatacaaagtaaaggaaatcagaacttggagatgtcacgtagctagtggcaaagctcagggaaacacaagatgatgagattctcaggcaaatttttttctcttacagaaataggtcttatctgtaagataagatatgtaggctggtctgtgaatgtactaatattctaataggtcatgaattgatcttttaagccaccttcagctgcaattgtatctgtggttttacatttactctatatcgattacaaactcttacagggcaaagtgttggtttgttcattcttacataaggtcctgtaaaaatggcatgattaattgagattgacatggtgacaatttaagaattatcttaaa

SEQ ID NO: 53738 - DNA, 1034 bp, Homo sapiens
tcctttttttgtcttttaacttactgtaattatgccccaatagttcgggtgcagtggctcacgcctataatcccagcactttgagaggctgaggtgggaggattgtttgagtccaggagtttgagaccagcctgggcctcatagcaagacccctgtcttaaaaaaaaaaaaaaaaaaaagtcccaatcattttaagtgcagtttggtgtacctcttggccatcaattttgttaaaaactctgattttcccaaagtattgggagaatatatactgataagtaatatatgctgtatatcttcaattagaagtgaagaactaaaaagcctctttaaaatttagttatactttttaatagctaccgattttatctttttttatcacttactatttttgttagatgttttcctaaaatgttatcttattctatcttaacaaaattttctaagttacatgttgacaggtttcacatctagtaactgagtcactcaacacaaagcttttaattgcttagagatcttcagagatatctatctagatatgttacttccgcagatttccaaaatctagtaattcagggaaaaaacttggttcagaattatgaaatgctgacatgaaatgatatttgggtgggctgtccagtccctcttccctttttttctgtctgtttctgctttttttccttaggtctgcacctgttcagcatttggcaggatggcaagcggaggagcagcagggtgaaactgacacagttctggtgagtttcactttgctgctcctcctgattctcagggaaagaattttgttactcctattggaaaacatccatctccaaatgaatccttaagataagatgcgaatattattcctttagggttgactcaactatttgtatgtgttctaattactccagtctgcagcggctctttgtgttggagttgggagtttcgctgatccagatgacctgccggggctggcacactttttggagcacagtaagaatttgtaaaatatcattcctggtgtgtttttttcc

SEQ ID NO: 53739 - DNA, 1040 bp, Homo sapiens
aagactccacctccaaataccattacattggggattaggcttcaacatgtaaatttggaggtggggacacagacattcagtctataggaatatgattaacatatctctttctatctcattttagggctactcagatcaagacctactcctgggacaatgcacaagttattctggtggggaacaagtgtgacatggaggaagagagggttgttcccactgagaagggccagctccttgcagagcagcttggtatgtacatgacacatgtatgtgcatgtgtgcatttgtacacatgctcatgagagtggggtaaacagggtacgagtgtgtttgtatttatgacattagtgttgtgattgtgaattatgtacctatgtgatctgtgtgtattgttttatatttgtatgaggtacatatgggctttgtgctgtgagttttagataattcatcatttttgatatgtatatattttgttatattgaatgtgtaaataaattttaaatttataaactctttttttttaccagttccttccacaaaggacttgagatatcttataaaaatggtcacaatacaacaataaaaataaataagtaagtgagaaaattggagcaaagggaaagcaagggtgagggaaaaataagaggaagctagggtaagtattaagttcttggacacctgcaagagttggggccaaaatgttgtctttgagcttcctagcaacctttgccaagagggaaacataatcagctacatggtttagagtgtcctagtataaaaacaaacccattattccagagaagcactactcttcatcatcaactgtagagcagactctgtatgctgaatgtgaccatgtcttgaatatcaaacatccttccagcactgagtatttatatgctgttcttacagtttatctcaatgcaaattcatgcttctcaccaaaacacaattcacaacaaaagtaatagtatgaaggaacaaaactatgtggtttgagtatgtagctcatcggtgtcctgactttttccaagcttaac

SEQ ID NO: 53740 - DNA, 1745 bp, Homo sapiens
atggtttggctttgcaagattcatagactctggctcaacccagcttctggcctgccattatataggggtgctttgtagaaccaccattcaggagcctatactgaaatagctgtcccccttgagtctaaatccataagcaggatgccccaagacagacaagaagtttcatctcgagtctacttaaggccctccttccaggtttctctctctctttttttttttttttttttttggcctgagaacttggcttcatccatgtatagttgatactggaaatgacgacccccttcagtagagacacccccgccccagcacacacacccctcagtgtaatctgtaacctccacaggaagtaaaataagtgcaacattcatccaaaagatacaatggggacggtaggaaggtgtttcctcttccctgggggtgaagtgaacatctacagtctaggacaggggatcagctctaatcctagagggtaagccaaaataactgctaagattttggtatgacttcgtagttgataaagcacttttattatccattctcccatttaacttttataatactgtgtgaagtgagttacattatttcattttataaatgaggaaacaaattcaaagagataaatgacttgccagggccaaaatccagagctagatcttgagtccagatcttgtactcctctcatatttcttctgaaacatttaaaagtgtacattggttgtcaaatgtcaaacattacttacttcatacttttttcctccaatctttatttcacagttgttcaggggatgaaggaagctcaggaaaggctgacgggtgatgccttcagaaagaaacatcttgaagatgaattgtaacatgaatgtgccccttctttcatcagagttagtgttctggaaggaaagcagcagggaagggaatattgaggaatcatctagaacaattaagccgaccaggaaacctcattcctacctacactggaaggagcgctctcactgtggaagagttctgctaacagaagctggtctgcatgtttgtggatccagcggagagtggcagactttcttctccttttccctctcacctaaatgtcaacttgtcattgaatgtaaagaatgaaaccttctgacacaaaacttgagccacttggatgtttactcctcgcacttaagtatttgagtcttttcccatttcctcccactttactcaccttagtggtgaaaggagactagtagcatcttttctacaacgttaaaattgcagaagtagcttatcattaaaaaacaacaacaacaacaataacaataaatcctaagtgtaaatcagttattctaccccctaccaaggatatcagcctgttttttcccttttttctcctgggaataattgtgggcttcttcccaaatttctacagcctctttcctcttctcatgcttgagcttccctgtttgcacgcatgcgtgtgcaggactggctgtgtgcttggactcggctccaggtggaagcatgctttcccttgttactgttggagaaactcaaaccttcaagccctaggtgtagccattttgtcaagtcatcaactgtatttttgtactggcattaacaaaaaaagagataaaatattgtaccattaaactttaataaaactttaaaaggaaatgtgctgtgatggcctttttgttattggaaaaggagggagggatggagatcacttcaggaagaaaactaacctagaggaccta

SEQ ID NO: 53741 - DNA, 1059 bp, Homo sapiens
tgctttgagacagagtctgttctgtcggccaggctggagtgtagtggtgcggtctcagctcactgcaacctctgcctcccaggcttaagcaattctcatatttcagccaccccagtagctgggactacaggcacgtgccaccacgcccagctaatttttgtatttttagtggagacagggttttgttatgttggccaggctggtcttgaatccgtggcctcaagtcatctgcccacttcagcctcccaaagtgctgggattacagacatgagccactgtgcccagccctccctaactttaaagcccaagtttgcagaatttacagaagtgttagaacttaacaataattttgttacagcaattatctattattattgaacatttgtctaaagattttcccaattgaaataatactacagaaatgtcttcacatattaatctttatcattaaatttcaagaagtagaattactagattataatttctttgttttgcttttaagtggactgcccctgatggtgattattcataaatcctggtgtggagcttgcaaaggtaagtgcaaatgctcaatctaaattcaaaactcagatgtgttgttaaatattaacatttaacaaatattggcactgactctggcccagcactactgactgtttaaggaatactaaagaaacatatgacatagatttcctgccttcatgaaatttgcaattatatttggaggggattttagggaagttaaggtgattaagatacagttatgtcacgtatgggattaagtgctaaaatgtcaaatgaacaatacatgttagaggaagctgaaatgtacggacagagacatgagaaggaagtaggacccaaattagaacccaagttatctgactctgtggcatgtgttctttctgctataccaccttgccacttccccagacaggctttttcttttatttagtatgctgcacttaaaatcctagatggaaaaggagtgtaaaaaatagtataaaagaccaggcgcagtggctcatgcctgtaatcccagcactctgggaggctggg

SEQ ID NO: 53742 - DNA, 1583 bp, Homo sapiens
aggccctaacgctgcgctttgaggctcccgattctcggaatcgctgggaccggcctttattcactttggtgggcctagaggagccgttgcccctggcggggatccgctctgccctgtttgagaaccgggccccaccaccccatcagtctacgcagtcccagcccctcgcctccggcagctttctgcaccagttggaccaggtcacgagtcaagtactggccggattgatggaagcgcagaagagcgctgtccccggggacttgctcacgcttcctggtaccacagagcacttgcggtttacccggcccttgaccatggcagaactgagtcgccttcgtcgccagtttatttcgtacactaaaatgcatcccaacaatgagaacttgccgcaactggccaacatgtttcttcagtatttgagccagagcctgcactgaccagaggaggtaggggggaagccatggcttctgatctccactccactttatttctctgggaaaaataggctgcaggtctccagagcatatcgatgcagtactgtactagagctgttgtgactgattcactcaaactttcctgcatacccctgtgccaggccttgggtttacagcataagttcagactaaagagaatggagaactattgtggtgcaacctggcaaatccctcagaggacagagctaaggtggacagggattacctagattggatcctacttgggctatcacagagcattgaccattggcttccctcatctgaggcgtgggagagcagactggatagatgagaattgttttaaaacaattgtgaacagaaactgaagatggtacagttctacatctgcacctgcccttttttcataccacaaaagtattttttgagtactgtactgactttttgctagtttctattctgggaccgagttcacagataaatccattggtttgtatccttgagaaactttgtttttgtggaagtaagaaagttatctactagattatttcctctaataaaatcttttaaaatagtctactggaatctctttcacttaatgttccctgtgtaacttcatgtaacattttaggtatacttgtcattgttctgcctttaagtgaagtagtattttgatagttctgagagagtagatgttttgagctactctacagtaattatattatgacaatttccgtaactgttttgcttcattctgcatttcaaggcaaatatcattgtaagcttgtctttcattcttcattgatttcattgaacaaatggtaggtacctactttaacagtggctgtgattttcaaagaccaattagatacagtgtttttgctcttgagatatgtggtgagaagccgggtgtggtggctcatacttgtaatcccagcactttgggagtccaaaatcgaggtcaggagttcgagaccagcctggccaacgtggcaaaacctcgtctctattaacagtacaaaaattagttgggcgtgatggtgtgcctgtaatcccagctactctggaggctgaggcacgagaatcgcttgaacctgggaggtggaggttgcagtgagctgagatcgcacc

SEQ ID NO: 53743 - DNA, 1073 bp, Homo sapiens
ttattgtcttgcttttacagatgaaggaggaaaataagaaagaaattgggacttggagagcttacttcactcacaagaattcacacacgtaataggaagtggagtcatggacctaggtctttctgaatctaaagctgtattgctgaatcaccttcaattggttatgatttgttatgacctgctttatgtttactctgtgggaaattctcgttcattcttacagtattattagcatattccgtgatagtttacaaagcatttaacgtcatttttaaatttagcctcctttgaaactgtgaattaggtggtggtgtctccattttgcaggtatgaaaactgaggcttgaggtatggtcccatacacctagaaggtggtggagctgggacttgaacaccaagctcttgacagaagaaaaccttcttagtgggtatcttgtgaacatgcacacttccttcttgggactgtgccctttgttcattatgtgaatgcttataaagttctttccttccaggttttggagatcatattcattggaggacactggaagatgggaagaaagaagcagctgccaggtacaagacatggttttaggtcatttatggtggtaaaacacttttcagctatcaacttaacgttaatttcaggtgaagggctataccaaggcagagcaagaactgaatagttgcctaattacaacaacagcaataataatggctaacatttatagttgagccttgaacaacatgggttttttttctttttttttttttctttttgagatggagtctcactctctcgcccaggctggagtgcagtggcacgatctcggctcactgcaagctccacctcctgggctcacgccattctcctgcctcagcctcccgagtagctgggactacaggcacccgccaccacgcctggctaatttttttgtatttttagtagagacggggtttcaccgtgttagccaggatggtctcaatctcctgatctcatgatccacccgcctcggcctcccaaagtgctgggattacaggcgtgagccaccgcgcccggcctttttttttctttt

SEQ ID NO: 53744 - DNA, 1594 bp, Homo sapiens
cacagatttgactttctttttttttttttgagacagagtcttgctctgtcacccaggctggagtgtggtggcgtgatctcaactcactgtaaactctgcctgccaggttcaagcaattctcctacttcagcctcccaagtagctgggactattggcttgcaccacggcacctggctaacttttttgtattgtagtagagacagggtttcaccatgttgcccaggatggtctcgaactcctgagctcaggcaatccatccacgtcggcctcccaaagtgctaggattacagacatgagccaccacacctggccagatttgactatttattttgcatgctgcatgcctgtttttgtgattccatgtgttatttctttaaacatttcatgcatagctatttctgtattttgtggctgataattctaatatctgaattcctcagggatcaaaatctgtttgttgcttgtgttcttgtggcgacttcttttctcacatttttggtgatccatgattgtgagctcataatggttgttcttcttcattggctatcctggaagcctaaagtggagaatcttttcctccagaaagttttggcatttgattcatctgaaaaccagggggtaccactcacgtggaatcactttagtctcttttgagggttgtgttaatgtgggagtttcagattcatctccattttgccacatcataatggacgcttgcgttcagggcagcctcacttgcttgttgctcataggttttagcttgctttgtgtttatggagggttctgtcattactgagtctagtgagcacattctgaaagtccattttatctaggatttcattgttttgtaggtgtatatcccttcagactgtctggttgggcatcttgccaaagcaggattcagttgcctgagtttagatattgaccaatagagtgatggtgatcatgttagacaccttgcagttctcctgggcatcctctcaatttcattctcaatcactcactcttcagagtcaaatcttgagccttaggcaagtgacagcatcccatgctgttgggaatgaaaagtgaggatggttagtttcgatactgcctgcatgtgctcatctggatgaccttttgtttccctgtggtagcactgatgaaaattagatttgaatttatttctgagaaagaaaaatctgaaagatgagtgtagtaaaccagaatggcacacgattgcaatttaaatctcagcttggccatttagcagttatgtgaccagtacaggtgatgtaacttctctgagcctcagaagtctcaatcgtatagaataacaaaagctactacttactgatcatttataatatgctaagcactatgctaagttttttgcatatatttcttatttaatattcagtaaccttatgagatataattattttatgcctcttttaaagatgagaaaacaagcatacagagattaagtaaaactgggttattaataaggccaaatttaaatgagataacacatgtggtatgtcaggcacatataaggtggtcagtaaacagcagctagcattatgatcactaataatttttggatataaaattc

SEQ ID NO: 53745 - DNA, 1087 bp, Homo sapiens
gcaggaacctaacaatgaaatccagttgtccagtcttgatttgtggaggggtaaggagaatccgaggccagtgggcaatccgcccactgttgggagcgactgacctcacgaatcaataatttgcttttgactaggaagtgcagcggttcttggggggaggggctggactgggtggcggacgcgaggagcaacggttctcccgaacctctcccccgcccctactatcttggcctacattttcccgctccgtcccgggacctggacacccagaatccacgaaaagcaactcgcgctcgagaacagctctcgtacccttctacgtgatctgcacctttaagctcactccatcccaaaccggaccccggaggcaccacccacatccgtctaacatcacttccttcagagtttgaaaaaaaaaaatctgggaagtagaggtgttgtgctgagcggcgctcggcgaactgtgtggaccgtctgctgggactccggccctgcgtccgctcagccccgtggccccgcgcacctactgccatggagacgcggcctcgtctcggggccacctgtttgctgggcttcagtttcctgctcctcgtcatctcttctgatggacataatgggcttggaaagggtcagaccgcgttcttatcttctctttactgatctttactatactgatcccagtataatctcttcttgccctagcaccgttcccctcccattctaactcttaggccactccagatttctttttatcttccccaaccgctcctggagtttgaagatttcttggggtagagagtagcgggtctggggaatggagaagttgtacttgaggcctctctaaattattggattggggggaaggaatggcccgtaaattaaggaaagcatgttaagagcccagcatagtgcctagcacttgggaggtcctgaggaacggtcaccttcccacctgggagaaatagagccgttggggacctgcatatgcagaggaccctgttctgggtctgaagatttctctcgttacttcttccgcgaagagctaggttactgccacttgcttgcctttgggaaacagcacctgcat

SEQ ID NO: 53746 - DNA, 2095 bp, Homo sapiens
tgttagacggatgtgggtggtgcctccggggtccggtttgggatggagtgagcttaaaggtgcagatcacgtagaagggtacgagagctgttctcgagcgcgagttgcttttcgtggattctgggtgtccaggtcccgggacggagcgggaaaatgtaggccaagatagtaggggcgggggagaggttcgggagaaccgttgctcctcgcgtccgccacccagtccagcccctccccccaagaaccgctgcacttcctagtcaaaagcaaattattgattcgtgaggtcagtcgctcccaacagtgggcggattgcccactggcctcggattctccttacccctccacaaatcaagactggacaactggatttcattgttaggttcctgcgagggtctctgaggagacctggcaagcctgttctgcggtgcgtgggctcgtgccgtgcagacatgcactttcccgctggagaagctctgtaccttatttttccttgcaaccgcaaatcttctactcagggatgatgcaaccaactgatgcaagctccaagaaaaccaaacttgggacctcttattgcaaaactgacttaggtggacttaggacaccaggatataagtcactgcaggctaaagtgtaaagcttctggttatttttcttgtagcttgaggatttcttcccaatttttccccttcgctgtataacaaacaggtgaaaatgtccggtctttttcttcctggtactagttgagtcctaaagtccgtacttaatgcatagcgaaaaagcgacctaacaaaagtacacacccaaataaaaacataccgaccacccttttattaggttccctaaaattgtaggcagggacacaacagaacgctcgggagactgcaagccccaggatgccgcgcggccacctgcacctgccgccactagcactaagagggatgcgcaaagcaggcggggcgttggagttcagatgttcgctcccgggataggctgccccggagagggagaggcggggtcggctgtatcacgtggatctgctcccgccgccgccgccgccgccgtcgtctttctctgtctcggctgaggcagccatctttctcttgccgcgtgctggtgttggaggaccctccctgcttcaggtgagacccccggcggtcccgccacttcacggccataggccgctgcgcacggtctccccccgccctccccttccgacacccgccaaccgctcaggctgccacttccgccgtggtgcggcgagcgggggcggaggcggctggcttggcctgtcggttaccggcggcgcagctgggggtcggcacctgtgggaaggtccccagcaccaccgccccctgtgggagcgagcgggcccgccctgttgccgcccagaccctgtcccaggaggcaggtggacgcccctcctctgttccattactccttgctcacaacagcagtgttgtgtgctttgagctttatacaggctctctgttgtcatctcatttgatgctcccagtctacagatagggaagctgaggttaccacttcccgcccttgagtccagggaaccgaactcagttacagcactcttcaccttgtaatggcagtgtttgtttacaagtcggcgtcccttgcccatctttataacccccctcccactgcctgctgaccgacaggctcagtgttgcacagctagtgaatggcggtttcaacttccgttcccacattcttgcagtttaccatagttgtcccctcgggagtggtaacaatagttaccagtaactgtgtatcttctgtgaaccattccctgtggttgataatgttttaaccctcaaaacaaccctgtgaagtacgtggtgttatacctttccaaatgcaggaggaatacaagttcagagaagaaaaatacctttcccaactggtagaaccttggtctttctgattccaaagcctgtgcttgtcttagagaaaccctacataataaaaagtcaggactcaaggttgcaattatttttatctctgtgtaaacatgatgtatgtgaaagtgcctaccacaatgcttctaacttaggcacttaataaatataaacctgtt

SEQ ID NO: 53747 - DNA, 2017 bp, Homo sapiens
ccaaagggtttaccaagtatctaggtctaatgtttttccttagcccctttttttttgcaataaattcctttggctctttgttagttcactacactctcatggccacattcctttgagaaaagtgaatgttggtccttttctgtggatatttgagcataggaattgggatttaagtcatcaaatttaagtctatggcagagctaagattggcacacatttaagacttcttgttttggactctaaacacacttcctcctataaaagtgtttttagctgcttcagcattgtgatacagcgctgagcagagtgaagaatcataaattctaaatattatttgggatctggacattagccttaaagaagagatagatatataggttattgcctaaggatagtgtcaaagtacaaaatggttagtaattatatagtctttgatgctgctttttttaatctctcaaatgaagcaaacagtatttttttcatgtgaatgatgactatacagggtttagagaattggccaaagaagatttgataacaacctagtcccttattccctccctcacatctcagtaatgatttgttgatctgcagaacaagtaaaacaagacttttaatttggcttttttttttttttgagacggagtttcgctcttgttgctcaggctggagtgcaatggcatgatcttggctcaccgcaacctccgcctcccgggttcaggcgattctcctgcctcagccttctgagtagctgggattacaggcatgtgccaccacgcccggctaattttgtatttttagtaaagacaggtttctccatgttggtcaggctggcctcgaactcccgacctcaggtgatccatccgcctcggcctcccaaagtgctgggattacaggcgtgagccaccgtgccgggcctgaatttggcttttctttgtttatgtaatgtggaatgtgatgacccattataaacttaagaatgtttttttcttagtgggattatcactgaccagactagattcatgactataattttagaatcttcaaaatcaagattaactttaaaaagcttgttttaggagtctcctctctgcccccccccaacatttattactgtagcaaagatatgtttttgttaaattgtgcaatgaagcattttaccctgtatgcaagaatgtcttgacaagtataacatactatatcagtgcagggtattgaatgaactctggagagtgctgcagaagcaccaaatgtctgaaaacctggttctctttccccattattaacataccatctgaccttgaatagaggacatgactacttgatatcttgacagctagacagccttttgttgaatttcttctttgttcagcttttttttccttttgtcatctttatggtttataagaaatacagaatgtgatttgggaggaaaaaaatctacttgaagattttgctaataacatttggtaacagctctctgctgtaaaaatctttgggggaaaaaaactggcttgcctacagagatttcataattggttaggcttaactgaatgccaaaggattgaatcatgttttaaggagggatctttgaataggtgactttgaatcccattctactttctgtttgtatatttgattccctcatggtaatttaattttgatttttaaaaatatctggtttatgaagctagaacaagttattaatgtttattaagaatatagacagtattaatatggtcatggtgttgatgcatactacaagctcagtgaaccagaaggtactgttgcataaacagtttgttaatttcggcaaaagagtgactttaacaaatctatttttccccccctagatttaccaacagcatgaatcaagaaaagttagccaaacttcaggctcaggtccggatagggggcaaggtgagtgtggcataagaaaaattgataggagaatgtatgattaccagatagtgttattatttcggatttgtggtcattgaaaatctaaaatcttttcaat

SEQ ID NO: 53748 - DNA, 1023 bp, Homo sapiens
gatttggtcttgatttgaaaaatatagtcctaccatatcttttgttcttttcccattctaaaattatgtgattctaggctaaatgcagagcaacatcccatttcacatccactgtcatccttctcgagcccagatttcacccactttaacatttaactttttaacaaaactgtaattatcttcaaaactatataatttatcttttctgaagttaacataactcacagtgctgtgtttttagaacagctgggttgaatgcttgtgtgtgatataattaatagaaccctaagtgtaatagtgagagagggaagggtatagaatttaaatagtgatttttgtcagaaaaacctggggaaattatttgtgggtttagttacaattttccagggatttgcctttattttctctgtgttccaggtcttgcctgaaatttagaagcccctttcttgcccttcctttctggtgctatcaatggtggtaatcacctctgaggaagaaaagccctcttcccactgtccatggagaacactcagcatctatgcttgattttgacagggcagattttggatgaatcatgaaatgcttctaaagtagccaagagttaactcttcctaacctttttatatagtaagcatgttaccccacaaggtaacttacccaggggaatcaactacatagtggaatcacgttattcacacatttaacttacacaaattcaactctactgaaaaaaacatgaagtacatgagtgagagagaaaaataacaatcttaagtagcacatgttaaaccttccatttcagtaagtcccaggcaatggatgaaatcaaatctgaaatagttcatattggtgaaagttatggaaagaatgtgaggatgatttttaaaggtttcctagttgataaagcatgttcaggtcactaggtgagtgggtgggacaatttctttgacctttacaggggttattaaagattgttgagaagctacccttaagaattagaggaactggctgggtgtggtggct

SEQ ID NO: 53749 - DNA, 1024 bp, Homo sapiens
aagaactagcaaaatcccttacaaagaatggcatgattagaacaagttgaaatttttataaatgtactaagtgcttgaaggaatgaaacacctggttacgtttctgagtgttctttatggatttttagtggttgtttttaccatatactatttcccctttgtaaccagtcccctaagtaagatgctaccctgccaagtggaaattgcactgattttgtttgacagtataaattgagtaagataatgagtaatttcattaagaagctggtttttggctgatacttccattttttaaaaaaacatggtcatgtacttccttctcttagaagtctttgaatttaaaatctagattctataatgaattgaatatttcttgtccatcctagtaatttgtgccatctacaccattttactttattactatgatctttttccacgaatgtccgttgcttggccagttactaccttgggattacataactaccaagtaaagaaccataattggctgaattgctttttaaaaatatattgttttagtgtacctagcatgtgaagtacatttttcttctgtgatcatacaggtgaacatgattaaagatgatgggacagttattcatttcaacaatcccaaagtccaagcttccctttctgctaatacctttgcaattactggtcatgcagaagccaaaccaatcacagaaatgcttcctggaatattaagtcagcttggtgctgacagtttaacaagccttaggaagttagctgaacagttcccacggcaaggtaggtatttcaatttagtaaatctttctctccccaccttacttaaagaacctaatcatttaaaaggtgtcccatcttaatttggatttgcctgtatgtaattattttactttctataaagttatttctatgcttcataaaattttgagtttgtttaatgattatgtagtgtgacatatagaatattcagaaacatggctgggcgtggtggctcatgcctgtattctcagcactttgggag

SEQ ID NO: 53750 - DNA, 1016 bp, Homo sapiens
tttaagcatcctgtttatctcctttcagtcattgcatagataacttttaggtttgtgttgattgtaagctcatgaatttaaattgattcacaataatgtggataggatctaatgaaaaacaacgtaagcacccaccttagaacctagaatcagaaattgtcacacaaagctctgctgcctggatttattaaattgaaatcactgtgattataaatttgcatagctattgttataacatttctgtatgaattataattgacatatgaaaatgctattcacctcagtaatttgcatagacaaaagatgaacatttccttaggattactgtcctaagcaaataattaaatcattgttagtaaaatgccaccagttcatttctgcctccttatgttttcaggctaattctggttgtactaattttattttttcgggggttagaagttaggagttccatttacctctttttccttttttgtattctttgattcatatactttgtttttctttttcagatcttgtagaaaattttgatgaggcatcaaagaatgaagctaactaaaagtttggtttttggaagctggcatggactagatttaacaaatcagctatgtggttccaaagttttacagacatggagaacatcacctgttactagttcagtaatataaatattttgtatattaataatgctgtttgttcagcatttttcggtcatttgattttgcattttgcacttcctcccaggatatttttttggtcaaaatatgaagtattggtgcagtttgagggtgttttggtttttgattcctggtttttttgttttttgtttggggtatttttggtgtatgtatgtttatgtatgtgtgtgggtatgtgtgtatacagtggagagcaaattggaaaacagttctatttatcctcctccctccccagtagaaataaaaaaaatctttacatttgttacttttcttttccccccgtaagacacagaattaatggaaagtgagtatcttgga

SEQ ID NO: 53751 - DNA, 1059 bp, Homo sapiens
catcttcaactttttatttctccctgatgttacagtttggtagatttcaaactggaatagctagcatgtgcttgctaaataattttatgccagccttatcctgtatcctagctgttcttaacagcaggtacaaaaatgcctgtttttcagcaaggttgaaattgggaatgtccttttgaatcagaagaaaataggccatagactcatctcccagcacaaatgggcattctatgaaatggtactggccctaggaggatttcctcaaccactctcctactcttggccttgaacctacctctgggttggatcttactattgtagctgctcactataccctcctgcatgcttagaataatgctttgaggggagcactggtaaaacacagtatttatttttttacctcctttaagaggacttggaggtaagttgcattcattcactcaagtttccctcttgctgtctaatagaagcttactttttgctatatcagcatttgttacagccaatatttaaggacaaaatttagaaaatatatcatttcctggcccatcatcaaactaatacagcttaaccttgcagctaccaacttttgtgtcaagctagatatctttatttgatatctaaggtgcaagaccaacaatatattaagagatctgtagacatgaaggcaaagctcttgtattttttttcatccaaacacctcaatttattttataaattcgttcatttttcctgttatgttttatataatatatggactaaacaaaataaaataacagtgcaaaagaggagaatatttcctcttgtgcttttcttgatgttgtgtacagaatttccttttatattattcctctaccctccacctgtaaatgaatgttagtgcagtaattgtttgaaataatgcctcatccagtgttaggtcagtagctccacagtctacacagtccagaattctttctctaattgtcccaaagggggacattgtggaggcagagttagggggaaccacttcaagtggttagggacagataaataataggcagtatagcacatgaaaga

SEQ ID NO: 53752 - DNA, 1094 bp, Homo sapiens
aaatactgtgccattttatataagggatttgagcatccacagattgtggtatcctgtgggttcctggaaccagtcctccacagatacagagagacaactgtatataataatcattggaaaagatgtagttgcaggcactgaatagaaatagttcatatatttagttttcaaaaaactctcaatttattaaatttacttaagaactgttttcagaacatagatttttccttataaactacagtaggctagaactagattttatagcctgccagtcttttcttataaccttggacaagtttgttaccctctttaagtctcaattttcttttctataaaatgcaactgataatagtcaccttacaggattattgtaagtattaaatgatataatgggtaaatcagagctatagttcagtcccatgagtcctggtaaatccggactctggaattggaaaatatatttctctgagttttgaaaaaaagaggttgaaagattgttaattatttatgtagtttactattaataagtaaaatcagcataatctaattttgaagtattagagattgctaaattaaggaggaaccaaggtgtcagtagaattagcatttagttatgtagtagaataccttatattttataatggtaaaatttatttaataaaataatttgaaaagtgctgtttttacaggttgagcatccctaatccaaaagtctgaaattcgaaatgctcaaaggtccaaaactttttgagcactgacatgatctcacaagtggaaaaattccacgcctgatctcatgtgatgggtcacaatcaaaatggtcaaaactttgtttcatgtacaaaattattaaaaatagtgtataaagttacctttaggctatgcgtataagtatacatgaaacaaatgaattttgtgtttagacttgcgtcagaattctaatctgtcccaaatgcttctggttccaagtattttagataagggatactcaacgcataaagtattttctattttacaaattaattaatacttatatttttcttttaaattatggtaaatagcccatttacggaactggaaaagttagaacagta

SEQ ID NO: 53753 - DNA, 1129 bp, Homo sapiens
ctcactgcaggctccgccccccggggttcatgccattctcctgcctcagcctcccgagtagctgggactacaggcgcccaccacctcgcccagctaattttttgtatttttagtagagacggggtttcactgtgttagccaggatggtctcgatctcctgacctcgtggtccacccgcctcggcctcccaaagtgctgggattacaggcgtgagccaccacgcccggccacaggagctgtttttctaatagcatggccttcctgcagaactctaggggcctgcattttgattctcttccttgctataaactctacactgcatcttttcccaccattggtacctccaacagcatagggattgcttgcactacagcctggacttgctgcagagttgttgcccctactcaatactagcagcctttcatgtcaaccagtatatgggccacagtggtattcctggatatagaatgtgttacttctagaatctgaaggagcctaccagacattgtgcttccttttttgtagttggggatgcaagatgcagcaatttgtcttttgctttggaggggatgtgttggcatgattgcgaccactggactcttaaaactttgctgaaatggaagatccctgaatattggtagggtttttctttaccctctttggaacacatgtaccccaccaagttcttcagtatgctagccacctcttgctcatcttgcaagatcaacatgtatcactgacgtgatggatctatatgctttgagtccagatctctgcagactattatgatagagtggagttaacatagccccaaagcaaaaccatgaatgcattttattgtttgttccatgtgaaagtgaactgcttctgatcctcttttctgattaggatagaaaggaacttatttgccatataaatggctgcatgctgtgtacccaaggctatatttatctgctacaacaaacatactacatctagcatggcaatgtggtcatggctgctacttgtttgagcttgtggtagatccaactggttcctgcaggggctagacttttgaattacatggatatatatagggactactgcccttgaatctttgagatccttaaaggtgacactcatcattgcc

SEQ ID NO: 53754 - DNA, 1048 bp, Homo sapiens
taaataataacagcaaatttgtcttctagactgtgtcatcaattattggaggattggaagcatatcttgtatcctacttagctcctcttctttgactctcctgctatttgtgctctgttttaatgccctctgttctttgaagcaacagtagttacatggaaaaaggggtgagtttgcataccgtcacactttggtatgcagtagaagtgccttcttcatatttccattttgtcacacagaatattaaaaagactttactcgagttgagatttaacaaagttaataatttttattgcttcatcagtcaagtgaaactgacgttttagaacaactgagagtgcatggcagtgaagaataagactaccagtatagtttggtattgctgccttgattattgctaaggtgcaagcagttctacccatcattgctattgtgctttcactacagttgtcaacatggtgaaaagggcatacatactaagatgtggattcccgcgagtctgtggactacaatttgagaaccactggagtaatctgaactcatcccatttttagtttgaatgttgcaacctgcactttacctcataagattacctagcctgtttaaaagtttttataaattcaacaacctggttagataaactctattgagtgtttaactgacttaatcattttaaaatgttttaataatacagggcttaatctatatccttcatgatttttcatctgaacactttattgtttgcttatatatactaattctaccctgatgattaaaaaaaaaagttttaggctgggtgcggtagcttatgcctgtaatcccagcgtgaggaggccaaggtaggagcattgcttgagcccaggagttcgagaccagcctagacaacatcttgtcccatctctacaaaaaacaaaaaagtcaggcatggtgacacgcacctgtagtcccagctggaggctgaggtgggaggatcacccgagcctggggaggtcaaggctgcagtagctgtgataatgccactgcactccagcctgggtgacaccagatc

SEQ ID NO: 53755 - DNA, 1048 bp, Homo sapiens
aggattgtttgagctcaggagttcaagaccagtctgggcagcatactgagtctctatctctaagctaaacaaaacaaaaaaagaattgataaaatgttttgccaagtctgatgacgtacaacattttttgtttgtttgcttgggagtggaacctttgggtctgcctccgcattgcagtactatctccccacttgctaacactcatcccaggtttatgcttttcttaagaggtgttcaacaatttaatacctactagttcagctttttcattgaagagggagtaataattataccttacagagtgctttcttttttaattttcattaacaaagggttggaacagatatttttattatcctcatttaagaagagaaaaaaacaggtagaagctaagcaagttttctaatgccacaccatgctaaaagattgtaaattcccatggaaagacttattctgacaaaattatcaatggttagtgtatttttaatgaaattaaaaatgaaattataagcctgggaaatgttattgaggaatgtctaaaattctattgcttagctctgttaagtagctgtagagtattagtccctaattaataaaccaaataagtaagatatgctatttattgagttggaagttttaatatagagtattgctaagcacttttaaatcctttgttaaaaataaaattggttagatgcagaaaaggctcttgatggccgggcacggtggctcacgcctgtaatcccagcacttttggaggccaaggcgggcagatcacaaggtcaagaaatcgagaccatcctggccaacatggtgaaaccccatctctactaaaaatataaaaattagctgggcatggtggtgtttctgtagtcccagctacttgagaggctgagactggagaatcgcttgaacctgggaggcagaggttgcagtgagccgagattgcgccactgcactccagcctggggacagagtgagactccgtctcaaaaaaaaaaaaaaaagcttttgataaaattcaatatcctggttgggtgcagtggct

SEQ ID NO: 53756 - DNA, 1828 bp, Homo sapiens
tagttgggatgatcaatgcagtgctgttgaagtgggagagaagaaatgtggaaacctggcttgtctgccagatgagaagaatgttcttgttgtagccgtcatgcataactgtgataaaaggacattacaaaacgatttacaggattgtaataattataatagtcaatcccttatggatgcttttagctgttcactggataatgaaaacagacaaactgatcaatttagttttagtataaatgagtccactgaaaaagatatgaattcagagaaacaaatggatccattgaatagaccgaaaacagaggggagatctgttaaccatctgtgtcctacttcatctgatagtctagccagtgtctgttccccttcacaattaaaggatgacggaagtataggtagagacccctccatgtctgcgattacaagtttaacggttgattcagtaatctcatcccagggaacagatggatgtcctgctgttaaaaagcaagagaactatataccagatgaggacctcactggcaaaatcagctctcctaggacagatctagggagtccaaattccttttcccacatgagtgaggggattttgatgaaaaaagagccagcagaggagagcaccactgaagaatccctccggtctggtttacctttgcttctcaaaccagacatgcctaatgggtctggaaggaataatgactgtgaacggtgttcagattgccttgtgcctaatgaagttagggctgatgaaaatgaaggttatgaacatgaagaaactcttggcactacagaattccttaatatgacagagcatttctctgaatctcaggacatgactaattggaagttgactaaactaaatgagatgaatgatagccaagtaaacgaagaaaaggaaaagtttctacagattagtcagcctgaggacactaatggtgatagtggaggacagtgtgttggattggcagatgcaggtctagatttaaaaggaacttgcattagtgaaagtgaagaatgtgatttctccactgttatagacacaccagcagcaaattatctatctaatggttgtgattcctatggaatgcaagacccaggtgtttcttttgttccaaagactttaccctccaaagaagattcagtaacagaagaaaaagaaatagaggaaagcaagtcagaatgctactcaaatatttatgaacagagaggaaatgaggccacagaagggagtggactacttttaaacagcactggtgacctaatgaagaaaaattatttacataatttctgtagtcaagttccatcagtgcttgggcaatcttcccccaaggtagtagcaagcctgccatctatcagtgttccttttggtggtgcaagacccaagcaaccttctaatcttaaacttcaaattccaaagccattatcagaccatttacaaaatgactttcctgcaaacagtggaaataatactaaaaataaaaatgatattcttgggaaagcaaaattaggggaaaactcagcaaccaatgtatgcagtccatctttgggaaacatctctaatgtcgatacaaatggggaacatttagaaagttatgaggctgagatctccactagaccatgccttgcattagctccagatagcccagataatgatctcagagctggtcagtttggaatttctgccagaaagccattcaccactctgggtgaggtggctccagtatgggtaccggattctcaggctccaaattgcatgaaatgtgaagccaggtttacattcaccaaaaggaggcatcactgcagagcatgtgggaaggtaagttgc

SEQ ID NO: 53757 - DNA, 1096 bp, Homo sapiens
tcctgaactacattttctttgaaactttagtattgtagtttaataaggttcactgacaatcagtgtttgtcaatattggttcactctctttgcatggcaatcccaagtaaattttgtgtgttcttcccccccccccccccacaggttttctgtgcttcctgctgtagcctgaaatgtaaactgttatacatggacagaaaggaagctagagtgtgtgtaatctgccattcagtgctaatgaatggtaagtattaaaacaggttgatttcatagttattgagacaaaacaagggaattacgatgagaagacttttttccccctgcctttctttacaagttgctcaccttctcaaatgtcataactttaactgaaaatatttagctaaatttccatgttttgaaagtatcttagcatttcagaattcctgtgcctaatttaatgaataaatgctaaagccaggtaagttttgcaggaataatggaagttctttggaaatctggtgcgaggtagttatttgtgttcctataaaataaccagagtgaggtgggaatggggagcttttgatcaccagatgataagatgttaaaactgggctgagattttccttttaagagaagccatctctttctaaggaacaacttaataacttagcatgtgttcttatcaacaccttgtttcattcatcttgttgaagataactattttagcatctaggaccaagtagaaaattgcatttttaaagcccatttatctctttaatgctacttagatttgctatgagaataatggtttagaatctagttgttacgtggtaaaaagaatatggccggggaaagtaaataaaacttacccagtgttcatcttttgctggactggaaatgattttaagggcatattagttaaaaaccctgagtattcttgtaaaaagatacactaaaattgttcaggttatagtattttctctttgaatgcatctttgtacagttactggaacaattactaatagacataaaatgttgaacttgaacaccagtgctacctgtgccaggatagtgtgcctcctggaggctggaacttatctgctctgagacccct

SEQ ID NO: 53758 - DNA, 1048 bp, Homo sapiens
tctgtaatcccagctactccggaggctgaagcaggagaatcgcttcaacctgggaggcggagattgcagtgagccgagattgcaccactgcactccagcctgggtgacagagcgagactccgtctcaaaaaaaatacatatcaatgacataaaagatcaagatgagtcatgacagccatagccatgtctgattctatactggaaggtttactggagggaaaaaatgctacaaagaacatcactgggcagatgccaggttaaagtatcaaatccatgtttgactgaagtagagaactgtcctacagttgtgtaagagaatatccttatttttaggaaataagcatttaggaggaaaggcctatgatgtacgcaatttactctcaaatgcctcaattttttatggagaaggagaaagggagagagaaaccctgacaaatcaaatgggacaaaatgttaataagtgaacaagaggggaatctgggtaaagtgtgcgtggggttttttgtactttcaacttcctagaagtttaaattatttctcaataaaatgtatttttaaattcctccagtatttataactaaaaatgtcctgggtgtattccatcagcattcacagaaatacccagttgaatacctgccatccacacgggcagatctccagcaatcctgaactcacctctgctctccacatgacatttacactgagttgcccttccgaaactggaagagtagattaagcccttgagtcttcgattcacttcaatgaataatctggtaaaaacaaaaatctaagtgtgacttctacttgataaacagctgtgatgtaactgggacaagatcagtgtggaattatcctttttataccaattctgtacaaagagtgcaagaactgatgctttatattttatttcccctctgccctcccatcccacccttggtgatggttgtacccatttgagcatttctgagcacatgaccataagtaaatcttgagagaggagcggaattcttgtctaaacagtaacagaaggggattagctgcaaggata

SEQ ID NO: 53759 - DNA, 1021 bp, Homo sapiens
ggcctgagctcaagtgatccgccatcctctgcctcccaactcctgatctcaagtgatccgccatcctctgcctcccaaactgctaggattacaggtgtgagccaccgcactcagcctcattgatatttttggtgaatgtagccacccccaaccccaccctgtttttttttttttaacagaaaacaactcagtttgatatttcctcatatttagaatcagtttatgtgtttttgcccataatgacttgatatccatctgccccctcattgatagtggtaaattttgatcacttggtcaaggtgtccaacttctctgtatatccccctacctggaacttataaccagtatatgtagactttcagaccatgcaaatctcttgcctatgaaagtgtcccgttaaattagcatgcattgatgtttcttacctgcactgatcttttactatgtttgcaaaatgattttccaattctagcgcattctccagctttacaggttgcacttggtaatctactataagcagaagcccttccttcccaatttattcatttaattttcattatacactcatggactgttgttttgctttgttttgttttgaaacagtgtctcactctgtcacccatgctggagtgcagtggcacaatcttagctcactgcagcctcaaacttctgggctcaagcaaaccccccaccttggcctcccaaagtgctgggattacaggcatgagccaccaagcctggcctttttcagtggttccaattcattattttggtgcacaaatggtctcagctttagctagacaagagacccttcaagctggctcctacatcctggtgatatgctattttttttttttttttttttgagtacttcttttttatttctatcctaacaagatgcttcaggcttatcttgtgcttatcctgccctagccctggaatcagctatttctgcaaggagccctggcttcttttaatgggagtggtattagaaaccaaaatctggtttatccatgatatg

SEQ ID NO: 53760 - DNA, 1928 bp, Homo sapiens
tgctgactctgccacatagagtcatctgcttctctctcttggccatctgtgaagtgagggtttgggtcagtggaaggctgcttcttcaagccaatgtttcttccagaagttgccgtggggattgaggagaaaatgaacagagctctaggatgcttgtctggatttatttattacttttttaataagactcacctaaaaccaccaccacctcctcctccaaatactgggagggtagggttttcatgaatggagattcctgtgttcatgccacaggacatcttagctcctctcacttctttcctgggaatgtagggacctgcctgctccccatctctgtccccttagttaccatttccctctctgtggtcctcacaggtcctggatggaaggaagcccaccggggggaagctggaggtgaaggtgaggctgcgggagcctctgagtggccaggatgtgcagatggtcactgagaactggctggttctggagcccaggggcttgtgaggtgggcagctctctgggccttcagaacctttgccccctccttttactcaactaactactcaactcatatctggagagaaaacctaggagtttctcatctatgagaaagacctaccatgctgggtagggcttatgggctgagtttctgatgttcctcagtagaactgggaagagaaggtaaccttccaaggtttaactatctatctatctatctatcttcaggaaaccctttctaaaatctttgtgttttcactgcagtttagactgacttcttgtgctttgcacccctgtgtagccgatggccagcaccaggagaggagtcaggccgcgactgtgcaggagatgactttcccagctttgctggcttcagaagcctttgtacataagagatgctgctacccaagcaccaaagacctgttaagcatgtgcactactgaccacgactctggtctttcctgttgttggcccctctggggctctacagaaacaggctgggttccaggagcccatctccccgctgtctccccctgccccgagtctggaagagggcaaggacacttccattcctctgtaccatggagtcctgcagccccttaacccctgcgtggcaactgtgtacagcttacccctgcctccagttgcaccacttctagatgtgcctttaaaagatctaactatgggatgggagaacttgagggtgatcgggaacctcccctgctgagggtggtgtcagggttccgtgactccagtgggccagtggtagcctgtcccagacaactccgtcaccccagctctgcctgtgcctttatccctgacagctgctgcactagccttcctgcttccctaaggacttagtggagggggaaagttgtttttggtactacttggtgggaagtaaggggaaggttggatcttgggtttggtctacccacccaagagaaaagactgttaactggaagaaaaaatatatatataaaattttatgtagacacgtttatttatctaggaaactaagtctaactcattgtagggattttatactcaactatacagagtatccaccaaagtcctaatctaaagtcctgctccctgtcactttttaaaagccagggtagcagtaacatgacaaacggctgctgtggcttcctcttgagagaggacagggaaagcctttcctcttcggctggttatgtggggaacttccttagtttttttccacaagaaattctcctttggctttgtttttctgaatggatggagactatgaaggggtttgtagttgtaagagatttaatattcaaaactgaaatattctgcatttcttagaaataccccatcttcccccaccccctttttgaattattaattcaagatcaacaaagcattcctcaagatcacttttaaaaaaggttagaagtgaagca

SEQ ID NO: 53761 - DNA, 2188 bp, Homo sapiens
tacccatccctgtcagatttgagaagcttgctcaggaccgcaagaaacagctggagatcctgcagctggcccaggctcagggcctcgaccctcccacccaccactttgagttgaagacattccagactgtgaggtaccaaggcctagggaaacaggggctccaggcagggaggggcaggaggctgggagcccaggccagagactgctacccctttagtgaggcttcccaagcctggccccgctgtgggcactggggctgctgaggacgacagggtgcatgctagtggagagcgcacagctgtctgggtgctgtggaaagagctctggaccagaagtcagagatcaaggtctgcataccagctctgccttccctcccgtcaccacccagctgggcagacaggccctggacgaagggaccttgttccactactgtccttcacttttgagcattttctccttcccgcttggctctaggatcttctcagaactcaacagcacagaaatgcatctgatcattgtccggggaatgaacctcccagcccctccaggtaaccctagggccgcccctactccaggaggctcttgcccggacactccaagtgctaggctcctggccactccctctgacttgactcccttttctccttcccaggggtgactcccgatgacctggatgcttttgtgcggtttgagtttcactaccctaactcggtgaggttcaggtagaagtaggatcctctgaaacccgccttgcattccaggaccctgtgctcactttcttcccatccctgggaggtgtggctgcagtgcctgccctgtgtgcctctttgtttatacgctgtcctgacttctccctcctcactgcttaggaccaggctcaaaaaagcaaaacagctgtggtgaagaacacaaactctccaggtgagggccacacgtgggcctctttctcctccctcagagtgtgtgggcagcactggtgtttccagagtgggttcccatctatgcccttacttgatccaccccacttgggagataaaggtgctgttaacatgcttcttctgtagttggagaaacacgcagagaggtacagggacttgcctggggcctcatggcaaggaagtggtagaaatgggatatgaacacaggaattctgtatcccaattccaagtctttcctactttgttacaatctatgactaaaaagagtacaaaaactcacttccaaggccaggaccgcgatgctctaccaccctttggaggcagtaccccaaaatgcaggtggagagattgggggaaggcagccagccctgggcctccatttccacttcctcaggaaatcccgagagccaagcccctccttgctttctccccctttgccagaatttgatcaactcttcaaactaaacatcaaccgaaaccaccggggcttcaagagggtgatccagagcaaaggcatcaagtttgagatcttccacaaagggtgaggctcctatcggtcatgctgccacacgggccgggaggagggaagagcgtttgtcactgctgcccctgcatgggctcagccagcacattcctgccttccctgcccagtccaatcctctgctgcctcttgactccccaggtccttcttcagaagcgacaagctggttggcacagcacacctgaaactggagcggctggagaatgagtgtgagatcagagaaattgtggaggtaggggctggggtgtgggcaagccaaaggggttggtacgacaagagccaatacgcactgaatgccacaccttgttgtaggttttcgtgctcattacttaatttgaaattctccacaagtgtgcttagagtaggtggaatcctcatttcacagatggagaggttcagaaggtctgagaaatctcacagagggacccaggagaaggcagcctccttgtttccatgaactcaatggattccacaggcaaggactatacgaccttgcctctgacaaatgaggaaactcaggtccgagaggaaagggggttctgtaagctcatatggtgtgtccttggcagagctacgaccagctccttactgataacctatgtaggctggggctcttcccactgtagcacacctggccctactgcctgcctggggaagttgttcttatgcgggccctggtctctattggagccactgagggtggttggac

SEQ ID NO: 53762 - DNA, 1039 bp, Homo sapiens
ccacttctcatgcgtctgcctcccctctgtggagccatccatcccagccatgccccagcagagccatgccccagacagggccccgggtagctttgtgcttctctgaggctgctccctgcccctcccatgctgtctctctcccacaggatttccccccatccctggcctggagtccactatgggtgttgaggaggacgcagtggcagcgacattggcagctgcagagaaactggcctctgcagaggattcagccccggctgataaagacgaggacgaggtttggttgagggctcaactccagggctggtggggagaatagcaggtgaggggtaaacccagaccctgttgtccatactaacaagcccaataaggtacatattctttcctccactgtacagagaaaaaacttgcccaaggacacccagctaggaaatagcagaactaggattcaaaccaaggtctttctgaacccagagccccggctccatccccattaccctgcagtctctctcctgctggggaggttagatgtgagagcttctgaggctgcttctagctctcagatcttttaggacccaggaagagaagccacccatctcaggtcacacagcgatgtagtacagtgttaggaagacagcccaagtctgggagccgccatgactatgctagggaacacatcccctcctaacagcctcctgggcacctgcagggtgagcccccagcacaggccccagtggccaagaaacctgcacggcccacagtcccttcatcccagcgcctgcctgagcccagggcctcaagttctaaggagtcaccgagtccatctggtgagttggggacaagcagggtgaagaactgagggcctagagagggcaggtgtggccctaaccagtggccttctcccttcagtgcgggagcagctggcactgctggaggcacggaaactgcagtatcagcgggcagccctgcaggccaagcgcagccaggacctggagcaggccaaagcctatctgcgggtagccaaatggcttgaggctca

SEQ ID NO: 53763 - DNA, 2021 bp, Homo sapiens
aatattgctgagagagagggtcctttactctcaggtcctgttgtgggtatggtcttgaggcccccaagctcctgggctgtgttttgtctccctagacggagctgcaggaggtcttaggtgtggacgaggagactgagcccctggatggtgatgaggtagctgacccaggcggctctgaggaggagaacggcctagaagacactgaacctccagtgcagacagccgtcctgacagcttcagccccagcagctcaggtgggttctggaggagggcccctgtgcctctgatgctcctgtgcgcccagacgtaacacgtgtgtggcctggcctgcacagcaaggctgcagtcaccctttccaggaccctcccccagcagccgccccaagcagaaactgagcacaagaaactcctccgtggcagccagcctcaaaggcctctctgttctcctagactaccccccgggagccatatcctggcttccaccaagtggggctctgtatttgcctctgccatggcctctggcctctccagtgagcctttgcttcctgccttaaggcttttaggctcttctttctcctggagtcccagagctccatcttctagggcagcttccgcagagggagaatggtaggcctagcaggccctggagtggccaggcccttagctgaattgttcataggccggagcatctcaggggctacacgctttgctggaggaacggattcacaactaccgagaggctgcggccagtgccaaggaggcaggcgaagcagccaaagccaggcgctgcgagcgcggcctgaaggtgagtcgggctaggctgggagcagggcaggggagggggctgcatgaaaggcggctggtggagatcgcaccagtggaggggaggtcaccccaccagactttgggggttggggggccacccctggcctgtcttggagcagggtctgggctgagatggctggctgggtttctggaccagttctctccctcagaccttggagtcgcagctagcctctgtgaggagaggcagaaagatcaatgaggatgagatcccacctccagtggccttaggaaagcggcccctggccccccaggaaccagccaacaggagccctgagacagaccctccagctccccctgccttggagtcaggtatctgcagatgcccaaatcctgttctagttcctggggtcatagcccacagcgtgtgtccccagcctgccaccactgttcattaccattggtcacatcctccccaggacatcctcaagccagtgaagtccgtgggcaccttcttctgtgaccctcatgtgctctctggggactgtttgtttccttatagacaacccctcccaacctgagaccagcctccctggcatttctgcccagcccgtttcagacttagacccagacccgcgggccctgctgtcatcccgacagagagagtacaaagtggctgccctcagtgccaagcgggctggagagctagaccgtgcccgagagctcatgaggattgggaaggtatggcatctggctcagggcacccaccctcattttatagataggggaaacaggctcagaaagggagctagactgagattgagtgagattggcctaagtgggggttgtttcagcccaggctcttggggtcccctgtctttcacccacacctgcttttccaacttctgcagagattcggtgctgtcctggaggccctggagaaggggcagcccgtggatctgagtgccatgcccccggcacctgagggtcagtatgtatcttctcaggctgcggtggggttggggaggagtagcaggcctggggctggccaggccctcccacctacacctctactctgggtcccccagatctgaagccccagcaggcttctcaggctcccacagcaccctcagtcattcccccagccgtggagcgagtgcagccagtgatggcccctgacgtcccagcaaccccaggtagggcaggatggtgggactgtggcgtggggacctgcaggca

SEQ ID NO: 53764 - DNA, 1068 bp, Homo sapiens
ttcttctgggcctacatcttgagacttcttagtccatttttactgtctttaaaaaggcaggtaagaaaggaggtggggtaaagggcatagactcaagtcgcaaagagcttgttttaaattctgattgtctcacaagactgtctcagtttcatctgaacattgggataaaaacagaatgtaagctgggtgccgtggatcacgcctgtaatcccagcactttgggaggccgaggtgggtggatcacctgaggtcaggagtttgagaccagcctggccaacatagtgaaaccccatctctactaaaaatacaaaaattagctgggcgtggtggcatgtgcctgtattcccagcttcttgggaggctgaggcaggagaatcgcttagacccgggaggcagaggttgcagtgagccaagatagtgccactgcactctagcctgggcgacagagccagactctgtctcagaaaaaaaaaaaaaaaaggatgtacctctacctagagtagtcatattcatggaaacagaagaatggtgcttaccagaggctggaaggaggggaggaaggggggttaatgtttaatgggtagaaagtttgtttcacaacatgaaaacagttctgtggatggatgatggcgatggtagcaggatattgtgaatgtccttatgccattgaactcacccttaacagtggttaagatggtaaatttcatgttgtatgtgttttaccagagtttaaaaaaataggaccttcttttttttttttttttttgagacggagtctcgctgtgtcgcccaggctggagtgcagtggcgccatcttggctcactgcaagctccatctcccgggttcacgccattctcctgcctcagcctcccgagtagctgggactacaggcgcccgccaccgcgcccggctaattttttgcattttttagtagagacggggtttcaccgtgttagccaggatggtctccatctcctgacctcgtgatccacccgcctcggcctcccaaagtgctgggattacaggcgtgagccaccgcgcctggccaaaaaataggaccttcttct

SEQ ID NO: 53765 - DNA, 1027 bp, Homo sapiens
atgacgtgaacccaggaggcggagcttgcagtgagccgagatcatgccactgcacggtagcctgggcaacagagcaagactccgtctcaaagaaaaaaaaagaatcaaaggtccttaaatgaaatgaaaaaatagttcaaaaactactgccctacaggacaccactggtcattgtcagtaaaggcagtggtagtctaggtatgaaatgtgtaatttgttatatgggacctgggaattgggtttgggggcccaagggtgactttccacctggataatcactgggcagtcaaccaacttattcctctgtcattttggctccccagggtcttaccaggatgtgcttccagccctatacatatagccagctgcagcagatcctaaggtcccggctcaagcatctaaaggcctttgaagatgatgccatccagctggtagccaggaaggtaagtcaccagctgcacccataaatcagtcagcacatctttgctgagtacctgctgggtatgaggccctatgctggtgctctgaggttggagagaaatttagaaagtcgtgtaaaaatatcaaaaaagacaagattatgagaaattccttagccttgttattttatgattagagggccctaaatattgtgggtttatatgcaaactaatatgaattcattcagggagcaagcagttttgcatgatgaaagggacaatatagtcaggtagacaaacctggtttgaattctggctttaacgcttagtaggcatgcagaaagttataggaaagttacttaaaaatttcctgagcctcagttttcttctctgaagaagaatgagagcacttccctcatagggtcattgtgaaaatataacaatatcatgtctattacatgcccagcaaggcacactctccaggctagatatgaggtattagatgcccctctcctccaagtctaataggagaatgctccctgagagttcaccacagactagtctccccggctgctgaggaacaaagtgggttaaatgtctgcctcaag

SEQ ID NO: 53766 - DNA, 1541 bp, Homo sapiens
cgtttaccaccaatggtaggctgcatgtttctgctgtacctgagtctcttccctgtcgggaacaggaattccaagacatctacaattttgtggaaagcaaactccttgaccataccggagggtgagtcatgtgaggcaggcagggtagtttggggaataaggcccctgctagtggaatgccttgggtgttacagttcagccatacaggctttctccagtatcagcagactagaccaaatcgttgctgaagcccaaagcttctgaaacatttgttgccaaagtaatcctatagtaacagaaattttgcctttcagaaagaatgaaactggccttcattgagtaggcagtttgcatatagcattatgcaaactgtggaatgaatgattctatataagcaggtcctactctgaccagcttccaaggatggtccctactgcccccacctccacatttcaagggtctcggtccttccctcagtatacattcccacactcctaactgattataacgtgtagtggctggctgagacctaccccacgggttttcctctcttgctctaggtgcatgtacatctccggtgtccctgggacagggaagactgccactgttcatgaagtgatacgctgcctgcagcaggcagcccaagccaatgatgttcctccctttcaatacattgaggtcaatggcatgaagctgacggagccccaccaagtctatgtgcaaatcttgcaggtaagcagagctgtttaggctttttggaaaatgctgtttcttcgtgacacatgaaaaaggaaagagttacttaattttgcgtgtattgcatgttcatgatataccaggcattgtcctttctgtagaggtagcaagggcaaggaagacagaattcttaccctaagagacttcaaagtctaggagctggataatgattacaagccaggaagccagtacttacccacatggtgaaaactgtgagcttacaggtagcagtgtggcaacatggaaaaggggtccgtggcaggccagaggttaagccttgctctttgtccatgggctgttattttggagcaggtaacatccagttatagaattctgtaatagtgattttaagggggcttctggcccagcctgtgactcatttgcatttcaaactcatataccttctttatcttctctttcggtgccttctcttgtccttccaagtaaaggttaagactagattgggaggcagaatataggataccgaagtcctcaggttaaatgcctccctccatttgcagatttaactttaagcccaagggagtaagacccttacagttcctcacaactgtgtttctcctaatgcagaagctaacaggccaaaaagcaacagccaaccatgcggcagaactgctggcaaagcaattctgcacccgagggtcacctcaggaaaccaccgtcctgcttgtggatgaggtgaggtgcccatgggcggacaggagaagaaacagggctgtacctcaggagcaagtgctggatgggagggaggaaagtcctggctccct

SEQ ID NO: 53767 - DNA, 1646 bp, Homo sapiens
tctaatttaaataaggttaaggcagactttgaactctgggtttgagtcaagcttcaattataactttttagttataattttttgccaactttttagcagaaagaaagttttactcttttcaaagtatatataaaaagactgggagccaatcaggccacttgactatcttctagtgccttttgtacactctggtatccaaaactgcttcccgtgacctcgctgtggtttcttgcagggatgcaaaagaagcaaaagcccagaatgaagcgacctctactccccatcgtatccgcagaaagagttctgtcttgactatgaatcggattaggcagcagcttcggtaagactactccttggcaggcagagaaacattgctgccatctctgatatctataatcttatctcctaatgcctcttatactgtttatttgccaatccattgaaattgaccttttacctagcatgtctggaattatgttaagtttcaaataattgtcttagtctgaaggggcaagaaatacttcctgggcttaggtgactcccatccctaatcatcatgtccagcaagactgttggtgggatggggtgcctaagagcatgaacttggattctgacagatctggatttgaacctgggctttgtcatttaccatctgtgtaaccttgggaaggcaaaattacctttctaagcctgaaattcctcatctacaaaatataataatatacatgtcataaagttgttgaggggtttaatgagataatataaataatgctcctaacagagtgtctcggtagcaagcacccatgtcacctggtcacaggagggaccctgcaatacttgtaatccacactaatgttatagagttcttcttatttagacttgaacactgagtatcaaaaaatatgtccctaccattcaggtttctaggtaatagtaaaagtgaccaagaagagaaagagattctgccagcagcagagatttcagactctagcagtgacgaagaagaggcttccacaccgccccttccaaggagagcacccagaactgtgtccaggaacctgcgatcttccttgaagtcatccttacataccctcacgaaggtgccaaagaagagtgtaaggttcttctaggtttacttcccattgaagcatccctctcttagtttaaaagttacaaatgctgaagtcacagattagtaacagctggaatctgaggacagatctgttatattcaatgctattctttgtggaatattcatggagaaggggacctaagtgaacactaggactgaaaatgaatctagtagagagtgatttttgaggtaagtcccttttacggtacagaatcagatggccaagagctgaacttcctgagggaagtaagtacaagacccactcctctttgcatttcccacggagcactggcagagtgggtatcgcatgtacggccaccgagctgtggtgttagttttgttgtcccacttgatacacctgagaaaccgggagtgctacttacatattggtaacaaatcatgtcacagcaagatggaaggaggagatcaatgaacatcttttctgcttcctgtggaactttagcagaacactgaaaaggtattcagatcaggatcttctcatgttcgaatgtgc

SEQ ID NO: 53768 - DNA, 1042 bp, Homo sapiens
actaggaaaatcactcctaaaatttaggtgagagatgaaaaattattagagctacctgggctggagaaagcaagcctggaatgattaaaaatatagataattcctgttttacatataactcagtggctgaatttggctgtgatgagattgtgggtttgtatattgttaggtaaaaaatttacacattgtgatgatttctcttagacttaggtaaccctcagatgtcccagcagacttcatgtgcctccttggattctccaggaagaataaaacggaaagtggccttctcggagatcacctcaccttctaagagatctcagcctgataaacttcaaaccttgtctccagctctgaaagccccagagaaaaccagagagactggactctcttatactgaggatgacaagaaggcttcacctgaacatcgcataatcctgagaacccgaattgcagcttcgaaaaccatagacattagagaggagagaacacttacccctatcagtgggggacagagatcttcagtggtgccatccgtgattctgaaaccagaaaacatcaaaaagaggtgaccagggacattacccacagagcaaattgaaatccttcacatcacgtgaagtatgtgagtcatagtcaaaaaagttagaacagtagttgaaaaacctatgtcacagaagtattggggagctttcttaaaatacagatttctaggcctcttcccacacctagtgagtcagactccaagcactggccctaggaatctgtatttggaaatgctcttcagatggttccagtataccgagctgttatttggggatcattgctatagaagataacttcccaaacctgcattgctatccagtttgggatttcattagttcctgtggctttttgccacactttaacagtcattttttaaagcagtttttcattgttgttgttgtttcattttatttcaatagtttttggggaacaggtggtcttcggttacatgggtaagttcttaagtggtgatttctgaggttttggtgcacctgtcacc

SEQ ID NO: 53769 - DNA, 1024 bp, Homo sapiens
taaacgaggactgcaccttgagtaaatcagtacaaagagtgctagttgctacagacaaatttgtatgacaggatttcttaataaatcaggtgctaatgagcggctggtttgcaggctgaagtaagtcactggttatgagtttttcctgaagtgacttcaggctccccagcatgggattaggttgtgatgtgaggtgtggttgtatgctgattatgtggttcattgagcgttagggtagagactctcgtctggcatgattatcttaatttatctttgagttaaatgagtgaaggagagaaagctaaaggagtgtgaggcagatgcaaaagttgaggcagcaggatgagtatacgcggagaggcacagggcttggagcatctgggcaggagcacagtggtgggaatagcaggactgtgacaagacctcttcaaggagtattgcgcactctgtaggtaaaatgaggccagatcttagaaggcattgaaaaattagtttaagtaatttggtcttgctacagtgggagccattattggctgttgagcaggcgagcatgtttagataagtttgtggggaaacttggcataggcgaacagaatggactggaaaagaaagcaatggtagggtataagaatatcagctaggaggaatctgtgaaaataacccaggagtgagaggatgcatatttgaactagggtgataataataggaattgagagatgaacaataaacatttttaaaatgaaatgaaaggaataatttatttcactgatgtctttaaagtgattaatgataaaatgagtaaatactcagtaaatattcattattatgtgtttttctagcaatatgctatgccatgtctatgcgtctttagattggaaaggtaacattttaggtacagatgtggacttcaatgtttttaattgtagctctgatggaatactccttggctctcttggggctcatctcttcctacttatctatacttcctaaattcaggtgatacctttagccccaaaggatgtgg

SEQ ID NO: 53770 - DNA, 1662 bp, Homo sapiens
cataaaattttgtatgtaggataatgtcatgtctatttaaggtgagttctatataacttttgatgaaaacgagatgatagatgtttttactatgtctttcccagccctggagatctctgacaatttgacattgttactgggcagcttgacagccttgggaaacatttgttgtgggaagcatttgttgttctttgtcaataactgagaggaattagggttcctaataagacctttggattcattactcagctaaaacaattcattcaacccattttgcctattcttaaatataactgggcgaattggtttcccagtaggagagttggtcagcagaaagaaatcaggattggagagccctctcctttgtgcccaggggatctgaagagcttgacccactttaagttatttcctaatgtgcttctctgttacttcctagagaaatgtgtgtgaaaacagaaggttgttccaccgagattcacatccagattggacagtttgtgttgattgaaggggatgatgatgaaaacccgtatgttgctaaattgcttgagttgttcgaagatggtgagtttgggactggaataataaaccattccttgtcatgaatgattgggaggtggggagattgtggattcttttgttcacagcagtgtgcagggcacattagactgaggtgggatcacgtaagaactagctgcgtcttcttccatctaaaaaatttctttactcaccaaagcagtattgagtaaaacggaactggaaggctcaataatttaactttttcattattttggggagtaagcaaggctattaaggcagaattgggggggatggagagaatggatgaatttgggggaaagggagaaggaaaaaacaggtaatttgtactatcatagagatgtgtcctttagttttggcatgaaggttagtaatatattttgcaagtgctacttcgttacaagtgaagaggtaagttggatttggaaggtgtagcaattggggtttcagtcagggaaaacaaaaacacttaagatattttacccagaggaacttgtgtgttaatgttggaaaggctagaagaaaaggtgacatttaccagagatgagtaagtgcaggaagccacggctgcccctaggctggaggaacaaaagggaaggtggcatcaaccagagcctacaagcccacatcgaaagccttagctgatttgctgaccttctaaccctctgcaaaacaagaggagagcacagaaatgtgggagtggggcacagctccacaaggaggattaggaagatagcaatttgaaactatctaaaactgcctcgttcaagagacagaagaagggcatggtcattaggtaatcctgtggtagtctgtatgcccaagagaaggaactgatagactgagtggataaagatgttttatattactatagtcccccttatccgtggtttcaccttctgcgatttcagttacctgacaacaaccatagtccaaaaatattaaatggaaaattacagaaaaaaacaagtcataagctttaaattgtgtgccattgtgagtaatgtggtgaaatctcacgctgtcccacctgaaatgtgagtcatccctttgtccagtgtatccgtgctgtacagtatgtgtgtgtaggaaaaatcatagcat

SEQ ID NO: 53771 - DNA, 1294 bp, Homo sapiens
ttaggcgaccatcttgaagccggaaacaccgtagtgtaaagggcttccgctccccgcgtcgcctatcgaatcaatgatggcggctgcatgttagcggatgtacgtcatgcgcccctcttaggtgtacggagtgggcggggcgagctagttggtgtcgcaacgaagggacggtctgggggcggggccacgccgattggcgcgaagttttcttttctccttccaccttcttttcatttctagtgagacacacgctttggtcctggctttcggcccgtagttgtagaaggagccctgctggtgcaggttagaggtgccgcatcccccggagctctcgaagtggaggcggtaggaaacggagggcttgcggctagccggaggaagctttggagccgggtgagtgtggcgtccagcgggctgcgagggactcgggggagggcgcatcggaacctctgaaactgaggacgttctctgtagactcagtcattgattcttttagctgacatgtaccaagcgcctgttcagtgccaggcactgttctgaactgttaagagcgttcctctgttccacactccgattcctaaaaggcttcccgcgctgcagggaactgagtttgcaggggggaaggcggaagccaacagcctagaagcaggagcattcctgccctccgcaccctgatgctcagtgatgactttccctccatctgcatttgtaaagcactctacttgtttcgttctttgagctatagtgtaggaaccactacagggaaggcggagcagaggttattaccccattttacggacgtaaattgcgcccagggagggacgtgtcttaggtcgcttttcgtgactaagcagtctgggctcctacccagatctttttttcagatgagctcctaactgctgggctgtctgtcattcaccttcttttcagaagagaagtctggtggcccccttcctacttctcttttctaaccccggaattgaagagtcttctgctgtgacagttggaaaaggcattcttatcctgatctatttgtgaaactgcaatgattatatacgattctagttgtctgtaacacatgaataatagtaccctcgtctctgctgtgttaggtgggctggaaatgccaaaggagtttccaatatgacagaatggtttaagtccctttgcaacagtttttaactttaatggagggcaatatgtggactttaggaggtttgtgaatctgccgaaattgaatgcaaaattttgcttgaattatgttagttccatagtattcatcaaatgatactta

SEQ ID NO: 53772 - DNA, 1050 bp, Homo sapiens
cctcgcagcccgctggacgccacactcacccggctccaaagcttcctccggctagccgcaagccctccgtttcctaccgcctccacttcgagagctccgggggatgcggcacctctaacctgcaccagcagggctccttctacaactacgggccgaaagccaggaccaaagcgtgtgtctcactagaaatgaaaagaaggtggaaggagaaaagaaaacttcgcgccaatcggcgtggccccgcccccagaccgtcccttcgttgcgacaccaactagctcgccccgcccactccgtacacctaagaggggcgcatgacgtacatccgctaacatgcagccgccatcattgattcgataggcgacgcggggagcggaagccctttacactacggtgtttccggcttcaagatggtcgcctaagctgtttagtgaaacttcttccacctttctccattcctctaggtgctttttctgaacctggatgtgaggcattaaaggatccgacggaaatagaattgaaggcattctaaaatggctaaccgtacagtgaaggatgcgcacagcatccatggcaccaaccctcaatatctggtggagaagatcattcgaacgcgaatctatgagtccaagtactggaaagaggagtgctttggacttacaggtaagtggaagcgcgcggagcgcctctcagcccccttgtggcccatttctcctgaccgagcgcgggtaggactagcgactggcctctgggggtggtactggaacggagtatgtcgatcattcagaaaaattttgagtgcctgctaagtgcctcgtcttgtgttgagtattagaggcacagatgaatctggtaaggtcatattctgaaggctgtctcagttgggtgttgtgagttattccgtatttaatgatagcaggctgggttgcaacagtgttaagctcagggatccggatataacactttgacacaatctgttgaaggtctttaaggacctaacgttaatatgcctgaaaccaaattcatgatcttactattcttagatctggg

SEQ ID NO: 53773 - DNA, 1125 bp, Homo sapiens
gagaagtcttccaggtaatcttccgatttgaattgtggctttaaatccatgtcctgtgacaatctgtggaccttgagcaagtcactttacctttcttagccctcattttccttacctggaaataagaacattgctagaactttcttcatgacttgttaaaaaaggttaagtgagataatatgaaaagcttagcagggtacctattttattatccattctcaatgtatattagctgttgtcgttactgttattaatacacattcgttctcctaatattacactgttgatgtatatttaggagaaccaaagcttgaactaactccactccaactaggaagagcttagccctaatatgttactgtattgtttttgttttttagctgaacttgtagtcgataaagccatggagttaaggtttgtgggtggcgtctatggtggcaacataaaaccaacaccctttctgtgtttaaccttgaagatgcttcaaattcaacccgagaaggatatcattgtagagtttatcaaaaatgaagatttcaagtgagtgcaatgttcactagctaatataagaggtttaattttggcggtttagaattgggctttggttaagaggggtgtacacaatgtatctcatttctagagagttccactccagatttttgcttttgagcccttgagtttgtattttttgtttgttttttgttttggaaacagagtctctctgtgttgcccaggctggagtgcagtggtgcgatctcggcccactgcaacccccatttcctgggttcaagtgattctcctgtctcagcctcccgagtagctgggattacaggcatgtgccatcacgcctggctaatttttgtatttttagtagagatggggtttcaccatgttggccaggctggtctcgaactccagacttcaggtaatcccctccccccccgggcctcccagagtgctgggattacaggcatgagccaccacaccctgccaagtttgtattttatctgttctgattgtattaatcttctactttactttctcagttttggtaatttttccctgaaaaaggatttcacagattcactaaatacatattaagcaaaagtgagtgcctgatatgtt

SEQ ID NO: 53774 - DNA, 1068 bp, Homo sapiens
tttgtttgagacagagtctcgctctgttgcccaggctggagtgcagtggcgcagtctcggctcactgcaagctcggcctcctgggttcatgccattctcctgcctcagcctcccaagtagctgggactacaggcgcccaccactacacccggctaattttttgtatttttactagagacggcatttcaccgcgttagccaggatggtcccgatctcctgacccggtgacccacctgcctcgcctcccaaagtgctgggattagaggcgtgagccaccgcccctggctggaacgactctaataaagcattaacagctagaaaatacctaacttttgttaggcacttactgtgtgctctgtgctatacttagcactttcaatgcatttcttgtttatataccaagccataaattaggtagcattatctccgttttacaaggattgagaaaacacatgatttgaccagtagtgtcacagacttagtaaattacggagtcagaatttgaacccagatgacttacttttttccaaaaccagcagtcatgtttatgtgtacttgttcttgtattgttattaaatatatcttctttctgttttaaaattcaatatatggccaggtgtggtggctcacacctgtaatcccagcactttgggaggccaaggcaggtggattgcttgaggtcaggagttcaagaccagcctggccaacatggggaaaccccgtctctactaaaaatacaaaaatatgccaggcatggttgctaacacctgtaatcccagcactttgggaggccaaggcaggcagatcacctgaggtcaggagtttgagactagcctggccaacatggcaaaaccggtccctactaaaaatacaaaaattaggctgggtgtgttggcacatgcctataatcccagctacttgggaggctgaggcaggagaatcgcttgaacccaggaggtggaggctgcagtgaattgagatcgtgccactgcactccagcctgggcaacagagcaagattctgtctcaagaaataaataaatacataaataaaaatacaaaaattagc

SEQ ID NO: 53775 - DNA, 1051 bp, Homo sapiens
gcggaggttgcagtgagccaagatcgtgccactgcactgcagcctgggcaacagagcaagactctgccttaaaaaataaaataaaattcagtatttcttttgattcttagagtaatcctgtgaggtaaataggttttattctagttttactgatgatatatttgaaagttgatcaatatgtatgatgttcccacagccataaatggtagcatgggaacttgaactcaggtctccatattttagctgtctttcttctgctgcattctacctccacaattgcagctttcttacctgccaaagagaagaacatgtttatccactactgtcatgagaacagctagttgtaaaactcaggaacttctaggatggcctgttgtttcactgtcatctgtctctcaggtatgtccgcatgctgggggcactttacatgaggctgacaggcactgcaattgattgctacaagtacttggaacctttgtacaatgactatcgaaaaatcaagagccagaaccgaaatgggggtaagtatggtgctaagtctcctgattgtcatttttaagccagtttttattttaccagtacttctacctttgcattgtcatagacagtgtgaatgctccttttcatctacattgttactgtctctatgcaggttttcccttgtccctcatgggagttttcagtctgactactagcttcgtgttggccttacccagcctgcctctgtctgtctccctttccaagtgcatcttatgttaatccctgccttgcatcatatgccccctttacatgtgctccatcccaaaagatctagctgcagaatggcttctccataaaaaccttccccagccctctcagacaaaattagttttccatattttacatcttcacagttctttctactggcctctcctctaacactgtaattcacactgcagcatataagactactcatttttatacaggaatcccactgaaaaataagtatatccaagagaggcagctccataccttctacaaggagattacttaatgtgctaaggagggattc

SEQ ID NO: 53776 - DNA, 1007 bp, Homo sapiens
ttggccgggcgtggtcgctcaagcctgtaatcatagcactttgggaggccaaggcgagtggatgaccagcggtcaggagttcaagaccagcctggccaacgtggtggtgaaacctcgtctctactaaaaatacaaaaattagccagcgttgtggtgggtgcctgtaatcctagctacccaggaggctgaggcagcagaattgcttgaacccgggaggcagaggttgcagtgagccaagatcgcaacactgcactccagcttgggcaaaagtgagactccgtctcaaaaaaaattttttttctaactctagccaaaaacaatatttccttattaaaagcacctcagctctgccatatactagtagtataatcttacgcaaattacttaaatttagttttctcctatgtaaagtgaggttaatgatacttttttccccaagactgttaaaagtattaaataagattataaacttaaagcccttagcagagtattggcacattataattgcctaataaatggtggcagctattaaatacttggaaagaaagaacactttcataattgcacctatcctaaggaataaaccttgtttaggagggggaaaatgtcaaccgcatagtcatgttctttcagtactagttacggtgctgaaaagttgaaaacaaccaagctgcccagttgttccaggaagcaaactttttttttttttgagatagggtcttgctctgttgcccaggctgaggtgcagtggctcactgcattctcggcctcccaggctcaagcagtcttcccatctcagcctcccaagtagctggaactacaggcacgtgccagcatacctggctaatttgtgtattttttttgtagagatgggatttcaccatgttgcccaggctgcagataaactaaacatacacacatacacacacacaggtctgtttctgttccctctcctatgagtcattttggctgtcttatatagctcataataagttttgttagttaat

SEQ ID NO: 53777 - DNA, 1073 bp, Homo sapiens
gttcaagaagttaaaacaggcactcaggaaatgctgattgaatgaaatgataacttaaaggggaagtgcctggtatggtctcaggcttgttatatttaagccttcttaaaccacccatatactactggggcatccctgtattgtagagtggcagagccttgactgtggttgagctcttctcttgagcaaagaactggggctgaaggaagttactattagtcataagcccttttaggaggggagagtctgcaactcttttctagtgggttttttccctttgattcctcctctccatctttcgtgtcctctccttttttcacatacaggtatttccttcccttcttcatttttctccccaccctctcaaatgttttgcagcatgctttatcacctcctattatataaatagaaaaaaagaaagctaactacaagttaattctaaggtgttgtcagataaacaggcacaagcctttcagtttcctgtctgtgttgtatccaacagacagatgtgccacccgtcggtgtagagagcgttgtccccacccaccaagaggaaacgtgtcggagtaatgcgagtccattttctttcagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaa

SEQ ID NO: 53778 - DNA, 1008 bp, Homo sapiens
tacctacctatatgctagctcttgtgcaagctactttcttttggttatccaatttaaacctcataatctgaggttcaaaatggaaccttagtagttttaggaaatgagatttgagcttagacttgtttggcctcaaagcccaagttctcaaccattatgccacaatgcctcaagcttgtaataggatctccttccaggccaagatataattgattctgggatagttggcattgtctttaggataaaatcttaagttcctttgcatgatgtactaaggttttttgaaatgtatatccccacctacctgtcccgccttttctcttaccacttcctccatcactcctgtctctatgttgcagattgttgtgcagttccccaaacttgatgtgctttcctgctttcaggcttttgtacatgatactccttctctctgaaatgccccccaccccctccctattttgcctaaatttttccttgttttctagaactcatattagtcaatcatcttacgaagactgtctctaaccttcaaagactgggttagccctctcttcagaacattttgcctgttctactagcaattattacatattgttgtgtatatatatatctcttcttgtatgtctcttatgaataatttgagcaaataccaatgctttattctttaaaaaagtttgtttggtattctctgaatttagcatagttcttagccaatggtaggtactgaatatatctttgtggaatgaagggatatttcaatgaatgaactaatgtttttaaatgtctttttccctcttgttgaaatgcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaaggtaccactgcttacaaattagttaacaggcttgggtgggt

SEQ ID NO: 53779 - DNA, 1062 bp, Homo sapiens
gaattctcattcaatactgtttttttacagggtgtatttcactaggtatccacaggtcaagctatgagaagacagaagtttcatgcaagcaaaatgccatgtatatattgccctaacaacactaaatgcctaaaacatctcaattttttggtctatttttattaatggtactgatatttttccactaagcaaagtctgaaacctcaaagtcattaccttatttttaatccatcttattaggtagttattgtacaattgaagagtaggctcatataaattaagtagcttctctgtagacagaaacccagatctacattattccaaaaggaatgctcattccaccttatgtgcctagcaaggacatatatacaaagcactgtgtaatctggaagattgtattagccagtctgagagaaaacactatcacccattaaagatactgctatcatcagtcaagactaacacattcacaggcagagtacttacacattctgatgactgtctagtccttatggactgatcaccctgttgctgagctgaaccagccacctgttgagcatttacaaggttgcggaccagctgggctgctaagagaaggcatcacaaagaaaatcaacagataaggaaagtagcagagaaatgacaataaataaactcccttcttatgtaaaagaatctcaaatatctctgcaattttataaacttggacttttaaaccttaagtatattaacgaaggacttgcagcaactgagctacttaattttaaaagctatttgtcaaactagcagatcaagaaaaaaaataacactgatcctagaagcaagaacaaatgttattctgcttttctaaaggagacaacatatttatttgagaaatactttctggttgggtgcagtggctcatatctgtaatcctagtattctgggaggctgaggtgggaggatcacttgagtccagaaggtcaaagctgcactgagctgtgatcataccacgcactgcagcctgggcaacaagagtctgtctctctctatgtctctctctctctctctctctcacacaca

SEQ ID NO: 53780 - DNA, 2964 bp, Homo sapiens
tatttttagtttttagagacagagtttcgccacttcgtccaggctggagtgcagtggctattcataggcacagtcattatgcactacagcctcaaactcctggccttgagtggtcctcccatctcagcctcctgagtagctgggactacagactttttttttttttttttttttttagatggagtcttgctgtgtcacccaggctggagtgcagtggcacgatctttgcttactgcaatctccacttcctggattcaagcaactctcctgtctcttcctcctgaatagctgggactacaggcacacgccaccatgctcagctaatttttgtgtttttagtagagacggggttttgccatgttggccaggctggtctcgaactcctgacctcaggtgatccccctgcctcagcctcccaaagtgttgggattacaggcatgagtcactgcacctagcctacaggcaattttgtacagagaataattcctttccagaagtagcccgatatagcagaaagcatgagttttgttgtgagacagacttagctctacatcttttatgtgagacttaacctgttttttctatgggcaaatgacctgaactcctgaatcagtttccccatctgtaaagtgaggatgaaaatagtatctactttattgagatttttcttattcatctgtagcatctttgtgtaatgtcatatggatgtaacttggttagtactattagcaactgtgatgatgatgattgtgaatcttattttcatatcttgggttttcttacagtgaaatatttgttgctgttattttctttgtaaaaataaaccatgtttgcatcttggtcttctttccatttggattcaaaagttttatagtgattcctcctagtaaaattgcattttctccctaggagtacttctttgattccagagtattaacagatggagaactggctcccaatgatagatgttgccgtgtgtgtggaaaaataggccactacatgaaagactgccctaaaaggaaaaggttggcaaatgaatatatatcaacattttgaggaaaataaatgagaggccaatttgtagctataattatgttcagaaatgtttaactgagaaagtttagggtatttaattatacctaaggtaaatgttcatttgagtggaattttgtaatagggtaagatttgcatgtggtataatagtatcttctaacattcatttgttcatttattcattaattcactcagtttttttttgtttttgtttttgtttttatttttgttttttttgagacggcatctcgccctgtcgcccaggctggagtgcaatggtgtgatctcggctcactgcatcctccgcctcccagtttcaagtgattctcctgcctcagcctcccaagtagctgggattacaggcgcacaccacaatgcccagctaattttttgtatctttagtagagatggagtttcaccaacattggccaggctggtctcgaacgcctgacctcgtgatctgcctgccttggcctcccaaagtgctgggattacaggcgtgagacaccatgccagccagttttgtgttttttttaaatgaagaactgtttattgacaccgtctatgtgttgggaattgttctaggagaaataaaagtgaccaagacgttgggttcttgctgaggatctcacagtcatgcaaactgataattaaaatacaattaatggaattcttgagataacatgctgtgagctatatttatagatcttggggaatgtacatcttctatactccctcaaaatatatctacgaattatagtctcccaggttctgtatactgtagtaggtcaggaagatctctttcttttgtcatcaagtctggcctaaaataaaaacttggaacttttgagacagaacgaacttccagtttccatcactgctatttactattaaatttagtcaagacacttatcttctctaagcctcaatttctttttaaaactggagataataaatatcaacctctaaggattgttaaaggtttaagatttggtattttaaaaaatttaatataatattgttttacaaaactactggaaaaccgagttcctgccaaatgagcaggtgtgccataaatgtttgttcccttgccttcaaaaagacgcatgaaatgatgggcatgttagtccttttgttattgtgagagtcctgcatagtttgttctgtgactcacttaatttacaagtccctagccccacattattggtatcagcagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcaggtaaatagaaaaggccaaacatagtttctggtagaaacgaagtcatttatgttgcttgcatgctaaatgaccctaattcctctctgttgcaaacctaattgtatgattttggaccttacaatttcttaaagagataaaatttagacaatgaggcttttacttttaatagtacttggataagtttattatcaaggtttccacagtctgttgtattcaattatctccctgtaagtattctttagatttttatttttatttttatttttttgagatggagtctcgctcttgttacccaggctggagtacagtggcgcgatctcggctcactgcaacctctgcctcccgggttcaagcgattctcctgcctcagcctcctgagtagctgggattacaggcgcatgccaccacgcccagctaatttttagacttttagtagagacatggtttcactgtgttggccaggctggtctcaaa

SEQ ID NO: 53781 - DNA, 2594 bp, Homo sapiens
tagtttatttcaatatctagcaaataaatctgtgtttacaaaacatgaaatacctataatagcgtctgaatctttaaggataaaatattacatgtcagccccttaatatcttcacttctttcttgaggtcagaaatcctatgtcttttgtttcagatattaatagctgcaattgcctctttttttttttttttttttttttttgagacagaatctcgcttagtcacccagtctggagtgtagtggcacaatctcagctcattgcaacctcaatctcctgagttcaagcgattctcctgcctccgcctcccaagtagctgggactaccagcacgaaccaccacgcccagccaattttttgtatttttattagagacggggttttgccatgttggccaggctggtcttgaactcctgacctcaggtgatccgcctgcctcggcctcccaaagtgctgggattacaggcatgagccactgcgcccggcctcagtctttcacttttgttttatgaaatgtcggaatatgtgctagatgacttttagtaaactgtatctgtttaagtaatatgtaaatgttaaaaagcaacttattagccctagtccctggaagcttgatttctgtgtaacatacttacatattaaatatagtcattcaacaaacatatattaagtgttctctatgtggctttggtctagtagggttctgggtttcagagataagccatagtccttacccacaaagaacttaaatctgaggataaaattggaggggccagacatgtagttaattttataaatcactgtcacatcaaaaatggaaatggccattgggcccaggcccaccttaactagtggatttaaatggtattgtggtttaactgtattctgggacccattagtcacggtagagggtaaagagaaggtggtgtggtatgttttctccatttataaactactgactgactaatttatatagtctttcctcattttcactgggaaaagtgagcacttagggagatgattgtcttgcccagaaccactattcctcaggatagaggctagaaattaggtctcctgactgaatctgttgcaccttcctactttattgcatctcttaagcctcctttagaataaaagtatcaattacttgtggaagtcagttacacagacatcttacgggatacttttcttgtaaaaatagcgtttttttctccttttttcttctccttaggacagcggattattattcataataaagtttatagtctttatcaaaatgtaagggaaagcttcctaattttccttttttttttttgtttttttgtttttttgtttttttttggtgagatggagtctcgccctgtcgcccaggctggagtgcagtggcacgatctcggctgactgcaacctctgctttccaggttcaagcatttctcctgcctcagcctcccgagtagatgggattacaggtgcacgccaccacgcccagctaattttttgtatctttagtagacactgggtttcaccatgttggccaggctggtctcaaactcctgacctcatgatccaccattctcggcctcccaaagtgctgggattacaggcgtgaaccaccgtgcctggccctaattttccatttttacaaaatgatagtccaattgctttttagccttatctgatatagataaatgattaaaggtactaggtcccaaaacagttctgttgccttcctttgggtgcacaatcagtgggtattatctattttgtatttttatatctgtgatcctttgatgaaactgctgtttcatcatgactgctgtttcttttttaagttttgcttcattattcttggactggatatgttttgataggtcaagtagataacatcaaatgtatcatttggagtttaatgctcttaaaagacatccttttccagctttggtctttcagatacgttttattcattaacttcttggcatcaaattataccatcatcctgacatgttctttttggaagaagtattttagtatgtcttataggtaaattctaaaatggtattagagtatttggacctttgggttggatcacttgaaatctaataatacaattaatttttttatgcagatctttgatggaaaacagattccacagagaatggttgatggatggaatgctttcttctttgataaaacagaagaactggtaattttaaaatagtctttatgttctagaatgctcactgatatatgttagcatctgtataatttaataattttacttaaatttgctgtccatgttttggatagtactgtatagacattgttcttttctttttttttttatatgtagaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaaggtaacatttaagctgatattaattcaggagcaaccaaaatttggtcaacgaaattgaggggaaaact

SEQ ID NO: 53782 - DNA, 1691 bp, Homo sapiens
tcacgcctgtaatcccagcactttgggaggctgaggcgggcggatcacgaggtcaggagatcgagaccatcctggtgaacacggtgaaacctggtctctactaaaaatacaaaaaaattagccgggcacggtggcgggtgcctgtagtcccagcaactcgggaggctgagacaggagaatggcatgaacccgggaggcagagcttgcagtgagccgagatagcaccactgcactccggcctgggcgaaagagcaagactccgtctcaaaaaaagaaaaaaaaaaaaaaaaaaaagatttgaatccaggtttgtctcaatttggagcctatgtacttaatcagtatattgttttgccctcaccaaactcacctctagttgtttattcacttattgaaaaccatattcttctcctgtctttgtgcttctcaaactttaatctgcatgtgaattaccttgggatcctgttaaaatgcagattatgatttagtagactggggagggtcctcagattctgcatttctatcaagtttccagattatgctgatactgtaggtctatgaatcacttacttggagtagcaaggttattatagagctttatggctggaaattgtaaatgctactattaaatgcttagattaaagtagaatttgcacaaggtgaaattgagtcaaacttatttatttgatttgttttttagaaattaaattgtaaggaaataattgaaaatttggcaaaaattcttaagagacatccaggtatgaattttgaatcttatctgtaaaacaaaataaatttttttagcatatatgaaaattatttaacctactgaagtcttttttttttaaattaggtttaagaaacattttgcctataactactgccaaagtgcctatagtaaaatttgaacacaggcgaagtgggttagaaggcgatatcagtttatataatacgttggtaagtttatctttataggccatgtatatacttttcattttaaaagtttacagattactgactctatgtttaaaactttcaaatgtgaacagtataaggaaaaagtattttactagttatcttgatagttccttcagattgaaggtcagtttttgtttgactcattaataggtgttttacattttacatttatatattttgtatttggagtgtattttacttttaaatctgatttgtagtttaattttacgaaatttgaaatcctttcaaatatgtaattatttttcaggctcaacataacacaagaatgctagctacttatgcagctattgatcctagagtgcagtatttgggatatactatgaaagtgtttgctaaggtatttatgaaaaaattaatgatctgctttgttcatgataattaaaatgaaacataactaatgtcagatttgtgaaaaattttgtctcagttttgtttatctgagcttttaaaaaagaaactttcagtattatatagcttgaatagatacctatcagagtagggtggctctgtctttttttcctgtatgtattctattcccatgtgcaactgactagtcagtttctcagcagtaacatttctcaatgcagtgattttagccccaggcatgggagttggcatatcatcctagttaagaatttctgagttaagaaatcttatatttgagtttagtgataagtttttctgacccagaa

SEQ ID NO: 53783 - DNA, 1404 bp, Homo sapiens
atgattgtgcctgtgaatagccagtgcactctagcctgggcaatatagcaagaccctgtctctaaaaaaaaaaaagtaataggaagaaaaatccaattctgttaaaccacagcttatttgaaatggtagctgttattggatgacactgagtctgaagggttaaccctatcataatttatatcaagtggactataatcactcatttttggaagagcatcgtatactaaggtgatatttgtaaacctacatgaattgtgctttgaaagaactaatttatttttaagagggcagtcctcaaatattgatcttaactattggtagtgatgttgagaatgtataaaagcagatggatttattatgtaagtcggaaaaagctaaaagtctcaatgattgtttggatgtggacattgagagacagatattaaggattgcacctgtatttctgatgtgggcatctgtgtacatgatggtactatttgctaagaacagggataatagaaatagtaatagatttggggcaaagttgatagttcagacgtgttgaatgtatgatgtctgtggaaaattggaaaaagcagttgggtacatgggtatgggaacttgggcaaaagcttgggctcaagatgttttggaatttctcagtatttcttccagtggtaggtaatttaaatcatagaaatggacaagagcatgttgtattaggtcatcagcagatagcagaagactcctcctctctgcttataataaggccttggactttgttttcctttgcttagaaaaggcaaggttgtgcttatttggctcttctaagaatggatttggatttcgtgatagtgatctggatatttgtatgaccctggaaggccatgaaaatgcagaggtaagagtgtttggaaagcgttatgtaagtttattttctcccaatgacgattctatgtttatttttgtatgtgatattgataaaaatgtggtatcactctttgtataaatatattagcaaaataagtgtttgaaatatgaaaacagtagcattttcagtttagaagacattgaactcttaagtaaaagtgtttcagtaattttatgatacaaaaaccatgtcactgagagttacagtgatttgtaatgaattttgggaaaaaatatatcacgaagttggaattttttcactagaaccaatgggaagctgatgcatcagttttgtagtgaacattgatctttcatactttgtcttctcatatctctttcattagatgatgtctttgtgttactataggtagtaaatataggtggtcatctaatttataattggttttgttctaaaagttagttataatttttgaccactcacataaaattttttccatagaagcaatgttacagatgatatgctaagggctgggc

SEQ ID NO: 53784 - DNA, 2161 bp, Homo sapiens
ttttaaaattgcatacattaaggctcactctttgtgctgcaaagttctgtgggttttgacaagtgcattgtgtcatgtatccaccattagagtgtcatacagaatagtttcactgccctaaaacaagttaacgaattacattaattttatttaactccccttcttctgtaagcactgataactgcatttgtttttaaaaagctgaatattagtttaattcattataacaaattcttaataaattactgctttgtttctgttactgtgttaacttttggggataagtctggaagagatagggaaaaaaagactttgttcttaagaaatatatggacttatttggaaaaataagatgaatataaatgaaataactagaaaaccaaaaggacaaaataaattaggtaccagactgtggcacacagtttgaagaactaaagaagtgtggaactaaggagagatcattgaaggctgtggttaggcaaaacagtttatagggaagatagaaattttgaccaggcatttgagggaactgttaaatttgagtgggccagatgcctagtatagcaacatgaatacagatcttaacaaatgggaaaataagcatggatatgggggagagtgaagaagtaaataggtttgtagatatacggaaaatgatcatgtgaaatgtacatatatcttaaaaattatttttctgtttcatttattttcgtttcttcccctgggttgctaaaacagaaaaacagtttttttccttctatctcccagacccttccccagtaacatttatggttttaaagtcagagaagtcaacaaataatgaacaaactgtaagtaaaatttttagggtaaaaacttgaagatgttttcagattctgttttccttacttttctttttccttttttcttctttttataaacccagatgagttatcaccaccttgttctgaacaacacaacagggagcaaattttaattggcttggaaaagtttattcaaaaagaatatgatggtatgtcataggttaaaaaatttattgcgtttttgctgtagtcatgtagtcttgagtttcatttatttaaaaatatttattgaatgctatgtgttaagtactgttctagttgctgggaatacagtgctaataaaagagatgaaacctcatgaagcttatgtttcaaatggggagacaaatagttgactaataaatatataatattatatcagcaaataatacatgctgttaaaagtataggagataaaagaactgaagtgatggagtgttatgataggcctctctcataaggtagcatttgaggagaatcctgaataacatgaaggagcaagttatataaatatccaaggagaaaacattgttgatggaacaagaatagattatgtttggcatatttgaggaatagccaggaagtcagtgtggctggagtggagtattagaggtagattgtaatgtatagaagaggtcagagagggggtctagggattaagtcattagtgccttatggatgttggtagaaagcctttgaattttattttgagtacctaatgagaatcttttagaggatttttagttaataaatgacatgatctgagtgaatggtttgctgggctataagactggaagcaagcagaacatttaggaggctgttgtgtgagtccagagtagatgagaagtggtcagatttgggatatattttgaaggtagaaccaataggatttgctgatggaaaatgtgaggcatgagagaaagaaagaaatcaaggatggtttcaaggtttttgctataacagttacagtaggtggtcctatataactgagatggcaaagagcaggaagagtaagttttgggcatggggatgaagaatcaagatttttgtgactaaatattttagaaaaggataaaagttgactttaatcagaatgaatttgtacttttacaagatgacccattatgtgctacatattacaattaaaagtatttgaaaacaaatattttttaaattaaaaaatcatatcatcattattgttttttagagacaggttctcactctgttgcccagactggagtgcagtggcatgatcatagctcactgcagcctcaaacttccgggctcaagcaatcctcctgccttagcctcccaagtcg

SEQ ID NO: 53785 - DNA, 1049 bp, Homo sapiens
attcacctgttgataaatatttgtctcatttcaaaattttggctgggtgggtctgggtatggacatatgcttttatttatcttgactaaatacttagaatggctgggtcatggcacgtgttttttagcagctttattaagatacaatttacatttatttttacttagtaatttatttacctcaatgtgggctcatagatatttgatgccttgggttataattgaatataattttcttttgttcagattattctagctttggccattgggaactcttttacttgactacctggtcccttttatatatatccatcagtgtgtggttttttttgtttgtttgggttttaacacttccatactttctggcactacaagatgctcctggcactgcatgtatattttgtgccctactcctagaattaggcatttgtccaaggagctgtggttccttttattggagaatgagattagaaaccaagacctgaacactagatgtgcttgctgttactgggctgtcactgctttgaggccatctcagagcaacaaaatatgtgtgtatatactaacctatgtatataaacttactataaagatttctatatgtagccgtctttttttttttttttttttggagactgagtctcgctctgtcgcccaggctggagtgcagtggcgccatctcagctcactgcaagctccgcctcctgggttccagccatttctcctgcctcagcctcccgagtagctgggactacaggctcgtgccatcacgcccggctaattttttgtatttttagtagagacagggtttcactgtgttagccaggatggtcttgatctcctgaccttgtgatccaccctcctcagcctcccaaagtgctgggcttacaggtgtgagccacggcgcacagcctgtatgtagccatcttatctgtattaaaccaaacatgatttcataatggtatatccaactcgaactcattaccacatggctcgttttagcccccactccaacagtgagaaacctggttcccaccatctattattcat

SEQ ID NO: 53786 - DNA, 3062 bp, Homo sapiens
gcttgggggacagagcaagactccatctcaaaagaaaaaaaaaaactcctttttccacaatttcatcattgaaactaattacttagttggccttctcagccatcccattattagtgaccttattattagtcttgtttatttttccttttagctttttattttatgagagaaagaaaaaaatgttgcaattgtatttcctcccattttcaggaactttcactgggagtctagcttagaaaaaccccttgggaaaatgtattctcctgacagtttatcagttaagatctacttgtatgagcttggaaatgtagtttgttagtagagacttagctatttaccattttctcttttgctagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaaggtaggatacagtttgtaaatgatctgtaagattttgtggttgttgtatgactatgtatattttttagattagaaatgtaaaaatagctatataaagtggtgacttgttttggaatgatattttggtatgtattttaccttttgtgtttttcatatagttgcctttaaataatgtatataaagcctcaaaaggtttcagcattctattaccagttggtttcctttactttctcatatatgaaaggattcatctgatatttcatgaaaatcttagcaaaggtagcatgcattttaaatgttgcttattttgtatttttttccccaacaaaagccacattcaagcttatttttatacataaaatttttcttccccccccaaaataaaaggtttgtaaattctaatagtattctactttaaagatatttttagaggggggaaatataagcatactaaaggtagttgagggaaactaagattaatagtcaaaaaaatgaagaatccagattctgtttctgctactgagcctctggatttcggcttatcctatatgaattacaggaatccaaacttttctactttttcttttcaagtaagatagtatgaacttattactactattattttgagacaaggtctggctctgttgcccaggctgaagtgcagtggtgcaatctcagctcactgcaacctctgcctcccgggctcaagccattctcccacctcagcctcctgagtagctgggacaacaggcgcatgccaccatgtctggctaatttttgtatttttttgtagagatgggatttcgccatgttgcccaggctggtctcgaacttgtgagctcaagtgatccgcctgctttggcctcccaaagtgctgggattatagatgtgagctactgcacctggccagatagtctgaactttaactcataaaggaaatcatttaaaatcataggaaaaaacccattgaacaggaagtaagcgataactgctttgtgaataaaacaaagttttaaccgaatcacagtacttcaagtgcattccagataattgcaatatcattattagtatccatgtgaaaaaatgattatacagatcatgcataagccaagtagaatattaaaaaaaaacaaaaggaaagtcatctagccttatccaggcttattgttttatcgtagttattgacaagctttaagatgtttaacctaattattaaatagtattgcctgttttttaaaaatctgctttattaaggtatggctagcatttaaaaagctatagatatttaatgtctacaactggatgtgtttgaacttaagtatatatattattatcactgtcaatgccacaaacctatccatccatcagctccaaaagtaccctcctcttcttttccttttgttgttagagaacttaagaggtaccttattagcaaatttaagaatataatacagtattattaatctgtacagatctccagaactactttgtacagatctccagaacttatttattttgcacaaatgaaactttgtaccctttgaccaacacctccccattttcccctcccaataagcagtatttcttcattctatgtaaatatacatctgttgcattttatctaggttgcagtatttaaggcacatgcactattgaaagcatcaaataaatggcaggtttttagaaaacttaattatataacttcagtttacatgtcttatgctttatactttttttcctggaaacttagggtaagtactgttgttccagttttcatttttactatttaaagagtttcctgcctaaatatgtcattttttaaaaaaagctttgaaaaggtgatagagattcttgtagtactgttaattagcccacagtgcatcattcttacaaagagagatttccttatataatttgtatcagaatttatggctatataaatgtccaggctaacattggagaaagacactttaggatgtaggcatattacaataaagaaaaga

SEQ ID NO: 53787 - DNA, 1993 bp, Homo sapiens
aaaaaggcctagaagaagacatagaaggttgttaattgaagtagaagtagaggcaagatgaaaaaatatttttaaaatgtgtccacagtaaaataactacatgtaatattattccttttaacaaaaatatgtatctttgtatgaattttaaaaagaatgaaaaaaatgatcatcaacattttaatggttattttagagtgatgatatttcaagttattccttatatttttcattgtcatttgaactttttacaatgattagggtaggaaaaagcaagctacttttatcatgaaaattaagaaagctaaatggtagtacttttttccccttcattttgcagttgtgctatattgactcccaaactgatggtggaatcccttcttactgttttgctttaatggtgatgttttttctacaacagagaaaaccccctcttcttccttgcttacttggaagttgggtaagcatgaatttgtgacatatatatgcatatatatatatagtttgctcttgcagagaactctgctcaaacattttaagctggaattctggtttgtctgtttgtccatctttttttttttttttaaataatttttccactaccaatttggaatgcctttttatatagattgaaggctttgacccaaaaagaatggatgactttcagctgaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaagtaagcctttttgtttttgttttttggcttttctatctgtagaatttgtgatattcttcgattgaagctattttaattgtagattgactgaccttgagcaagcctcttggcctcattttcctcatctataaagtgaggggttgatctggtttagtttttcagtaccaagattctctaatgaatttatgccttattttggaaaacttgtgttgtttgaatcatgtcaagataaatctgtcatttttcatctagacaaggaaaatttcctttaagagttgggctctgaccagacttcagcatatgggaattttgttgccaattgggtggagaaataaagcccctgtgctctaagagagggtagctttgcttatttgatcattcagcattcatttttaaggacctgctatgtgccaggcattatcttgagtgctagagaaccaaaggtacatggattatgtccttcagaagcttgtagtcttctaaatggacagatgcattattacagaaatctgaacatttctgaaatcattgctctagctatattgaattatttgtagtttcctgatatacttgactattgtattcaactcttccactttcctgtactactgtatactctctcctcaaaccactaatactctcagccaatgcttgcttattacttcactgggaacttgccatgttcttatctaaagtcattttcttcacttgcgtattcagtctcatcctttcttgtcttttccagaatatcactctagcaattattccctcataaattgccaatttttcattccctacaaaatcaaacatgctcttacttctcccactgtaagaaaaatctgacatcacttcccctcccagctattcctttgctcccttttgcagcgaaacttcttaaagaaatgtctgtatttactatttttgatttctctgtttccccttaactcacactaatcaggctttgatgtcaccccatcagtttgccaaaacttgtatcatcaatgtcagtaacctccacattactaaatcccgtggtcatttctcagtttctgttgtttttgatttattagcaacacttgccagttaattacttccctctctgaaaattttattcacttgactttcaggacaccagacccgtgtctggttatt

SEQ ID NO: 53788 - DNA, 1135 bp, Homo sapiens
tgaaaataacatattagtacaattgtgaaagcttggataggaaaaattagagtcaagaagtatagccagtcagttaagtattcattttttgctattatcatgtagaaagcaagaggattgaactaggaaattaccttgcactatttgacattgaagagatcagtgccctgtctctcatgtatatcagttttgataattcataatgctgcttttgaaattaatttctcattaacttaaatactaagtttggttgaaatttatttctgaagtacaaatgaatgttaaaaacatctttctttaattcgtatggaactctagttatggaatgacatgtagttttcagttagctctaaatttattaaaacatttgtttttattagggcttttacggtactatgttacaatatgataactagaaagaaaatagccacaggatttgaagtattctgcttttaagggtattaatacaatgaaatttgtttctttctcattcacagtggtttactttgtagagtgagtgcaggaaacgatatggcatgtctcactactgatttacttactgcccttggcaaaatagaacctgtctttattcccttggtgttagcctttcgctactgggctaaggtaagtgaaagagaggaaaactacttatttatatttttagaaggaaatgtatttaatcttcaaaattaggccttttcttgtactgacatgtaacatcaatcataacatgtgggagaaagtagttttctgtgctagacagaaagttggtgtggcaggttgtaatttatggacataaaaataaatttttgtagacacacttatggatatattttagaatttttaattgtcatgctatattctccttttatgtactatagaaatgttctctttcatatcagcatatgaggctcaagttttcactcttactgtaagttaaacttgtaaggttttaagatgtatatacattaagattcttttgttggcatatttttttccccagtctctaagaatgctattctctttcctctaaatcattgataacatgtaccaatttctgattgggcaactgctgagcattagttatttaagtttcctaaattagtcttaatttgtatgtctaaaggctgtggtt

SEQ ID NO: 53789 - DNA, 1087 bp, Homo sapiens
tccttagcagctttgattaggcaaactcttcatatactaacgggaaatgtggcctgaagagttaggttgtaattacattggtaatttaaaagaactaaactgtcaaagcatgataggtcctcctttcatggctcctgtggaactagctctcaggagtaaggggtgtcctctctttgctgttatctatgaaggtttaacaactttgactagattatctacttacttggaaatattaaaacttttagggatgttaagacctttcttaaggtgattataatttttggacagtatttggggctgtacctgtggtttgtgatatacagcaaatgacaccaggagaggtaagagatttcgctgggttggtgctcataatgagaagagtggattatcccacagaagcaatgagaataattttcagaaggaaactgttacttaatgtttactgtagagtacgtattttagagatgttgacattagcttacttttttttttccttattagtattatatgtagatgtggaatctgattttcacgctaaagttcctgttgtggtgtgcagagatcgaaaaaggttggtaacaatgaagataaaatatttaaaaaaacaaaccccaacaaccaaatttgtagtgaatgatctttaagagaaaaagtttttgttttagatttctccttggatgaatatgactaagctagtttctattcattaaaaatagcaagcttaccaaatgcatgtgaacaagaaatatatagaacatcagacagttgaaaataaaatactctaggcaaaacttcaattttttttttttcaagtcattcactcacccaagagtattgcatttacttatatgcaggtactactttgctctatggatacagacataaagaagaaatagcctctcttcagtcacttgagcccaggaattcaagactagcctgggcaacatagtgagaccttgtctccacaaaaaaaataaaaaaatcagccaggcatggtgggtgtgtgtgcctgtggtcccagctactcgggaggctgaggtgggaggatggcctgagcctgggaggttgaggctgcagtgagccgtga

SEQ ID NO: 53790 - DNA, 1032 bp, Homo sapiens
acttctttgaacaagatttgttgacataaaagtaaaacatggccaggtaaggtggctcatgcttataattcccgtgctttgggaggcaaaagtaggaggaatccttcttgccaggagttcaagaccagcctgggcaatatagcaagaccttgtctcttaaaaaaaaaaaaaaaaaaagtattagctggatgtggtggcacacacttacactcctagctactcgggatgctgaggcaggaggagtctttgagcccagaagttcaggctgtagtgagctatggtcatgctgcagcctggacaatacagggaaacctcatctcaaaaaaaaacaaaaaaaaaacacgattctgttttcactatttaaaacacaaagcatgattatatttaaatgttattctttaatgaaattgagttttccttaatgttctgctgtccgaactttgaaattagtatatcgatttatttttgaaacttttttagatgaatcatccagatcttctgataaaagtacttgggattttaaagaaaaatggtgagtttcttttctttttcttttcttttttttttttaatttgtctttctaaaggtacatgtgttgtttatatatggctaaccaagttaaaactaaactgctggcatagttgagtcattgcattacaaatggagatacatacacacacttgtttatagatatactagaaaatataatttaactgtaacttaggtaaaaaaaaaaatgccatattaaaattgatatgtaggctgggcaccgtggctcacacctgtaatcccagcactctgggaggctgagatgggtggatcacctgaggtcaggcgtttgggaccagcctgactaacatgctgaaaccccgtctctactaaaaacacaaaattagccaggcgtggtggcacgtacctgtagtcccagctactcgggagactgaggcagaagaattgcttgaacccgggatgcggaggttgcagtgagctgagattgcgctgctacactccagcctgggcggcaaaagtgaa

SEQ ID NO: 53791 - DNA, 1365 bp, Homo sapiens
tgagaaccacagtgttttgggttttaggtttacagaattaactgacttggcttcacttcgtattttataaaagcattggcattgaatgtttatgatcctttccccaaagtgctcttacataaatatttaagagtaaataaatgtagtttgtgacagtagccatagctaagttggtacattagttactgttatatattgaatgctaaacatattgtcagtcatttctaaatgaactattactaaaattttgtttaaacagtaagcttctgtgagtagtttctctctcccttctctgttcctacactccataactgggaaccatttttttattctatagatcagttagaaagggtgttcttcttgtataattgtcttactagaaatggaagacgtagaactgaagtgtgtgaaattttcccgtcgctgtttttttacatctctcatatttgcatgctatttcatgctttgatgtttttcctttattccagaatgttcacttaggttgtatggctcatctctgactagatttgctctgaaaagtagtgatgttaatatagatataaaatttcctcccaaggtaagtaattagaatctttcctgtgtggttcttaactagtacttagtaatttttatggattatctttgtagagaaaggatagggaaatataaaactctggtttgtatagtgttaccatcgtgactaaacagtgcttttggaaattactattagatttcagacaaaggcaggataaaagaaataagggacaagggcaaaaggaagcagaagaggaaagctggaaaaaggaaaaatgtttatatttgaacatgttgaatagttaatacttctggtaagcagtatagaaggtgggaagagttttgaaatcagatacctagattcagatcttatctgtgataagcaagttgcttgaactttttgagcttcagttttctcatttccaaaacaggaataataatttttatattaaatgagataatattaatatatgtcaggtgtcttaatatagtatctggtacatatgggtacttttaataagtagtacctagaatcattagaacaatattgatattgttctaatattgttatcagtattagaacaatattgtttagcactgctgacattctttattgacatatcaatcttttaaaataagtcaatattttatgttttaaattgaataatatgtttatgttcagggaggtttgatttgggtgaaaatttggtgtttgtagggtgatacatttactttataattaatgtatggttattaaatatttttgttgtttgtttttgagacataacctcactttgtttcccaggctggagtgcagtgatgcagtctcgg

SEQ ID NO: 53792 - DNA, 1581 bp, Homo sapiens
gtctgaatatggtaacagttagtgaaaatagaaatggaccaaagtctttaagtatatttgattgggtagggaaaccaactagctttggctattatatctgatgggagcgtcatgtttcaaaagataagagatggtttcttgagtgaaaaatgttaatagaaaatgcctgtgtggggaggggatgtgttaataatactaaataaaagagaatgattgtggctcagttgtgttaaagaatgaaggagatagtaggatatgaaattgtgggttattttcttctttgtattttcctgtgttttatgtagcttttgtaattaacattttttaaatcagaaaataattaataaaagtcattgcatatatatagcaaagtgtctttttagctcctagatttaaattggctttaaaacttttagcagaatagaggttttttgaacatttcgcatagcgttggataaaatcacaaagagaaatcactggtaaatagtaggcaggaagttttcctgtgaccatttaacttgatactgtatatgctgattagataggattcaagacttttctgctacatctaagacaatctgccttggtgcaacaaaatcgtcaagttagtattgtacttaaggtaccttggctttaatgtagcatttcagaatttatgcagacagtacagtggaacaaatttttaaaaacttagtagcatcccctccccacacagtacctctcattctcaaaaccctgcttcccaaaggcagaagtcttttgttcacttccgtattgtaggtatctggtagatggaaggtgaatatttttgttgagttagtttatttctgtctttccctgctaaatataagaacaattaaaatagaaactttttttgtttttattgttgtgaatcattacattaataggaaaaacaagaagaaagtgagcttcgttctctgccacctccttcccctgcccacttggctgctttaagtgttgcagtcattgaattagcaaaagaacatggaataacagatgatgacctcagagtccgtcaggaaattgtggaggaaatgtcaaaggttataacgacatttttaccaggtagaaatacatttcatatttgattttgaaaatcacaaaactcttcccttgctcctcttgaactagagtacatttcttaatgtttttcttcccttttctccttaaaagtagataaaatttattgttttatgaatgaatttttgagggaaatatttcacacaaggaaattgagaattatggcacagcacacttttgtactaagaaaaaaagattttaaaaatgccagatgtagaactatttcttggcggtcaaatattttagtttttcaatatcactgatttctgagtggactattttgttatattattttcagtataaacatttcatccagtcactgaactaaatttctgttgcctgatggtggggaaaaattaatttactttaatagggcctttagaaaaagcttattgtttggtacaagggagtgtcagatttattttagatatttatatatggactatttgcttagcccatatcttttttgcatcagtatag

SEQ ID NO: 53793 - DNA, 1024 bp, Homo sapiens
agccaccagagtagctgggattacaagcctgcgccaccatgcacggctaaattttgtatttttagtagagaatgggtttctccatgttgtccagtcttgtcttcaactcctgagctcaagtgatctgccagcgtcgtcctcccaaagtgctgggattacaggcatagccaccacactcagcccgactgcttttcttacattggattctaaagatgatagtaggtgaatattaaacataatttagcattaccatgatattgttagatatcgtattaaagttagtatgtaatctcctatgataactattttgaaaaaggactactatctcttcagtatataagtttattaaaaactattactttagaagaaggaaaggataaagaaaaaaccttcagtgcttatttctgtctacttacataattgtattattcacttatatagtcaatagtttactcctctgttttctgaataaagtgcatttttaaaatttgtctcttcagcgatcaccagaatataccaattgtcggtatctatgcaaactttgcttaattcacattgaaaatatccagggggctcataaacatataaaggagaaacgacataagaaaaatattttggtaagttctttttaaaaaatacttttatttatttttcaagttgtaaaaccatattgaatattttttatttgtgaaactaaaaatgaaatatttgtccaatcttatattggtaactgaagtgatagctttggaagcaattgttgccttccttatctgagataatcaggaaggaaccttgttgagaccggtttgctcatcctttagaatgttgattcctaagtttagagctgttaggtacaattagtccatccaactgatgtttattgagttcttgtgtgctacttctaggcagtggtgaataagatagttgtggttcctgccctcagattttctaagaattgatgagggcatgcgttgaataaagatttaaatataatgagtcttgttagggggggaagattgtgcta

SEQ ID NO: 53794 - DNA, 1005 bp, Homo sapiens
tttttatcagattgacttcagagattctccaagatgattatgttatattagctttgtgtaattagctttgtgtaatgtaagtctcagttatgtatctcttgatggatagattggaagaacaagctagtcatttgacccataaaggtttttctttgtgactttggataccatgtctacctcttacctatattttatatatgcataccaacttgtatactttcctaaggaaaatataaggaaataatattttttctgtgtataaatttaatgtctgttttccattaaaaaatttaaaaatttaccagttctgatgataactgagtgattgctttcttttctaggtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaagtatactatgttgttttagttatttggggggaaatgtgtgtttcataactgttttccccaagtacagctttttttatttttcttttattcataagacagaggttgcattcatctttccttacttccctcttctctacctttcttcttctttccctcttttcttccttgcctctctttttcagcagttacttattatctgtgagtctgacttcattcatcccaagagttggcaaactatggtctatcccttgcttttgtttttgaatgggttaaaatacacctagtctccccaccgtttttggtaaacattttattggaatatagccatgcctatttgtttacatgtcgtttatggctactttcatgctacgatgggaaatttgagttgagtagttgtcacagagcttatatggcttgaaaagcataaaatatttagtctttgccaaagcataaaatgtctaccaaaatatttattcgcccctttatagacgaaacttgct

SEQ ID NO: 53795 - DNA, 1055 bp, Homo sapiens
ctattgaaattcttaaagaaatatgagacaacctttacttctaaaattctttattttggtgctgttttaccacaattacattagaattcccttgatgagcatttggctatttacctagtgcactgtaactccttctcatatagttttctgagttttgtctttttttttttttttaacaatttcttcagtttttagaacaagtttaaaaaattgttttttaatgtctaaccataaaaaattgtttttgcattttaaataacagatttttctcttttttttaacccaatagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccggtgaaagccgaaaaggcaaccatttcacaggcaaaatcagaaaaggcaaccagtttacaggcaaaagcagaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaaatgtgctctgcaaaactcaccacgatctcagaagcaacagacatgtacagataatactggtgatt

SEQ ID NO: 53796 - DNA, 1879 bp, Homo sapiens
cgtgtcccggcctccagcggcggcagcggcgacggcggcggcagcaggaggcggagggagagcaggagccactgagatgaggaggcgtcgcgcgcgcctgtagctcgcgggcctcgcaggtacgaggttccggccgcggggcagcgtcgggtaccgagggggtgtgctcgggaaggccgggcggcccccggttcgccctccccaggtgccgcgcttcgcaggtgtcgggggcctggcctgagagcgtctcagccgccccctgggggcctgacacttctttctttcctggaacgggcttcgggtgtcccaggggaaggctgagataagggaggtggggacggcggcctgggcggcctgaggagggcattggggcgctttggggacgaactccacactgtggctggggctcccggtcccggaccgaaacctgttgtagaccagcggggcggattttgagttaacgggattggtttgaacatttctgttgggtccagttacgattccctgtcatgtgtacctttttctttcacccttgcttagacataggtgactacataatgtatataaatgtatacacgcatataatacatactgaatgtttccccgggctcgtccttgtagggagaaggcagaggtgtctgtgtggattttgtttcttgctcgcccgccttctctctcccccgccccccagtcgaaaggtggtaatgcgcggttttgacgtgggtaactgagattcgtatttgtaaacagatagcgctctcctagtgtgttgcacgcctctgcgaagggtttcagactcctgttggtatctggattgcgaaagaatgagatgtttagacctgaaagaagcacatcagcgggatttctagtcgtacttgaatgggatgaattactgttgtattaacaacgttgattacacattttcttttcagaagatttcgaagtcttagatgaattttgcgtgagatcttagataccgtatatctgcttcttcattttgatagaagtagtagttccttacacatttgacctgccctatcgtgatcttaaattgtgtccagaaatgcaattcgaattgtgtattgttggcatgcatttagtaattagcccgagtggatcagatggccttttatttccaaagattttttccctccagtcttacagcagcgaaatgtttgtagcacttgatgaaacagaacatatcctgtttctgtttttaaagtaatgagaactgttagctaataaaattggataatcccagccagatatgataattcagagaataccaccgagaggtgttgaattgtgggatggtttaaaaagaaaagccgactttgtgtgtgtgtgtgtatgtgtgtgtgtgcgcgcgcgagcgcgctgaaattttctttaggcttagaactcatgtatgtcactacactgcatcgtagtactgattagtcacaactggtaaaatgaaatattgattctcttaaaaagctgtgcttaagataactcattagtgtctagtgtgctatgttgcttttataaacaaatttttaaagattgcttcttagaaaccatatactttggggaagataagaattttaagtcgttttatgctttaaaaatatttatatttaatataaacaaaagaaacttacttttaaaactcttagataaatttttctgctgcttgcagtttttcacttggctagtgtggaaaatgaaaaatgaagttttcttaaaataattcagaaatggaagtgaaagttaatgacatttgatgttttaaatccagcaaacatttaaatacagaaaagaaatttaaagtattttcattgtcataggccaagttgttagtacagataaattaacaaatattgtcatgcatataagt

SEQ ID NO: 53797 - DNA, 1035 bp, Homo sapiens
cccttgagacagggtctcactttgtggcccagactgaagtgtagtggtgcaatcatagctcactgtaatgaactcctaggctcaagtgatcctcccgcctcagcctctggagtagcttaaactacaggggtgtgccactacacccggctaattttttcaatttgtatttagagactgggtctcactatgttgcccaagctggtctcaaactcctaggctcaagcaatcctctcaccttggcttcccaaagtgttgggattacaggcaggaccactgtgcccggcctgcttgctcattttgacacatacttctgacttggtttttatttaaattttgtcttgctcctgccaaaataagtttactgactacttttgtctctccagatctgacctagaccattgtactctcctatcagcataggccagctgcctcatcttgaagagctgttaaaataaaaagaaaaaagagaatggtaggaaatccagtataccaaatagcactatggtgggattgtgggtagtttatgtcatttttctataggttcaaaattttgcaatgtggttatgttattttaaataaaaatatttgaagtttactgaagtcactcatcaagtgctttcatagataactattgaattttcttccctttcatgatttccaaggatgaatataaaactgatattcctctagccaacaagatatggggtttgagatcctatctgggtcagagaatctgttctccatcttcctcccttcaaagccaactctgcactgcccccagtttactttccaaaacagagatacaagcatatatttcccctacttcaaaactttgaatgctcccccagtgtttgcaggatcaagtccaagtgacttaatatggctcccaagacctttttttttttttttttttttttttttgagacggagtctcactctgttgccgaggctggagtgcaatggcgtgatctcagctcactgtacctccaactcctgggttcaagtgattctcctgcctcagcctcctgagtagct

SEQ ID NO: 53798 - DNA, 1021 bp, Homo sapiens
gtacacgttatagtcccagctactcaaagactgaggaaggtggatcacttgagctcaggagtttgaggttgtagtgcactatgatcgtgcctatgaataaccacagcacttcagcctgggcaacatagtgagatcccatctctaaaaaaacccagagcttacaatgtcgctgttttgccttctgatatgtaacttgctttttctgtttgaagaaataattctttatatttgaaattcaataataaccaggattaatctgtcttttgatggtattgctggataatttattatttgtctaaaatttgctgagtaacctgaggaaaagcctcactctccggacctcctgtttctcaactgtatgaggagggggataatgagtcttgtcagtgttgtcggtctatacttccctgactggatttatgaatgagcaagcagagcaggaagtttgaattttatatgggctgtgagcaaaaagttgcataaaaactgagtttgaagaactgtttatgaaggctgcagcaggacttcaagctcttgagggaagatggactacaataactaccttcaattcaactcaaggttcttttccatcccagaagtgaatttatgataatagtgccttgttatgtttctgtgattggtgcagttggttaaagtctgatgtttcccggaagtttagagtggaagtctatctccaagcccttctaaaccaatgctattattgtacgcactggcaactggatgttcagacttgttcaaggtcacacaatgttggtggcgcagcaaggactggaattcaaactttctaattccccatctatacttttccctcagcagtgtagtatgataatgggactaaaaacatagatctagagccagggtaagcccattagcttgccactgccttgccactatcaactgatgccagtgggtcattgatcttttcagtgggagcctctggtcacttccagtggggttgtggggaaagcataaaagcagacagatacccccttcttttgtt

SEQ ID NO: 53799 - DNA, 1023 bp, Homo sapiens
tttttctattacttccatcctataccgactagctccacttaacatgtggagaaactgaggtcggagtgggggcgtgaccaggccagcctaaggccgctgcactaatgagaagctgagctctcagatttttgcctccctgtccctgccaagtcgctgtttcctgggacaagagggagcctcactgaaacgaactccggtctcaggggacagaatcctgaaaccctggctctggggtccggggcaggggtgcgctgcctcaggacagacggtgaaactgaggtccagagccggacatccaccgcctgcggagggaacgagaacgcggcgcgtcctgccttgcgggccgagcggcgccagagccgcctcctcccgccccccgcgctagatccccccgccccgtctttgccctcgcgacgccgccacctccggaacaagccatggtggcggcgacggtggcagcggcgtggctgctcctgtgggctgcggcctgcgcgcagcaggagcaggacttctacgacttcaaggcggtcaacatccggggcaaactggtgtcgctggagaagtaccgcggatcggtgagtgcgcggggtctggcggcgccgctgggcccggcctcgccctggcggggcctgctggggacgccccgcagcccggtcccccgcgcggtgtggctccgaggacgctccagccgcgcggccgccaaaccccggcccccgccccgctcggccgtgacctctggcgcggcgcccccatcccgcgcccggcccggcccggcccgcggctacgtggcacggccttggcgcggaggaacccgaagcgctcgcagtcggcgcccacttcgctaccggcacctttgggcagcggggtccagaccttcgccgggaggccgggcaccactgcccagcctttgccattcacgggtgaaaaaagtaaccgtagcatcgtgcggcctttccctctcccgtcctcattttctgcatctggaacggggagtggctgattcggagtccagtgaagaacact

SEQ ID NO: 53800 - DNA, 1049 bp, Homo sapiens
gcctgaggctaagagtttttgagtccagcctggacaacatggcgagaactgtctctaccaaaagtaaaaattaaaaaattagccaggtgtgatggcacgtgcctgtagtcctagctatttgagaggctgaggtgggaggatcacttcagctcagaagtttgagactgcaaacggttggggggatgtcctgttatgattatgccattgctccagcagcaacaacaacaaaagtggtgttagttctctggagaggagggggacaaaaaggtgattgccctggagttatgagggttcttttctcaagaaaacctgtgtctatgttcccatgcaggcgtttgtgtttgtgtgcacacttactcattcatctgaaacttactgagactttttcatatgccaggcccagagatgaagtggacatagctcctgccctcagtaggttcacattctagaagggagactgacacagtgcagagtggcgagtgctagctgactgagccaaaaattgagcccaggtctccctttgtaccccctcttatcagttctcagtatgtgctcaccagtatgtgtgccccagtctgtggatgtgctgtgtgtgtgggcatgtgtggtgtttgctaacatgtttgtatcgtggtgcatgtgcatacctatttatgtatgttgtatacttatgttcacagatgttcatgtatgtgtgcacacatctgtaagctcctgaatgtttgatttcatatgtgcctgtctgtgtgcatgtgtttgtgtatgtgtgagagcactggacacacatttacatatgtgtacacagtgttcttgtatgtgtgaggcagtattaactgttgagggagtcacatatgtggatgtgtcagggcatgtacaggttcatgcctcttcactggcttgtctgggctttgttttgttttgtttctgtcatacaggtgtccctggtggtgaatgtggccagcgagtgcggcttcacagaccagcactaccgagccctgcagcagctgcagcgagacctgggcccccaccactttaacgtgctcgccttc

SEQ ID NO: 53801 - DNA, 1007 bp, Homo sapiens
gctgtttgcaatagaaactttggccaggatagccaaggcgggcagattgcttgagcctaagagttggagacaaccttgggcaacatggtgaaacccagtctgtaaaaagaaatattaaaattagctcggtgtggtggcacatgcctgtagtcccagctactcaacaggctgaggcaggaggatcacttgagcccggaaggttgaggttgcagtgagccatgatggtgccactgtactccagcctgggtggtagagtgagatcctgtctcagaaaagaaaaaaaaaaagaaggaaactttggctagagtatcagaatattccacaatgataagatccaaggggccccagacaggacatccacatcctgaactatacccagagacagcctgttagttggtgtatctccatcaaccttgcatgtgtacatgtgtatagttatgcatatatgtatacttatttagttaaattggggttatgccatgtaattagtagtgtgtcctgctcttttcaattaatattatcaataagttcataaagatttatccattatcttagatattaaaatctaggctgggcgtggtagcttacgcctgtaatcccagcactttaggaggccgaggcgggcggatcacgaggtcaggagatcgagaccatcctggctaacacggtgaaaccctgtctctattaaaattacaaaaaattagccgggcgtggtggcgggtgcttgtagtcccagctactcgggaggctgaggcaggagaatggcatgaacctgggaggcggagcttgcagtgagccaagattgcaccactgcactccagccggggcgacagagtgagactccatctcaaaaaacaaaacaaaacatattaaaatctaaaagatctgaaaacatttttttttgagacagggtcttgctctgtcacctaggctggagtgcagtggcaccatcatgtctcactgcagcctccacctcccgggctccagcaaccctctcgcctcagcct

SEQ ID NO: 53802 - DNA, 1178 bp, Homo sapiens
gtctcaccccaccctacccatcccctaattcctacttttctggctcaagcggaatacagttcatccctcggccctgtgaatggaaaccatcctcctgcttttcactgctcagccaccagctgaattattcagtcacgagaatttgagacagcatgtcctcttgatttttgtttcttatttttaagaagaaaagtgcattgcctgaccttttactaaataacagctttaggctctctctgctttttgctcaaactcagctcttagttcctacccttcttcttcattaagtgttggcctctccttccctctgcacccaaagcatcaacccaggagcttccttctgcatctgagatggttacaggcccactctcttacattcatcagagctttactgttgatagactttcatttctgtttgctctcttgcgcttcaataggacatggagagaggtctttacccccattttatagcagaggaaaccaaggctcagccaagggaaatgaactaagtccacatagccagtgagcatgtgtcactgcgatgtcaacccagatctcccagactctaaagcctatgattgcactgtcccttgggttccttagctctgagtatggaggcaagggtggggtggggagtgccttggcaagagcagagtgtaaatggaaaagcagtttctgaaataggcttctttccctgcccaggcattctgtactctgtcccatcaccgtcacacccatcccatccccaaacttgggatggcaatgaagaccataactttcttattctggtactttgtgaggaactggctagatcagaaaagtgagttcctactgttgagctgggcactgtgctaaggacttcaaacacatcatcccctttaacctgctcaactactctgcctggtgattattatcaactcccattttgcagatgaggtcagtgaggtgagtgtagaggtgatatctaggtacatttaataagatactaaaacattggggggaaaattaaggagtccaattcttatccttttctgaaagttgttggtgaagaggtcattagtcagccattctcatcaactagaactcaaaagctcctagaaataaagtctgatgctctcactgtatagatggggcagctgaggcccagagagaggcagtcatgtgcctaaggtcaccca

SEQ ID NO: 53803 - DNA, 1022 bp, Homo sapiens
cctcccaaagtgctgggattacaggcgtgaaccgctctgcccggccaatgctctcactaaaatctgacagtatggtgctcagtactgtgaggaaggaaaggaagagtcccagagagggaagggaaaacctgagggtatagagatttggcttttatcttgtgggtaatgcagagtcacgaaagggttttgatcaggtttggaaattagaaagatcatccccagtgcagaaaatgaatcacgggggaaagactggaggcaggaagaccaatgaggagatggctgcagatgtcaaggtgagacatggtggggcctgagctaaggcctgtcaagcaaggaagggagcacaggtgagaggccagacagctgaataagcaaaattgagccatgcgggggtgggaagaaggtggggttgagcatgaggttgaaaaatataaaccaaaacaggtttagcttgggcatctaggtggacagtggagctattcatattgatttggagcctgtggtgtggggatggggacaagaactctgaactgttgggtgattttttaagttttataaataaatagcatttttatttgttttatgaagttgcttgaaaaattgtatgaagggcagcgtggcagagggaaaatgcctagacttcagatcctacagatgtggacaattctggattagtcaaaggcagaatacgcatgtatatttaggacacctaacaaagaatgagaaatatatacatttaaaaatagtaatgttatattcctttttttttttttttttgagacagagtctcgctctgtcacccaggctggagtgcagtggctcgatcttggctcactgcaagctgcaagctccgcctcccattctcctgcctcagcctcccgagtagctgggactacaggctcccgctaccatgcctggctaattttttgtatttttttttagtggagatggggtttcaccgtgttagccaggatggtctcgatctcctgacctcgtgatctgcctgcctcagcctcccaaag

SEQ ID NO: 53804 - DNA, 2063 bp, Homo sapiens
agtagctgggattataggcatgcgccaccatgcccggctaatattttcgtatttttagtagagacgaggtttctcaatgttggtcaggctggtctagaactcccgacctcaggtgatctgcctgcctcggcctcccaaattgctggggaagtctgggcttttaatgtaaccaaccatcacccaaataatgcacttgtacctgttaggtaattttttattcctcaccatcctcccacccttcccaatctccagtgtctattattccacactccctgtgtccatgtgtacacagtatttagctcccacttataagtgaggacatgcagtatttcacttcctgtttctgagttgttataacatttattactgtttgaataaattttgttcatttatttatttattgtatttcctcccctagaatgtaaattttaggagggcaaatgagtatattctcagcatctagaaccatgtctggtacatagatgcatagagatgctcaaatatttgttgaacgaaaatgaatgagagatatatgttgtcactgggggtaaagaagaggggagagagattaaggaaagaggtttactgggactgggagactgccaaggaagtagagcctattttcattagaagctgccgcctctactctttctctttggctttcatgttcctaccctggctgaggagtaagctatagtcattacagcacccttttctttttctttctttctttttttttttttttttaagacagagtctcgttctgtcacccaggctggagtgcagtggcgtgatctcggcccgccgcaacctccgccccctgggttcaagcgattctcctgccttagcctcccaggtagctgggattacaggtgtgcgccaccacacctggctaatttttttatatttttccactcctggctaatttttttgcatttttagtagagacagggttttaccctgtccaggctggtctcgaactccagacctcaagtgatcctcctgcctcagcctccccaagtgctgggattacaggcatgagctaccgagcctggcccagcacccttttcttgctgctacaaagactagcctatgagccttttaggttttcactgtttttaccatttaacttcatgagagattccaaaactagcaaagtttcaatcatggaagtcagtggatacttgggcgtggctgacagggagcagaagggctggtgagtggtagagccaatgcaggggctgaggtctccccaagccatgcattgctcagtccatggctgtggggagacaatgccatttgtaggaatggctaaacaccacctacattctttgtggtaaggccaacttgccacacatcaggaggacaggggctgtcttaaaagacatcacctggcctgccacacctgggcaccccctacccccaagtccccactgcgagcagcagccccagacatgaagaacaacccttgccctcttctcgcaggttgctatcggctggtggactatttggaagggatccggaagaattttgatgaggctgccaaggtgttgaagtttaactgtgaagagaaccagcacagtgatagctgctacaaactgggggcctactatgtgactggaaaaggtaaggagggcctgccttttgggtccttgtcattgatagcagtgctggcctcacacctgagccccatgataagctcttgcagaagggtctcgcaggcattgggaaagtgcattgtaggaagatggagaggtaggagttcagcagagtgatggggggaagaacacagcctttcaagttaggtaaaccttagggaatgctattggcaagtagtgggaccttgagccaatcacttcgactctgtgcctcagttacatcacctgtaaattggagggaaatagtacttgctttgtagggtggtgaggattaagtaggacagcataggaaaaggcatcagcatgtgcttggcacagagtaaggggtcagtaattattgtcttccttctgtcttttctccttgtactctaattgtagttatcactggcatagtgtttacattat

SEQ ID NO: 53805 - DNA, 1005 bp, Homo sapiens
cctccttccccattcacctgcttcggtgaacccctttaggtgacaccccctgaatctcccttctccccgatgacatcctttttatcacccccagtgacagcctttttcgcattccctttgtcgcccactccttgtcctttaaccctaacccttcctttctttctcctctatcattttgccttttttcctcttatgtgatttttactttcccccctttcctccctagttttcgctgctcttccttgctcttctcacccctcttcaccattttatctccactgcccccttctctccgtgttccttctccccttcgtcctcttccatccacgtttcctcttcccttatcggatgtcctcgctcggttcgccgtcgcagctgtccccatttccttctacgggcttcaggggtctaagcaggaacaatttgaggactgttgcttcccgggagctgtagggcgggcagatagggatttataggtttgcttcttccttttcgtttttggaggcattgaagagatcctggaagcctattcacctagtgtcattgcaaaatcgaagtggtggtgtgttacagagcagtgaagtgagggccagcatgcatactgtgacctcaggagagatctagtcttttgacagaaatagctaaaaaatgttttgaattttttttattttgagcatcttttaatgtggaggtgcagttggagaagtttaaaaatacttatttacaagcttggctattattactaaaaacaaatgatttgttttcatttggaggcagagaccaagggcatttgaggactgacaatcaggttggcaggttgtgacagtctctttaaaccttctaaagagttcatttgttttgccctgtctgcctttagttgggagaaccttatatttgcaaattttctttctgtctgaaaataggttgaggcttcagttggttttttcattgagttgggttataagtggtttgctgtacatttattgaaaacattgctccatcata

SEQ ID NO: 53806 - DNA, 2702 bp, Homo sapiens
tgcctgtatttccaggctgaggcacaagaatcgcttgaacccaggaggcggaggctgcagtgagtcgagattgcgccactgtactctggcctgggcaacagggcaagactctgtctaaaaaaaaaaaaaaagcataggaaatgcataaaaatataacaacacttacctgtgattttgggtcaaagataaggtagttatgattgtttttatttttttaatacaggttgtacatgtcttgaggttagaaaaatcaagctagctatttattgattgaatgtgtaggccttgcactgtagacgtaacatcagtatagaggttatttatcaagctgtagcatgttagtgatcaataacaaaacagctaaaaaaaaatggctcctagaagtcatttttttgtggaataattttcaagtgttttaagaaaagctatttctcctgttttgtgtgtgtttttttttctttttcagcttcaaggtattgcagcatgctgattgaagaaggaggattgcagcatttatacaacatcaaagatcatgaacatactgatccccatgtccaacagattgctgtggccattctggatagcttagaaaaacacattgtgcgccatgggaggccacctccctgtaaaaaacagccccaagccagactaaattgatagccataagtattggatagttgaatcacaggaatcctttttgtgattggtccatttggaatatcttaccctccctgatgttttgggggtttctatgacaagagtcataaaatcagtttgggattgataatgtgtagtactgcccatgtgaacagtctctaatttgtcttgtgattttaaacttatgagtcaagaagggtctcttcctttatcattgccttttaggaaattttccacatctttcagtgtttgaacttacttgtgcttgagattctacagttttatggtaaagtttgcacgaacccttaggccagacttttctgatctcagagtcccttccaatcaatttgcagcttcacataagctgttgacctgatttctgacactgcttcagttgtaaattttatactgcttctgtataaaatgcctttcttctctatctgtgtatattttataagatgtccttcttagtgtgaaagaagggaaatgtggatcatcttgtggaagctaatcactggcaggagcctggatggctggcggaaagatatatgagaaagaaaaattatgaaggtagaacagagtgtaggaactgggaattggtttcatggtataggttttaaaatgagacaggctacccttcgggagtccacctctcttgaggcggtgagcagaagcttgtcctccatatttatacctagaagtgtggactgctggttcctgcacagactgccggttattcactaggaatatttccccaagcaccacagtataaaatactacagcactctgtgttaaagactaactgtctacatctccatatgttgtagtgttgtgaaaatgtgattttaaaaaattatcgccagttaaaactggctattcttttcctctatttcaaagtcatttttgttcagtggaatagagacagcaacatggtgttaacctctcaattaaaatacaattgacaccagtaaattttgccataaaaagttaaaatctcttgttcaaaatatgtgtatcttcttaatgtgttcatgttagagaaagtgtccccatctcactgccaaaaatgaaagaaaataattaaactctttaaatgattaaatgtaatgattctactcgcagtgcataacagcacatatttttgacagattattttttaggcaattacctttccttaaggtatctgatacagtatagtaaagaatcacttatatcagtaatagcacttgagagatagcaagtcaccaagaaacttaattttcatttaaaattttattttgtgaataaggtcaatctacaatcccagataactacattttttttcatagatggccagtgttttcaacagagatttaaaatggaatattaaaattatagtgattattcagaagcattttaatttagaaaggagctggtttgttagttcactgatgacattttttgacaaacattttataccattatcacaataatcagacttgaattttttttggagttccttcatgtgaatgaaaactgagttaaaagaaagtaggcatttaggtctggatgcagtggctcatgcttgtaatcccagcactttgggaagctgaagcaggaggattgcttgagcccagaagttcaagactagcctgggcaacatagtgagactcggtctctaccaaaaaaaaaaattttttttttttaaattagctgggtgtggtggcacctgggaaacagagcgagacgctgactcaaataaatatctaaatagatatttagaatcactgaaaaccatattaaatgctgggttaatgctgacttaattggcttaaggaatttttataggcgtaagataaattttcacagactaagtttatttcagacaaaatagagaattcttttaaaagttttttttttttttttcctttttcgaatgttaatgtctaagacaaagttcagaaaacgagatggcctgtggtagtttggaaattgctagatatgttgaccgtttccaggtcttttatctagtgtagttaagggaaagcctatttaagaagtttggc

SEQ ID NO: 53807 - DNA, 1022 bp, Homo sapiens
tcatgactctaaagtaaagctcttttggatagcacagcctaactttacagctagacagaatggccattaagaatatttccaaaatccaagtttatcaaaattattttgtgggaaatcatcaatctattttattaatgttatgtgtttaattttggacttattttgggaaaaactgttcaaattgggtccttttaagcttattttaagcagcctagaaggaagaagctacttagctaatgaaagctgagacactttattaaaagcaggatcttaagagcattgtttttccttaaaaactttatactctcagataatctgcaacaacaaaaattaagaaatccctgacttttgtagaattcccactgtcaaattctcactgacttatgagtgtgagagaagttatcttttgtttgaattctgatagaacagtttaactcctttctaaggatataaaaaattcattggaaagtgtgtatatttcaaagactctcaattatctggactgaaggcactgttctcactatggccagatgaatgggagtattctgtacatgaatcatgctgtattttaaatcaggacatcacttaagtattaatgttgtgtgtacagatttttgttttgggattttttttgcctaaataaatgttataaattttatgtaaagtgtgtcttgtctacttttattctagacatttggctttaaaagttaatattaatgcaaacttcaaattccttagtgatccacttgtaatgattgctttctgaaaaaggctacttttactggagaagtttttatttttattttattttttgagacagggtcttactctgtcactcaggctggagtgcaatggcatgatcgtggtgcatgccaccacactaggctaattttttaattttttgtagagacaggggtctccctatgttgctcaggctggtctggaactcttgtcctcaaactatcctcgcttcagcctcctaaagtgctggaattataggtgtgagccaccacgcccagcct

SEQ ID NO: 53808 - DNA, 1039 bp, Homo sapiens
gggtttagaaccgaggtttgatgcgtcttaacattgctttccttataccgcaattgattattcattagagcatctaactccctccctgtctctttggtttttaggaacttctagcaatagtaaaacaaaagactactgagaatttagatgatgtcaccttcttgtttactttgaaagcactttggaatcttacagatgggtctccagctgcctgcaagcacttcattgaaaatcaaggattgcaaatcttcatccaagtcttggaggtgggaagacaggattgagtttatatgtaaagttcttctcttcatgataaagtaacctgtatgtatatatttttttgacagaccttttcagagtcagcaatacaaagcaaagtacttggtcttttggtaaggtgaattgttttgaattaattttaattgcttaaaagcaaaacctaacacttatatagtacctactatatgctaggcagtattgtaagcaatttacatgtataaactcatttaatctttacattagccctacagagtaaatactattgtatatcagttatctattgttgtgaacaaactatagcttagtggcttaaaacagtagccatttaatttacttatgaatctgtgggtcagtagtttgagctcagctcagctgtaaagttcttctggtctgtctggtctcatgtggggtcacttatgtagctgcagtcatctggtggcttgactggggctggagggtctaagatggcctgactcttatgtctgacagttggtgctgcttaccagctggcgggctttgtgtccacaggcttctccacatggcaatctctagagggcaggccccactgtccaagcgctttttaaacctctgcttatatcaccttgctaatgtttcataggacaacacaggttatatatttaagcccagattaaaggcagtaaagtcacattgctacggggtgtatatacagggataggagaagttgtgttatttttgtattctaccatacactgttatccacgtttcatagagaatctga

SEQ ID NO: 53809 - DNA, 1042 bp, Homo sapiens
ctagtgtaacatataaaataaaatactgcctgactttcattgttgttgttaaaagataacgtaacattgagcaggccttcagtaatgttaagtatttgaattaggccttgatttgtattctagttcatccagttattagcagtatgaacttgacaagtttgtcttgcttagtgtcacatttctttgtagtagtattttaaagattaaatgagataaggtagataaaaagacaattttatttatctagtactgtgcctggcacttagtaagtacttatttagtgattgttgttaatgatcatcctcatcaagggagttggattgtgggttttaggctagcttgaggcggaggcgggtataagaataagagttctgaatttatctgacctgagaagcaggaaagggaaaaaagccaattcctgattctcccctcccttcttgtctctggggttctctgctccatctgacctgtagaacaacatagcagaagtcagagagctctcttccaagctggtgaccgaagatgtgctgaagcatatcaacagtttactctgtagcagggaaatggaagtcagctattttgctgcaggtatcatagcccacctgacatctgacagacagctttggatatcccgtgacttccagaggcgtactcttctccaagatctggtacaggaaccacattcttatttataaaatccagagtaatctctaattacagaaaatgtagtttcctaaatcataataatatgattgtagaaagtgggaaaaatagagaaaaacttattactaacccatatctttccatccaaaactatctctgttaacattttgttgcatatgacttacttcggtcctctttctcatcagctttttttttttaaaactatttactttattgatgtttctttttttttttttgagacagggtctgtctcccagggtggagcacagtggcacaattcacagcacactgcagcctcaacctcggaggcttaggtggtcctcccacctcaacctcccaagtagctgagactataggt

SEQ ID NO: 53810 - DNA, 1011 bp, Homo sapiens
ctagtgaacaggtcccactcccatgacaagctcccaaagggaaaaaattgtccaaggctagagaaaagtaacttgcatagctgttccaacacaagctcccaggccttcccagagtccacggtttgagtcttcaaaattgctgctgaaaggctgcagaatgagtccaacttgacttgggattacagctatcatacaaatccaaccttttgtaacatatataaaatcaacaatcaaaggccaatgagacagccaactcacaaactccaatgacaactgatgtgcaattactgccagggcagaacacctgacattgaggaagagcacacacctctgaaattccttaggttcagaagggcatttgacacagagtgggcctctgataattcatgaaatgcattctgaagtcatccagaatggaggctgcaatctgctgtgctttgggggttgcctcactgtgctcctggatatcacacaaaagctgcaatccttcttcttcaactaacattttgcagtatttgctggctgaaagaaaatcaagcagagacactccatggacaactggcattttaaatactcccatgtcaccacattcaccttgctgaagaaacaatacaaaggtttaagctctttggcctaggaattaacagataaaatgagtcaattctaaagcagttcttcaaaacttgcttggcttgtatgaggtaacagatgctcattttagtatgtttacttccagacaactctatgcttcaaacatctttttctttttttttttgagacagagttttgctcttgttgcccaggctggagtgcagtggcgcaatctcggttcactgcaacctccacctcccgggctcaagcaattctcctgcctccgcctcccaagtagctgggattacaggcatgccccaccacgcccggctaatttttttgtatttttagtagagacggagtttcaccgtgttagccaggatggtctcgatctcctgacctcatgatccgcccgcctcg

SEQ ID NO: 53811 - DNA, 1006 bp, Homo sapiens
gtgaaccgagattgcgccactgcactccagcctgggcaacaagagcaaaactctgtctcaaaaaaaaaaagaaaaagatgtttgaagcatagagttgtctggaagtaaacatactaaaatgagcatctgttacctcatacaagccaagcaagttttgaagaactgctttagaattgactcattttatctgttaattcctaggccaaagagcttaaacctttgtattgtttcttcagcaaggtgaatgtggtgacatgggagtatttaaaatgccagttgtccatggagtgtctctgcttgattttctttcagccagcaaatactgcaaaatgttagttgaagaagaaggattgcagcttttgtgtgatatccaggagcacagtgaggcaacccccaaagcacagcagattgcagcctccattctggatgacttcagaatgcatttcatgaattatcagaggcccactctgtgtcaaatgcccttctgaacctaaggaatttcagaggtgtgtgctcttcctcaatgtcaggtgttctgccctggcagtaattgcacatcagttgtcattggagtttgtgagttggctgtctcattggcctttgattgttgattttatatatgttacaaaaggttggatttgtatgatagctgtaatcccaagtcaagttggactcattctgcagcctttcagcagcaattttgaagactcaaaccgtggactctgggaaggcctgggagcttgtgttggaacagctatgcaagttacttttctctagccttggacaattttttccctttgggagcttgtcatgggagtgggacctgttcactagaagagaaaggaaacctacagggagactttgatatttatattaaatttcctttgttgttatcgtcatgtgaagctatgagaaaagcttgggaagcatatgcttcaaaatgtagtgtttagaaggcagaacccctgttggagagcggggaaaagaatttatttatttatttatt

SEQ ID NO: 53812 - DNA, 1588 bp, Homo sapiens
caaaagtgtttcacagtgatgatttcgtttggtcctcacgaaaacactgtaagttaacaattaaaacatatttattgaatatgaagtgtttttattttgctaaatcttcacaagttttgttttgtaggtgaggaagctgaggcccagagcatttaaacaatttgtccacggttatacagcaagtaactggcagagactgggatctgcagtctgacccctgacacatgttcaaccgatgtcagagtttatttattacctctgttgttcacaggaagaaactaggggtatcttaaaatcttctgacatctctaatgagtgcctgataactgagagaggtcaggggctgagagccaatgataccaagactcagagagatctaatttaattctttatcattcaagtagagagacaggcattttccaaagcaaacccaaccctcgtgattatttctagccagggtgaagctaaggaaggtagcagtaggtggtaggatcagcaccttggttccaggcatcacgccagtcattttatttccatcatcatccttgtgaagaaatggaagtctggagaggtgaaatgatgaaggcaatctggccacaaatcttccttctggatcctgctcttcagggcatgcatctcccatgctgaaggttaaaatgggggtcatttgccaacaaatttgggagtccgcttctccctgaaggctgccatgccctctagccggtcccgggttggaatattctgcaacaaggtacaaaatattagttttgggggagcagggccacaggcccaaaaagagttgcttaagcttgtccagcccaagacaaggccagggtccaagtgtttccattgtctctggactctgatcttgaggcatgcaaaggtataagcctccgtggctgctttgtctcctggggaagacaggccagcctttgtattctctgtgccccatcagcattagcctccacttgcacactgctttcatgcctcctgagaactcagctgccgtctgcagtggtctgacatgaggctgctcagtagagaaaaaaattctttgcagtaagaaatctggctttgaatccaggttcacactagtttctccaagtcccaggaccccttaggagtattttggatatctgttaacgtggagattagcattttttactcacccatgagtaagagatttaataggtcagtcccaagtgtacagcccctacattgaacacagcctgcaggctacaaccaagcccttgacctcccaactccatcctgaactttacagtggcatctgatacagaggcaaaagatgtggttcttcctcttaaggacctgtgttctgtgattctcggcattaagtgggcaggatgaaccccagtacattagatggttgagggaaaagtcccagagagaagcactatggctctcctcaagccactccaggtgacttatgagggacgatggatgcggtcagactgtttgtgttgagaagaaccttctaaaattggtcatgtaccatacaaagtccctctagcctggcccagcctatgttaacaagcaggcatgggctggttgctacatacctgggcat

SEQ ID NO: 53813 - DNA, 1478 bp, Homo sapiens
cagtgagccatgtttacaccactgtacaccagcctgggtgacagagttgagaccctgtctaaaaaaaaaaaaaaaacagcaaaactctcccccgccaaaaataaaaaaaaaaaagatgaatatggagggagttgtaaaattaaagaaggtacatgggtgcatgtgtgcttgtgtgtgtgtgtgtctgtctgtctaacaacagcagaagcaggcaagggctactgtggtagtcactgttgttcctctccccattttgcttcacagtttacaagtccttccactttctctctgaggcagaaagagcaagggtttttctctccattttatggttgggaaaattgaggcctgcctgagtgtgtgacttgtggcaagtcactctggtcatctagggcagaggctccccagatcccaggcctcctgcctccagtccccagcccgcagcccaggattaggcagagccagctgctttcccgtggctgccctgactccttacagggatcactgagattctgatgaacagaccttctgcccgcaatgccttggggaatgtcttcgtcagtgaggtaagaaagggcgggcgccagggtgggctggggatgggctggcactatctaactgggtgtcctctgtagctgctggaaactctggcccagctgcgggaggaccggcaagtgcgtgtcctgctcttcagaagtggagtgaagggcgtgttctgtgcaggtaggttctctctcctgcccccatctgtgctctgcagggtgcccaccagcctccaggggttgggggaaaccttagatcagcttcagcatgggactcattgttgccattttaccgatgtgaatgcagagactcagggaggaaaattcccttgcctaggatcacatagctagtaaggggtaggatagactttagtttgaacttggcctctctaacccttagatcttagttatttcggctatgccatgctttgttctgacccttcacgggggaaataagaaaatggagtccaagacgggtacagtggctcacatctgtaattccagcactttgggaggctggggcgggtagatcacttgaggcccgagttcgagaccagcctggccaacatggtgaaaccccttctctactaaaaaatacaaaaattagctgggtatggtggcaggcacctgtagtcccagctactcaggaggctgaggcaggagaattgcttgaacccgggaggcggaggttgcagtgagctgagattgcagctctagaattcctgggctagttcctgcccctctcggagcttcagtttccgcatctctcacagaagggctggaactgatcaaagatttccaaaggctctcccagctctgacttcctgtagtctaggactggaagagtctatttactctctactcctgctcacccctgcatctggcctttgaggaccccaccacggtcactcttcccgccaaggcgcttgcccacctgca

SEQ ID NO: 53814 - DNA, 1050 bp, Homo sapiens
aagtgaggcgcaaatgggaggtgaagcagtgaggttcgcaagtgtagacacgctcaagggactcattaaatgtcatttcatttaaaaaatgaaattgagcatatgtgcaagcaaggttcacacaccccatttaatcttcacaccaccacggggtagtcactattatccccattttacaggattaaaacactgacgctgggaggttgacagagttacaccaaatcacacagaggagctgggcttcccccgacctcctccgctcaagtctccctgtccccgggaggtgcggaaggaggcaacagacgcttggcccataggtggagcaattggcgaaggcttcgcccgacgccggaactgcgagctctcagcgggagccgagacggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaaggtaaatgtgcagttccggggcggcgcatgacgcgactgggactaggccggaggcagcgggggaccggcaggtgggccgctcagtgcgttgaaggattcgatccccagtccctccctcccagttctaggcgccccaaaccgctccaggcctgagaggtgggcggccgccttagtggctccagactctagctgggggcggggggcctctggcaacctcggtctcttcaaaggccctttggggtcttccgactgtgtggaagggggagcggggtccgcacgggtaggactgggccccgcggcccccaggccaggagcgtttaagtgcgcgttcccctcccccgccaagggtcctggcccggttcgggggcggaggcagcggagccagtcccagtgcccagtgcggcagcgggcagagtgaggagggtgcctctccagccgcgcgcccgccctgggccgctagcgaacctttgcgtccttctggctccagggaaaagttcgctgtttc

SEQ ID NO: 53815 - DNA, 1050 bp, Homo sapiens
ttgatttagacattgtatccatgtgtgagatcctgcccatccccgctttcttggtgtcctgtgagtttaaattcatgaattcactctcaactgccaccgctaacaggacacaggccaattccaacacgaaccccaacggctctcctcagggtcacctttcatgagtccgctttccggccaacccctcctctcagtcttaggccccactgcaagcctactcccgctcaccgtacagaacctaagcacaggatcagagatggggacaggttgactcagtcccatgcccaagtccgcaaattagggattcggctgcctaagggctagagaacgctccccgccccacaggacgcgccccaccccgccccctcctcctgcccctacgcacgcgcactctcacgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaaggtaaaccgagcagcggccctgctggccctctgaggctcgggggcggtcggtgcctgggtttctctgtccctccggtctcctagcttcgactgctccgcgcgtgggtcatcggcgtggcgacttggtggcttgtactctgcggaatctctggggtcatagcgtctcgggctggttcctgcggccttctgcttcctccttcccttttcttctggtcagagttcatgaagcagccccgagataatccaaggatctcacctctttagattctgagcggagtcccgaggtgtgtgggctggcttgccccggagggaggcaggtcgcgaatgccgcctgctcggccctcccaggaacagcccccacaggagccctcacagagacagctccagatgtggatggcgaggagaaacgctcctgatgcccagcgcctcggcccgagtggcagattccggcctccctctgtccctc

SEQ ID NO: 53816 - DNA, 1062 bp, Homo sapiens
tgatagcatccttaagctctctttcttgttccatagacagagtcacctcttgatcttttctttgtaagatgagcacattagtgctatctgctcccagtaatgacagtctttctcattttaccctctagatgtgcagtggagctacagggatgaataagacaagggacaaggaccttgtcattaaggagctgtaagactcttcagatttaatgtagatagatgtgaagttataacagaaagtgttaagtaccaaaaaggagatacggaaaagtgatgcagtagcttagaggaaaaaatgattacttctgaaagtagagatgtgacatgatttgatgaaggatttgtcatttgaattgagcatagactatatagaggtagtttactttgagaaaactctaaacttaattttcactctcctaaaacaaatacttaaagcactttttgataaaaacctttcgtttttataggcaagaaggctttagctgatgcacagatcccttattcagcagtggaccaggcatgtgttggctatgtttttggtatgtattaaactgtgtattctaaaatttttttacctaaatctagcagcaactatacaaacaatgcggaggcatttgtgaattttaaccctcaaaaactcagaattcattcaattatatttgtattgaagaaaaaagaaaaaaatctcagaattcaaagtctgatttaagggaattaccactatttaaagatttcccttgtgtgtcaacctagtgtaatttttcttttggtgactattccaaattatactgtaaagatcttctttggcctttttaaaaatatggccaggcactgtggctcacgcctataatcccagcactttgggaggccgaggcaggcggatcacgaggtcaggagatcgagaccatctggctaatacggtgaaacccttcctctactaaaaatacaaaaaatgcgcctgtagtcccagctactcaggagggagaggcaggagaatctcttgaacccaggaggcagaggttgtagtgagccgagattgtgccactgcactccagcctgggc

SEQ ID NO: 53817 - DNA, 1040 bp, Homo sapiens
gtaaagtatttcattaataatttttttttttttttgagacagagtctcgctttgtcacccaggctggagtgcaatggtgtgatctcggctcattgcaacttctgcctcctgggttcaagcagttcttgtgcctcagcctcccgagtattacaggtgtgcatgctaccatgcccagctaatttttgtaattttagtagagacagggtttcaccatgttgcgcgggctgttctcaaactcctggcttcaagtgatccacccgcctcagcctcccaaagtgctggggttgcaagcatgagccacctggctcactgataatttttttatgttgattacatgttgaatgaaaatattttatatatatataaaatgtatatattaaataaaatatatactagaaaatttaaaagtattgtgtgggcattatatttctgttagacaatatttatttagataattaatgtaattattgatacagtaggatttaggttggtcatttaattatctgttttctatttgtcccctgtaatttttgttcctctgtgcccctcctcttgacttcttttgcattatttaaatatttttagtatgccatttcaacttatcgattgtttttttcaccatatctctttgttttttcttctttgtttatcccagtggttgctatagagcatggtttatcaaccttggcactattgacatttgagctctatcattcttgtgatacagcttgtgcatggtaggatattcagcaatatccctgcctcttacctactaaatgccagtagcaccaccccccacagttgtaacaaccataaaatgtcttcaaatattgtcaaatgtcttctggggggtaaaatctctcccagttggcagggcgcggtggctcaggcctataatcccagcactttgggaggccaaggcgggcagataacgaggtcaggagatcgagaccatcctggctaacacggtgaaaccccctctctactaaaaatacaaaaaattagccgggcatggtgttgggcacctgtagtcccaacta

SEQ ID NO: 53818 - DNA, 1024 bp, Homo sapiens
agcagttagaatgaggaatttataaaactagttaaatgtcacttgtatgtgacaactttttaaattttatagactagagttaccggagacagatttttgtttttttgagacagagtctccctctgtcatctaggctggagcgcagtagcacattctcagctcactgcaacttccacctcctgggttcatgcaattcttgtgcctaagcctcctgagtagctgggattacaggtgcatgccaccatgcctggctaatttttgtatttttagtagagacggagttttgccatgttgtccaggctggtcttgaactcctgaactcaagtgatctgcctgcctcggcctcccaaagtgctgggattacagacatgagccaccatgccatgccatcagagacagttttgatcagtgggaagagtaccttaatcaactttttgatcacactactggctttgagcatattaatttagccttttccttatttagaaaatactgaaaatatgtactttagggatcagaaaataacaaattaaaaatatctgccacacattgtagttgctcaataaacttttggttttttatttcccagtgcattttcctttcttctttcctatttctctagttgtgtcactggttaaaggtcaaaaatagttttatcttagtttaatttaattcaattttatagagacagggttttgctatgttgcccaggctggtctcagactcctggagtcaagcagtctgcccacctcagcctccagtagtgctgggattacaggtgtgagccactgtgcccagcctgaaaatggttttatttattaattataaatattacttaggggtataggaaaaaaatgaacttaaatttttagtacagtatggggaacatatccaactcattgaagcctacagcttggccaaagaggatcttatcatatctcccaccatacctctatgaggtttctttgtttgtcttccaactctcaactctgtgggctgtatttctatgtgtgatggacccatg

SEQ ID NO: 53819 - DNA, 1052 bp, Homo sapiens
ataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggcctctcttgtttttactgtgtatgttcttgctcagggctctctagataatgcagaataaagagaaacgttgggggatttataaactgaatgttatctggacataatcactagtttttgattggggaggcagtgtggtataatagaaagagcacttgactgggagccaagagacttgcttctcttaggcagataactgcctgcctggacctgtttgctaaactattaggagatttaagtagatgatcccaaaggtcccttctgctcagaatcctgtgagtttcctcagagcacagtagaatggtttgggaattacccaggccccacctttctgttgtttactcattacttcacccataggtggtcagaggtagacaaccagctggtatcatttgtttaggtgtttggagcccttg

SEQ ID NO: 53820 - DNA, 1003 bp, Homo sapiens
cacctggtgggaattatttttttggtggacaaggctcatcaatggaaagccaactctgtatttttgtgctttttgttagtgattttgctgttgaaatggccacaggtatagtgctaaagtgctttctaatgttcctacgtatgagaaagctatgatgccccttacagagagaatacgtgttagataagctttattcaggcatgagctatagtgctgctggctgtgagttcatgaatcaacaatatatattaaataagttatctttaaacagaaacacataaagctagattattgattggttgatgaaaatgtgaccagaggctcataggaacctaaccctgtatttccccggggagtattcattcagtattccctaattcagtgtttgtggtggctttactgcacctaactaccatgaagaacaagaaatagtctgtattactggacatattactaccctgcagatagaaaagccttgtgctcaagccttgaaggaaggacaaaaacttcatttcatttgctcagcacctaataacagcagctagcatctactgagctcttacatgtgccaggcactcactatgctgagtgcttttattttattttatgtattttttgagacaatctcactctgtcgcccaggctggagtgcagtggtgcaatgtcagctcactgcaacctctgcctcctgggctcaagtgatcctcctacctcagcctcccaagtagctgggattacaggcgcctgccaccattcctggctattttttgtatttttagtagagaccgggtttcaccttgttggccaggatggtctcggacccctgacctgaaatgatccacctgccttggcctcccaaagtgctgggattacaggcatgagccaccacgcccggctgctgagtgcttttaaatgtgttacctcatttgattctttcaacattcaatatgaactccattgtcctttttttgtttttgttttttttaaatagaagacaggactc

SEQ ID NO: 53821 - DNA, 1050 bp, Homo sapiens
tccatgtctgctgtctacagaaagcttcatagggagcaggtgcccaaggcaggcttcctctaagaaggggatgagttcttcctgggtctcatactaggcctccaggggcagtaagtgcccatttggcaggaaggagaggggccatggggtcatcctgagagctcatttgggcctgcctcctcaacacacttcctttctaggctgaagacaatgagaacttcaagacaatagtggagtttgagtgccggggccttgaaccagttgatttccagccgcaggtgtgtgtgtatctttctggggaatctttgtctttggggaggggatgtatgaagtgacagccagaactgtgctacctacagataccatggactagacattctcctttctagcggtagtaataattgtcccttaagtggctgctgtatgcttgggcacccatgccatcatttttacatgttaccacatttaattcttatggtaaccctatgaatttattcatcctgttcttcagatgaggaaggaactgaagagattttgcaacttgctcagggtcacacagtaagcagtggagctatagtttcaacccagatctatctgacttgagctggtgctcatccccctttatttgtgcatgtttcacctcacaacaaatctgtgaggtaggcagaagagcaaatacttcatccccgttttatcaataactaaggtccaacctgggaaatgacatgcccaggagccttcagcaaaccagggctagtggaagggattacgctgcccctgctgccttctggtccaaggctgtaattcagagaaaccaccactctagttctgaggcagctgccgggtcctggaagctcagcagttattccaagacaggtactcatactgcatctctgtcctccatcccagaagtgtgagaagagccagcagcctggccggcccttacttatagcccaatgccttcttttgccaagactaactggtaccttcttgtgccctgcaggctgggtttgctgctgaaggtgtggagtcagggacagccttcagtga

SEQ ID NO: 53822 - DNA, 1462 bp, Homo sapiens
ccccaaagatgaaatgtggcaactgtggtgagatttcggacaagtggcagtacatccggctgatggtaactgttccccgcccaacccccaacataaacactcacaaacacacatacacttctgggcagggatttggggaaactggccttcatctctccagttctttgctccctgctttttgtggtttgggagggtaggtgtcagtgtgatcagcactggattcaataggcatctttgaggtatgaggcagagttcaaaatcaaggggaagccctttttttattttcctcaggaagccttcccaggagtcttgtcctagtaagttaccctttctgggtcttggtctctttaagtggacaataaatggtgggctcgatctcctcaggactgtacatctaattcatatgtgactgaaagttctgtttgctttttgccaggacagtgtggcactgaaggggggccgtggcagtgcttccatggtccagaagtgcaagctgtgtgcaagagaaaattccatcggtaggtcaggctgtgcgtactgagttctgccagggtggcccacagcttcctggcaccaggctgaaagtagactcatgttacctgagggtggagtcaggcctaagatgccgacacctgtacagcgtgatctttttcagggccacatgtgggcacctggctggggcgagggtatggactcaagtcaactttgtgttctcttttctatttcagagattttaagcagcaccatcaagccttacaatgtaagtttgctgctgtagtggcagggatggtgggcttaaatcctaactggagttagtaggtctgggttctagagtcatgcctgcatcagagtgacctgccataggacattcactcatgaacttagttcttctttgactcagtcatttatccactgtacactgagtgcttggtatattgcctcttgcagtgccttcttatgagggctgggctgtgagagctcaggggacctctgacacaacctagctgttcagtttgcatcactgagagcacttgccttgtcttcattttaggggactagcaagctttctctgaaaccatgggtggggtagtcgtttggtgcatcccatcctttatatcatcagtgttaacaagttagcccaaaggtgagggagggtgtgctttggatctgtttgtttaaagaaagccagttatatgtattcacctattccttatttggtatttatttaaagtatcttgagttgtgccaaattcttggctttgtcctgaagttaaagagaaattaaatgaggactcgccttcacgtacataataatctagtggaaaatacaaaaaacaagaatcgaactagggccctaacagagaagtgccttaccagtgccagagatgtggtcagtgtgcaggaaattactttacagtgaatgacaggatgagactgaatgtagggcatggcacttgtggtc

SEQ ID NO: 53823 - DNA, 1071 bp, Homo sapiens
ggcggcaggctgcttttaccgtccggtcgaaactcaaactccaggaactcgtggccgaacttgcccttgtgccccacgtagtaacgcagataaaagtcactctccatggctcccaaaagacaaccgagcctgaacttccaagagcaagccgcactgccgccgtctgcgcccgacactgacgtttgcggcggcgcgcggaagtgacgtcaggtcccgtcgtcgctgcgtggaggggttccttctcgctaacctcttcgcccggaagtggcaacaagactgcaacatcccctcacgcctagtctgtaaagaactttgtttaacccggaggcggggccagccagctccgcccctccagctggacgcgggagcgaggttgaggttcatacccctgggttctctccaggcctgaggcggagagccagccgcctgcctacctctgggctttgaaccccgggtctggtgacttcgcttaaagacctcgggccgaaggcccgccaggctcaacctcggttcacaggacccccgacttgtgtgagtcgtacaccgctctttaccgtctctggacctaggtcatctcggcagtaaaatggggtgaaatgacccgacctccccggaggatgccgcgcacgatgtgtgcctcaagttggcttccactgacctgaactgttaagaaagccctcctcagtgacgccttccctgaatccacagtggagattgccgttttcctggaactaattcacccacacttacccatttcatccctttccaccttttatttctacctttctgccccactgatctctagaataggtgctgggagacgttagagtatttgatctcccactccccagtcatcccacttaccgagcagtaattctctgcctggctgcacattgcaatcacttgggaagcctctaaaaatactgatgccagggctctaccccaagccagttaaaatctccagcgctggacctgggcattggtactttttgtaaagctttcaggtgagtcagagttgaggaccactgaccaaagaggtcctttcttttcagggtaaagttgtcctctgtg

SEQ ID NO: 53824 - DNA, 1087 bp, Homo sapiens
ggatgcattgccagcactttgcagaactgatattattcagcctcaagctttccagtggccaaagggaaatgctgactgcttttcatatatttgagtcaaagattttttatatggtcaatgaagactaatataagggcagtgggattttcacagatgcatgccatgttgtcgagagcctcttagattttctcaactgtgagaaagaaaaacgaaaatgttgaagacgttgagtctggagaggggatactaatcactgtccagttgggcactggtgggaatggggaaatggcacaggaatgcaagcctctccaccctaccccccgaactccagccatacactcatcgtttcacaaaatataaatgagttagcattaaatgtttcagagtaaataattccttttcccgaaatgcatgaagatagagtaacagacttctcacactgtatttttagggtatggagaatttagaaggttaaagaattactgcttcaatttttcagttaaaaaaaaatcaggaagctctgttcattcaggctatgcaccatgtgcacagtcaagaattagcagaaaccctctgcatttacaaacactttgtgctataaaaaagtaatttttaaaaagccacgtgtgtgtgtgtgtatatatatatatatatatatatttaaagccaaggttttgatacttttttacaaaaactacaagagaaaacaaatatacctgtccaaaccatatacttttaaaagagcatttttttttccatacaagctgttgttaatttgggggtaaagtgctgatttgcaaacttcatcaaattgttcccaagtggattctccttgtttgtctccccctaccaaccccaaagttaccatatttgatgtaagaatcaggcatgttagaatgttgtgtcacactaactgattctgctctttttgtcttgtcattcaagttccgttagcttctgtacgcggtgccctttgcagtctggtgtctcttccagaggcgagggggctgaggatggggtgctgcatctcactagctatactggcatcatcttggtaaactgaaaaccaaatgtggacatttgtaaa

SEQ ID NO: 53825 - DNA, 2259 bp, Homo sapiens
aaacagaatgatgaaaaaatctacagctttggattcatacagacctgggatcaaattttagttcagccacttgctatgtgatccagaacaaaccctacttaagctcattgagttttgtttctcatctgtaaaataaataggataaatcctgtctcttaggatagtttgaacattatgtgagctaatacctgttaaagtaacgtaagtctgtgatttgtcaatactaaataaatagtaactcttatggatctaatgatgaattctttggtttgtctccccagcgagtggcattaagccttgaagatgatggactaccctgaggatgggatcacccccttcgtgcctcatggaattcagtcccatgcactacactctggatggtgtatgactggatgaatgggtttctatatatgggtctgtgtgagtgtatgtgtgtgtgtgattttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataaccaaatgggggccaatggcacagtaccttactcatcatttaaaaactatatttacagaagatgtttggttgctgggggggcttttttaggttttggggcatttgttttttgtaaataagatgattatgctttgtggctatccatcaacataagtaaaaaaaaaaaaaaaacacttcaactccctcccccatttagattatttattaacatattttaaaaatcagatgagttctataaataatttagagaagtgagagtatttatttttggcatgtttggcccaccacacagactctgtgtgtgtatgtgtgtgtttatatgtgtatgtgtgtgacagaaaaatctgtagagaagaggcacatctatggctactgttcaaatacataaagataaatttattttcacacagtccacaaggggtatatcttgtagttttcagaaaagcctttggaaatctggatcagaaaatagataccatggtttgtgcaattatgtagtaaaaaaggcaaatcttttcacctctggctattcctgagaccccaggaagtcaggaaaagcctttcagctcacccatggctgctgtgactcctaccagggctttcttggctttggcgaaggtcagtgtacagacattccatggtaccagagtgctcagaaactcaagataggatatgcctcaccctcagctactccttgttttaaagttcagctctttgagtaacttcttcaatttctttcaggacacttgggttgaattcagtaagtttcctctgaagcaccctgaagggtgccatccttacagagctaagtggagacgtttccagatcagcccaagtttactatagagactggcccaggcactgaatgtctaggacatgctgtggatgaagataaagatggtggaataggttttatcacatctcttatttctcttttccccttactctctaccatttcctttatgtggggaaacattttaaggtaataaataggttacttaccatcatatgttcatatagatgaaactaatttttggcttaagtcagaacaactggccaaaattgaagtcatatttgaggggggaaatggcatacgcaatattatattatattggatatttatgttcacacaggaatttggtttactgctttgtaaataaaaggaaaaactccgggtatatgtatagatgttcttcattatagacatcttctttgcttttcttggccttgggggaggaagggagaagtgctcttttctacttgtggggtctcccattggaaacataatcctatagtcccagaaggattcagtccccagtggctttcccatccaaagagaaagagtttgagtttcttaactctgctgttctgccacttactcccactagacaaccagggacaaggtgcaacatggaagtgtttgacttaagtaggagcagaggagctgcatctaatctcatcatacctggaacttgacacacttaagcaaatgccttcccatccctacctgccagatgcccccaactcaatgaagttggatgtctcaccagcttgataccctttgaattttcagtcagacattctggagttctagcatcctgtacctaggaccttcctctgtgtcactcttggcctcctaaactc

SEQ ID NO: 53826 - DNA, 1026 bp, Homo sapiens
aggcatgtgcaaaggcttgaaggtacaacacagcatggctttttgggggaatgaggaccacaaagtggcacagcaggtgtcactgttatacagcacagtcagggggctgagtgtgacctcagaggtcatccacagtgccatccccctgtcaggcaatcagcagctttgatcgcccactgtgggcagagccctgtcttggggagaccagagaaccggaagacccagcccctgccctcaaggagctttttgtcttgccgggggaaccaaggtcacagctgcaccaactcccgaagaaccctctttccgagctgcctgtcgtcaaatccaaggtagggcagtgccactctaagtctgaggggctggtgagtgagggcatgaaccaaggcaggcgcagccaatcctagaaggctttctggtttgggaaggctgcaaattgtaagctgggtgttggggcaaagaagaaaaatgggttagtcacagaccaatgaatggcatgtggaagaaagcaatcaagtttggggcagggcagacagaattgctgctgaggcaaactgttcatgaaggggagacatgggaaatgagatggagcaaatgaggagggttagcagatggccttgaggatccttaacctcggccagtccaaaaaaatagttgcttgaccagtttttgaagatcagagggagcacagtggaagaagcactgaacttggaataagaaaactcccagttccatccttccactgccctgtgatctcagtcacttctttctgctcactgttatttgtaaaatgagaataacaacccccattctacctgcctcctgagtttataaagtacaagtgagatagcacgtgtgagagcactttgtgacttacaaagcactctgcacatgtaaagtgacattatttccagagaaagaaatgactcagggggagttactcccgatgagtgttaaggaccaagtaataagcttctgccagttgcagagaaataaggaaatcaacatttagtgagcacctactgtgtg

SEQ ID NO: 53827 - DNA, 1050 bp, Homo sapiens
ccttttgcaatataattgggactaatagttaatacttcaaccgcatacacagattcatgtcctaatcttgatgtatagccaaggcctttcatttgagcctaagtctactgcattattaatgatttacaggttcaattgtttaaagtggaataagaatttcaatctattggtataacaatatatgagtgtaaaatccttctagatttatctgatttcccctccctacagtctttttattgctgatcttacaactaattccacagcaatgttttaatgactcatctttattgaatcaaagtgaagtgcttagcattcagctaaagaaaagatcatagcccactggggagattaggaaaggcttcacagaagtggcatttgagctacgccatgaagataagttcctaagtatatctcagaggcaataccttaggcaacaaaattatctgtccaagtgacctccatggtatttcccctccagcacctcaatctacctcaactacgacgttagcttctaccatgacgaggacagtacctgccaccacaagagcccccgggaccaccgtccacagatccacctaccagaaccacagcacagagacaccaagcctgacagctgcagtcccaagctcagttagtgtccccagggctcccagcatcagcccgtctaccctaagccctgcaaccagcaaccactcccagcactgtaaggaaatgagttctgcattctttcatgacatgggagggctcctagggaagccaggaagggggtatgtgataagacagaacctaccagagctgaatactgcatatctttgaggaggttactgcatatctgagagggaggtagagtaccagcctgcgatttaggactcataggtgcccctaccttacagagggtcttgtaggaagctgagaccctgtgagcctcagttgcttctcttacaaagtggaaataaccacccttccacaacctgcttcacaagattgccatgatagacaaaggtgtaaccggtataactggaggtgctcacgcacacagccgttgctgac

SEQ ID NO: 53828 - DNA, 1109 bp, Homo sapiens
tgcagtagtataagctaatgtatccgagggccatataataagtcagcttattggttgggaatagaatctaggaatcctactactaggttgtcccctcctctatcactaggatacattaattctaactgtaactgaagtgttggctgccagggtgaaagagggagagcaagggagtgtaaggagctaagattggtgcctgattctagacctagaaatttaaatgagagacatagtatgtggcacagggaaaaataaaaaccgcgggcttatgggctttggagcccagccgacctcaatttaagttctatctctagtccagacatggtggctcatgcctgtaatcccaacactgagaggctgaggcaggaggatcccttgagcacaggagctccaggcagcagtgggctatgattgcattactgcactccagcctgggcgacagagcaagacccctacctcttaaaaaaaaaaaaaattcctagagtataggtttgacgaatttgttctctttgagcctaggtgtctttatttgtcagtctgggatgtaacgtccccacctctcagaattgttgcaaggattaaatgagagtgtagggataaaacactaggtatggtgctggaaagtacccaataaaagtagtagggaggccaggcatggtggcttatacctgcaattccagcactttgggaggccaacgcaggaggatcacttgagcccaggagtttgggaccagcctgggcaagaaggcaagactctatcactacaaaaactataaaaatgacccttgtatggtggcatgcgcctatagttccagctactcgggaggccgaggtgggaggatttcttaagcccaggagtttgaggctgcagtgagctatgattgcactgctgcacttagtctaggcaacagagtgagaccctgtctcaaaacataaaacataaaaaaaattgaaaaagtagaagggcttcacaattgcagagatgtggaaccaacctaagtgtccatcaactaatgagtgaataaagaaagtgtggcatatatacaccttggaatactactcagccataaaaaggaacaaaataatgtattttgcagcaacttggatgg

SEQ ID NO: 53829 - DNA, 1262 bp, Homo sapiens
ctgagccacccttttgggatagctgtgtttgaggtgagtcctgtaaggagaggcaagggcccactaggaagctgaagcctagaaaatgcttgttcaaataggatgagtccctgagacttgttcaaatgaaaacaggaacagggaaaccaactgatttgtttgtaaacaatctgtgagctgcctgcacacaaaggctctgcagcccactctccacctggcagcctttcccacgctctcttcccaagacccctctcccagagcacttctcacaggtgagctgctaggcatgtatgtttcctctctgtgccctcagcacccagcactgtaacccatatacaaaaggcacccagtaaagggaggaaaggaagaaggaacatacatatccttagaatcatttactggaggaaatggcctgagagatgctgttcaattctgcacacttttattgacctctgccagaccctggggtcatagaagtgaatcagacactatcctagtctcaagaagctcccagcaaagtgaggagcgaagaccctcctgtgccctgaccctaatgacttttcttctccgggaatgaagaagccagaaccaaccaaggtctcacaccttcacctcttcccgaaaactaactccaccaccaaggggagggaaagcaaagggatgatggtctgtggtgggcattggcaggatttgcttgcagcaaagttactcagcactgctctgaagttgtgggcaaagctccacctctaagtccagcccctgctttaaaggacaggtgtgttggtacacaagtgtttgtgcttgtttatatacatggcatgtacatgtaaagtatgtgtatgtgcatgggtaaatataaatgcatcagaataaaagtgtgcattcctctaagtgctggtgcttatgtgtgtacatacatataccaagatgtatatagactgcatatttaggggcaaatgtagctttttgtgtgtggatgaacatttgggtatgtgtttagatctgtgtatgaggatgcacagttgtacctgtacgtgtggatttgctgacagatgcacatctaggcttatatggactaaccatgtggactcgtgtggatacccagaggctacaggaagcccagcaaggcataaccctcatagctcacacattccttccaatcttggtcccaggccccagtaatgataatgctatagagatttaaccttgggtttctgctgggctctagcaagcaggcttagttcagcatgaatgagtaatgt

SEQ ID NO: 53830 - DNA, 1337 bp, Homo sapiens
tcacacactggaggaggttctctcctaggactttctcagatgccagcacctgccccactgcatgtctgggccctcttcaggcagtcatgtcctttctttgtcctgagatccacttggcaggaatgccgatgaccaggcgctgggtagacactgagtcactgatgaaagaatgatgggacagatgggtggaagagtggatggaagcaaatatagcaagtgctactcactgacaactagattcctgcctccctgcaacatacagacactccgttcacacacacccaaaaacataactagaacaatgcctgtccaagagatgtaactgaaagaggcaggatttggtgacagactagatatggggctgatggaagaaatttactccttcatagtgaattttgggagtttcaggtttttggcttgggaggtttcatgaatggtggtgctgttctctgatgtgtgaagcagtagaggaggatcagggctcagggtttgggccgtctggttggccgaggggaagggaatggggatgaacagttttggacatattgagttcaaggtgtccatgggacatccaaggggagctagttagctttgcagtctggatcgtaagagagctgttgggattggagacttagttattgatggcagtggacactaaggaactaatcacccagagagagggcaagaagaagaaaacctctggggaaacagcatttgctattttgctaatgttgcctcctgagtgtctactgtattcttagcccttctttccattctcactggcacggtcattcttcagactctcttaatctcccacccagatgctgtaacgtcctcctaaccagtttccctgcttcattccctctccttccaacccatccactccatagatgccacagtgaactaacatgcttattggactatatcctctggcctgtctagttatcactggggagaaatcctaattccttggcgtggtactcaaagcccatcaagatggggttcctgcctacacctgcttgcagtctgacacccacataagcagctcccctaagtatctcactgttccagagcagactcacctctggccatttgcacaagcctttcttgttccctaatggctttctgtcctggtgacttcatgctcctggtgaactcgtccttcaggactcaactataaagccttctcccgccctctcggatgaggcagtctccatgcctctgctgccatagcctctaatgctttccataatcacattgtattatatctggctcaccctaatgggcagagctgtggagcagccccaccttagaaagccagagaccgtggcccatgt

SEQ ID NO: 53831 - DNA, 1051 bp, Homo sapiens
gggaagtccaggtgagcagggggttctagttttaaatggaatggtcagggaagccctcactgagaaggtatttgagtaaagaaggtgaaggggggtgggtgtggtggctcacgcttgtaatcccaacactttgggaggcctaggcaggaagatcacttgaggccaggagttcaagactagtctgggcaatgtagtaagaccctatatctaaaaaaaaatttaaaaactagccaggtatagtaccatgcacctatagtcccaagctactcaggagactgaggcaggaagatcccttgagcctgggagtttgaggtcacagtgagttatgatgccactgcactccagcctgggtgacagagtgagaccttttctaaaaaaaaaaataataataataataaataaaaagggagtgagggaggtgagacagtaagctaccatgcaattatctataggaacaagcatttcaggctgaagagacagaaaccgcaaaagccctaatgcaggagcatgcctagtatgttcaaggaatagcaaggaagctggtacagttggagcaaggaaactaggaagagatgaagccagagaggtggcttggggcagcccaaagggccttctagaccattgtaagagccagctctggatttcactctaactggggggaaaccattgagggctctgagtagggaagggacatggtgtgacattttattctgactgcagtattgagaacagactgtagaggacaagggagaaggcagggaaaccacttaagaggtcattgcaataatccagaagcgaggtgatggtggctgaacccttattcccacattattactgtgggaataatgaaaagtggacagactgcagatatagtgcaaaggccagccaacaggatttgcttatgaattgaatgtggaatgtggaaaaaaaagttacagcaactgaaaaaataagattgctacgtatgggcttgggaaagatggtgagggaagcaggtttggaggaatcttaggctgttttggacatgttatgtttaagaaaactggttagg

SEQ ID NO: 53832 - DNA, 1188 bp, Homo sapiens
ttcccagggctgggcctggctgagtcatccctgggtcccccagtcatggagttgctgtggtcttgttctttcagttccgccaacattcctgggaaacaggaggaggcccaggggtaaaggggttattccctaagcatggctcaggctggaagtgggggcaccccatagctgtgcatggcctggggtgggcagctcagaccagctatatgcatggccatggctggctcagctcagcactgcttggcttggctggagtggcagtgcatgagcctggggggcagagggggagaggggcgcggcacctctccttggcttgtggaattaaccttctgtgactctaaagctcaggagaggctgtaagagcattggtcctggattccctgacctcccctaagaccctgccagaaggtagtgagggagtggaggatggggaaccagaaccagatgacctctgggcatcccttcacctcttgcagcaggtggtaatcctggaaccgggcccatgacaagataggaggaacagggacaggtgctgagaggagaggagttaaaaaacccatcatattagttcatgataggagagaattgatttagcaatggctccatgttaaaaaaggcccaggagtcttaaataaccacaagcacattagggggggcatcctgtgttgttcaggttccttctgggtggcaaactagctctgggccctgtccagacagggacatggacagatggagtgagtccagagaaaggcacccaaatggcaggagaccagatatcagtgctttaagggagcctgtgcaccctggccaaccccacacagcagagctgggagcacaagcagaagcctcagcaggcagtgctggtccacagtggagccagctgccccaggagggaagtgggctccctgaggctggagatatttaagcaggggcattttggaagggattcttagggtatcctgagggttggatgtgacacacacaggacccttcaactctgaggtcacgaggaaggaggcgctgtgagaaacatgtttgtgaaaggaaagaccttgggccactggggaaggcctagctgcctccagcttggtggtggacagagccccagccgggaggccggggacctaagttctggttccactctaccctgtctctgtgtctggcctggagtaggaacctgccctctct

SEQ ID NO: 53833 - DNA, 1431 bp, Homo sapiens
agcacatcccagggccactgctcaggccatacctgtgtgggagtaaggcaggccttgcagcaggaggtggcaccatcctaagccctgaggagttcggacctgatggggagaccagacttggaggccagactaaagcgagacctggatggaagtggctgccctgatgtcggctacagctgtcagggtgggttccaggctagaaagaacagaggctccaggctgtaggtagggtgggcatcccagagaacatgctagaaacccagtgtggactccaggaaggttcatgagtttttttttgttttttgtttttactgttcccaggttagggcttgagggagatttgacagagaagccctgggaggacagaggctaggtcagtccctccctttcctgccttctggcagactgtttccccagcacctacctcctgggtgcttagaggaggttcatcctcctgagcttcccaggaagagcatatttccttccccttttgaagattaaaaaactgattgtgaaaggaagagtagttgagtgaaagtgactcagcttctacctgagctggcaggagatagacactccctctgcctccaggccctgccaagagaagtcccagaagaaggaacttgtggaaaaagagacagggaagccagaactactgagcctagctcccccaacacccagatttggagtagccagggactactgtcctactaatccctctcttctctctcgtcgtttgcatgacacaccaaagaggagtacgtacacacgtgcttgtgtctgtgtgtggcctctgtctctgtgttggtgagaggccggtgtctgtatccatgtcttcttctctgagtaaagcaggggaactgcattcatgcatctatgtgtgtgaccccatgtatgtgtgaatgtatctatggagtccatgggactgtttgtgctctgcacataagctggtatgtgtgcatgtagttgtgggcatgctggtgtgtgcatgtaggtgtgtgcagtgacaccacttcttccttccatggaaggaagccgcaaatactactctggcctctctgcaccactctaccccatccccctcctctcctggctccccagcggaatcacacccaggctaggtagaattaagaaggactgaagacttccctgcaggcatttggggaaaggttacagggacagacaggtgcagacctgctctcctttctcttcccctcacccacctgagccctggaggactctgtgccttccttcatcagaagccagtcactttgagttctctcctttccccttccccctttcagggccatcccacctacacatgccacttcatcaagtgctcagtaaatagaattgttgagttgttgctagctgcaaaaggagaggaaggaggcgagtggatgcatgatgggggcagtgggtgagtgggag

SEQ ID NO: 53834 - DNA, 1091 bp, Homo sapiens
ggacgaggcagccgagctctgcggccgtccgggccccggggccacgtccgcgcccgccgcctgcgccaccgcctcccagttcgcctgccgcagcggcgagtgcgtgcacctgggctggcgctgcgacggcgaccgcgactgcaaagacaaatcggacgaggccgactgccgtaagccccctccataccgcccagccccgcccagggattgcggatccgctatccgatccggatccgccaggtgcaggcttcctttcattgccttacctgaatacattacccgggtttactacagaggagaccgaggctgggagaagtgaggtgacttatttgaattcacgcagctgccgggctgcggagctcaggtctaactccagaagcctccactggtatctgtgtccctgctgtgagccctcccagtcgtacttcccacccccatcccccgaacccctccacccagaaacctggcaggctcaggagctccccccatctctttacccgctaggcctgctcattcctcaaggcctggcctagactcctctgaccttcccagctgggctgggtccctctgctgggcaggtccccagcagctttctcttatagctcatctcacactgatgtccccatctgagcattcctcacccttgctctgcaccctgagctcctagaggatgaggaggctcttaggagtctctgggctcccacccccacctccacctctcccagcacagcacctggcacaggaaggtttgccaaatggatgaagtcattaagtaatgagcaccaagactcaaaagaaggccgtgtgtctgttctgaggagtggccctggagagaggcagggacagggaaacaggagatctgggtttagtcctgaatctgccagccagagtgctgtgtgaccctgggcaaggccttccccctctctgagcttcagtctccccatctgtacactgaggtgccttggccaggtgtcctttgaggactcctgagttcagccactggttctgtttttgctgggggtggctatggcatggggattggggtggtggggaaattgtcctagcaccacactgactctgatcctctcccc

SEQ ID NO: 53835 - DNA, 1061 bp, Homo sapiens
gcctgtaatcccagcactttgggaggccgaggcaggaggatcacgaggtcaggagattgagaccatcctggctaacatggtgaaaccccacctctactaaaaatacaaaaaaaaaaaaaaaaattagccgggcgtggtggctactcaggaggctgaggcaggagaatcactggaacgcaggaggtggggttgcagtgagctgagagcacaccactgctctccagcctgggcgacagagcgagactccatctcaaaaaagaaaattaaaaaaaaaaaaaaaaaagcacttcccatcagaactcccagaaagcagtgagtccaccctccctgcacatgcacaagttgggtggggacaggcaggaagggagctcatctaggtgtcagcgtaatattgaggggcagtggcagtggcagcatgtgctttttccaccaatgccccagtgtctcaaaagcccaggaggggaaaaaaattcaactgtcagacacttggtagagctgtcagaaacgcatgacacgagctacctacctggtgaaactgaagacatcactctattttatcttcaataacaatgaaaattcacatttttccatcagaaagtgaaaacacagactctgggcgcccccacgtggaaagatctggtgctgccaccaccacctcacctttggccacagccactgcatcagtgccccaccggggcctacccccatcccggggccaggtcttggcctgtgtgtggacgcacaggagggagggaagtgaggaggtcactgccctgaaaaacagctggaaaaactccaggaagggaggagaaaaccagaaaagccaagaggaggagtcagagtaggaaagaaaagccccaaatgtgagttctggttctcttgttgtcatggactgtgtgaccctgggcaagctgctcctctctctgggcctcagtttccccatctataaactggcaatagggctggctggcctctaagttcctcccggccactgaactcagactagcctaccagagagaagcccagagccccaagcagagccatgacgtgtgtccttaatt

SEQ ID NO: 53836 - DNA, 1811 bp, Homo sapiens
caaactgaggcccagctggggcatatctcacctaagggcacacagctgggaaatggcagagaagagtgcagggcatggtggctccatgttgccagaacttaaagtggaggtttggagggatgggaggtgtggccaggaggggcaggcagaagtcaatggatcaaagggacttgagggccagggaccagggggccatgaaagatgttatgtagagaagggtcagatttaggatttgaaaattcctggcacagacagaggcttcttctcagctgatgaaactgagacatgggccagaagagccctgatggactcctagggccttggaccagatggctggaacagggtggtaggactggttggcaccatgccctgtgtcccccttggctaagctatgcatggacgtctgtctccacagccaagcaggtgtgtcctgcagagaagctgagctgtggacccaccagccacaagtgtgtacctgcctcgtggcgctgcgacggggagaaggactgcgagggtggagcggatgaggccggctgtgctacctgtgagtctggggtcagatctccagggtctgccaagcatggtcaggcagcctcagggagtggcagccacttctggggagggggcccagttccccgtggggcttggtggtggagaggaaaggataacgatcaggacactagtaatggctagattctatggagacatggtcttctttcatcttcacaagcacctcatgagcagccattatcatccccattttataggtgaggaaactgaggctcagacaagggaggaaaagtacccaaggctgagtgatgaaaccaagattcagattcaggactggacagcaaagcccatgagcttttgttaccatgtctgacatctgctcatccatcccacaagtctgccaatcttggagcaagggcagggggaccagggagggtgctgcgtggagaaatggcggtggtctgagccagggcgccagcaatgctggggggagggggacggattcctgaggtgtcaaggacgactgttgctgaaatctcagattcaagcacagacgtcacagggcagagaagacattctcagcagcctcggcagggacagatggaagtggtcactgggacagttccacatcactgagcttcaaacacaggattatctccttcccagggagcaggccagcagggcctgggccattggggagcatggccaggcctcactttttcaattcgaggggcacctactgtgtgccaggcctgaagccaggctctgaaagggacagtgaggtgaatcctacacagtcttccctctgggaacacatgattagtgggggagacagactggctgtcgctactaggctgtgcggctgggctgaaatacgggcggtcaccctggagggcttgccaggcacttgcccatcactgctgcctactcccctctgccagcctctatatttgcatcctatccatctttcctggcccagggaaaatgccatctcctccagaggtgtctgagtcgtcacactttaagattctaagtctggaatttgatgtgtctgaagcaggaagcatctgggtatggagggagatcctggctgggaacagcagtttcaaagtcccagtgatggcactggctcacttcctcagctgtgataattttgctgggactcactggccaatgagaatcctctttcctctttaccaagccccataatcagatgattcctccaatatgaaggccgctactgcaagggatgggagtctctccaactagggcatgttggaataggaacattccccattaat

SEQ ID NO: 53837 - DNA, 1036 bp, Homo sapiens
ccacagcttggctgactcctcttccttgaacacagtgcccctcctctgggaagccttccctgacccctgggccaggtcaggtggccctcgcctggcttgctggctacaaagtgggattgggagtcattacctgggttcaagtgcagccctcccacagacatgtgctgtggctttgagcagtcacttctcactaggccttggcttccaggcatgtaacatgggagacccacgtagggggcctcaagaccctggagtccaacacggcaggacattcggattgccaagaggaagctgcacagagcagtgcccctgggcagcccggactaatctttattttggagccttctctctgcaccggggctccacgatgcgtgtgggtggggagcagcatgggaaggatgtatactgtctcagggaaggatgtctctggaggcgggggaagccaagaagtgctgagtgattctaacagtttcacaggatcacagacactgagtgtggagagggccttaagacttagtcagcgccacacctccatttcctgatgaggaggaggcaagctcagaaggtttgacggatgggcccagtgttacacacacggcagctggggccagggctgtgacttcacacacctctaacttgcacctttttgcttctcagttcataaagccctggggccatccttagcttatttgcttctcacaatgaccctgtgtgtcccgtgaagcagacgaagaaagtgcggctcacaggagtcctgtaacttgtgtaaggtcacatagcctacaagtggcagggcgcagtttgatagaccatggactgtctggcactttccttggcccgtgttcttgttataaatagcatttcccacttcctttgtcctggatttcccactctcccctactctaccctggggtcagcccctcctcactgcccctagaatcccctagtcctttgtggcagcccatctgttgccatggcaccagattatgatgtcgcagaccctggttgactatgtatcactcctgggctgagggac

SEQ ID NO: 53838 - DNA, 1046 bp, Homo sapiens
caggggcgggctggcacgccccctgcccccaccccggatctgcattctgctggaagcggtcgtcttggcaacgctggggcatggcgagctctgtcgaagggtaactgttggtgggagcagccctttcatctccccgacccgggtacaagtggcccaactgccttagggccagagccaggccaccctgtgctggcccaggcctgggagaggaagtgggaacatccaagtcccttctgtgcacccagctctccaagttaggggctttacctttgctctcagcctctcaactgccctaggaggggaaagaacctgccccagcttgctgaacaacaatgttgagctggaatccacctttcttaggggtcgctgctctgccttcagagaacattctctagagcccaagacctgtccacagaaaccagagatcagtcagagcctgtaaggctgacagctccctcatctccctgtcctaggtggctgggtatcaattctctctgttctttccagggcctttctctagacgtgtccctgctctgaggattggggtctccagtggggtccctgcagcttcactctgggctccatgctctgtgaacactttgttctattttttatggcctagtggggctggcccagagacagacggctaagtacaactaccaggctgctgtgtcaacacgggctagtccctcccttctctgcacctcatctaatcatctgtaggatgagaggcttgtgccccagcagtgttttcctaggtgtggttcattggaccacttgtttcttgggaaataaacagatgtggcatctgaaaaaggagttccttggttaaacaagcttggaaggctggaggaaaccgtcaatcagatatctttactgcagtccttcccagggcctttataaaccgtgggcatcatgcatctccaagggggaaaataataagtgtctatcccaaatatcctggtgcatggccacccctgggctctgtcctgccccctacccctcccctcctctgctaagggccgattttctgtcttgcatggcct

SEQ ID NO: 53839 - DNA, 1051 bp, Homo sapiens
gtctgtgtgctgcagtgtgtgtccagcatgacatgcgtgtctgagtatgttcagtatgtggcgcacacctgagtgtgcaagtgggtggtgtgtgccttgctgtatgcacgggtgcccatctgcaagtacatgcgctgtgtgcatgtgcctgagtgtctgcacgtctgtctgaacatacctctgtgtgtggtccatgctcaggcctgcctttttggtgcagtgagccaggctgagctgtgtgcagatagggaaggggctcgtgactcctcctggctgaggtggtgggcacagacagctgtgtagaaggtgggacggggtaagtgtggcaagtgcacagctggccttcagtgggtgaggcagggcaggcatccttgccctcatttgacagatgggaaaacccaaaactggagcctgggctctggggctccctgcgtggtgctctttctgttccagcgggctgctgccctggctggcacctatgcttttggcatctttatgctgttagattttcatggtggctcaaagtggttctgagagagtaccaccccccctactcagtattgctcagggggcaaggtcaggattcccactgcacatcctgtgttcttcctgtttcaaggaggagatatcagggctgctggagaatgctgggcctgatagtcctctgactgctgtgtgacctgggcccatcctgtccctctctgaacctcaggggtgattgtaagaactaaatgaggagacatatacaaagggcttcgtaaaccaggagatgaggtgaggtgatgtagacagatgagggcctggcccagagatggcatcacaatacgatcagagccaaagctgaggcccaagttcatgtgtcccagggtttcctgaggagcaggccaggaggtgggacccaggacagaggcaggtgccctcccagccttgcagactctgaacctgtcctcagaaccatctgcctggtgccagcactctcctccaactccagccccagacacatggctcatggcagtgaagtaaagcaggaacagacccagggagcagtggg

SEQ ID NO: 53840 - DNA, 1051 bp, Homo sapiens
caaagggctgttggctgggaagattaaatgagatgatgagccccacgcactatcatcaatgacgcttatgcttatggggagtggggtgggaagcacctctgctctccatgcatgacttcatgaattctttttttttaaagatggagtctcactctgtcgcccagcctggagtgcaatggcatggtctcggctcactgcaacctccgcctcctgagttcaagtgattctcttgccttagactcccaagtagctggcattacaggcgcctgcgaccatgcccagctaatttttgtatttttagtagagatggagtttcatcatgttggccagactggtctcgaactcctgacctcaggtgatctgcccgtctcagcctcccaaagtgctgggattacaggtgtgagccaccgtgcccggcccatggatcctttaacagccctctgaggggggatctgtcctgtctctttactgatagagatggtgaggcacagagaggtggggaaacacccagggtcacgtagcataggagtggcagcagcaggatttaaaagcgggtctcttgcactccaaggtccacgtgttagccagtgcaccaggcaagggataaaggacttagtgtgagagctcctttggaattggagttgcagaggctctggcttcctgtgctgatctcctgcaagcctccagcccccagtcacgtctgtcagcagctctgagagccctccttgggcctctcacctcccacatgagcagggaatcagcaggcaaggtccgggcggtgaggatgggggatttcccgactcacttgagatccgtcacattaatgttaattaagccttgttaattcagccctctgcttacacatggctcctgacagcaaattgctcataagtgaggcagtaaatttattgctgctttttccaaacatttagcagcaaagacggtgccccaggaaaggcagaggagagacctggagggccagtgatgcttggttcctgctagcctgaaccccccaggatcctcatggcctagagaataaggtggggctccc

SEQ ID NO: 53841 - DNA, 1048 bp, Homo sapiens
tcccgttgatagatgtgtgtttggttgcttccatgtttttccctgctctgtgcaatgctaggatggacatccttgaactccatccttgtgcatttgcttggtcctttctttaagataagttcttaggaaaggagctgctgagtgtgtgcattttcatcattgccgttctgctctctagaggggagaatctttcccatctcacaactctctccctctatggccccatggctctcctttccagcgaggcaggcagctgaaggacttccctcttctctgagcacagggccacctcattctggtcccatgggacaaagcagccatatccaggccacagaaagcaaagccaggagagagaacaacgagcggtgttctggccccaagggctttcacccccaccaaaaaaaaaaaaaagcagaagagtacaaaactgttccttcattcttctcaggatattggtagaaggcatctcctccgcagcgttctaattcttctatctatgcccctaacttgctgtgtgaccttgggtgaatggctctccctctctgaacttcattttcctttcactcattggtccttattccacctgcactgcccccagcacttggagcagactcctgtgcctggagctgggttcagggctggagctggccagtccttgcctagggcagggatctgtgccttactacctggtgacagtgcggggagtatagctggcttggtgggctggattctgggcagggaaacagggcagctggactccttagctccacttccagagctccaccctgaggcccaggttccttgggtgactttcccttctgccttcttcctgcactcacaattgggccggatgcagtgcagtgatggagaaaaatggagtgaggcccaccagcttcatgagactttccgaaagcgggaaaatgagcccatattccggaggtgtgcgggctgaggaaagtactttgcccagagcctggccctgaaaatgagcgtttcccttcccttcctgagcctgtgattcctgcacagggaatggctgagtaaaagg

SEQ ID NO: 53842 - DNA, 1108 bp, Homo sapiens
taaaatattgcagtgagtttcctcactgggagttgttctgtggtctccttagagtgggagtactgaggacgaggcaaggaatagaaactgcgtgtctgggctggttatgccttatctccctggctctttataacaactgtccttgtgaggatggctgtgaaaagcagaaattttcttgtcattctactttctagataaggatgcctcctcagagaagttgagtgacttatgcaaggtcacacagctcaggatgacagaacttggtcaggatctctgcctgcctcgagttcagggcactgtctgctgaggtggggagtgtggtgcggaaagcaccaggagtgtgatctaggagctggaaagacgggctttaaatgttaggcctggtgcgtttcagctccatgtgaggctttggacgagatggaggagtaaagtagctgggtgctgagtgacgctcaggtgggccaagagagctccaatggccaagctgggctcctgcatggctctgagatgcatggggtagagtcataggcagggagttattaaacaaaagtgaatgacgtcaagcttggagtggaaagggtggcggcgctgctgatagtaccaagtagtaatcacacatggcttggcttttctgagcttgtttcctcatctgccaaacaggggcagctgtccctccaacgctggctgtgcacatagacacacagggctggcaagaagggaacggatggatgagtgttcccacctccacggcctttagaaacggactcctggtagccataaagggaaactgaagaaacggagtggggcttacgtggctgtgttggggccaggtgctggaaaatgttctttcctcagcccttcccgcattctaggccacctgcccagactgaatttctttgaactgttctccctgcaggagagagagctgttggctcgtccctgaggagctctttattaaacctgggatggaggggtgataggtgctgggataacaaaatctgctcctccctgagcagtctccgtgccttacccctgaccaccctctttggcacaccaccctgcaagagggcttgagctgccccacctttgtacatctctgggcctgcaa

SEQ ID NO: 53843 - DNA, 1054 bp, Homo sapiens
acccacattgccaacctcttctcccaaaggcccccctggcacttgagtttaagtcaccacatgtgccagacagggggtcctgtggggttgggatgcgttcagacccttccccagtgcagagcagcgctggacagaagtcagctgagtgggctatggagtcagccaacttgggatccagttctgccccttaaccacaaagcagctctgcggccctgggcctgtagcttcatctcactgaacctgtttttcataattacagcaagaatagtaatagaacccaccgcctaggattctgagcacccaagcacaatcgccctggcatatacagaagggctctgtcactgtgaccgttcagctgttcccatgcttatctgaggttgcctgtgttccttcttgccttcaataatttggcaggtgtttgctgaatgcccccttccaaatgccctgtgcctgtgtgtttggggccgtgcatctaccccatcaggagccccccacttcaggggtgagagctatgtttggtcagcccatctggctaactctctctcctctccgcctctctgctgtgtgtgccgtgcaggtgtcagaaccaggaggagacttccagccaagctactacctgccgccgccgccgccgccactgccgccccttccaccgcttccaccgcagccccagttcctcccgccaggctacctctctgcgctccacttcctccccccgccaccgccaccaccacctccatcatctttctcactgaccgtcctgtttgatactgacaaggagaacactggtgagtgagctccagtcttccagcttcagcgagagccagggagactttctggaggaagaggtacctaatctgaagaaaggttaggtgtggagagaagggacatggaatttaaagggtgttgagccctagaatgagctccttcttacacccttcctccagtccccataggcacacatctaagggaggtgggaatgggattccaggtgaggaaaccagggcctccagcagttctcttgggtataaatggcagagctgggatttgaaca

SEQ ID NO: 53844 - DNA, 1050 bp, Homo sapiens
ggtctcctactggaagccagagagtgcaggagcccaggagatgctgtctgtgggggtcagccccctgcacacggagcagggtggaggctgcatctgcttgtgacctgcagagggagagtaaccacccccacacgacacgcatcaggtcagtcccctgcccccaacccaccaatggcctctactgctcttcaaataaccccctgacccttggcctgggccttgagatttggagccatctggcccccaccaggttggtacatgagagacactcatcattggtccaggacaccttcacttgtttgtttgtttgtttttaataatgtgataagcacccatgaatccattgctccagacaaaaatccaggcccggacagtatctgacctccagccagcggacccccattgactctcacctctccggcctcagcagccagaacccggaatccctttgcctcctgcacttgctttgcttgttggatttcattgcatccatgtgtatgcctagatggtcttttgaacagctgttttaggatgtagtctttggggcgaggcttcctcactgaatatgacgttgctcacattcacccatggtgtggtgttgtgtgctgctgccttctctgctacagggtactctgggggcatcctggggttctcgtgctcttcctctggcatgtgggcatgcaggttacgctgcggggagcagggctgctgtggatgtcactgcccaggtccttgttggtccacctctccccacacctgctactccccttcctttctctcaccccccgcatgccagccacactggcctttctccattcctttgagctcgtccccaccttgggcctttgctcctaccgtttcctctcccaggaatgctctccttgcctggctcgtcctcattctggttcagcttgatggcatcttctcagatgcctgccccaacccactgggctctgtagccctcccctccaaacatctgtccccttgagggcaaagtattcctggggggctaagggagggactccagcagatgtggctggagcacagggt

SEQ ID NO: 53845 - DNA, 1091 bp, Homo sapiens
gtgtgtgagagagggagcctacctctggggtgcggtgggctgggggcagcaggggccatccgcggcaggcctccgctctccctcccaggccaaccccggcaagcttctcactgctgtctctctctttttgctctcctccgtttctttaatctggcaactctccatggcagcaccaaggtatggtcgtctctttctgcttcccctcctcatgaggtcccagggccatgggtacctctccctgggtctgaggttggcctggcctctccttagtccagcaggggcaaagctgccttgaggtcctgggggcagttccacgtgggtgtgtctggcaggacatggcagtccctggcactcactctgagaggtgtcatttcctccaatccttctcctgtcccctgcagtcccagcagggcagaggcttctaagagagcggaagcactagacgtgtccgcaaagggaagccttgtaagcttcaagccccagcagcggccagagtcctcaagcagggtcctgtggaagccttgggagagattgggattcaattagagccacgagtcccctgccctgggtcactcagacctaggatgaatcagacaagtcgctccctggctgagaagagggacactgagcaaacccagcacataggctggacagcgcttagggggatgttctggcccggggaggaggtggaggatgcgaggagagcttggagaggaggtgacgtggctgcgggagagctgaggaggtgctcgtggtgggaggtgtagggcctgcggtgccgggagatggcctgtagggcaccagggagccaccaaggggtttcaaaggcaagagcgggtctgtgagaaagaccttcccctctggctgtgtgtggggagcctgaggcctggagggcagggtggggcctgggcaggaattcaggaggggcagtggggatggatttggggtccacttcttatattctgggtgagccatgggggcctgaggggaagagacttgtccactccccatgcacagggcacagcccccagccccgccagactccccagcctccccagcctccccagccctgtgttctcagatccagccgt

SEQ ID NO: 53846 - DNA, 1094 bp, Homo sapiens
caaatgaaataaactgaacagcaaatacgaaataagaagaaactcacccataatccttgattttgaccattttaatatattttttaaatgctgctatgaacacaaaatgaaaacgtattactaaaactaaaaccatctcttctaacataaattgttgtcatctttataaatggttaaaataaacaagttttgggtaactgtttatttggaaattttgggaatgtagccatttggcgaagtaatttgtggctaattggcttttgacgaattggtcatttgacacattgatttttagccaactggcacttggagaatagatgttcatcaagttggcccacctcccacacgggcctggggcttggtgtctggggccgggctgtgaggcccacataggcgccaggcaggctgagtacttggtgtgggatccaaagatcctcttagaccaggagggagagccccacaagacctggccatccctggccttggctggcctgctcctggctgggctgggggagacttgggggggatacagaatgagagtgaccctttatggactgtgtgccaggccctgagctaagtgtcccatggggcattatctcacttgatcctcacaataaacccctgcaactagtatgatgatctgcatttgacagataagggaatggaggcacagagaggttaggttacctggccaagaccacactggcaggtgaggggcaaagttcagattccagaccaggctggctgtctctaaagcctatgttcctatccccagggccaaaatggatcagatggagtccttgtcctcatgcagctactggcccagtcagcttcttgataaaccatttctatgggccttattgtagcctgacagtggagcccatttctctttctcagatgaggaaactgagatctggatacggtgtgaggcttgctgaaggtcgcttagtggatcagcattagagctagaacaggcaccaggctgggtcctgttcgtcctccatcggctgcctccacctccagcctggctccgggatttctgctcttttgtgttcttctccctgaaagtgggacaggccctgcagtctcccgcc

SEQ ID NO: 53847 - DNA, 1031 bp, Homo sapiens
tccgttaagccttttcgcagggggcaggcctcccttctgtagcagcagttcagccccttgattacatacctctggggataggaagctcactccctccctgtgttgagcagaggtctgtcaccccagccccaatctatggccctccatccctccctgcactggtcctagctcttgtttggagacacagcccagcggagacctcaggacaggaagtttatcttccctgttggcagtcctgggttgaatgactcttcactgagttctcatctggtggtagccaacctccctgtccccagtcctgatctgtagtgttgtgtctgtcccaccatccctgctacttgccgtgcggtaggcacatcctggggccaccccagagaggggcagcatagaggtcccacagggagccgtggggaggaggagtctcgggtggctgctggaggcctgggtcctgcttgaccttaaggagtcagcgcctttctaggcctcctcgaatcaggccttcagggtccttcagcagcccagaaactctatcacgtcctccccacgcctcccctttaagagatttccaactgtgtgggcctctggagtggtctagggaagtctagaagaccaggcatttggggagttttcgatgttgggggattgtttctaataaaaaccaattaggctttttgaaaatcttgttccaggacaaagcccaaatgcatcactaggcaaataagccgtgtgatgggcccagcctgcctcttaactcctcctctgccttctatcctggatgtgctatttaccttagtctccctgtacctcatccccactgcccagctcaagtgccccctcctccaagaagccttccctgactgtctcgactgggtgagggccttttctgtcactaaccgtttgcttacctgtcctcccaacaggcagggacccccacctgtggacctcattcccaagaagcattagcatttctcactttgcaccttctcctgattgtgtcctatgagccaggcagtgctgagacatacatacat

SEQ ID NO: 53848 - DNA, 1068 bp, Homo sapiens
gggccactggggaagtaggtgtcaaaggactctttccgaaggaggtgacttgcccaggacctcacagctgctgagcgtagtcagggcttgaaaccacggttcccctacactgtgctgcctttctgtaaagcccttttggttcattccctcagcacagtgtaactggaggcatgggtatattttgtttttcctgtgtatctggggctgagtttccctggccaagtcgccccagtggtaatctaggccctttcagagtcattttatcactgctatctctaaatcactgcggcgttccactagcaacaacaacaaaaattctgtgggcatggtgtggacaagaggttaaagacataacacttatgagcctaaactgagtgtgggctcgggaaatgaaggggggcttgtggggacccagattggaacaaggcttccacctccactggcgccacttaggcctttataggcatgagattgtggggaacacggagtgcttgccagctcagggagtaatgtacccgacactggagcgacctggctgggcagagacctggggacagtctggctatgttgggcctaggggagggcccacgctgcctgagccctgcagccagtcccagcagagagtagggtagggccacagcagctccagggcgctcttgccactgtgggcagctacatttgggagatcacggcccgcttttatacccagccctgagctgggtgctgtggggcatagaaagagagaaaactcgaggtttgtgtcgggaaggggagatagaggagcaggtggaaagtcttgcagggcacattgtcaaacaaagcatcagaggctgcaggcagacttcacagagacctgcaaatgcaaggcctcaaaagccaactgggtttgggttggcagagaagccctgttgtcaatccagctcactgctctgtgcggttagagactgctccaagactcacagccgaataaatagtccaatgataggggatgttctgagtactagagaagcacacaataagtcactctaggcccaggggtaggaggtgatcagggatggcttcacagag

SEQ ID NO: 53849 - DNA, 1003 bp, Homo sapiens
gccccagaacagacagtggcccccagaggagggtgggacttgggggggtggcactgaaccatgctttgaagggtgaagagaggtcccttaggcagaacggtggggaggaactgcatgtgcaaagcaactggaataggaaatgaaagttggcagcagagtgagaacctcagagggccttgaatgccaagctaaggaagtcccaactctgccagtaggcagggggagtctctgaaggattttgggcagggtgacccactcaggttggcattgctgtctttcctccactttccttacagagcctgctattgtgtcattcttggggtttgttgctgtgaccgtcttcccactatccagacaatgtccaaaagttcttgtcctgcctcctcccagctccctcccgtggtcttgagagaagtagtcctcagtggttattgaattcatttatgaatccacccagtgaatatggacacacctcctataaaaatactggtcaccatgctaagcacaatgaaggggcatctcgagaggggctgtatggggatgccacgtggaaggtattctgtgcccagactcatgtggccatctcgagaggctgtcagccagggttgaaaggcgaaagtctttaagagacagagttctgcaggagttccaagagtggatgatgacctgttccagctgggggaggcaggcaaggctccgtgtgggaggtgggcccttgagcgctggcgggaagggagttccaggcggcatgggcaaagtgtaatggtgggaaagcagacagcacgtatgaggacagcagtgagctctgcttggctgcacggaagggcacgtggagggaaggagagaaataaagttggagggcctcatgagcatggccgggtggggtgagggtgggggagtttgatttattttcctgtaggtagagggggccatggagagtttttagctatgctttggtaagactaattttcacaccctgtggttctttggagaaagggcaagt

SEQ ID NO: 53850 - DNA, 1076 bp, Homo sapiens
ggattgctaatgcctgccttattcctgccataaattggtttaaggggtggaaagtaggctgagagtgagcaggtgggaactggtggaaagtgccattcggcaaggtgctgtttgacacggtggtcctgggagagcaccccaatttctgcagcattggctgtgggcaaacatttcttccaagtgggagagaagacttttcaaaggccacatatcatcttaaatgcacaagtgccactgagggagaagggttgtttgtttagtaggcaacactgattctcagaacaagctaaacaaatccctcttattgaagaatgttgctctgggctaggcttgattaaaataggaaaatctaagaggcttaaatgtgtgcggttttggttgtggagggatcaggagtgcttccccctgccctgtgtcttgctggacatggtcactgagttgtgaggctactgaaggtctgtgtagtgatgggcccattcagcaccaattttaccagtgaggggctggaaagccttcccggcccaggcaggcagtattctgagcaccttcctctgggctctgaatgccttgggttaggaggtttgtgtcgagggctgcttggagactagtttgctctgtggtctctttaggtcaagggctgtcctattgccttgatctatttggaaaagtaaggactcatgcttttttttttttttttttttttagagacagggtctcactctgtcatcctggctggagtgcagtggtgtgatcatagctcactgtagccttgaaatcctgggttcaaacaatcctcctgcctcagtctcctgagtagttaggactatagttgtacatcaccatgcctgggtaatttttatttattttttttagagatggggtcttgctatattgcccaggctggtttcaaactcctggcctcaaacgatcctcctgccttggcctcttaaaatgttgggattacaggcatgagccactgcacctggcctgactcatgcttttgagcagctctaggtgccagggcctgtaccaggtgccccatgtatgagtctcctttatacctctctgtctctgtt

SEQ ID NO: 53851 - DNA, 1098 bp, Homo sapiens
ggtgtggggacagcagatggtcagcaagggttggcctggctgactgctgcaccaggacctgggatattaccttggccttcctcggacttcccgggagcattgatgggaaagctcagtggcaggattagcctaattgggagtctttccgcagaggctaattaaaggatttgggtaaatataaaaagtggaaacagcttgggatggaaggctcccctcacctcccttcttccctttcctcccttcttctgcctcctgttgtctcagaaggagtctggggttggcagctgctgacccaggactgagcacagccagaaaactcaccttttttttcttttctgcacacctggtggcaggtgacctgagaactaatgagagcaagattggattttcttttcatatttaaaatgtctcagtaggacgtctaactagcttaccagttgttttataggagcagaagctgcagagaagagagaaggaaagattcctccccgctccaactccccaagaggaaaagtttgcttttggcaacattgactttctctaagatcctgtattgatcagcacttgccatttccctggagatttactgcctggtttttatttagatgcagagtgagggaggaatctgtggggatggggacgctgcctttggagtcagccagcttgaagttaccctctggctgtatctgccgctcgccaggaggtaccctgggcaggtggctctctcctcccagggctcagtgtcattgtatgatacatagtagctgtgggagtcaaatgcgatagtagctgtggaagttctgaactgggccccgacactgagttagaatgtgccagatcttcccaggaggcagcatgaggcctaggaaaagccctgaaaagcaaaatgcctccttcactctttggcgcaatgctgttaggtacgtgttgggggcaggtgtgaattcatgcgctccctcttcatgtctcctcccctggcctcactttactcatctgcaaaatggggaggagactctcttttctgcctcccatgaggtggtgcctgtgaaagcagctggcaagctgcaacccctgtaaattcagtgatgctaacaacca

SEQ ID NO: 53852 - DNA, 1069 bp, Homo sapiens
ccatgatgatttctgatacttggtctagactctgcatttcccccactctaccccatcaatttttctagatagtttatgaattttctgtctctctctcgtgttctgaaattttctgttgatgtggggtttttcccattcgttgggctagatacttggcaggcccactgtttctggagactcatgaccttcagttctagacagagtattagttctttgacttttttttaaatataatttctctactgccggtttctagaaatccccctagttgcctgtttggctttctgtattgatcctctacatttcttatgtttttataatacctagctctttgtctttttgatctgtttttggagggtttctttgactctttttcccatcttcttttttattttagttatttttaggttgcaaaagcactttcaggcattgtgcctccatttatggatgcaatatcttatcatacctctctgaggagatttttaggattttaaaccatctttttccttattccctgtgttcctgttttccattcatttcatctgagttccacttgttgattgttgttactcctttcaggttgagggttttcctgacatgccgatgatgactctctggccatacgaggatgtcagatctactgaccctcccctttccccaactggtcacccacttgtcctcacttccttccttgcctagcttagtgttcattataattacacctccccaagcaccttcaaccctctgcctccctctccccctgttgttctcactgttgggcccctaccctagttaagatcgaaccacctgtagctgtctgtcaaatggtgctagaggagacacacggaaccctgaaagagcccagtctgtatctgggagttgagagctctggcgagtactctccaagccttgcctcccctcctctgtgggagctggcaatgcctctcctctatcaacagccaaaccatcccagggctttgcatccaccctccctcttcctcgaagactgtgcttcagcagtgacctcccctgcagtgcgactctcgccctctccaggggtcactcctat

SEQ ID NO: 53853 - DNA, 1048 bp, Homo sapiens
catgttgtccaggctagtctcgaactcctgacctcaggtgatccacctgccccagcctcccaaagtgctgggattacaggcatgagccaatgtgccaggtctcagatacccctttgatatactgatttcctttcttttagatgtatgcacagcagtgggattgctggatcatagggtagctctaattttaattttttgaggaacctttatactgttttccataatgtctgtcctacattcccaccaacagtgtctgagtatccccctttctccacagaggatttggtttttttcaactcccactccacccccatcttactcacttgcactacccctccctccttcctcctgccccagttgcatcacaattctttgggtaaagtggtgcaccactaggactacgtgtaacggggtattagtgtaggcattgtgggtctggctgagtcctaagacagtggatcttaacagtaggcattggccactacattcctaagcaggacttcaggtgtgtaaactctgattttgagatccttactggcatacgctttgaggatatgaaagggttgaggtggaagagcccacagagaggatttcttcagagagaattgttgagaagctgacgttttctgccccccatgccaggtgggcagggagggaacgctttttccttacctcaactcaagagagaagggctctaagaggatcactcagagaactgggcacagccctggacgccgagcagtgagtgcatttgatccatgcctggaaatacggaacacgaaagactgtggttggagcccctgcttcgtggcagaatgaggagaggtggctgcattgtttctgccaacgatggggcagaggcagtgttcaaggacctgggcagtggtcgttttcaaactgatcctgcccaagagagcttcttgccaggtagaggagagaggctggaagtgtcccacgggatgcatgcgggtgcctgccaaccggaggagctccctaggaccccacagaagtggcccagggtaacacagtgggcactaagcatccaagt

SEQ ID NO: 53854 - DNA, 1212 bp, Homo sapiens
gatgtattttgccaactttccaaccctgtaaataaattacacgtgccggcagaggttgccaggatccactgtgtcagttggagcttaatttttatcctaaaccaccgaatacttttgtcctagcaagcagagaaagttacggagttttttgcttgtcactgggcccatcccaagacgacggtttaaagagcctgagaataggcctccgcggagtcactgattttgacaccgttttcggtggttaagtagcttcagcagtctcaagtccaaccctcaaggcagagaatgataatataattttaagcatatcgtaaaaatgaaactcaatcacttccactccccaaacctgtctcactccccatctctctggagaaaacggctgtaattgtgtgtttaatctcaagactgcctttgcattttatcttatttgagtgcaaagcccaggtaatatcgtggcatttccagcgcgaaacaaaatagggtttctaatttggagacactattaaatatttcatgcttcaaccaaactcaattcttttttcctataataagtttaaatattaattctctggaatgtcagatgcctaaagcaaagcatttagtgatctgcagtttcaagtatctcgaagaaggtttatgaaacaggatatttcactgggagggatgagtagtgtgcttcagagatatgtgaattcaaggcatcgtcttctgatttattttttaaagggaaaaggtcataaaataagttgctttatgtgctgatggattaagtggcttaggctgaaataacagcaggaactttactatttttccctgttttaacaatgctttttgggggaggggggtgggtctttttcccgcctgcttgtctcctccctccgtaccccccgtcaaccccagccagatggctttaattctaaccaaatcccacgctgaggccaaatgattgatcaaacagtcatttgtacttacggagcgctctttgtgagaatatctctgtgctagggcttctcgttgaggcaggctcttctttgggccttcaaacggatgatttcaaacagatcgagcggcttggtgaggaggggtccgcgggtggatgcggagcaaaaatcccagacctcaagtccgtagaacttctcgcttaaaacctctgtgttacttcccatccctgacagcaggggtatccaaatgttctaagtataaggacaaaaa

SEQ ID NO: 53855 - DNA, 1163 bp, Homo sapiens
acttataatcccagcactttgggagaccaaggcaggtggatcacctgaggtcaggagttcaagaccagcctggccaacgtggtgaaatcccatctctactacaaatacaaaaatgtgctgggtggtggtgacgctcacctacttgggaggctgaggcagaagaatcatttgaacctgggaggcggaggttgtggtgagccaagattgcaccactgcactccagcctggaggcagagtgagaccttgtctcaaaacaaacaaaaaagaaagaaatttgtgagatatagcaaaagccatgcttagagggaaatttatacccttaagtgcatatgttagaaaagaagaaaggctggatgtcagtgaggtaagtgtctcaaaaagctagaaaattgatttaatccctttagtttttaccacttttgtacctttccaatacacatgtcataatgtatgattagtgtgaattggcttgccctcttttccaaaggtctatgagttctttggatttagggatcgtgtctttctctttatatccctagtgcctattaaagtaccttgtacacagttgatatttgtttggactgaatggaactcctcatcatcagtgtcttggagctgttacacacccagggtcttagacttaagtgttcacaaaagccagacaattgatgaggtgagtgaggccagctggtcagggaacagcatactggagagcgtgtggaaggctgctgttgctgcttggccccagctgctgttgttgctatgggagagtgctggcccagtgtggctagagctccctatttgtttacaagaacgaggccaggcggctcatgcctttaatcccaggactttgggaggccgaggctggaggactgcttgagcccaggagttggagaccagcctgggcaacatggcgaaaccttgtctctacaaaaactacaaaaagtagctgggaatggtggcgtgtgcctgtagtcccaggtactcaggaggctgaggcaggaggatcacttgagtctgtggtggggtggggtggggtggggttgggggaggcaaggctgcagtaagccatgttcacaccgctgcattccagcctgggcaacagagtgagacccagtcaaaaaaaaaaattgcatttcgatacaaaatctccctttttgaag

SEQ ID NO: 53856 - DNA, 4285 bp, Homo sapiens
aactttctatcctttgacctacatctccccattccctgccacctcccatttactcctaatttaggctaatttaattctggttttccagcctataacatatcaaaaaaatttttttgagtcagggtcttgctctgttgcccaggctggagtgcagtgacaagatcatagcatagttcactgcagcctcaaactcctgagctcaagcagttctcctgcctcaggcctctcagtgttgggattacaggtgtgaaccaccatgcctggcccatatcaaaatttatttgaggggcagagattgctactagagtcaggagtactaatagtaaattgtaagggacactttactacctgctagcagagagaaatataatgggaaagccacagatttggtgttggagagaattccagagccattaagttagagaagacagcctcactagcacctagagggcatctttgtacagtaaaatacttgaaatggttcaattggaggtacatggttcaagaaagcaaagatgtctataagacattttagggcaattcataacacaattattaaaataagaccgttttggcacttttaaaagcggtgacctattcaagaactagaaaaccggaatttttcattatattcaatttttgcccaaaagtttaagaggaagtattatactagtttcagtatatatttgccctaattttatcaaggtgtaatatattttcgtgatggtgagggtggagagagaacacagtgttcacatccaaaacataacttatgttcaaagggagaagtaaatctaaaccaccaagctgttacctttgaaaacaattaatggagtctattgtgttttaaccaaacattttagattaaaggattttgtattaaaggcaattcagatactccacaactcaaagataatgttggaatctggtttaaataaaataataaaatccagaaaatctactccaaggcctggaactccgcacagcaggttccatagcagagcaggttaaagtcaatgccttcacttgtcagtcttaatttgtttggtcttttagaagatagaagcatgccattactgaatgcaagccctcctcttcattagattaaaaagagttttcatccagctttttcagaaatagtaataagtgaagatttctattcatttttaattgttttgaaaaatattgtctctgtgctctgtggttcacttaatatgcttaatgtaaaataaagcttatgctttgaatttatgtttcatttagtgctgtgcaagcatctgcagaacatcagaaaagacttcaacagttcttggagttcaaagaatagttaagtaatataaactgtgttcattacactgctgatacaactacagatgggacagtaaatgttcagcattcttggatcagaagaaaacggactaattagatgcttcctttgtcgtggtggttgctttgaaaactatactttaatgggagaaatcatggaaagaaattctcaacagaataactgaaaactgccttttctgtaccgattgctttttgtgtgtgtggtataataaaatctttattcaattttacagaagcattgatggcagtcgaaatgtctctagctcatataacttaatagtaataactaaaaaacttttagaatttacttttgaaaggagggaagccagttctgaaatgagtataggttgatttcatagtcttcttaattaagagtttagctctttgtaaactcaaaatacataaactttttaagtgtagtttcatttactgaaggataaaaatggtaacagtgcagcaatattcacaaaaaatattgtctaacggacatattttgttaatctgttaggttgggtttttgtttccagggacaaattaaatttgtatgattacccaaaaaagggtctcagtttacagatgctaactctatataaaggaatgtggaaaaactcagttcttaagttacaagattaaaaattcacatttggtctttaagaaacaattgactgacatctatgaatttattttgtatcatgctagtaaacacgaagtattaatgtatgggtattttcccagctagttttgctttctttttctggagcaaaacattaagtgattgcagagtttttcaagcaagagaaaaaggtttgcaaaaaaacccaggaaatgttcccttttttccccaccattcatcttcattagatcaaattctgtgaaacttgtctggtctctcaaagggagcagcctctgtagtgttaaatggctaattaaaataggaagatctttatagccagaaacaacttagtcatcaaatagcaagtgaaaccaaaacgtcagagggattactgtacttggaagtatgttgtgtgtcccaaatgtgaacgaagtattgttagaatttattagatcagcttctttggagatcaaagattggaaatcctagtcatagatattcactggactggctttggactgaaatgctcctttgtaattcttttcctattgtcttttccttctagtgtcccaaaatattttctttaaagtcagcacagtactgtatatgaatctttaatgtggtatcatatatgtctacttttgtctgattcatcgatgtattatatctttataattgaatattttagctccgggtcctgttgccccttcaagcagtacatgccaaattataaataggtgctactggccttgagcatatcactgtgggacagttccccaattgtcaagtgtttagatatgtagactattgccatttgtttttttgttttggttttgctttgtgtctgaagctgaattgatttcttttttttgaatgtgaaagttgaatttcaaacgtagtcatttcttacagatggccaagacagaaaattgtggctaggttgactgagaactgttgtcttccatgtattaacacaattaagctttttatattccactctctgtgctgaccctggctgaggcattttgggagacaaggactctgaatcttctgcttccattaaagaagaactgtgatattcaacattggatttctgagaataaagataggatgattcctttgaactttgacttacttgtataaaatgtccagctaggttaggtttttgccatttcctatatactttgggtaaagctacatttgatgagcaatgtgaatgtttctgagaatgttcattcctgttttctcttaagagaatgtgctgtgtactaaatacaggccacatagtgtctgcctgttgaagatctggaaactgcctccccagatctgtattgtatttggtaggtaagggggtcagtttctttttctcattgtgtgttgataatctacacaccatctgttggaaccagggtgttattatggggaactcctcctgtgtactaggaggaggaccttagggagaccaagaggagagaagcatttcctttgatgaagtcacatcctgtctatgagcccactaatgctgtaacattggcctgaaagagagtgttctttaaaagcctttctcggctgttagtataaaaacatgatggtatcagctcttagcatgtttgcttgacccttatggaaggtataaatccacagaacttccttcccagagaactgggaaattgtcctagaaataaaccttgtacagttgagtggacatggataagcaacaatttgttactttgcaggatttgttccttggtaattgtttggtgtgtcatcctgtaaatattcatgatagtctgtttatatccttttgtatatcgttgatactggattgggtagaaaaataaattggcaatttaaaaaaatggaacagttaattgaaatatgtgtgtttataaggtcaattatttaatttctgggcgggggggtggtggtggtgatgtttcctgaatcatttcaatttagtctcagagttgttgcttataaaaccagaaagagttgaacttcttgagaagtcagcttttgcccttaacctagactgatttggtgggtttcatggtaactctaaggagcctgaattcagaaagtctcattctttgttgtcttggctgacaaaactaaacaaagggtggaggtgctcaaagccatctcttaacagaagtttcttttcttgcaatagtgtttccaaatggatcgtattcccctaggctaacagttacgtctgtcaacgttacttaaattaatctgaacttcacctctaggtagttgaggtacctcaaaccccttctagctctcccaagccatagttacctttctttacaaccaaatagc

SEQ ID NO: 53857 - DNA, 2784 bp, Homo sapiens
tttccagaggcagatttcaaattggtggtgggagaagcaccaagtaactctagaaccacgcgtgaagggacaggtacccaaaataaagaggtttgggtgagagctgtttgaaaattagttagatccctagatcctatgatgtggggtaattgctcctcttccactgtagtctgaggtttatcctttaagagagagtagaacacccagtctgggggagttgtgggtgctgcactaaaggagagggatgagttccaaagccctggtgtccacctggcttcagaacactggggcaggccctgtagtcaggatactagaagacttttctttgggcactctgaccagtccaagaagaaagacctaaagtgactgagttgaaggttcacgccccaaaagtccctgcagatgacccactgtgaagccgctcgtctgtaatccccagtcatgcacttagaattggtgctcagctctttagcaggtcccacttgcatttgtgaacgaggatcactagatttctgaggaaagtctctcatgcagaagttggagactaaagggagcaaagggggaaaatcagcttggaagaaactaaaaaacaaaaaagctgtcatcagaatccttagaaataagaaaggatattgcatctttgaaacaaaaataggatgctaaaattaaaaagaacagatgatgttaaagagctcttgaaattaagaacttgatggcaaaaataattttaattatttttgttttcagttcttttggtggttacattcataactataaatagtacgcttatactgttgtatcttgtcagtttatttttccatggggacctcatgatgtaacagtatcataaatgccttatctgaattgaaaaggaagataaactatttagtgaataactatttctgtaaagtataaagttttggtctttttttttttttttgctgaggtcttttaataaagctcctcctggctgtcacatcataagcagagtaggacatcagtgtttgacttcaagctttgcattttcaaggatattgaatgatagcttcatttccaagggcaagtctggattttggggggggcctggtaactgtcatagtagctgagcctccctattgcattgtttatgaaactattttgactgtgatctacagtaagaaatgtgttacagcatagctatagatatgtgtatatctctctgtatatatccatttgtatctatctcaaatcttaattctttggactgaagtgacttttttctttttaattttttattttattttattttatgttatattatgtttgttttgttttgttatgttatgttatgttatgttatgttatgttatgttatgttatgttatgttatgttattttgagacaggatctctgtcgcccagtctggagtacagtggaactcctgggctcaagcagtcctcccgcctcgtccttccaaagtgttgggattacacatgtgagccacagcacctggcctaggttggctttctttataatctaaactgatgtgttttctttcttggtgtaggcagtcgacaagtactttaagcttcctcatgcttccagtaaaccaccccggatttcaggaagccttgtggacacttcatataaaacattaagatttgcattcagagcatcactgaaaactgccatctatcgaataactactacatttggtgaacatctgaagtaagtttacctgttttgatccatgatgatacctattctggggagctttccttagaaataggtatgggaatgataaggctcatgtgttgaaagtgttcttttgggaccttgatgattctcactgtaaacttacagcttggatgtggacttaatatttatattttaaaatttggcccatcataaagctttggggatttctttcaaatggacaaaagaagacagaaagttataaatgcagcagattaattatatatatatatttaaattatcaaaagatccttaagggagaaaaaagagcagaaaacccgagtacctttccagaaaagcatattaaaactaattctattgttatatcttggtcagcaaactgaagacttggggtgagcaaagtattccagaaatgaatccctggtgctttgtgattcatgctggaaaaacaccaacagatcacaacaccttgagaaacagaaccagagagaaaaccacaaatgccaagcctgtttatatttagttttattcatgtttactgctttcctcttgtgaaatgatctagctaggcaggatgagggatactagcttagtaactaaactgtatttatatttatcacaattataaatgaactttagaagacacgagagattgctctgctgtttttgtatgcaatcaatgaatagtttaagacttccaatttaaattaaagttaaataaagttaaaaattcaatttgtcagtcaccctagccacatttgaagtacttaataactacatgtgtttagtagctactgtattggacaacagaagtataacatctttccctacttccagaaagttttatcagatagtgctattctagacaatacacttagaacttaatgttttttcatttactcttttcaaagaccctgtgaagtgtagaaattatcataattgtacagatacgaaaactgaggcatagagatgttaaaatttgcctgatagcacaatctagtgcgtattaaacatgaacctgaaatcaagtctttctttctcttaaaaatctttcatctttctatctacaacactagactgcctccaaga

SEQ ID NO: 53858 - DNA, 1079 bp, Homo sapiens
aaaaaagactaatatgaaaacagaataatgataaaatcatgtagtattgcatgatttttcatgaaaagctatatgaaaagtctagacacacatctttgtagtcttttagttttcattgaatacaattgataattcataatttttaaattttctgtccacatggtaaagggaagaaaattgccaatatgttaaaacaattactgagacacattggaagacaaatgcagagagacagatagcagcactctagaccagttctgtccaatagaaataaaatgcagtcacctatgtaatcttatattttctgatagatacattaacaaaatacaggtgaaattaatagtacagtttatttaacccagtatttaaggtagtatcattttatcatgtaatcaagataaaattactaatgagatcttttatatccatttttacatgctaattcttagaaatctggtgtttgtttttcactttgtagcatatctcaattcagacctgccacatttcaggtgctcaatagctacatgtggctagtggttgccatattggacagcatagctctagactttaatgatgatggtgaaattgatcatataagaggaatttcaggaccgggcgcggtagctcacacctgtaatcccagcactttgggaaaccggggaaggcagatcacttgaggtcaggagttcgagaccagcctggccaacatggtgagaccccgtctctactaaaaatagcaataaattagctgggcatggtggtgcatgcctgtaatcctagctacgagggaggctgaggtgggaggatcgattgaaccagggaggcagaggttgcagtgtgctgagatcgtgccactgcactccagccaagatgacagagtgagactccgtctcaaaaaaaaaaaaaaaaaggaatttcagactgtgaaccttcagttgatgatattctagatatattttcctgaaactcaaagattacagaacaatatgtttttaaggagagcaaggaaatatatgtggtatgcttatctagtaagtcattcaacaggaaagacttcatcccacagtattttataataa

SEQ ID NO: 53859 - DNA, 1972 bp, Homo sapiens
ttctgttggtgacaaagtcacaggaactactaatgctactatgatttgttgcttacattcatagttgaaggaaatgctagattttaattagatcttagtaaagataaatgtgtaattcaagtttgtaccccctgaatttttcccttaggcctatggacccaatgtaagagcccttgctccaggcacagccgtttcatgtccttgctgcttctgtacagtttctttgatcctaccaggatttccagttccttttccccatgttctttgtctttcagctccctcctgacttgcgtatatgcctttctgtgtccagtttagaccttgcagtctattatttcaaccactttattaccaattccttcaactcctttgtccccatgtccttgagctgcacccatgtggcagttccattacccacccattctcttgctgatccttcctgccttgcttcaggatcttggcatttttgtcctgaattattacatcctcttgctcctatggactctcaactgagttacttcgtgctctgattccagccactctgctattcccatgagtcctctgctcttataactaccatagactattcagtctctgcctcccaccaaatatatcttattttcttaacttgactctaactgcacatgctgccttttctttccttttttgtctagaacatatttttctcctttggtctgactctactctgtaactcccccctcaacactttattgtctttattgacttttattgtctcctcttcatattagctagagtagaggtggggactttgtctcgcctctattcccatcatctgatatagtacctggcaaatgacaggcacttattaaatgcttgttggatggctgctggattgcatcattgctggttcagtggacgaagacttctgttttggggcttaaatttagtgacagttctgatgcaatgggttgattaaaatgctcccaaaccatctttttgttttgagaggcaggaatgtgatgtgactcatatgatccctgttatatatttttggctttctgttctttggtctagaagggatcaaagtgaagagcgtaagtttaagtatctctgtaatttaaggcaagttgtacattactggcttctgggtgttactaaggaacaattgtgtggaactgttctatccttttgttttacttttcagtatgaataacatcagccatttcactgaatcattaaaggcaaaatgtgaaagggaaggggagcctttcatccttcaaagtattcagagggcaaggagtagagtgatggatatgctagctagctcagtggtttcagccagtggccagaccatcctggagatcactgttattataagggacatatgtactttcatttgaatgattaccatttctccaacatatttgcagctgttttctcagaggtttttacatgctgttttggttaattaaaatacaaattcatttgaaagcattgctgagttcatagtagttatttcctttatcagtggatggacaacaagtattatcctctggaggtccataggattttattgttgtttttaaaaagggtgcttacatacaaaatgttaggaaccaaaatgatatattttataattaaaatttttttggctaagtgcgttggctcatgcctgtaatcccagagttttgagaggctgaggcaggaggatagcttgaggtcaggagttcaagaccagccagggcaacatagtgagacagtgtctataaaaaaaatttttaaaaatttgccaggtgtgatgatgctagcttatagttccagctacttgggaggctggggctgaaggatcacttaagctcaggaatttgaggctgtagtgagctatgtgactgtactccaggctgggcaacagagtgagaccctgtctctaaaaaaaaaaaaagaaagaaaaattaaacttagtaaaatatacataacataaaaattaacc

SEQ ID NO: 53860 - DNA, 1010 bp, Homo sapiens
ggtgtgatctcagctcactgcaagctgtgcctcccgggttcacaccattctcctgcctcagcctcctgagtagctgggactacaggtgtctgccaccacgcccagctaatttttgtatttttagtagagacggggtttcaccgtgttagccaggacgatcttgatctcctgacctcgtgatccacctacctcggcctcccaaagtgctgggattataggcgtgagccactgcgcccggcctgatttgtgtatttttagtagagatggggtttcaccatgttggccaagctggtctcaaactcctgacctcaggtaatccgcctgcctcggcctcccaaagtgttgggattgctgcaggcgtgagccactgcgcctggcttgatccacatcccttattctttcttcagagagaatgattctacccttagaactgtggctttcaaagtttttggactgtgatctgcagtgcatttacattagactcaaaatatagtgtgtgcgtgtgtgtgtgtgtgtgtgtgtgtgtagataacagaaataaaggattcttggaacagtactcaccttttactatgtgtagtgcattttaatatttttcattctatttcattttttaaaatgctggttaaaactcactgaattgatttcataaagatcacactgcctgccctagaggtattctataccaaaattactctgcttttaactctaccaccatcagaatttctggttcttcatagttggttagaaggaaagcaatctgtttgattatagtcattcatacctttgagtaggaaaataggaattacagatttgtcaaaaggtcaagccctgtcttgctctgtttcatgctgctctaacagaataccacagactaggtaatttataacgaacagaaacttaatttggctcgtggtcctagaggctgggaagttcaagattaaggggctgcatctggtaagggccttcttgcggaatcataacatggcagaagggatcacctgaacaag

SEQ ID NO: 53861 - DNA, 1868 bp, Homo sapiens
ccaggaggcagaggttgcagtgagttgatatcacaccactgcactccagcctgggtaacaaatagcgcaactccatctcaaaaaaaaaaattttttttttgtagggacgaggttatctaggctggtctcaaactcctgggctcaagtgatcttcctgccttgacctcccaaagtgatgagattacaggtgtgagccaccacacttagtctttttgtttgtttgtttgaagagatggagtcttgctgtgtctcccaagctggagttcaatggcatgatcatagctcactgcaaccttaaactcctgggctcatgcaatcctcctccctcagcctcctgagtagtttggactacaggtgcatgccaccacgcccagctaagttttatattttttgtatagagacagggtcttgctaagatgcccaggctgttgagcctggattcttttatatctttctctacttcaaaaaagtgcaacagatagattgtttttaacttatgttaacttatgttaaatatgaaaacttagttgttaaagagctgtttcttttcatcttatagatacagccgtctcagtgcttaaatgttgctcagaggcctttcctgaccattctctgaatactgtatgcccttaccacatgtttttttttttttttttaatttcctggcacatattattacgcaacactatattatttttaaaattttcttcctaatagaatgtaaagccagagactgttattttattcattactaatgcaattgagtacttttttcagtgcctattccaatttttttgcccgtttttctattgaattgctcctccctttatttatttatttatttatttatttatttatctatttatttattttactttttattttcgagacagtcccactctgttgcccaggctggagtgcagtggtgtgatcttggctaacttcaacctctgcctcctgggctcaagtaatcctcccacctcagcctctcgagtagctgggactataggtttgtggcaccacacatggctaattttgtagagagggggtttcaccatgttgcccaggctcgtcttgaactcctgggctcaagcgatctgcctgcctcagcctcccagagtgctaggattacaggtgtgagccaccgtgcccagcctttatttctttttatattcagaatattaatccttcctaaaatagatgtatttcaaatagttttgcctaattttgattgacttttaaccttttttttttttcccttgaggtctgtcgcacttagtagcagcatcatttacagaggatagatttggagttgtccagacgacactaccagctatccttaatactttgttgacactgcaagaggtaagaaatctgtgggttgggagggggtagaggtcatcttcccctcccacccagtgctttgtttgtttcctatatatcacatttatcgagtgacaaaacatgttggaagttaaaataatgatactttttcaccctcaggaaattacaatctaaaagacagaaaagatgctggtgtggctcatgcctataatcctagcactttgggaggctgaggctggagggtcgcttgaggtggagagtttgagatcagcctaagcaacatggcaagactcggtttttacaaaaaataaaaaattagctggccatggtggtgtatgcttgtagtcccagctactcaggagcccgaggtgggaggatcgttggagccaggagtttgaggctgcagtgagctacgatttcaccactgcactgcagcctgggtaacagagcgagaccctgtctctattttaaaaaacaaaactaaaagatagtttggaagagaaaacttttaatctgcttataaa

SEQ ID NO: 53862 - DNA, 1733 bp, Homo sapiens
ctgtctgtacaaaaacatttaaaaattaaccggacatggtggtgtgcctgtattcccagctacccaggaggctgaggtgggaggatctgttgagcccagaaatttgaggtggcagtaagctgtgatcataaaactgcactccagcctaggtgacaaagcgagaccctgtttctgaaataaaaaagaaaaaagaaaaaagaaaaaaatttcaccaaaaccacttagaattaattaatttttttttatgtcagggctctaatttgggggttaaacgtgtatacatgggaatacagtttagttggctcatcttggttgtccaatttgtagcacaaaggtatttagttacatggcgtattgtttaagtattattattctttgcccacaagatgtgaagtgtttcattttttcatttaagttactgtctggaagaactaggaaatgtgttatatttgaatagaatttaaaaggtaaatgtgttaattcttccttttttccaactcagattaagaatttcttgtcaaaacgggtgctgataatgtattttttcagtaaggtaagaatatgtggttatagcgttgggaatggggagggaggaaatgaaatatgaaataaagtagcagataggatctgacttgtaaatattttatagcttaatcctagcaagctaggcagctttgcatagtgcttcactgaacctccgttttaacaatagttgccctagacacacatctcacttcagtggcttctgaagcttgactctctagttgcctctcgtatctcttggctgctggcagctttgtgctgataggcaacacagaccccttcctgctgtctggatcttcacaaagtgaacacatttgtgtggctatctggtgcttcttggctcacgtcctgctagcgtctttgtgaccattttggtgttcaaaagagagatgatgatatcacagatgttaaatttatgatgaataaaaaattataattcagaccacacatgaaatgacttcccaacttgtgtatcagctgttccagctgccacaggagagtaaatctcagttgtagaagctaaagattgattcctgtttttgctggctacgactgttgtgtctctatttaatcctttgatgtgcaaaacctttgcccctatgtaggggaaagaatttttgtttttagcttttaaaatctagcctctctttctgcagatattgcagtattatctaatatcacgctcactccattaataccttcaagtgaaagtttatattggcatctgttatatttattatttcggagtcatactctggtggaaaagaggtctgagcaaccctgatagaatatagataacgcataacagtcatttcaggggcttgaaactgcttttccactatggtggaagggacgatccacccaactagccattacctttaccaaaaaataatccaccctggtctgcccattagaggaaggtgtcttgtcttccaccaaaaggaagaggggttgtctgaagttttacttcagtgcttggtttcaaaagaaggggaaaggccgggcatggtggctcacacctgtaatcccagcacttttggaggccaaggcgggcggatcacgaggtcaggagatcaagaccatcctggctaacacggtgaaaccctgtctctactaaaaatacaaaaaattagccaggcgcagtggtgggcgcctgtggtcccagctactcgggaggctgaggcaggaga

SEQ ID NO: 53863 - DNA, 4236 bp, Homo sapiens
ctctattactaaattggagagtcataagatgacttttgaaaaagctgtttacagatcagatttatagatattctgggcaaattagcctttggtgtgacttttgttaacttgaaagaactttcaggccaggtgtggtggctcatgcctataattctagcactttgggaggccagtgcaggaggattacttgagcccaggagttcaagaccaacctgggaaacatggcgaatctgtctctacaaaaaataaaaaaattagccaggcatggtagtatgtgcctgtgtcctagctactcaggaagctgaggtgggaggatcgctggagccccagaagttgaggctgcagtgagccgagattacaccactgcactccaatctgggctacagagcaagatcctgactcaaagaaaagaaaaggaaagaaaaagaaaaggaaaggaaaaaactggggaaaatggggtaaggttaatatttttttcctgtatatgttcacaatatagatttggtatgttcagtcaagtaatacttaaaatagtaatgcagtaaaactggatagattctaatgcagtaattaaaattgccaattagaaataaaatgtgaattgatgagttcattcaaaattgcttagagttagataaattgacgttgaagatgaagatattcatggggggggaaaaagagagactatatcgatctgacagaagaagatgtataaagctctttgagtggagcttgaatgcagtagtaaaatcgaatcttgagactataatcataaatggaaacaatctactgagctttgggtaaatgcgttaaacaaaaatttggtatgtgtagaatttgaaagcgttgctgctagcctgcttggatcaggttgcctcttcagcactggatctgttgttttacagaagaaactgcttttcagacaccaaaatctagccagatgcctcggccttcagtgccaccattagttaaaacatcactgttttcttcaaaattatctacacctgatgttgtgagcccatttgggaccccatttggctctagtgtaatgaatcggatggctggaatttttgatgtaaacacctgctatgggtcaccgcaaagtcctcagctaataagaagggggccaagattgtggacatcagcttctggtgagaattatatattttttaagattttaaatgtcatgttgcagaggatcagacagcctaagttcttatcttgccttttcttttttaaaaatagatcagcaaatgactgaattttctaatccttctccatctacctctattagtgctgagggtaagacaatgagacaacccagtgtgatttattcatggattcagaataaacgtgaacaggtaggatgatatggttataggatttatatttgcatgtaaaattgagaacattaaggatctcacatgagtaagtcatcaggaataagaagcttttttttttttttttttatgcttcgtgtattgactcaaatgaaacagccaatatttgactggtttgagctatacacattgtaatttcatatgacttgacctgataacttcatgtaagaaatatttgagttctttatatatccaaggtgtgcttttaggcactgggaaaaaagcaaacaaaacagagtccttgcccatgtaatatttacattcgagtgaggggaaatcagtgagtaagcaaatgtattatattctgtttctctgaaatataaaatatcattaattataagacttatgtgctattaagaaaaaagatgccttaacccatgacgtgctattgactgtaagatgcatctcaacaggtcatattcaagatatggaaaacatgcataagaaggaagaaatttgatataagtcttaactagaaaaacagagcaaggaagacagagagttcctaagggagagggtatcattttatgtggagtgataaggggaagtctcattgataaggcaatgattgatcagagacctgaagggagagctgggagcagcccagtgcatctgagatgggaatggccttggcttgtgtgaagaacaatgtggataccagtgtggctggagcagagtgagtgaggggagagtggtaagtgggtgataagatcagaaaggtagcaggcacccagggctcattggctgtagtaaagactggcttcatctctgagtgggatggaaagtcaccgtatggtcttgcccacaagaatgatatgatgtaacttatattttgaaagtgctgctctaggggctgtgttgggactaaactcttgcaaggtaggcatgtaagcccagagacggtgttaaggtgttaagtaatctagtgggagatggtggtatctgggaccagagtggtagtggtgggggctgtaagatgtggtcaaggtctaggtatgtattttaagttagatggaataggattagcttatggtttggttgtggtgtatactagaaagagtcagtgttcactggtaaggtttttggcctgaagatctggaataatatagttgcaatttattgagttggaatttactgatgattctggagaaggagatttgatagaggtgaggggagggaaatcaggagtttgattttggacaagccaattttgagatacctatgagacaaccaggtgaaaatacttagtaagaaattaggcatatagcggtagtgtaggggaaagttctgggctagaaatgtaactttggaagttttcagagtatagatagtattcaaagcatgagactcgatgcaaactcttgaatgtaaatacagaagaaaagagatatccaagaaaggggccctccaatggctaaaagtttgggagataaagaatagcaacagagactgaggtgggtagaaatccaagaaaagaaagagtttcaaggaggagaaggtgggagtgtcagatgctgctgatgggtagcatggggcgggaactaagaattaactgttgagctagaaatgcggaggtcactgagtccttgacaagagctgttggctggagtagtggggacaaaaaaatgcatgagttcaggagagattggtagacgaattggagaccacaagaaaaaccacatttttcaaggaatttgttgtaagtggaacagaaaaatggggcaatagctgggaggaattgaggggtcaaggaacttttttaaaaattttgagatgggttcttggtctgtctgttgctcaggctggagtgcagtggtatgatcatggctacactgcagccttgaactcccgggctcaagtgatcctcccacctcagcctcctgagtagctgggactacaggtgcctgccaccatgcctgcctaatttttttaatttttattttttgtagagacacagtctctatgttgcccaggctgatctcaaactcttggcctcaagcagtcatcctgcctgagcctcataaagtgttggaattacaggcgcgagccaccacgcccagtcatgtttttattttttaagatgggagaaattataacatgtttgctgatggaatgactgattaatagggaatgaatggttaaaggcatttcataaacttcgggatcccatacggctctatatgccattagtactgccgtgtcactttctacccaaccagacacgtgctgcttgctgcagccttctgactagtcatgcagctttgggtgagagtatggtaggagcagattcacttttaagttagttgggttagcttttagctgatactaagaacactttttcccccggaattgtcaactagtagaaaactactttgtgtcttaagatattttttttcctgtaatctcagcactttgggatgccacagtgggaacattgcttgagcccgggaattcgagaccagcatgggcaacatggcaaaaccccatctctactaaaaatacaaaaattagctgggtgtggtggtgcattcctgtagtcctagctacttgggaggctgaggtaggagaatcacctgagcccagaaagcagaggttgcagtgagctatgaatgtgccactgcactccagcatgggtgatagagtgagaccctgtctcaaaaaaaaaaagatttttttttccctgtgagagaaacatactctttttttgggtattaaaaggttaaagggcaggacagttatagagaatcgagaaataatgtggccttgaaaaatatctccagtctgtaatcctagcactttgggaggctgaggtgagaggattgcttgagtccaggag

SEQ ID NO: 53864 - DNA, 5441 bp, Homo sapiens
ttaaagaagttgtagtaattttacaaatcaatctaagtaagcataaatggtttagattgaatttgcaagttgaaattttaaactagatctacagtatgtgtgatcctgttaaaaggtcctttaaaaagagctaaaagaggctgtgtgtggtcttcagcactttgggaggccgaggtgagaggatcacttgagcccaggagttcaagaccagcttggaaaacatagggagacctcatctcaacaaaaatttaaaaattagttgaatggcatggtggcacatgcctgtggtcccagctacttgagaggtggaggcaattgcattccttgagcctaagagttggaggctgcagtgagctgtgaccctgccactgcactctagcctgccactgcactttagcctgggtggcagagtgagaccccatctctaaacaaacaaacagaaatgctaaaagaaagtagttagaacccagttttgatcacactctaaagaatttataaacaaataagaaaataaatagaattacttttaaatattaattataactaatttgttagagaaacttaaaagtatcagttactcatttggttactcaccaaatatttatttagtggtacgtcagtctctgctagttgtttgtggtagaatgatgaataagacatagcacagcctagtagaaaatacagacgcccaaaataactaaaatgtactgtggcaaatacattgggacctcttattcagcttgggaccaatgcaagaaaacttcagagagggatggtatcttgaaggatgagtaaaggggtttgcctgggaaaagatgaagattttcagtaaagaaaaaaaaaaaatagggtggccgggcatggtggctcatgcctgtaatcccagcactttgggaggccaaggcaggtggatcacttgaggtcaggagtttgagaacaacctggccaacatggtgaaaccccatctctactaaaaatacagaaatcagttgagtgtgctggtgtgtgcctgttgtcccagccactcgggaggctgaggcaggagaattgcttgaacccgtaaggcggaggtagcagtgagccgagatcacatcactgcactccagcctgggcaacagagtgagactttgtctcaaaaaaaggaaaaaaaaaattaggtatcacgtgctaggcactgcctttggatatggtagcaagtaagattttccgttttcttgtgggccgcacagtttggtgggtggaatcagatgggacaagtaaacattcaattacaatacatgatgttagtgccattgttgagagctatgtgagtgtatgtttgtgtgagggaaaccagggaaaattccaggaggaagtgatgtttcaatttcccaccgcagatatatgaaagagcacagagaattctgtagttccttgtagctagaacttgtagtaggtagggagggtagaggcaggaaagttctggaagtctagaaaggaaggttatggttctgagattttttttttcatgaaaaagtttaattaatttcctcttggatatataatgatgaacccaattagtgagattttatgtagaggttaaaaaaaattaaataatatgtgttttttccccctgttagtatttagccttgcaggacctgatgttgctttctcaatattctccttcacgaagacaagaagttttcagcctcagccaaccaggtattgctaaaagtaatagacttgattaggcatatgtgtgtagaaagtaattcacttggccaggcatggtggctcaagcctgtaatcccagcactttgggaggccgaggcaggcggatcatgaggtcaggagatcaagaccatcctggctaacacggtgaaaccctgtctctactaaagatacaaaaaattagccgggcgtggtggcgggcgcctgtagtcccagctgctggaaaggctgaggcgggagaatggcgtgagcctgggaggcggagcttgcagtgagccgagattgcgctactgcactccagcctgggtgacagagtgagactccgtctcaaaaagaaaaaaaaaattaattaacttaaagtttttggtgagaaagatgtatttaataaaatatcagatgtcaatgagtccattaaatgaagtattgaattaaatcttacacagcttaagagtttattaccttcagctccttcatttccttaacctgaagaaattatttagtacactgacaattttagggcagaaaaatacagcttaagaattctaaaagtttggctgggcgtggtggctcacccctgtaatcctagcactttgggaggccaaggtgggtggattacttgagcttaggaattcgagaccagcctgggcaacatgatgagaccgctcttctacaaaaaatacaaaaaattagcccagcatggtagcatgtgcctgtagtcgcagctacttgaggagctgagctgggaggattgcttgagcccaggaggttgatactgcagtaagccaagattgtgccactgtactctagcctgggtgacaaagtgagagcctgtccccctccccaccccaaaaaagaattctaaaacttttaatgctacaaaggatcttaaaaattaggtggtctactctctagatgggagatttaagtctcagagattggcttaaataaagttaatgtcagaattggaataagagtcctgtcatttggctccatgtacaggactcctccttctgctatgctactctgcctccttttaaaaaaaaattaggaagaaactagattcaatggtgactcaaggatgctctcagcaactctgaaacacttacagtgtatactgttcttgccatgctgttcaagactgtgactttgccagttctctgttgttcctagagggaaaacagtccagtcccaggcactggtgggaaacagagaacctgggtagcctttcttctgtattttaagagacagggtctcactgtatcaccaggctggagtacagtgtcatgatcacagctcactgtaacctcgaactgctgggctcatatgatcctctcgcctcagcctttcaagtagctggtattataggggcataccaggtgtgcaccaccacacctggctaatttttaaaaatttttgttgaaacagggtcttgccgtgtttcccaggctggccttgaactcctggggtcaagcagttctcctgctttggcctcccaaagtgttagaattacaggtgtgagccagtacactcaaccagcttttcatcttttttttaatgatttcttcattagtttgccaagcttgccaattaccagataaaataccagataataaaccttctatagttaaatgttatatggaaatgaaatccagttatataaaaatgtaattgactggaaccactctccttttagtaacatgagaaacccagagctgatactgtggaaaattaactataacaatgcttttctatcagatttgagttaacataggaattctatactctaaatgttttttaccagatattcaagtaaaccgtaaaagggtggcatttgctctgccagagagtgtacattctagcacataaaaaaaatttaattggatggacgcagctcacgtctgtaatcccagcactttgggaggctgaggcgggaggatcatctgaggtcaggagtttcaacatggtgaaaccctgtctctactaaaaatacaaaaattagctgggcatggtgttgcacacctataatcccagctactcgggaggctgaggcaggagaattgcttgaaccccagaggcagaggttgcagtgagctgagatcctgccactgcactccagcctgggcaacatagcaagattccatcacaaaaacaaacaaaaatttaattggatggttacacagttcctcatgtacccaaattacagtagtacaaaacatcctgaggcctagtgatagagtattgtgtgtgtgtgtttgtaggttaagtggtattcctgagttttacaatggggggagtgtttaaggagagatccaagtgaagagggaatgatcatttggcacataggatagagaaaccagttttcagtagacttctctgctattaacgcataatggagcatgcttgatttttatataataactctaggcgacaaagatctactatgagaaataagggaatttttaaaggaatggggacacagtagtttaagttaaataataagataatctgtaagctctctgagtgtaaagtgtgatcattattaacgagtcattcccacagatgtaacagcaaataggggctgttatatacatgaaaatgtaaggaagcccagggggtcagacgcaaaagtttagaggtcactggggaccatggaggtgcatctcactggacatcgtagtgttcattgtcttagttcattgttcacagtcatagcagtctgtttaatactgctagtgaagtaaccctggtctttctcgctcaacctatgatctagtgtttggctttattttagcgaccaatttgagaggttttttgtttttttttttttttggtatgtgtgtggtaaaatagcaagtttttgcttgtagacttttgggaaacttaattcatccaagtattcattgaactcctgctgtgtattagatgtcatgagtataaatagtagcttcactaagaaaagtgggtcctgatgccaagcataatgtagaatttcttactgactttttcccccacttcaagaggggaatgtaagattatttacattttaaaagctggtgtttggacctcctaggtggacatccccacaattggacagccatttcaagggagtgtttgaatcttttaaatggtatgactcagaaactgattctctatcaagaagctgctgctacgaatgggagagtgtcttcatcttacccagtggaacctaagaaattaaattctccaggtaatccctaggactactaagaggggaaaacatttacattttatttcctaagaaagatgactgtagtagactgggcgctgtggctcacgcctgttatccccgcactttgggaggccgaggtgggcggatcatgaggtcaagagatcgagaccatcctgacccacatggtgaaactctgtctctactaaaaatacaaaaattagctgggcgtggtggcgtgcacctgtagtcccagctactcaggaggctgaggcaggagaaccagggaggcggagtttgcagtgagctgagattgtgccattgcactccagcctggcgacagagtgagactgtctcaaaaaaaaaaaaaaaaaaaaaaaagatgactgtagttaattgaaggatacttatatgagtgtgaggtgtatatttttagggaaaattgatccaacatatagcatcttatattgaaccaagaaaatgacgtgggtatcattgtagattgaaaaaattaagcccaaaacat

SEQ ID NO: 53865 - DNA, 2383 bp, Homo sapiens
agcagtctaacagagtgtcttaaattgctttaacattgtttagtagcatgtgcttttaacgactatgaatctgtggtttatagggcataaggataaagctgaaatctggtccaggagaagtactagtcatgtttaatggttttgaggtattagactacaaagcaacaataataaactttcacccagctgctcgtagtgaggcttataggcttagctcattcctccttcgtagtaaaagtcagtgaagattttgaacacaggaaactgtagccccgatttaggtctgttcttcccttaaagctccctcatgtacctcataagaaagtattagggaaagagctttataaagatatcgaaggagaggagtctgtcaacattgttatttagacataatatttgtgtctcaatgtggagacttaagtgtgttaatatttagattgcatttttcctagaggattaatagtaatttctgcattcacaggcaggttcataggccacttgacacagtgagtggcctcttaaatctctcgttactctaccatgtctggctgtgtggtgtctttctcctgacgacttggtatgtctcatggatactcttcaaaatctatgccacagaggtatgttttttaaaatattttttcttaatacttttgtgttttggagtgcacagttgatttttagcagagcacactgatcagcacacgcaaaaccatttccgtaagctggtttttggtctctcttctgagactcttggggccatatcatttgtaaccaccatttatgtggtattttttttcagaggaacagtgtggatattcacttaatttttggagattaaactgaatggactgccactatgctttattgacatcctagttgtcttctgggggcttccatttctctactgagtacatactaaatggacttgaattttaaattaattttccatgtcattggcatagctactattaaaatatttaaatatgtggcagtaagaattttttttttttttttttttttttttttgagatagggtctcgctctgtcacccaggctggagggcagtggcctgatcttggctcactgcaacgtctgcctcccaggttcaagtgattctcccacctcagcttcccgagtagctgggactacaggcgtgtgccaccatgcccggctaattttttttgaattttagtagagacagggtttcaccatgttggccaggttggtgccgaactcctgacctcaaaatgatctgtcctcgacctcttaaagtgctgggattacaggtgtgagccactccacccagccaagatatttgttttctgaagggaagttttaaaatttatattaaagaaatgattttggaaattgaggtgagcttctggataattcccacagaaatctttttaagtgattgagaattacattgtttttatcatccaagtgtttgtcttagaaaattagtgtttctgttttattttacaatctccgtaggtttgtattcttcagtggcttcagagaatccttgtttgtgaaagtggtttttattattcagagacagagtctaataaagttgggaaagtaacattaaaaaaaatggtgtgtttgggtttatgtaactttaacctgtctttgcaaggagcacgaaagatgtcagtttgcttgtgctgtctgtctttatgttttaatttgtgcatgcttattgaatgtaagatcatgaaaataatcatttttggtttttaatttatttgataggctcatgtgtttcctgttcaaccaccatttgcagaagggtcagatgagtgccttccaaaagtgttaaatagcaatcctccccccatcataaaggtatccaaactgtgttgcatatcttcacacagttttctctaactttattcaatacacttaatatttagtatatttaagtagttgtattttttgagggcctataatattcttgtactggtatgataaaaatcacctacttgctaatgctgtttattttttcaattttctttccaagtgactaaaatgcaagtgcacagtacagtgtatgtgtataagctagttaattctatattcagaaacagatataagaatatttccaagcataaaatacagtgatatgcaatcatctacattaacttctcacaaactattcatgatagcataacaaaatattattgattttttttttttgagacggagtctcgctctgtcgcccaggctggagtgcagtggcgcgatctcggctcactgcaagctccgcctcccgggttcacgccattctcctgcctcagcctcccgtgtagctgggattacaggcgcccgctaccacgcccggctaattttttgtatttttagtagagacggggtttcaccg

SEQ ID NO: 53866 - DNA, 1545 bp, Homo sapiens
ttggcctcaagtgatcctcccaccttggcctcccagagtactgggattataggcatgagccatcacgctcagcctcattgcaatgtattgacctactacatacagtcagcctggttgttcctctagagttgtttatttgggctatttttgtgactatgatcatttccatgatttgctctttctcctataacttcatttatgttcaattcaaatttcgttttcagcattatcacttttcatttctttgttgcactttgattttttttttttttgccagtttcttcttttttttaattaaaaccattttattttttatggaacgcttcatgaatttgcatgtcatccttgcgcaggggtcatgcgcaattccccttttagtatgcgcaattccaattttagtatatgtgctgctgaagcaagcactactttcctgttttagctattcattttttaaaagtatcatttggatttattgtgggaaacaaggaggcaacacaactacatgctttgctgtctgtgtctgtactgaataacagatccaagtgaccaatcagcaacagactttgagagaattgatgggattgggtcacagattataatgcacatcggttatctacatattgatttgtgtcctgaaaagttagaagtgctatatgcagttgcttatagttaatataccacagtaactagagtttgaactgcatttttgggtgactggtattttttaactaaaccatggtaactgaaatgtgtatatatcagaactgtacaaagcaaagactgcctgtgttaataagtactgtcttttcctactcattcctaataagtctaacattttgactgaggtcttggtgtctgtgtggccatgtcattgaccttatattctaaagcttgactaaaacttgttttataactttttatgttcatagcttggtattttttcccttcaggctatattcccaaagcttggattagcactgctatgaaccttcacatagatgagtaagtgatacctaaaaagtctaattttaactctgtttccattcttttagatgtttgctattttccagatattttgtttagattttgcctttaacatttttttaaaaattgtattcatttttgaatacatatagtttatatggtttaaaattccaaaggtgtataaaagggtaaaattagcaggacttggtggtacttgcctgtagtcccagctacttgggaggttgaggcaggaggatcgcttgagcccaggagttcaaggatgcggtgagctataattgtgccactgcactccagcctaggcaatagagcgagaccctgtctcaaaaagaaaataataataatagggtataaaatgaaaaagtctcctcctctgtctccactcacccagttctccgcagaagtaagcaatgataattgttcttagatgcagcttttatactatacaaaagtggctttctcgagttgcatggaccaggcctctgtttcgtttttctccccaacaatcattccttctctggtgtctcatgatatataccaatg

SEQ ID NO: 53867 - DNA, 2061 bp, Homo sapiens
gttacgaacccctgacctcaagtgacacacctgcctcaggcctcccaaagtgctaggattacaggtgtgagccaccgcacccagccctttttcttttcttttcttttttttttaagctcatcagctatcattagtattttatgtgtcacccaagacaattcttctttcagtgtggcccagggaagccaaaagataaggcacccctgtcttagatcattagaattttcaggttcccactaaggaactatttagctggttcagctttcttgtctttcacataattagagaggaggcatgacttactgagggttgtacagaaagagggagcactagaactcacaattcttgattcctaggctagtgtcttcttcactgcctcccatttttttgcaaagagcatttttaaaaattcagtgcaaaggcagtatgcattatctttaagattggaggctctgaagccagcctgcctggattgatagctcagattttccttttgctggttgataacattggttgttatttaatctctctgtgccttgttttcttcatctctaagatgagggtagtagtaaaaactcccttacagggttcttatgaggtttaaatgaattcaaatatgtaaagtgcttaggacagacagtacctggtacatggtaagcaacaaaaaaatgttagctgctattgttactgtgtttcttgtactttcttcatctgcatagtgcttagtaccaagtatggattgatatggttaattttcttatttctgattttatatcagtgagatgttgaataatataaatattaattttttaacatctgaaatagttgatgtttttgcttctgcaatactctttgtcttcttatacaataattatgttttctatgtagactgttacagtaaagtgcttgctttaaggtgatgttgagtgtatcatttgatttgaatgtgtcatttgattcttttttttttccccacagcaatacaagttcttgcgttttaggagatctctgctcttattagttaaacacagttgtgtggaatcactgttcctggttagaaatttctgcattttatattattttcttggtaagaatttctgctttttgatacagtgatatattatctcatagcccagaaaatgtcagttacaaagtcattcttgtgtttttgtgttttctacagttataggtatgtgattagctcaactgattcattgtttaaattgtcaaagagaatgtatttaggaaaatattgttgaagaaaatgtgacatatgcctataacgaaatattatttagcctttaaaaagaaggaaatcttgttatgtactacagcttgaataaaccttgaggacattacgctaagtgaaataagccagtcacaaaaagacaaatactgtatgattccacttatatgaggtatctaaaatagtcaaactcttaaaaaacagaatggtggttgtcagcctggagagttgggaaggggtggagttgttcagtgggtatagagtttcagttttgcaaaatgaaaagttctagaaatctgttgcacaaaaatgtgcatatagttaacactactgtattgaacacttaaagatggctaaaatggtaaatttttttttttttttgatgatctgtcacccaggctggagcgtaatggcgcgatcttggctcactgcaacctccgcctcttgggttcaagtgattctcctgcctcagcttcccaagtagctgggaccactaccaggcgtgcaccaccatacccggctattttttgtatttttagtagagatggggtttcaccatgttggccaggctggtcttggactcttgacctcaggtgatccgcccacctctgcctcccaaagtgctaggattacaggcatgagccaccacgcccggcctaagatggtaaattttatgtgtaggttttttaccacaattaaaaacaaatgcattctttttttaagaaagaaaaaatactgtgcatcatttggtcattactctatctagaaatgacatcctcctttttataatttgtaacttgatactaatacaatgt

SEQ ID NO: 53868 - DNA, 1060 bp, Homo sapiens
agattctttgttctgtgagttaccaggagtgtaaaaaatacaaataataaaaaagatgaaaacaaaatcacccaaccaaaaaagaacaggaacaaaaataattcttaatgatggacccatagggaaaagcagactgttagtatgaagtagggcacaaagaaatggacatcaagacaactatgccaacaagactgttgaaagtattacatttatagagcatttagcatagtgcctggcacacagtaaatatttagtgaagggtagttcatagctacatcacagaagaaatccaacagagaattgaaaaacacttcagcatgggagcaagaggtgggggaaatggtgttttctgcctgtctgctgaaatgtcgacctgcttccctagcctctctgaacctttgtgaagaatggttgaggtgaaagctatagtaggaatagcataggaactatggcgtttttattggggcaggtgtgtggtggtggtagcacccagtggctacacagaatagtgcaattccacatcttgtactttgaaaatatttgaacagaccaatataattgaagcaatatgattagtgaccaagtatttatatgggctactttttgtttgtttgttttctttttgagacagtctcgctctgtcacctaggctggagtgcagtggcgcagtctcggctcactgcaacttgaactctcaggttcaagcagtcctcccagctcagccttccaaagagctgggattgcaggcgcctgccaccgtgccttatcttacatatattatttttgtatttttagtagagacggggctttgccatgatggccaggctggtcttgaactcctggcctcaagtgatctgcccaccttgtcctcccaaagttttgggattacaggcatgagccactgcacctggcctgggctgctttttgtaagatactgtaggcatctccattcataatatgaagatatagtttctgaatactataattatttgctgttcttcagcttctgaaattccttaaggaagaatcagtcgtaatataagcataaaagaagaccagg

SEQ ID NO: 53869 - DNA, 1124 bp, Homo sapiens
agctggggctactggcatgcaccaccaagcctggctacttttgtattttttgtagagtggggtctagctatgttgcccaagctgttctgactcctggactcaaacgatatacccacctcagaatacaggcatgagccactatgcctggctgagaccctatctctttaaaaaaagaagagaaagaaaaaagaaataaagttttcacatgcctgttgcatccatgagaacaagctaatgaaaatacacacacagcagggagatggtgcccactgaaaaggatctggccctcacctccctgcaatctgagtgtatgaaaaaaaagtcctatctagaaatccttcatatcttgtgaagatgaattaaaagcaggatgtcaacttggctacctcaaaatttcacaaggagaaaaactccaaaatcttatatagaaatgtccataataaatcatctttgattctaacaaaattaagaatattaaaaataaaagaaagtgttagggaaaaatgagatgccccacaataccttgctggacctccatggtccccagttgaaagtgaccatgtatttaacaccacagatatgcagtagagtgcacatagaagtctgatagttgacaatgctgataaattattgtttctaccatgtactgtaaaaatttgtaaaattttagtactttctttttgtaatttcttttggtaaaatgttagatttattcttaatcccaaaagtttattctatgatggtaatattcagctttggcttcagctttgacagagtattgatttttgataattggtaattcagtatttggtcaaaaaatatatatggggcatgtcttgtagccatgagtgtatagtggtattggtttgcccaggtgggcgctgttctccagcctggggatggttggagcaggtgttttgctgggtggtgtggtggaagggcagtggaatgaggaagctgaagatttggcaagactagtggaaatgatagctcttggtgcccagaaccatagtttcctgcctatcaggtttgtaagtgtcttgcctggcagggtaggtttgcctcccgagaagactaagagggagggaggacaccgtagcttatctttctttcattagctctag

SEQ ID NO: 53870 - DNA, 1071 bp, Homo sapiens
gacatgtatgggactctatctgctttaaaggccttgtgccccacaaaatccagtagcatctcttgtagcaattttatgggcacaggatccccgtgagggaatactcagttttaaagagataacacaaacccaatgttatggcatctctatcaggtatatataacttatttacagttgctgtcagcccagacacttgtaagcaatactgcttgttattatggtagatatacttaatcatgtcagatttccaggggaacagaggtagaattaattaaagatcagagtctcatgattcaggaaaaaaggttttgttaatcttgttcacacttactgaaaacgagccatcttgttagaatttgggacatttcttaagtcattaaagtaattaagctttgccttcagtaaacattgagcctaaaacagtgatacatgtccctgactgttgaattaataacttaattttttcccttcagctttggtagccctgctgcgcaaacctgcttaaatgaatatcatctttttttcctactgactggagcatttatgggctatagctatagcctcctgtattttgttaacaacatgaactatcttccatttcccatcatacaggtaagatcatttgagcattacttgatgtcaaaatttggctgaggtaaaattgccttggtgcatatgtatataactggatttatctgattcattcaagatttgataaccaacacttagaactgaaatcctcaaaatgccatttagcgagaagagatttgtcttcatgagacttaagcatatttttgagagttgcagctaccttttcctgttgccaatctcagaatacctctttgctacactgtttccctccctgctaggtagtggcacttgctgtgacccagcagggtttggggaagatgatgatgacattcatgcaaagtactctgtgtagcttctttttttttggagacagtctcgcttctttgcccaggctggagtgcaatggcgcaatctcggctcactgcaacctccgcctcctgggttcaagcaattctcctgcctcagcctccacatgccatc

SEQ ID NO: 53871 - DNA, 1130 bp, Homo sapiens
aactccgtctcaaaaataaataaaataaaataaaataaaataaataaataaataaataaaaagtcagtattcaggagctgaacccagtcactctcccacactgcaagaccattacagtagtccatatatgaaaaaaaaaatcattattcttttatggtgcttaggagaatactaggataggcactattggaactattaggaaattttaatgaaaaatgttgatcatgctgtccttaggtttcatctctagattctttgggtttttttgtgtctgtttattcatgctttcctcaaatttttttaacttagaatttttaactttaaatttttctgtattgtatttgcgttgactgtggatttctctctgcctttggaacatttgtgcaaggatgagaggggatagtttagatcctctaactgcatatgctgtaggttataaagccacagtaatgtgtttcctttgcagttgtgccttctattccttgctccagactagctctgatagggaagatcattcatcctcagcaactcatgcactcatttattcatgctgcaatgggaatggtgatggcctggtgtgctgcagtgataacccagggccagtacagctttcttgtggttccctgcactggtactaacaggtaatattaaatatatatttccttaggaatctcatttacttactaagccaaaggtgacctatataggttaatcctatgagtattctttgctttccagacttctgcaaaaggtgctttttgcatatatcaagtgtttttaatattttgtgtttattgatttcagcaattaaaaaaatttattatgtgcaaggtgctatgcgatttatgagagtgactcaaacatagactataagctctttgagagttgagaacaatagagaaattaagacatggatgcagagggatgtaataggatgaagaaagtgagatgtgcagacaaaacctgtggaggttcagaaaacaagagggatccacacatgttcttggaagaggtagcatttggttggagtttgaaggaagggtagtatggaaagaatgaagaaaaatttttaaaaattataactgcctttttatagagtgcttttataattttgaaacttgtatagttct

SEQ ID NO: 53872 - DNA, 1191 bp, Homo sapiens
atgccaccatgcctggctaatttttgtatttttagtagagacggggtttcaccatgttggtcaggctggtctcgaactcccgacctcaagtgatccgcttgccttgacctcccaaagtgctgtgattacaggtgtgagccactgggcccagcctcgctttctttctttttttttgagatggagtctcactctgttgcccaggctggagtgcagtggtatggtcttggctcgctgacgcctctgcctcccgggttcaagtgattctcctgcctcaacctcctgagtagctgggattacagttgcctgccacctcgcccgtctattttttgtatttttagtagaggtggggtttcaccatattggccaggctggtctcaaactcctgaactcatgatctgcccaccttggcctcccaaagtgctgggattacaggcatgagccactgcactcagcctgctttcttaattcctcactattgactagtaagctttttccatgcaagccctattcgaaactccttggcttacagccacacttaaacagagtgttctttcatactctcccatatgcttgggtcatcttctgtatgtaatatgtcagttgaggggtccccagccagtccttcttaaagcctgactattcactttggctcattccttcagtaaccatcccttatgcatttactatatgccatgcattgtgtggagagaaaagagaaatgataggtcccatctttctccagagatcgtgattaatggagagacagtaaacatgaagcatatttgattacagtacattggatggtaagagcttgtataggagcaccacttgccccagcatgggggaacttgaggagatgatccttaaaccaagccttgcaggatgagttgaattaagtagacaaagaaggaaaatgatgttctagagagaaggtatagcatataaaaaggcttagtgacatgagagggtttggtatatttagagtgttataagttagttgcacagtcagtaggaccttgtgggcatttctggttgggagggagaggtcataggaacctcttcctcaaagtataaagcacctgaaacttgtcccttcatacttaattttctacctcctgccatctctttactttgagtatagtaagagcaaaatacctacatagatagatcagggaaccctaggctagctgt

SEQ ID NO: 53873 - DNA, 1031 bp, Homo sapiens
gttcttgagttgatatctcattgaacctgtcagtggtgtacaattaaattcttgaagaaaagataacctttaaaattaatgacaattgtggttcaagctctttttatattgcagtgtcctgaacgtgactacatgactgaataacctttactaattcatctctcttgtgttttagattctttcagtgacctgtatagttcctatgtaatcttttacttcctgctgctgtcagtggtaataataataataagtattttcaatgtggagttctatgcaggtgagttttcaaatgttaaccttcttagaaatatgcgaatttatttaactaagggaagacttagtacattttatatgtgaatgtgttttgtgtcaaaaatttaaaaacgtatacagaatcatatgcttcaaatgttgtaccttaaaatttatttgggtgctagtttctgttttaaaaatatttttagactttttaggacaaatattatatgattctacttatacgaggtatctggagtactcaaattcatagagaaagaaagtagaatgctggttaccaggcgctgggggagggggagtggagaattgctgtttaatgggtagagttgtggaagatggaaaagtttgggagctggatggtggtagtggttatacaacaatatgagtgtacttatgccgcagaactgtgtacttaaaaatggttcgaatagtgaattttattattttaccacaataaaaaaatttagaccttttaatagttcataactagtattaaagctgtgatttagcagatacattatgaaaagaattcctttatagggaagaccaggtgatttctaagtttttttttcaaatataataatctataatactgtgattaaaaaaaaacttatgttttgccttggagaatcacctgctggattccagagcttttaatttttctgtttctcttcatattctttctgccttttcagattccttgagactgcctttaagatacaagttgtggcagattcacataaggaaaaaaagat

SEQ ID NO: 53874 - DNA, 1062 bp, Homo sapiens
caggagtttatgaccagcctgggtgtggtggcatgcacctgtagtcccagctactcgggaggctgaggcaggagaattgcttaaagggggagtggggggtggaggctgcagtgagctgagatcacgccacttcactccagcctgggtgacagagtgagactccatctcaaaaaaaaaaaaaatttaggtcaatgaattgtacttttaaaaataagtggttaatttttaagtcttagcaaacatgctcttatttttatttcattcatatttttaggcattatatatatatattttaaactttgagatggaatatcgattgttgaactactctaaaatgtgaatgtattagtatttcatgggggcatcctgatttttttgtttttgagttccgctcgtttagatgatgtaatgtatggcttattctatttccaaaaatgttactttagctatatgaggtaattgcatttatgaagaagagatctgaaaagtattctttatattttaagaaaaaactttgttggtatattactaaagatgatacttctctttcacatgattaaatatttgcatatgcgtggctgggtgtgatggctcatacctgtaatcccagcattttgggaggccgaggtgggtgaattacttgaggtcaggagtttgagaccagccttgacaacatagtgagaacccaaaaaatagccatggcgggcatctgtaatcccagctactggaaggctgaggcaggagaattgcttgaacccaggaggcggattgcagtgagccaagattgagccactacactccagcctgggcaacagagcaatactctgtcttgaaagaaagaaagacagagaaaagaaagaaagaaagttttgccatgttctagtgttttgtctgatgttaactgggtcatttaagaaattgtagtataattttaaagtacctggggccaggtacgaataactcacactgtaactccttttttctccccccctttgtttttgaaacaaggtctttctctgttgcctaggctggagtgcagtggcatgatcactgctcactgca

SEQ ID NO: 53875 - DNA, 1046 bp, Homo sapiens
atatcttcttgtattattcagcagtaaatattttcctcctatatgatagatacgggcaattcaaacatgaatagaatgctacagtgccgtagttgcccagtaaaggttcatatctgatgattataaatacagttacagtatacaggtggttcccataaaatgtgtacagcctttatatattaatatagctatcaattaagcctagagagacaagtattagttgctctaaaacagctgtaaatcaatgcccaccacccctcatacaaagtatgatatttgatgttgcacctaactttgtactaatgcaggcatcagctcactgatactataaattctttagtggtacgtaatgttattactagtagtgaatgtttgagttacggattatgatctgagttagtggttaacatcctgtatgaaaagataggatttgcataactgaaataatttaactgacttcatgagtgagggtttttctttttgtttataggttttgggctggaggatagttgcaagtattgtttggtcagtgctatttctacccatctgcaccacagtatttataattttcagcaggattgatttgtttcatcctatacagtggctgtctggtaggtgatactcaacttggggagaaagttataggacctacttctcaacataaaaattgcattatgtttcaagcagtttattttcaattactgcctatgttatattgacacatcaaaacattcactttgagataattttaagatgtctccttcgtaacataaatcacctttttattatgtaataagattaataagcttgtcaaagactgtgatcataggaacgaaaagatcattagaagaccccataaatgaaaacttagtttcatttgtttttcctttgggcagctttattgagattgtttgtctctttaaaatacagaatggttcctgtcatcgattcgaaattgtgggtagaaaatatgacatgtacctcttttaaaaatacgtctaaaattaagagcacttgatttctttttttgaaacagagtcttgctc

SEQ ID NO: 53876 - DNA, 1027 bp, Homo sapiens
aggctgtacaggggaaccatgataagacgatgtggactcacatcactgagaacgagacaattcgagcccagctggagagggacagaggtagagaacacaatggcaacagtttcctgggtctctcttttggcccaaagtacctgacatcgccatgttgagggtctctctcaacctgcccctgagctaggacttaagttatttcatttcattttggttgtaaaggccttcagagagtcagagcagcatctgagaagagcctgcccctcagggcccttgaagacttagcagactggtgtacacagatttgacgcctctgcgctttgctcagatctatgaacttggctgttagagcctccatttgggtgtcaagtctccaaatgaggtagtgatgaacagcttctttgcagcctccctggcagaagcatcaattgctttgctgatagagaggctgtccagagccctgaatgctgctgatttacgagctggctgtgccttctactgtcatctctggactcccagctttcactgaaaaataaaggcttctaatctcaccagtaacctaccttccccatgtaaatctgtgtattggaaaacttagcctagagcgcattcccaggagagcattggaaggcttagcttagaacacattccagggagaaccccttctctccctggaacctcaggatcataggggagcttccagttacagtcatgcattgcttaatgatgggatgcattctgagacatgcgtcattaggcagtttcatcattgtgccaatatcatagaatatacttaaacaaacctagatggtatagcttacaacacacttatgtgggatagcctattgctcctaggctacaaacctgtgtggcatgttgctatactgaatacagcaggcagatgtaacccaatcgtaaatatttgtgtacctaaacatagaaaaggtacagtaaaaatatggtgtgatctcatgggaccaccattgtatacgtggtctgttgtcaactgaaacatcattatgcagtg

SEQ ID NO: 53877 - DNA, 1062 bp, Homo sapiens
ggtcctgaaaaatgattaatgttactgaattttatcttcctgtttttttctgtctttacctagtgggttatgattagtaagcccctgctacctttcgtatattgtttcaggactccactgtggagggttacagcattatagaaaatttggaaaatagcaagggggaatgggaggctggaaatcacccagaattttattaccctgtcacaaaaacttttactgtatttattttcttctagttgttgaccatatgctgtacagttagaataataatgtgtgaacaattttgtgtcatctttttttttaacttagtattatatcacaggcttcgtaagtacaattttaaaataacatttgccagttggcatacatttaaactaattttctttttcttccctctgtcattacacagtttgtcccctctgtaatacacaggggacatctatgcatattcctgctactggtaccttcaccttttttcttactttctaagattaaatttcaaggaatagaattactgggtgcaaggttgtaaacatacttatagcttttaaaatatattggctaattgctttccagagaaattatataaatataaaaatgtagtcatgcttcagggtagcgtattctgaggcaacattaaccaaaggaaacttctttattatgaaaaatactttagaaagacactttttttttttttttttgagacggaattttgctcttgttgcccaggctggagtgcagtggtgcgatctctgctcactgcaatctctgcctcccgggttcaagcgattctcctgcctcagcctctcaagtagctgggattacaggtgcgtgccaccacgcccagctaatttcgtatttttagtagagacagggtttctccatgttggttaggctgttctcaaactcccaacctcaggtgatctgtcggcctcagcctcccaaagtgctgggattacaggtgtgagccactgagcccagctgacacttttaaaaaattagaaactgggcatggtagctcatgcctgtaatcccagcactttgggagactagctttga

SEQ ID NO: 53878 - DNA, 1050 bp, Homo sapiens
accatgttggccaggctggtctcgaactcctgacctcaggtgatccgcccgcctcggcctcccaaagtgctgagattacaggcgtgagctaatgcgtccggccttgacctgggttttgaaagaagagtgggagatggccagataaacaagaaaaagggaagagtaggaaggggcattccaggtagcggcaatagaggcaaccttgaatgccaaagttcccaggcaactggtgagttttgcttttcctaaaccagccaccaggcctgcctggtaggctcataaagccctgggcacagcaagatgaagttacatgttacaaatggcattttaattggatttgcttccctgtgccttgcttttacagttgcaaccaaggcaatgtcttactacctcagctcagaaaaccacctggacccagggcccatctacatgcgagaaaatgggcagctgcacatggtcaatctggctctggatggtgtcaggagtagcctgcagaagccaaggcctttcagactgttccccaaaggcttttctgtggagctttgcatgaacagggaagacgacactgcacggaaagagaagactgatcatttcatcttcacatacacccgagaggggaatcttcggtactccgccaaatccctcttcagccttgtcctgggtttcatctccgacaatgtggatcacattgattcccttattggctttcctgagcagattgctgaaaagctgttctctgctgctgaagccagacagaaattcactgagccaggtgcagggctgagggctttacagaaattcactgaggcctatggaagtttggtgctttgctccctgtgtttgcgaaacaggtgggtgttctgattagattattcggtattttattgggtgtgttaattctgtcaagctctggggcttagtgggctcaggggcttccctcatcaaatagcacttcagtttagaacttccaaatatgaagtaaaagaccatattgaaaaaaatcactcttccttctcctcacctcttagatgacacttaactttattctga

SEQ ID NO: 53879 - DNA, 1040 bp, Homo sapiens
ctttcctcggtgccatagaaacttggtggcagaacaggattgaggccaaagactcttgactcctggccaactgatttttctagcacataccacctctttagggtaggaaaaacccttacacattcatccatgccactcgctgtgtgcaaacagagacacctttcatcatattcattgcatacttaaaggacatttgactcatctttattttccttgagtctctgatccttggtgtctgtcagctaggtccttttttatcagtgtttgcctgatgaaaagctggatgaacggataatttactcagattaaccagatattgactccaatggtaagaggttgacagagatcatttacaatttaaccgagcatccattgactctatggcaggacagtatgatgccaaaagaatagaaagagcagtggtttgaggtctgaggacccttcttggtctaccacttttactaccagttatataccttcagaccagttatttaaccactttgagcattggttttggcctttgtaaaatgaggataataatgaatgtcctggctgggcgcggtggctcacgcctgtaatcccagcactttgggaggccgaggcgggcagatcacgaggtcaggagatcaagaccatcctggctaacacagtgaaaccccgtctctactaaaaagatacaaaaaatcagctgggcgtggtggccggcacctgtagtcccagctactcgggaggctgaggcaggagaatggcgtgaatccgggaggcggagcttgcaagtgagccaagattgcgtcactcactccagcctgggtgacagagcaagactctgtctcaaaaaaaaaaaagaaataatgaatgtcctccctacctcccagggaagtgtattcattcaacaaatattttttgagcatctacaatgtgccaggcactacgcttatggccttgaggactcaatgctaagtgtagtactctctgacgtgagaaagtaatatataagaaaggattctgaaaataatgcaagttggtaagagtggtgatag

SEQ ID NO: 53880 - DNA, 1047 bp, Homo sapiens
aaccaggacctctcttgagcagggctcaggaaggatcaaataaaacacctagcagcctggcctgagagtaagttgactggaccagtgcagcttcctgccctccgccctcagctgggcccctagggcgtggcagcagtgctttgcctatgtcttggggatctgttattgaaactgtttcaggctgattccactcacctgtcctcattctcatctcacaagggtccacttacttccctatttctgtctcagaatttctccatttcttcaaccgtattacacttcccttctatccgagagaacaagtatgctcctttattccagtcacaagccctttttttcttttttaaaaaattctgttccctaagatctccaacttcccttgtgctatttactaataattattttcccctcctgcccaccccccccccatcttcattgtccccctttgttggctatctgctttctgtggataaacacaaggtgtccttattctagcttggtcctcattccccagtgcagctgtgcattgtttcctgtccagtctgtcccaccccctccttgcctactcagttcttactcccttgcgatttagttctggcctcccctgctctcctgacagtgtcctcttgaaggagatattcttcaccttccttggctttcctgcagcattcgatagaaacatgcatgacttatgtatttttctctgggcctctctcctggctctcccccaactttctcactcctctggctatgactgattcctctttcttcctctcctcttctcccacatctccacactccccaggtgctctttcactgttctcagagctccagctgtccttgcgaggatgactctgcattcctctctcagacactagactcattcccaagtatcctctgtaaatctccacctgccacctcaaattcagcttgtcccgaaccaaactcattttcttcttccccatccccgaccagctcttattgacattcttatttctgtttagcggaaggaagcaccattttccctattgcccactgagtcaacat

SEQ ID NO: 53881 - DNA, 1051 bp, Homo sapiens
taaaaatggctaaaatagtaaactttatgttatgtatattttatcatgattttaaaagaaaaggaagtaaatgatgaaatcaaagtgaaggaaatgtaaaggtactaaataagaatccagggcataccaaaaaaatgtaaaataggttgtatcatttgctatttggctcttagagtcaaatccagatttcgaataatgaaggctgtcatttttgtggcctttagtgtgtgtcaagcattgtgctaatcactttatgtacatgatctcatgtatcttcatatcacccttatgaaataggttttgtatccctctagaggtgattaaacagaatctcagacaagtcacttacccacggtcacttctaggaagaggcagatctaggatttaaatccaaatctgtcagactgtagtatgcctccaacctgtgccgccatgcacaccacagcgacctcacagggcactcaaggcaaaatgcaatcaatgcagatatcaccctgtttgggcctttgtcatatccctgggtttatcctagactgatgagggaattagcatatgccagtgtagtgaactcatcatccctcccttctgtcacagatgggaagcggtctcgagcagaagccccactgaagtgtcccctggcagacacccacatgaactcttccgagaaactccagttctataaagagaaagccccagattgccatgggccagtgttgaaacacgaagctatctcaagccaggagtcaaagaagagcaagaagagaccttttgaggagtcagagacagaacagaataactcttcacaaccttcaaagcagaaatatgtatgtcttgctgtggaagactgggacttgttaaattcctattgattagtagatacaagttgacctttctctggcccccagctctagtgtttgagtaaaggagactgaggatgatttactttttgtttgaatttacctatggcattagcatagtaagcagatatttctacttttgtggtgtgggaggggaatgctatggaagtatgtaataatttctaatgtatatt

SEQ ID NO: 53882 - DNA, 1602 bp, Homo sapiens
cattcttttagtgtcttcttgtatatggtattaacaattaaggaactttatatatttatgaagacccttctatcagtgtgagagcatttcatgcatattctttgttctcgcagccttttcaaatagcatctatcattttccatacatgttaagctaaaacatttaggagcagaaaaacttgcaccaaattattttaccacttggtaggagagctaagatgttgaaggacttgatcacttaaggcatccatagctgtttttcttgatacccaattgttatactcctgaggattttaacttgagacgtggaacagctttctttggccatccattgggagctgaatcacatatctacaacactttgagaaaaagtattcttctttcttaaagttgtttatagaattttttttaccaactatttataaattaaattgttatttaaagactaacttggagaggttcctaattatccagactactaatgtacattggttttcttttgcagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataattatgtgctgaaatttgagtatctgatttttctagaccttccctcctattcctgcccaacctagataagaattatgaaatgttctgtgtttattgctattgctttataatgtgatggtcagggaccattttgatgcaaaactgatctctcagcagtacatttgatgttattttgcacaggctataggtttttgtttgatgagtgtttccaaagaactatttttctctgttagatagcatatcaagtataaggtaaacatattttcagagaaaacttcattttaacactaaaaattagactcttgtgatacagaattaagtataaattttacttggcaaaaactcgttttatttttacctgcaataatacagagcttaatattagaatgatatcaggtcataataataatacaccagaatcttttgagatggaattttgctcttgttgctgaggctggagtgcaatggt

SEQ ID NO: 53883 - DNA, 1050 bp, Homo sapiens
gcctggtgtgaattcttttataaaacaaatgatcattttaaatttacctattctataccttaactttttggtatattggttttcttaaagcaagtatcgtaataacttgcaaaataatatatgacatttgtacaacagtgtacaatttacaggacactttcacttgccttatatatttagcagaaagtcaagtatatctgattttattattattacaaaagtgatatagccatgttacagaaacattagaagtggaggaaaaagactttatgccaacctaatgtaatagctattagtataatatttccttctgtaagtatgttttttaatagtttcaaagataaccaacaaagttttaattgtactgttgagctaagtacataaggttgactaattaagaatttcctgtttcttataaaattttaatataactaattgttgattttttttttccagtaactctgggtggattttaactacaactcttgtcctctcggtgatggtattgctttggatttgttgtgcaactgttgctacagctgtggagcagtatgttccctctgaggtaaatttaattcttaccatttgaagactgagccctgtgatatatcattttaaacaccttatttgtttagctggaaaaacaaggcctttctactaatagaaagagagaagatgtggtggttttaatgtggtagaggttggcacacataaaaattacaggtttgcagcacaagaattgttgttctcagctttctgtgatgctaactaccgtggtgacatatatgttgactggcttgagaacggtgtctctttctgactctctaagactgaaaagacctgttgacatcagtttctaggggatatatgggaaagaagactttttttttttttgaggcagagtctcatctgtcacccaggctagagtgcagtggccaggatcttggctcactgcaacctctgcttcctaggttcaagtgattcttcctcagcctcccgagtagctgggactacaagcatgcgccaccatgtccagctaatttttgtata

SEQ ID NO: 53884 - DNA, 1057 bp, Homo sapiens
ttattggaatctggtcgtagctgttaaagagacacccttgtctccagaatggaaattgaggtcactctttcttcacttgcatttctttttgaggagccaggcactgtgctagggagttgagacctagtaaagatgtcaggagttctcagatctaaacagacatggacaataatgattgctatacacacacacagtcctacacatgtctcatacacagcatataaggactgtatttaagtctactggaggtttcaaggggaggattgacaggtgagatagaaatatctcaagtgatgagtagaaatttttgctagttatagcagaagatttacttaaaatttttttttcagatatactggcctcctgctcaatgtgtatagggtacattactatatatggaggataaggagagtcagaaatttgactgaactgggaaaacaggaatagagagaatcaggaacataagtgtcaagaagaggcttctatgtgaaggatagattagaggaccaggttggagaactttggtaaatcagggaagaaattatgaggtctggattagggcagtagataagaacaggagataatggagatagttgaaaatctgtaggatctagtcattgttttgttgtggagattgaagggatgagccccagttttctggcttaggtagttgctactggaatctagatatcaaatatatcctcattttgtggtaaattccttagtactcaggttacttagggctggaacatggagaggaaagtgggtatttgttcattaaaaacatattttactctattatctttctaaattggatacttaaagaatcatatgggagttccctgcttttagatacaatacattctccaaagtccacctcttttgctggcagacaaacaatgactgtgcttactgcatgttcaagtcttggcaaactatcaagtgagtgattagggtggtaagtatagatctcttactaggcagtgttggatgagcagagatgtgaaaattagggagtatctgtattacacagtttgtcagagttagacttttaatt

SEQ ID NO: 53885 - DNA, 1284 bp, Homo sapiens
catgttgcccaggatggtctccatctcttgacctcgtgatccacccgcctcagcctcccaaagtgctgggattaccggtgtgagccaccacgctgggccattaaaatcttatcagtagcttactacatatattcagcccataaatactcccttcaccctgtcgtgttgtcagatgtctaccattttatatatatattcttctgattgattttttccgttctcttttccattgatgttcattatagcatgatttattcttgatgaaagcattaaagatgagaatgatacgatttgtcccttcccgttctacccttaaggccttgctggtccttatttaattacatcttaagagtcttcttatttttggacttaattcaaaagcctgttattctgatagaggtgacaggtagctagtaagtgtgtttggtggcaaattaaagtatccttggtttttaagctttaccataatgtgcatagataactaagagtttactctaatgctattgattatggtagatgtatttaattgtttgtatcctgtcccaataaggattggagtaatcttgattatattgttcttttgaatatacatatataaaaataatatatttctcattatttattttatttttagcttatgtccctgatgccaaaaatgcacctactctttcctctaactctggtgaggtcattctggagtgacatgatggactccgcacagagcttcataacctcttcatggactttttatcttcaagccgatgacggaaaaatagttatattccaggtgacaactgagcttcatggattcatctaaatactaacaacagtaaatgtatatgtcttaaatgagtgtttcagcatagaaccatactcagtcacttacaaatatttatcatcaaataataattacttatttggccctacattaaaatattagacatcagttttattacccttccctttgcccgttagaagcctaatctaaagcccattagtttttatgtaaccagaactcttgagtcttttaaattttatggtggttaaattgataaaatgaaatttttaaatatgagagacaataattaatatacttcgaacataaatagtggccatatatgattacatatggatatcagataaaagcaatatgacataatttttagttttttacagtgcttttactcatgactctaataagagaacttgttgaagaagtattttgcctagagaagtaatgtctcctatctcatcgtttaccacatgataataactgttattccc

SEQ ID NO: 53886 - DNA, 1260 bp, Homo sapiens
ggaaatggatttaatgaactaaatgagagtatatctggtagagacccatttcaacattagaattatctgctgtagaacattttctagttcaattttcttagactttcagatgttaggctgattgttttatttttcttttgccatgtgcatacccttacttcttaactgagtgatctggttcttaacaataataccttatatttgtataaatcattaaaatatattatttcattcaaccctatacaataggttgtggtatttctattttacacatatagaaatcaatagtcagaggttaaactgctcagctcaggtcacacacaccaacaaatgatggaactaaacctttttgagtggcatcttcaggatgccaatccagtgcattttccaccacacaaggatcctcttatatgaatgtcatcatgtggccagagcctgggtgtataattaatagatttgtatctaaaacatttgacttgtaggagggagacaatatggagttctgttaaagatacatttcctactactatattaccaaatttggaaattcacattgatgaaacctttttaagtataaaaatttttttaataaaatgccaaatccttttctttcctctttccctttctcttttgtttcttgtaatttgactatttttctcttacagcatgtacagaagcatattcccaatctgatgagcaatatgcttgccatcttggttgccagaatcagctgccattcgctgaactgagacaagaacaagtacgaaacaatactgcctttcaaactagcctgcttagatggcactgacttgtattgcttgaagtgtttatcacccacttgatcctattttagtgttatattttatatttggctttcagcaaacaaaattagtttgcaaatagaaaagtcagttgaataattgcttttgtataatgctttactattaaaagttatgcttacgttcataatcttattttgtttcttctcacattccagtgaagatattatcctcattttacatatgaaaaaaccaaggctcagaggaattatttcagagttctttttctccatcccaactcccattggacagttgccattgccttaactcagataatcatttcttgtctgtatttttaaattaacttccaaactgtttttctaatttaaccctgtctaactccatcctttgctgtgtccagatttttttttctaaatttcatcatgccattctcctgtcttatataatcagtagctcccaa

SEQ ID NO: 53887 - DNA, 1030 bp, Homo sapiens
cagggccgattcctgaaacctcggctcttttcaccatgccatatggttttccgaaattggtactggatgacttattaaaggaaagcatatctgagaatgaaatggcatgtggtatagctcatactaatgagcttatgcttcctttgtgcaatataaggaaatatgtggtgctccagagacataaaataattctttaactgttttacaaagcctgcaacagctactcagatatgaaatctatctcaattgttaaaattctttcaatttcatcttaacagtaaatgcagttggaactgaggtccaaaagtgtgctaccttcaaagttgtatgataaagtatatttaatattagactgcaggcatctcttcttgatggattgttgctgctgcgtaaattttactaatccttttgctggaaagaaatacatagcttgtatttcattggttgctaactggtatatgcacatgctgtttccttattaggtgtctgccagtttgtacacagtggatcacatagtaagtcgagggggctcccccatatgcaatagctttttttaaatacttttattttatcaaagaaaaacagctgaagacattagtcttattaagcagttaatattttacagtaatgaagaaccagatgtccatcctgtcttaagctttcacacgtatacattgatgcctgtaattgttttctattttaaaaatctattaacactattaccatttattaagcaccttctacatcccaggcactatactggaaatagcttccaaattattgaggaatttggagataatggctgttctctccttttttgatgagaaagctgagattcttagacaggtaaaataacttatgcactcacccaaaaggtttgatctaggtctggctgattgcagtgtcctttcccatacaccacactgttgctcctgtgttttcatttaatgtaagcccagttttaaaaaatcccttcatataaacatttttatagatgtataccttactttatcaggcccttgtgtcacca

SEQ ID NO: 53888 - DNA, 1357 bp, Homo sapiens
gacataaaaagatggaaaactatgctggagcttcctgatcaaaccaaagagaatcttgttgaagccttacaagaattaaagaagaaaataccctccagggaagtgttaaaatcaacaaggataggtatattccttcttaattttattttttaagaaagcttatattttgtctcccttcttctttccttcctctctccttcaaacatgaagttatctgccttatcaatgctttcaactctctggtaaaggactgttgtttaaaaaattatctgttggttgcaggccaataccttggtaatatattaaaaaaattatcagaaaaatgaaatatacaaaatacaagccccagtttttaaaattagattcaacagatataggattactcttgtcaaattactatgaaagtttctaaatgcttacatttaatttatgtacttacttcatggactggaaactggcaataacacatggataacattttgagtgtgttagatgctgggtatgcagaaatggataagacatgatttgtgacctcaagaaacttaggatttgggctgggtgtggtggctcatgcctgtaatcccaacacttggggaggcctaggtgagcagatcacttgaggtcaggagtccaagaccagccaggacaacatggcaaaaccccgtctctactaaaaatacaaaaattagccagacatggtggtccgtgcctgtaatcttagctactaaggaggctgaggcatgagaattgcttgaacctgggaggcagaggttgcagtgagccaagatcgtgccactgcactccagcctgggcgactcagactctgtctcaaaaaaaaaaaaaaaaagaaacttagagtttggtagaggagacgagcatatagacaaatgggaacagtgaaatattgtaggtgtaaataaaaacgtgtaaatagtgttctgagtactattctaatctaaacaaggtatatactggggacttcagaaaaggcttcatagaagaggtgacatttcagttacatcttgatattatagcattggagatatttaaaaggtaagtcagggaccatgttgaattgccattttagtacagtacacaactgtgaataatacgtaagggagggccaacatgtgttactcaagctgctcccagctccccagggagtccaggacagtcattcacagctgctgttcttgccctcactagtgcagccattgccttggtctgcctccccttgacctcttgttcatgagaagcaggagagagagcagcttcagaactggcactaacagctgggaagagctgtgcaaaatccccagagggccccccaagagtcttagagttgtacccctgtaat

SEQ ID NO: 53889 - DNA, 1027 bp, Homo sapiens
gttacatcagttgctatgctgaagatttcatttggatcattgcctgagagtgtttacatttcttcaacctttagtcttcctgccttttcctatcctgtgggttataagggacaaatatttactgagtacctttcctgtgttgggaactatataggcataataatgaaggagacagatattgtcctgcctttttggagccttaagtctaatagaaacacagtttaacaagacttcatcatacaatgtgatgagtgctctgatgatggggagaagttagcaaaatgactatatgtgttaggagtagggcagaaggtattgaagaatgtgtcaggccggggcacatcacgtgagctgtatagaaggtggaggtgggagagaacatggtgcattccagaaactaaaagtagtttggcgtgttagaaatgtaatgtgcttgagagagcgtggcaagaaatgaggctggagagacattctggaccagatggagaaggttctttgtaagccattcagaactgtttggtcttggcatatgtattagttatctatcactgtgtaaaaattactctaaaatttagctgctgaagacaatatttattttttcacacaatttttttaagttgagaatccaggagcagcttatctgggtggttctagcacagggtctcttatgaggttgcagtcaagctgctggctggggttgcagtcatctgaaggctggaccagggcttaaggatctgcttccaaaatggctcacaggattgctggcaggaggcctcagtttctcatcatgtgggcctctccttggagctgctcatgacatggcagctgactttccccagaacaagtgatccaggaaagaacaagaaaacaagagaacaaccaagatggaagccacggtcttttataacctaatctcagaagtgatatatcatcagttttgtcatatgctattggtcacacagaccaacgccgatacagtttggaaggcaacataagggtatgaataccaggaggtgataatcattga

SEQ ID NO: 53890 - DNA, 1051 bp, Homo sapiens
aaaaccaatttgaaagtcaaatgtaaatgttttttatttaactgattcaattcagcaaacatttatggattgtctcttctgtgctaggcactatgctggggggctgggaatagaacttggagtaaggtacaggttctgccctcaacccgtttacagttttgaggataagatggacatttaaatattctaggcagagggaatggtatgagctaaggcacagaagtaggagcaggccagccagcatgaccccaaacagggacatgcaagctgctctctatggctagaagttagtgtacagaggcaaaagagtgggaggggtgaaagtgaggggagggaggaaggagggcgacatggtgacaggtgaggccaaagagattctaggtcatccagagttttaatgctatgttagaagttaatttgagggccatggagaaccatcggaggatttttattaagcgtatggtatgatcaaattgtgtttgaaaaaggtcattttgccttcagtagagaggatgaattggagagggcaggactggagacagagattggttagtgaagtaatacagtagacctgtggagaagtgatgagaacctgaatcagggtagtaagagtggagaacaggcgaggaggaagagtaaaagatagagggagaattaaggaagtagatctatatgacttggaatggctgagtgaacataaggttgaaagagacagtggatcctaaaatggtgggtgggtggtggtgccattctgtgaccaaaaatgttgagttagaggtgtttgcagaataagcaggtggagatgtccagtaggggactggatatttggtctcgtgctcagtgagaacctttggctagggacacgtagttgggagtcatctgcctgcaggtagctggaccacaggagtgggcaagattactcagggaaggcaagtggagaaagaaaagaggccaaggaccatgccctagctggggttcacagataattaaagattgggcaaaggattagcagccagcagaggagatagagaggagaagagactcagtaaca

SEQ ID NO: 53891 - DNA, 1365 bp, Homo sapiens
gttaaatgaatcatatatgcaaaagaatagtagtgcctgctgattagaagttatttaatggatgttggttacttcccatttaaaattccttcccttcttgctgaagtaaaaattctgtgatggactgtgttatggaatatcaatggtaaaataaatagctgtctattgaaaagactcagatcccccattttttgtcaacagccatatctttagctttaaggcataaaatcaattggatagacttgttccctaacaccttcatggcttacaattcagatgatgttagtggtttgaagtatacatgctggaagaaggatttttgctcattaataataatattcattgtcatcaaacaacaaatcttataagccgattaatactctggaaaataggacatataatattcatgtttcttccttatcccaggatatcccagagcaactctgctaaagtatccttaaagaacaatttaatattaataaaataagcaattcagaagtctgatttaaatgctagctctgttactacagtctctaaaaaaaattttagcctttctatctcaattttttatctacaaaagaaggacttgtgatatagtacttactttttttaaaataaagttttggacctgaagtgaatttgcaccaaagcagcagctgcattgccacagttctgtcttcaccttcaccatgttcctcttggtcaaaaacgcaccaagtcgtctccaagtttgaagcattcagcaaacaatggcaaggcagagccaccggaaacgtacacctgattttcatgataaatatggtagtgctgtattagctagtggaaccactttctgtattgctatatggacataggtagcaacacaaatcagaatagaatggaacctgtcccctgttggcagggtcaccccaaaggaatggagagatcagtaatcattccagctggtgtaataatgaattgtttaaaaaacagctcgtagttgatgccaagttaaagcactgtgtacccattaagatatggcattattgaagaaataaagtacatttgaaaccttaaaaaactaaataaagttttgggtttttaaatacaaacttctaatagaaaatgagaaaaatgtataaaagggaaaaaaatgtaacccagacataatcttgttaacacattggcacatttccttttttggtaaattattatgggtttttaaatgaatgttgggcaagttatgattatctgagatttatatagagtgaattatatgccaaatgttccataagatatttttattgattatttaagtaacattgcagaatattgatgtaattatttacatttgtgttctcttgaatcttgatcaattttagttag

SEQ ID NO: 53892 - DNA, 1103 bp, Homo sapiens
tgagagtagttcctgagacctctgagttacctgtaagtcaaggtgtgaatatgtcttataagcaagttcagttgctaggggaaatgtgggaaagtaaataccatttgtgtctgctctaatagcttattgatgcttttcttgtagtggttaatttggaggtcctggttgggcatggtagctcacacctataatcccagcactttgggaggctgaggcaggcggatcacttgaggtcaggagtttgagaccaacctggccaacatggtgaaaccttgcctgtactaaaaatacaaaaattagccagatctggtggcaggcacctgtaatcccagcactcgataagctgaggcaggagaattgcttgaacccgggaggcggaggttgcagtgagctgagatggcgccattgcactccagcctgggcgacagagcaagactcacctcagtctcaaagataaaataaaataaaaataaataaataaaaattggaggtcttggtcctctgtgtagggactcagtctctgtattttcattcattcattcaacaaacaaatattgcccatcttctgtgtgccaaggactagactggcactggggacacagcaataaaggagagataatttcctctgagtctggtgaggcagatagacacataactaaataaatagagtatagcatattgggtgataactatagacatgaaaatattgagaagatggggaaaggaatgaataacaccactcagaggaagaatcttcacagaggagttcatgtttgaaccaaagccagaaggataggtaggagttcttagcagagggctcagtctatgtgaaagcacagaagcgtgaggtgtatggctagtttcagtaaaggcaaataatatgaggtggctgaagcataaggttcttaggaatggtagtgagaaattgggcaaaaaaagtaaccaaggccttggaggccttatcaacgagtttggactttggccttcagataatgggataccatgggaagtttttgaggaggtgagggacctaatcagatgtgtgttttaaaaagatttaaaaaacaaaaacaaaaacagatattttaagaaaattttaaaca

SEQ ID NO: 53893 - DNA, 1050 bp, Homo sapiens
gagcctatacgcccatcagccctgccaacgcagaaggatactttgaagtgttaattaaggtgagttgacccttgaggatgctccaagatgccgtggagaagctatgggtctaagaatggagagctaaagggaaaatgtgggaaggaaactcagtgctgggaacaacatggacaaaggcaattggggaagtaagtcctttgtcctggaacagaaggaaggagtgccaagggagcaggatgcaatctgagaggattaggcaagaggtaggacatggaggagcttatagacaggactaacctaacatcacctcttaggggaggtgggcagaaccggggcatttgagttggaccttgaagaaggagtacaaattggcagtggccgtaaatggcattctaggctgaggggatggttaaccaaaggttgggaggggtgaaatagaacaagtcttctaggaactatacccagcctgagagccaggaggagagggtgctggtggagaaggcagggtggatggaggaattggcagatatgagatgaacaaagtaggttggatgcaaaacaccctggagacccaaggaataggaaacaaatatataagaagttgtggaggcccaattatgtggaaagaataattaggttgagctacatgaaattgctgatattctaacttttttgacttaaagaaacatcagcttcatgtgggtcaacctaatacacagctctagatcatcatttcccaaatggaatcattacgaatatttaagaatagtgttcacatccttaatctatgttataagacatgacttattatctatattgcattgataagtaaacggagtcccccagaggtcccaaggccccacagctagtaagaagtgctgctagtaggtgagtcctgccccctgacaccgagacctcagcactgcctccagctcccgccttcctacctgccgtctgagcccgagtgtttattcctccacacataagcttggatgggatcccttcttcatgcaactgtttgtctgggagattccacaaatcctctccaaa

SEQ ID NO: 53894 - DNA, 1009 bp, Homo sapiens
tgaatttgaatttttgtctacagtgtgattgtggacaagtaagccagcatgactcaactcaggcctcagtttccacatatgtaatacacagatattgggttagacattctgaggtcccatcaacttataaattatgcaaatctggattttagcagctttgaagaatgggtatgtcttttacacattggagatgaatgttctggataagagggcactgcttgagcaaataaagactcagaagtaggaggcagcagggtgttcttgggaggacaaagaaaagtctggcattagatgcctgggagataaaatgaggcatgagggtcgtccacagggcctttgagtgggcagctaaggaaggagcccgcattttaccctggagctgaggggagccatggaaggcttaagagcaggataggctcaaaggaaagcgctctggcattcttagatccaattttgaaagggaagtaaggtgaggctagtgtccagtttacaggaaacttcccgagccaagacagcctctccttggggacagtgggaaggatgctatggatgcctgtgtgtctgtggagccccggcctctagctgttggatctcttcctgttgcagagctgcccctccaagctgaacccagagaccttcgtggccttctgcatcattgccatggacaggctcactaaggacacctaccgtgtccggtttgctctacccgggaacagccagcttggcctgcggcccggccagcacctcatcctacggtacactcaggtagcgggaggaccaaagcttcacagccctgctttgctatttgctagctgctggccttgaccaactagcgtactctcccttaagcctccatttgtcatcttcaagatagacatagtgacacatgactcagagagttcttgggattgaactagataatgcattttcataataaataataacacaatcactttaatagcatttactatccaaggcacagttctgggtgcttataggcatgaaatca

SEQ ID NO: 53895 - DNA, 2256 bp, Homo sapiens
aggtgtacagtgagcagtcacgctcagagctggcttgggggacactctcacgctcaggagagggacagagcgacagaggcgctcgcagcagcgcgctgtacaggtgcaacagcttaggcatttctatccctatttttacagcgagggacactgggcctcagaaagggaagtgccttcccaagctccaactgctcataagcagtcaaccttgtctaagtccaggtctgaagtcctggagcgattctccacccaccacgaccactcacctactcgcctgcgcttcacctcacgtgaggattttccaggttcctcccagtctctgggtaggcggggagcgcttagcaggtatcacctataagaaaatgagaatgggttgggggccggtgcaagacaagaatatcctgactgtgattggttgaattggctgccattcccaaaacgagctttggcgcccggtctcattcgttcccagcaggccctgcgcgcggcaacatggcggggtccaggtggaggtcttgaggctatcagatcggtatggcattggcgtccgggcccgcaaggcgggcgctagctggctccgggcagctcggccttgggggcttcggggccccgagacgcggggcgtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgagggtgaggccccaggacgggcggcaagggaccgtgttcctctaaccagcaccgaccccgaccctctgtggctttgggcaagacattgaaactctgtgggtcttggtttcttcgtctgcgaaatggggccgtagtgattcccgtcttctgagggttgttagaattgagttgtaaggagctgggcctctgtgcaggagtaatagagagtttgcgtgtcagcatgaaaagagctgctttctaggcctagccctggctctctctctttgactttgggcaaatggctggccatcctgggcctctatttcctgggaagtgaatggttttgactggacagtccacattgacctttccaggtctgacattctggagattaactgtatattttaaaagtagttggagagagtttatagtggagacagcaggatgtttaatctccaggcctgtcacctcttaagcccatgactactcctctgtcactctcactagggacagatcaaaatgactttgccaaaaccagcctgtctatctagaacagtaccagaaattattttccagagtccatggagaagcttgtttatccctttctccattcttccatcttcctcaaatcaggatagggatggggcaggtcttgaaaacagaatggttgaggtaagtggaaacagtattttccaaggagtgattaggggggaaaaaaaaggcaaatctggcaagattgggggactaagccagagaataaatcctaggtttgagaaaacttaagtcaattggccagcctcttaagcttctcaattccattcctgaaagctgattttcaagcctttaaacacttccagtgtccttacaaggtagtgggaaggatctcacaagacttggcatccttgagtgaccctggtaacaataccaagtggatgaatgcattagcagtattttagacgttaagattacattcgtttgcctaggctgaaaatgtattgtgtatcctatgtttttgctgctcacagagaggttctgtaggctgtaataaaactctgcaggatacagggctagagaagccatttggggtaatggagagaggtgatgttctttagggtagacatactcagattctcctcctagccttgtcacttacaaagtatgtgagttggagcaaattccttagtctctgagtttcatttttcattttatgaaatcccatctaacttgcaggtaaagctcctggcacagggtagatggtgactttcagtaaatggcagctctaattatcacctatttttcatatgcaaatagaacataaagtcttaatattttatctattgtcaagtttaaggaacagtggcggtgtcagagctaaaacttagtttatctgactcccagtc

SEQ ID NO: 53896 - DNA, 2282 bp, Homo sapiens
caggctggggtatcttttcctcctctgtgttctttatgcccattctgccatcatagcacagattacactgtattgtcagtatctactgtcggttctgtctaccccactcaactgaactcctaatggctgggaccatatcttactcacattgtccacagtgtctaacagttcatggtacacagtaggtgctgactgaagggatgtgtaaatgcatatacctactgttggtgtttcaggcagggatgttcagagaacacaggtgttctaactggtggaatcctggagcaggaaaaccagctacggaatgatctgggatttcaggacatctgcttggtcaggatttgtgtatagacttcctggcaatgagtcagctttgcagaggtaatgacaccactaaggaaattagtgaacctcattaatagaggagtacttggcccatcatcaagtattacctctaattaaactaccccatttggagctgtcactggaggagggatatggagggaattgaatcagaaaccacacaagagtggtctgtggggagaatggaaaacccaaggttaagagaggtccatgcacatttatttttcttgcagattatatgtgaggaaacaggaaatactttagaaaactattcttgaggtgtgacagatcagagtttatccacccccagatgtagtatccctttcttacctatccagtaagggaggccacatgctaattaatgacagtgctgttgaccaaaccaattcttagacatacaagaaaaccggccttgatccattaccatcacactgtggctatttctgaaaacccaagcaccttctgagaaagatttgcctccgtggatactcctcaggaggccattctcaaggtgtttttccaggcacattttgtctggtggtagcatgtgacctcctgtggggacctctgtgaagggcatctatgcatgttcacaatggctggcttgctgatgagtcagatgtgagtttgttttcctcttgtcacctacgtctgcatgtagcatatatgctaatccgacttcagtgaggctgtttgactggctagggttttctcactctcagttgttaaggacaatctggcccctttcctaagtttaagaatctcctctgccttggctgggtgcggtggctcattcctgtaatcccagcactttgggaggccaaggtgggtggatcatgaggtcaggagatcaagaccatcctggctatcacggtgaaacccggtctctactaaaaatacaaaaacaaaaaaattagccgggcatggtgatgggcacccatagtcccagctactcgggaggctgaggcgggagaatggcgtgaacccggaaggcggagcttgcagtgagctgagattgcgccactgcactccagcctgggcgacagagcaagactccgtctcaaaaaaaaaaaaaaaaaaaaagaatctcctctctaactctagtctcagtgctcctctctctctccatcacttcttccctgctgtatcctactctagtcacctggatttctctccttaaattctgccacggagttgcctgcacctgacttttgcacattattcctccttaactagagtgcttttccccctttctttgcctggcaagctcttacccagtggttttcaactagggacagtttttccctctggagaacatttggcagtgtgtggagacatctttgacatgatgtggatggggtgtggggagttgggatggggagggagttaaaatggcatctagtaagtagaagccaggatgctgctaaacatcccacagtacacaggacattccctccccccactccgccaaagagttatctgatccaaatgtgaatagtgctgcagttgagaatctctgctcttatccatccttccagatgtcattttaaggcattgcttctttcagggaacttcccattcccagagaagttcagttttccccacctgtacaatttttgaatatgtttcatccttttcactgtagcactcactacctggtgggctccttgagaggagagagtaactctcacacatctctggttccccaggttacagcaggtgctcaggaagatctggatggggcaggcttcgctccccagagaccatcagccctcagggtttactaggaagggaacacaggaagaagagtgcattggttcatcccctcttagggatcccaggattaacatcctaactcaaagttttgtgttctgtgattaggctgatcaagaaatgctataaatgacttgaggcacatg

SEQ ID NO: 53897 - DNA, 1417 bp, Homo sapiens
gaacaagtactaaactttgattctcagcaccagtgttgtgtgggtcagttgtgaatgatgaggcaagtcatttgtcactaatattaaagtagtaaattttgcaaatgacttgctttcttttgaataattaccacagatttcaagttctccttctcctaacatcactgtcatctgtgtgccagaatgagagagaaaggtgtggagttagaactagcttgcaggcagcacctataacaggttggcaggcattttctgtgaagagtcaaaacagtaaatattttaggtgttacaggccacatatggtctctgtcacagctacccaatagtcatacgtaaatgagtgaatgtggttgtgctccagagaaaatgttatttacaaaaataggtagcaggccagatttggccagcaagctgaagtttgccagcccccgagctatagtgatagtatccacctttgttgagtctctctgtagcacctgtccctgggctaaggcgaggtgactttcctgaggctttgtggcaggctgatgaatcctttccacccctccacataattgtgtctcttgcaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatggggtatgtaggtggagaagaccactgagttgctttacgtggtgttggtctcctcccttaaggttactgctcagaggaagaaaagggatataggggaactgatttcttgactgaggagttttagggaggagtacttcagcccaccctgtggagatgagccaacatcactagggggtgactgcctgtgcttcacctaagtagctcacttgatcacagtagcccacatgtttttactgaagtccccactttctaagctatgccatagaattacagggaggccatgcagcttatcagcattacacagcactaagtggtggagataggactgcagctaggtctgccccactctgaagtcttcagttgtttgtgctgcagcatgctgcctctgttcttgtagtggcagaagtggagcacaggcaggaggaagtggagcaatagagatggccaagccctgcctgccaactcaggatgggtgctggggacccaagatactcgttggtgttatcccctgatcctaagaggaggtttcagggacctagatggtatagaatacaaactaacttgtcacagagagctgtcccaagatggggaaagcctggctctgggagcaaaggcctccagggaggggagggctatatgggagccctcaagcaggcctgggacaccagatccctggtttggggtgtgttgggg

SEQ ID NO: 53898 - DNA, 1020 bp, Homo sapiens
ctggtgaaatcctggcgctggcatggctggagtggatactccagaaacatggcccgtgctgagttgcagcgtcagcatgaagcccagtgaatgtgactgccaggcccttagaagcaaggcaggggcgtgggggaagggtgtggtctggcatgagcctgtttgggttctacaccacccatcttcgtgacttccggcaagtcactttacctcactgagtctcagtttcctcatctgtcaaatggggtgagaactgaatgagattatatctatccgttgaccctccggattcacatttgatagctgatgtcactgtggtccttatcaagtaacgccaggagtttgagggatttctgtcattaaccccccagctggcctgcctgaactctggcttgcctggaaatcgcctctcagtggcaggaactattactttgatgtgctcaaatagaagagcaggcaccctggggccatgaggcacagccagcctgggtgaaggaaggcccggccctggacagtgccctgaactcctcattctattttaattgtcccaaagagaagccattcagtggacgtaggtggacgttgtaaagggaagaactagaagctgcctgggccgtgctgttccttacactccacagcttctgatttgttttccttgtccccttttcctctcagaatgatgccaaggtcttggagcagcccgtggtggtgcagagcgtgggcacggatggacgtgtcttccatttcctagtgtttcaactgaataccacagacctggactgtaacgagggtgtcaagaatttggcctgggtggactcagaccagctcctctatcagcatttttggtgtctcccagtgatcaaaaagagagtggttgtggtaagttgagccatctcctgcctgacccaggagggccatgcctcctcctacctggtgtgagcctcaggtgggattgctggggtgctctgtgaggagagccctggccctggggacttcccacccgggatctctgcctggaggact

SEQ ID NO: 53899 - DNA, 1662 bp, Homo sapiens
aactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagccctgctgtctgtctgtgcccaagcccttccaccagaaaagctagtctaggtgtgagagcccacattgtctgtagccatcaaaaataataataataaactggacagtttacaatcgttggtttctttcaaaaggccttttttggaaagaagaaaaggcagtcaccgttttccacttggggttttggtttgtgcaacaggcaggggaggagtggggacgcgtttgttctagcttgatttccatggcaacagcagcggcacgcttggaccccagaacccagcaccctcatcctgtggccagaggggccggaccactgacccctttcaggattccaccacagcccagaccgtcaccgtgacccggtggcatgcactgttcccaggacaccctcctcctctcctggacctcccttccgtcctggcctccctgcctctccagcccctcctctgcccccaccccagtcttcccagtgagaatcctgccagctgggtggtggcctggcgcagagtgggagaggctgccactgacaggatggctatgacctgggacatggaaacagtgacctccgcgttctggtcccgagatcctcgcatcagcgtcatcgtgtgcaccggcttggggggctggagttccggttttctttgttttttctctttattcgtcctttctcaaagatgggatactgatcagaattgctctgtatatgcttgggactggatggaaagactttggagcagctgtggggggtggggggacaccgacaaccaaacagacgtgctggctccagtcctgtttttactttcaaaaaccaacaagcccgacagtggagcctgtcccctcccgggagggtgctcatggccccactcacctcatcaccccacggaaacctttgtgtcttgccctggaagacacccgaattctttgtacattgacatgcccttctccttcctccctcccctgtagctggtctttgttttactccctccctttctgatccatgtatatcatattatgtgagatatcatctgcctgaaaaaagactttgtgcggattattgggaacattgtagctgtttctgtgttttttcttaccttgtagtctggttctgaattaagagaggaaaaaaaagtaattatgatacattgtagtttgtgtacgatatatgttgataacgttttattaaagggacatcttttttccgcagcccttcctgacatgtttggggaatgtgggttggagtttattacactgattacaaaatgcaaggtgacttcttgggcacagtttttgttcctggtgcataacaagatgttttgtgtttgaggcgtctgccttcttttcctgggcctgcaaat

SEQ ID NO: 53900 - DNA, 1102 bp, Homo sapiens
atttctctgccttgctctgaagccgcagctgtactttgcagctgtctttggaagtcagcatctctgtcctcctgtggggtagttgggtatccgtgagctgctcctctgggctggggctcaggtgtgactcagctctgcgtctgtggcacccagtcccggccaggtgccaaacagccctccattccaccacctccactcccttcccactcgatgcagatgcagtctgcatcacagggccttggcgctccaggctgggctcagccgcccctccccagccccgtgactcgtggctgtgggatgtgacctttctggtcttcctttccgagaagggtttgatagttccagataggcttgtgggtgggtagaatcgactcttatctccaagccctcatctgccacaccaacagttctgcatgggagcctcatcagtgacctcctgccaccaccccacagtcccagggtgccatgcagtgcctccagggccagtgccctagctctctcttccccaccactcatcaaaccccacctcttctcaccgcccagccccaggaaacatcttcatttctaatttcttccttttgttaacttgggagagggccagcatgacagctccaggcctgctgccaggttccagtcccagctcctccacctccagcctctgggacctcaagcaaagcgtttcctctcactgcttctgtttcctcacctgtgaagtggggatgagaagcacagatgttttggtccctggcctgacatggtcggagagctgtccacatgtgcctctgtctggggaaccacactctccacacgggggatggagagggccctgtggtgggatccgagaggctcagtttcagaggtgcctctgtgtggagttgggtggcagtgggccagtccctctccctcacctgggtcattggaatgagcacctctgccctgcagcttagagggccgaggtgaggaccctggcccagctgccaggcaggacatgtccgagtgtgagcagagcctgccggagcaggggttccccagggccaggactcaagcgtggctgcagccccctgcctgtgaggggtgcagagggccagggcccgctgagctg

SEQ ID NO: 53901 - DNA, 1050 bp, Homo sapiens
gatagaaacgttttagctggagacttttttggctaactggggagatggaggggactctcccccgccccctcctcggctccccatagcagggaagctgctcagctgcaggggtggagctggccgcagccgggatcctgggctcccactccggctctctctttctgctgctgcattttgatgagctgcatgacctacattccgactgggccacatgcacccactccatatgtgaatgcgtttccagccccatccctgcctctccctcctgccccatcagcctggcagggtggcctctgggtaatttgccacgtttccctttccctgatttgattaaaaccactttgtagggtggtgggagagcacaggtggtgggaggagagcacaggtggtggttctgctgcccccatgttgtcccaggcagtgtctggggaccagattcggtgtggggtggggagacaagaatttgaacccgtaatccccctgtgccgtgtccacactgctggggttgagtggttttcacagttgaattttctgtgattaaaaactttgtgaatcttcattaaatacaaattagccagaaaatggtggtacttagaggaaattttaggttataaaatacaaaagaatgagttccagtgccatgagtttgttttaattaagaaacgaattaatcaccccgacttgtgggtttccactgttctacagattcaacaaattccagtgacaacatctacacaatgattaatccagtgccgcctggaggcagccggtccaacgtaagtctgctttctaataatttacatatcagacaccataacaaatcataattaacttcatcagctgaggggaaagcaagtttaattgatttcagccatttgttaccaaagatgaataaaataaaccgtcagaaaagtgattaactcttgggcaactcagttcccatttcatgggcggcagggggtgggagaggaaggggtgggacgatgcccaccctctggttagagccagggtgcccgctgtgctgctgggacttgccacctcctgccgtgc

SEQ ID NO: 53902 - DNA, 1072 bp, Homo sapiens
tatgattgcactactgcactctagcctaggcaacagagcaagacgctatctcaacaaacaaaacaaaaaaaaactcacacacacatagtgatgatccctgagtgcagaaatggagttttctccggcttcccagcatcatgtctgtggagggcctctgatgctgacacatgggtggggtaggactaccacctggacctggggcaggttggcgtgtctgtatgtgccaggcctgggcctgcaccagcctcgggcaggcttctcaggagtgcctgctcccatccacattgacactcacccctcgcctccctgcctcctcacctcagagcctctcaatgggttccaagaccaagtccatcccctcttacccgcctgagcccagggggaaggtacaggatgacatcatgggagcccagagagggcagcggcttgctggatagccacatgtttttgagaacttcatcttgaaagctcctgaaaatgcactgaatgttgtgactgtccctctgtgctggcttgtcattgtggtccctgtgacttggttcccacccgccccaccgtttttgaaagaatgtattattttttctcatcaatccttttcacagactaaccctctcactatgttttgtctgtttgtttctcctccctcctcctgtctccggttcccttcttctcatagactgacccttggttatcgttgcagaattacggcagcggcatgagaccaccacccaactccctcggccccgccatgcccgggattaacatgtaaggcaaaaacgacccggcccgtggctcagagtccaggtcttcccccaccctctgccagcaccctgggagactcatgataaggggtcattgctggtacctctctggacctcagtctcctcatcggtaatgtgaggatattgatgatcctggtgatgagagctcagcctcatagagtgcctctgtgtgccgggcacggttcaggcatgctgcgtgcatcagctcacctcatcttcatgattaccctatgacgcgatgatttttatttttatttttattttttttgagacagagtcacattctgttg

SEQ ID NO: 53903 - DNA, 1093 bp, Homo sapiens
gctgggaacagatgtcaggctatttgagagcagcagggtgtgctggcagttcaggacttcctctgggtgtggtggatgtctcatcatgtctgcccctgacccgtagtccagcacactctttggcacactttaaagaagtgagggtcccagcggctgaggccctgcagtgagactctcctggcctcacccaagcagtgtacaaggggtagagctccccttagaccctaggagtgtctccagcgggagggagagaggctcacccgtctttatttatgttacacacccttgccaacctcaggaactctggaagcatatctcctgctctttattttactttatcaatgtggagaccctaaagtgcttcacccatgtttcctatactcctctgggtagggtgagtattaaatcccagagccaaacgtcccttgaagaaacccagggtgtctgcactggcccatcactggggtcaggaaagcctggcattgatgtagcactgggcccagacaaggttgatggtgcaggatggattacagggtctgtggtcacctacgggctcatcttgggcccggcagagcctggtggtttgggactctgaggtggagggtagggagagggcagactctccctgttccctaggccatttctgtctctcccctgaggatgatgccctgtggacaggacagggacaagcccagaacttagttctggaaagcacagtcctgacagcagctcagcctggctgggcctccagtctgtcatctgcaaaacgggcagcaagtgatggcctcatggggctactggagggtgggcgaaatagcagctgtgaaatgttacttgaagtccccacatggtgtcctgtggatcccttccccttcccgcaggccctgagcttgtgggagggagccctgcctactgccacagcccgggctgtcaggaagggcggccagccccttcagcataaagtaagcaccacaacacacacagtgctgtgctgagaccaggctcaaaggtgggagaccatcggcatgtgattcacagccgggaattagattgcttttagccagtgaccactccagaactttctgaacaaaga

SEQ ID NO: 53904 - DNA, 2980 bp, Homo sapiens
gggaacatctgctcctcggagctttccggaagtgagcagctcctcgcttggccaagaaactcccaggcctcacagcggcggcgccctcgggttcttgtacagccccctgcgatgttctctgcacacctcttctctgtgggcccacgcccctcctccccagtgggcaggcggctggcagcctggctctgcaggagaaggccaagggggaaaccctacctaggcagctcctctctctttttaatttagccacactcaccccctgtgcacattttgaatttttctaaaaaccaacctctaaaaaacagcacagtcatgggtggggaagagcgaatggaggcctgtctcctcatccctggcatcagcatcccacgctgggtgggctggaacgtgcttccgaggcagccctccgcgcttactgactgtgacccatggtaggagagtcctttggtggtgtgacccagtctacacacacatgaatatttacacacaaaaccggggttcatgaaagacacctgccttaaaatacacaaagctctctgacttttttttttattacctcggatttttaagagataattattgcagcttgctgaattgctgagtgagtttctacccatagtttgtaaccccaaggttgaagtgaattcatctgcccatgtcttctggggcggggtaggggggtcgaggtcagcatagcccagggttgaggcggtgggggtgggggtcagcttggaactgaggtatgaaaaggatagcccacccagtcgcccagcagtccggggtccccacccttcatgcacttccccctgtccccagctctgcaccggaactcttgggtttcagggctggagatgggccttggacccatggggcttctcatcccagctctgccactgaccagttttatggccatggccaagttccttcatccctcgagacttagattcctcatcagtaaaaattggaatgagaaaccccgcctcacagggctgctttgaagtgcaggtgaattcacggtgtgcgagtctgtgctgcccacaccgtgtggccctcactcactgtcccctcactccctgtgtgttacatctgtggtgccccttgctcctcttgcctctgttgtttatctgtcggtgcccccggccctcctgcccccaggaaacccgtcgcctgggcctctccctgacacttgatcagtactgcctcgagtcacccatagccgtgtcactgtcccccagactgtgagctccttgagggcagggcccttcccgatctttccccacctcccgtgcaagcggcacctacgtgctttgcacctgggtccctgtgtctgtgcatcattgtactccctctgagcccgtctcaaccaacgtatttaacatggcaaactccgctccaagggtaggctgtgtccaggactgtactcccgtgtgctttgacagaggtgcttcattttttgttctttcaaccccctgtgaatgtatttatcagcttctctcgctcccgctcgccgttttacaccgttgagccggcgaccaaagcagcagctccaccacctcccaccaaccagagcccacccccccgcacgcccgccgcccacccttcgttttggtttaatttttgttcttttaagctgcttctgcgcttctccatgtgctgtgatctataacctgcctctactgtctggcctcacagggtcctccggggtcacagccctcgccgcacgcacagcctccacctcacaatcctagcagcatgatgggaccccacagtcaggtaaacgcaccgtggcgctcccgcccgccggggacgcggggcgcggaggaagcagagagcccgcagaggaaaaacaaaaatcaaaatgtgctctagccactgcctgcgagtctttattgacaaattaaatttttttagaaatttcttttttctaaagatagtcttcagtcctcggatatcacacccagcttggatacgaaaccaaaaggaaaaaatatatatttctgtgaccttgtcagctgcctttgcgtttttgttttttcctctctcacttttggtttggttttgagtttggttcaccatttgtttgtaaccgaagctgcatcccgagccttttctttgtgcactcgtgctgctgagaaagctttcctgccattcccctgcattaagttagggagcccgctgtctccttggcgtttcccccccagtccttgctcccctctctgtccctgctggtggtttctgtgtgcgtgtgcctgtgtgcgtgctcgtgtgtccagctttgtctgcaggcccttaagatgttacgtatcagtccttcttaccctttcatttgcccttaccgagagcagaggtttcctcctccgccctgcgttgatttaactgtttttcgtttcttatgcaaagtcccagccgctgcccttcccacccagagtagatctccacgaacaaatgtggagtcaagagacacatttgttgtgtggatctattgttccctctgcccaaaggaagttttgctgtcaaagggaagaggctagcaggagaaagaacttaaaagatcactagttataacaaaactggactttgtggagtggagagcatttgtgtttgtcactgtgcagtagggcaggctgtcattgaactaattacctataattgcagccttttatgtcaccgcgatacgcaggcggccccaggcccccgatcagaatgggaaaccaggtactgtaccttttcatgttctctctcccctccctcagccatccttggccctaggtggactttgacacaaaatgaaagttgagggaaaggattgaggggtggaggggcaggtttaacgtggctggtagcttactagctgttccccagagagggccccatgtccccgctgtgcccatggtgcggcagttcacctgcctctccagatggccctttggacagcccattccagagttcagaaggtggcagcagatggagctaaggcgca

SEQ ID NO: 53905 - DNA, 1060 bp, Homo sapiens
gcttggcctctgtcaagaatgtggtatcatttttctccctgagtgactggcaggcctgggccaagattcctggtcctcatcattccaacccctagctccaagtcagagggaagacttctagctgctcttcccgccccagatttaacagcttgttccccatgagccagagaggttgtggggctgggctggggcctccctgaccagcctggctccatccttactgcttgtcagctttttttcttgaggcagctgcgccaagagcaagcttgtgccacctctgcttatccagggactggtctccagagtcccccaggggcgcttctgagggaggcgcagaggaggcacacctgccagccttgctgtctggatctcagcagaccccggttggagcactggtcctttgtaaaggctgccgtagattgaggccccaccgtgtgcgccacacgcccttgggtgcttcacttctgttttctctaatctgtcagtgagccagcctcctgccctccctgaccactgggcacacaggtgtgaggggcttgcccagagccccactgctcgccctgaggaagcactcagttaccaggaagggaaggacgcgagggaggaggcactcccttcttgccaagagccgaggaaccaacagaaggccttttgccccctcttggcaactggaccttacccttgaaccttcctcctctgttcttttcatatttctttttttgggggttggcttcaaattatcttgttttgtttacattacacccaagttacgtggtacaaaagacttgcaggtgcaaatatgtcccgccttcattaactcccctccctttttaatttatgtgatttcaattttccttccctgtactgttaattaggggaccctctaatcagtgccattatcacagtggtattcatgtttgggaaagccgctaaacaaatgcttgcaaaattgctaaatggctaattaatgtctgttaattaagaaaattgctcatggtaacaaaccatgccgttgctggcagccgctagaaagacacacacttgttgaaattagtagcgt

SEQ ID NO: 53906 - DNA, 1800 bp, Homo sapiens
gcgtgcgggagggctgggggtcctgctgatgcttctgaaatgcttttccgcagagtccttgaatccgttttacagtgggaatgctctgctccccacgctgtcagtgtgggtaaaggctttttcactaaccatcagtgtccacacttcggagttttcgtgaagtggcccagtgtttgcctcgatcacacccataacagagcctcctgggccctgcctaagtggctctcaggagctgctggatggaacactacccagtgctgaaattacaggagaaagaataacaagaaactgcgggagttagttgtctccactcagagatcttggggccagctgagatggaatagcgagtccattaacagggtccagggcagctggaaggctggacaggaagtgggcgtgtttcctgcctccttttcccagattcaggagtggggattttcccccatgttgaggtctaccccagggcttggtcctgctgccatcaccctgcagaggcagtgcagtgcagtggaaagagctctgacccgtcagtggaccccagttctcatcccagttccggttggctcatgggggtaccaggcctacatgctgtggccacactgggcctcagtttacctgtctgggagtgagagggaggtaggcatcaccctctcttggagcccctggcaggttaagccaacacttaagcttatttctctctgtgtaatcgtttttgtccttagcctggcagctcctcagggtcaggacaagtctgatgtgcctccagaccccagcatggggctggctggccacataggaggtcagcacccggcatctcggtgctctcccaagtccttcagccttgggttcattccactttgccctttgctttctgccctgacagatgacacggaggtgctgctcgcagtcttgtagaatgatgggctacccaggaccctgttagactctagaatcagacatcgaggcctggctccaccacgtaatagctatgcaatcctggagtgcctttatctttccaagcctcagttccttggcaataaaatggggcaattgatcccttactgcgaggagtccgggattagatgagcttatgtaggtagaggccacgctccctgttattgttactctcacggccccattccactgtcaagaaaatggaaatgcagtcaggggcagagccaggattcgaacccagttccttccaaaccctatttcttcatctaaaagagatgcaaatgggaatgtgatgttttgaggagagccctggggtagagttaggagatgtggttcagatgccaactagttttctgtggtcttggagaggtcacacctctgtcatgggcctctcttttctcctcccctgcaaatgttggaggaagggatgatagaatctgtcaaagccacctaacaggtgacccctgggcagatgccgttctccctaagcatctagtaaggacccccagccaccctagtctagcctgatattttgcacaccttcagggtgccatctgccctgatccaccgcatccctggaaggttaattaggcagcctctggaaccgaaggcatccagctctcatggagggagatgttctaaatggagctgggcctgctggccaagcagccctccagatgcacccattttgggttcctcaaaagcttccagcaagtggaagcctcaccagagatgtcctgcatggaaaagcacatcagtatcatcagctttgagactccctcctcctctcaccttccaccacagtccactctgcctgcctgctgggtctgttcagagttcggggaa

SEQ ID NO: 53907 - DNA, 1956 bp, Homo sapiens
tcagagctgaaggaaatctgttctggggggagaggatcagtttggcaaggccacgttcaccccatgttccagaggactggagtgggtctggatcccgggcccatctcttcctctccaggcttgtctctcctgcaccagtagaggtcagggagagagaggggtgctgtctggactctccccgtggggcacaggattcctagcttctgtgccagcattaaagaaggctgggagatgggcatggtggcccatgcctgtagtcccacccgcttgggaggctgaggtgggaggattgcttgagctcaggagtttgaggccagcctggacaacatagcaagaccctgtctttaatttttttttaataaagagagctggctgtgcagggctgggatgtgacttagcggggcagcaggtaggatggaaggagccactcacagatgggaatctaataattagtctccaacttgagagagggtatagaaacatctttggaaaggaacagaatagatatgtgattcccacgatacagatcgtattgccatttccttggtcaagcccccaaatgttagtatccttccccttggcctggtggtcccatccccaccatcttgtgcatgaagtcctctagaaccacacccaggcctgcctttgggctgcataaatgccatcctcacggtccagaatccccttccttttcttctctgccaggagacacctgttcattctgcaagtcctgcctaaatgtgactgttctgtggtcactgctccctcactccccagtgcactggtatctctgcctctattaaagtgttgcaccctggtctcactggccagtctggagctctttagggaagggcagaatactgcttgttcacgtgtctccggcacttagctcagggtactgggacctagtgcccagttagagtgactgccagatagaggtgggctctgcacatatgttatggatattgggctgtgttcttgaaaagagtgccctgttgtatggatacatgtggaatacacggagaatctccagcaggaaagccctccttaagcatttagtggctggaggcaaagtcacgtctcatatcctggcccttcccaaccacagccattcgaggtggagccttttcctggctgagatgaccccagaggatctaattctttgtgaattcacaccacaggaaagggtccaaacggtttgaacctgccaaaagaactcaaggctgggattcaagctcccagaatatttgtgctggcaaacaaggggaagggcttcttccccagcattgtggcaagaatgaaactggggacaccatcagcaaggagggttgtgaccagccagctggacgtgagcgctgggttttgtgttccgatgatgcactatcactgtattcgggagcagtggccaagagaccagggctcattgattagtgagcatggagggtgttggtgtgacagccaaattcaggtgtgctgatgcctggccagtgctcattctgtttgtcctcaggggcataacatcttggctctgataattaatgccttaatgtcactatacttcagttttccccctttgtaaaatggggtcaacttttgcttcatttgtcttacaagagaaatgtgaggttaaaatcaaagtgtagcactgttttgtttttccttgagaattacagaagactccacttttttccctcttcagtcttgaggaccatcatctaactcaggggtctgcagactttttctgtgaagggacagctaggaaataatcttagactttgtgggccatcaggtctttgtaagcagccgtggacagaacatgagtgagtgtggctctgttccaacaaaactttatttgcactgtgttccaataaaactttatttacattgtgttctaattaaacttaatttataaaaacaggtggcaggctagtttgaccctgacttgactgtagctca

SEQ ID NO: 53908 - DNA, 1065 bp, Homo sapiens
gctgtagaaaaggtccaagagcttaggaacttcggtctgttttgggaagcagctttcccttcctggaccatagtgtccccacctgtaaatgcagcagtgttagagagcgtggatataagagtccagtggtgagcagaagagacctggcccctgtcttctgggccgtcaagggctttgggggcaaaagaaatgggggactacttctagggccagatgactctggtggagtttgctgaagagcacccagcattgggtggagtttctcttgttgaggggcatgcttccaaccccaagagcagctcagattaggacagcttacgtgttgtaggcaagaggggtagctccgtgggctaataaggaaggctgtgtgaggtaataaggagggctgagccaaagaaaggaggttcctgaaggattccacgaggcggggcagattccgagccacagcttggtgtattaagagctacccttggtaagggctgaactaagtacttgactcctgatagttagacagttctctgtgaggcaggtagggtgaccacattttacaagggagataagtcagtttcagagggagctataggccgagctccaagccccatgaatctggggcttttccagcagcaccacagagctgcttctcattttccgtcaagtttgccaggtattgttgcacctgcccgtgtgactgtgggcccgacctcccacatctgtgtctcccagagtcctggttcttcccctgctccatcctgttgcttcatcttaacagaggaaggaggaagaggtcttgggccattccccaagctcctcagggaggaaaaggcatgaaaaactaccgagttttccagggggctgcaagactgaaagggaaaaacttggcagactttgctgttccgttcttagccctcttctgctcagtgggcaattggggttgaattaggggcattctggatttgtggtttccaaggctttgcagccccccttcctagttggatatgacgaatcattactttttataactgtcgggggtgaaggggcagggcaggaaggctgtgtgcacccgtg

SEQ ID NO: 53909 - DNA, 1881 bp, Homo sapiens
tctgtattgaaaatagaaaaattagccaggcatggtggcatgcgactggaatcccatctattcgggaggctgaggcaagagaatcgcttgaacccaggaggcagaggttgcagtgagctgaaatcacaccattgcatgccagcctagaggacaaagcaagactctatctcaaaaaaagaaaaagaaaaagaaaagaaagaaaagccccgtctcttgtttcttgctcaagaccaaatggtgggaaagagactggggacatggtggggtagaggggcacacccttcatgaagtgccaggtctgtatgcagcacaggcatggggttgggagggcacccagctcggccgtcagggaggccgcagagtggctgtgaacagggtctttggagcacgatggccctgcacttggctggcagtgtgatcctggcagtgacccagcctcttcaggcactgtttcctcagctgtgctgtaggaacagtcgcgcagcaaatcctaccgtgtcctttttggagctgtggtgaggattgactatacatataaacctatattcaggccacacgtggtggctcatacctgcaaatcccagcactttgagaggccgaggcaggaggatcgcttgcagccagtttgaaaccagcctgggcaacatagaccctgtctctacaaaagaaaaattaaaaaattagcgagactttgttgcataggcttgtagtcccagctgctctggaggctgaggtgggaggatggcttgagccctggagattgatactgcagtgagcctcgatcacaccactgcactccagcctgggcaacagagcaagaccctgtctcagaagaaactcagaaatctacattcatgtcagtaatggtttattattactgctgtggaaagatgactgggcttcaggatccgtgttgaccagcagctaagcctggagctcccagcgtgccagtcagctcatctgtcccttctgtcttggacagggaggtgctgggtcccatccctccttcaccttctgtgaaggtgatccatgcttcctggtggcctctggtgtcacacagcctgggtgggcacatgggtttcctcgagaaagtcagttcacctctctgaacctcagttgcttcatctgataattgggggcgatgataggccttgacatcttaggtcggctgcgagaatgccgtgagatgatgtgtatgaagccccacctggtgtctgtgctgggttggctctcgagactttagagttgttgtaggcgtgtctgggactgtactgttctagaggcccaggtctttcagtttacccaagaacaagagctgcctcagggtttctcctctttccaggagggagtcttaggggcatggcacagccttagtgacattgatgtgtggaagaggttctgggtatttttgagatccgctagctttttagtgtttaacccttcagtttgaccaacatatttgacacacctaagcaccaggccctgtttggccctttaacacgttacttcccttcatcttgtccacctgatttacctcccttagcccctgccaccttgactcctagtgccctgctccaccgcacaggagctgccgggggaggtcgaggctgggaggcaggtgttgtgtgtctgggaccctctgattcttttcctcccgggcttgctaccatgagtctgatggagaccagctctgacctggggagctgggtcttcacctgtgcgcctgcattctgtcactggtgaatttcacctgagtatcatttgagtttgcgttccccacctgtaaagcagaagcagctctccctggttcatctgggagatgaacacttgtaccagcataaggtgtgtggtcagaatgaatggcagatgggaaatccgaca

SEQ ID NO: 53910 - DNA, 1059 bp, Homo sapiens
taactctcactgatgaaatggaaagttgaacataaatcaatgtctgccgcccagttagctatgcatcagcaggcagcgcctgggagatttgctcggtaacaaagcacccaacagctgcttgggccttgactgccccctaacgcagagccagccccatgctacagagcccagctgggctacacaccacgtcctcctggcctcccaagtgcaggatgggactctcactcctctcttcaaccttttgagggagggaagggggaaggagtctctggcctcttggacttgggaggcctgggctctgttcttgctgctgctcctggcgaagccctcactgggggtgtaaactgactcccgaatctctggcttctgtggatctgatactggaaggatgggtgtcagtagctgcgttcacctcatgcttattaagagcttgggctggtttatcctttctcctttggacctgagtttttactttgcgttttcttagaatggagtgatttttccctgtgcctggaagctgctctgccgcaggtcggcagttctcccagcactgtaccgtggctgctccctctgcccccacgaggtccttctgtccttcatagggggatgggagtggagacccctgcggggctggagagtatttttgttttgtctcttcatagctgactgaggggtggactctcttgctcctgtccccacctaccttctcagcaaattgtactgaggtttttctccctttttttttttttaaaaaaaaggtcaaattccttagcccttgtagcagaagaggtttgaggaagagaattccagcagaatcctgtaataacacgcctcggcatgacatggatcaggatagaccccctgagtaagctcatgccacagtgggaggaacctccccttcaggggagtctgggctgggctctgggcccaggcactgccctgggggtcagaggccattccagcatctagctcagtgtgaggcactgttctaagtgcagggaaccacagtatggggtcaggttcatgtcctgtttctgcctaagttaactcccaggcaac

SEQ ID NO: 53911 - DNA, 1059 bp, Homo sapiens
ctgggacactgccaaggggaaagggtatctctctggaaggaggtactggctgcccatttccggagtaggcctgcttacaacaggaatattagctattgattgctggccctgcccttcactagtattgcagccggccactctgatattagaagggaaatagagatggtatcgaggattttatctgttaccaacaattgcactccttcccctgcttggccaaggcctgggtaggaagctctgctgcagaaaggctttgcaccagggagtcggcttgggatggctgagccagctatggccagaccctggcctagggtggccagcccagttttcaggtcaggacttcacccctagcctggtcctaaatgtagaagccccaggcctccagggttgggtgggagagagcagctgcccacctccatcccagcccctcggtaagcaacacagggccttgcttctgcaggcctctgactgccaggcttcagctcctggggtcagaagttttggccacccacaatgagggttggccatcagctttctcttcttccacgtccaggtttccaaggcgggcagtacctgtctggtcccgtggcatgagatgtctctggtagcaagttaagggctggcagggagatggcttggaaactgacctgaccacacctcacctttaaaaaaaaaaaaagccctaatattggcatccccagcacctggcatatactaaggacctagtaaatgtttgaactgagtttatttgtattgctcacattacagaacaggagcccaggcagccccaaagcactagatccaacattctgatcagggagggcctaacaggaagccagcttgggagttcaggagtggtgttctggtgttttgcagcagggaaggacagagaggacttggccgcatacttgctgagtgaccttgggcaagttgctccccatctctggaccctagttttctcaccagtagatggagcaggctggaccaggtggtctctgagggcccttccaactttgattttctgctttggatccagatggattttacataatcaagcag

SEQ ID NO: 53912 - DNA, 1108 bp, Homo sapiens
ctggttaaccacttgattttttccgagtgtgatcacagacagcatcccacaagcatctgtgcccgtgctctgcccgccacaggcaggaacagatcccacgtgggtcgagagtctggccttctccaagagacaccttgtttggctttttctggggtgtgtgaaattgggctttctgttttgccaggttgggcgcggctgccaccctctctgcgccgcctcctctgtctctaccttctcctcggcggttcatgtgatttaagccaacttgagactggggaatgccatcttagagaggtacagcgtgcagggctgtaaggaacttttatgatgacactctcgatcataacatctctcgttctttcaagcctgtcggcagctgagtttgagaatccgcccgagttctccacaccttttgaaagattggcactcccagataagaacatggaaagagctgttgtgtggaaaaggaggcagaaatttcctctgtacagccctagaattcagaactaggaccagtgaggcaaagtccaaggacacttttgcttggtataggccagaatttagcacctgtgctcacaccacatcaaggcagggggctctctggccctagagatgtctaagcaaagacctgacaaacgtctcctagggatgttaaaggggtttccctctaggtgagagatgatctggaagatgattctagttggcaagattttgtatttcggttggtgttaactcctgagagaagagggctgggacatgctgctcaccagctaagaaggacggcagtgaaattcaggtgttccccaaaaacagaagtggtaggtcacatgatggtggtgggaggagagagagggatgcaggatggccatccggggcattggatggccacatgtggatctgtatgcattcccagaacactgccaaaactggagccttgtccaaggggtggagatgagtgtagccccagaaataggtgtgtgagctccaggttggactggaccaggcattgctagggtctcagcttggggcaaggctgcagacatattaaagatgggttgagagttagaccttaaaatactggaaactcatggacccaagaaaggcagta

SEQ ID NO: 53913 - DNA, 1047 bp, Homo sapiens
gatttggtgactactcttgaaaagcaggatttcttttttcttttctttctttctttctttctttctttctttcttttttttttttttttttttgagatggagtctcactctgtcaccccagctggagtgcagtggcgtgatctcggctcactgctgcaacctccgcctcctgggttcaagggattctcccacttcagcctcccgagtagctgggattacaggcgcccaccaccacgcctggctaattttttttgtatttttagtagagatggggtttcaccatgttggtcagggtggtctcaaactcctgacctcaggtaatccacccgcctcagcctcccagagtgctgggattacaggcgagagccaccatgcctggccgaaaagcaggatttctgcaagaattttatttatccaaaaaatatttactgagccagcatcttccctgtgctgtgcacaccattcctgctcccatccctggaagatagctggctaatttaataaggaattaacagtcaggtgtgacaaacactgtgctgagaaacacataaatgacgaaagggtatcacccaggcctgagtagagaggagaagagtgttgcagagagaggaacctgcctgtgcagagggtggttgctgtattcatcaaggaaatatgtgtgaaagaaaggcctttgtaagctggtactaggtactaaatatgtgtaagtaataataggttattcttctctgaatgggaccccaataaatgttttgtaaagaccttcctttgtgttttcaataccatatcgatgggtggcatgagtaggggatggaccacctctatgagaagtcccgtgtttgtttcagaagctgagtttgggtcagaattctcagtggatgaactcccatgtcccttcagaagcctctgaccagcccgcgtgcctccgatcctcccaggccccacccccttagcagatctctcaccgggatcctaagcgatgtgtgtgttcttgggtgctctggccctcttcttggtgggtgcaaacaagaaagccctgctgtgtgc

SEQ ID NO: 53914 - DNA, 1072 bp, Homo sapiens
caaatatttggattccacttttttggaaccaacagtcctgcagggagataacctttgtctatataataagaccaggtagaaaaatgctggaagagtcaaggtagagtctcatataggattggagggtgaataaatcatcctgccttgtgtccagggtagcctaagggatatgttagaatggcagaaactagcagggaggtgggcattccagatggaggggagaagggcatgtgcaaaggctggggaccagctagtgtcccctgtggctgaagcttagagtacgagaaaagggggaggttggaatgggaggcagagaagaaaggctgagatgagatcacagccctttcattatctccttgtttttttaaaatctcttgtcaacccagagattgtcctatattacagggtgcagctcaagtcagaggtgaattgcctgcctctctgaattggtcagggagcccaagagctggagctcctgccctaaatccagtgctgtgtcggcttggttaggaggccattggtattgcatgctccgtgggatgcctcatgaaagggacacgggtggaaactggtaacttctagtattgagttccagctcatgaacctacttgggactttagtacccacttggactaggaagcagggggcatttgagctgggcattgatggataactgggagttctctaggtagatacatggaccgggatggagggagtggtgagggacctgagacttgatctgttaggggctggagccattcccaggacgtgatcagcacaggggtggggcagagtagggatgcggccggggggccctagtgagctgcagggatcctggtctctctgctctccccttctctctgcccctctcaagtttcatttcatgtcaagtgagggactgaggaagggacggggaggggaggctgggggtgatggattcctcccgcatgagctcagggcttgctctgtggtttgtctctgattgcaaaaaccatgtctgctataaatctgtggcttggagggtctagctgtaagggacagtccctagtttggtggaggagcctctgcttgt

SEQ ID NO: 53915 - DNA, 1542 bp, Homo sapiens
tacggcatggtagtgcagagaggggtccgagctaggcctccccagacctaatcagcttacagtggggcagggcagcgctcttctgtgattcaattcagagcctcggtctgcttgatggaggcagctttaatgagattagaaagcttaaccaagaggccaattaaatctgggcccatacctgtttgggcagctgttgaagccctgacctgcacccggaggcttcctgcaggcctcctaggagactggttggggagcatgagggggcagaagaggcctgcgcatctggcccagccatccccagaacctgggatctgtttcccctgctggggtcagggtagagacagaactgaggagggatctgatggaacatctggtccaggagctcccagaagctggatccctgccccctcaggaagacaggcagcttagttgttgcaaagctcactacatgattttgatgtgcaaccaggcttggaaaccaggaagtgaatccattccctttgttttatgggtacagggaagggccttctgggggcagccagccaagcctgactcctcacccagtgctcttgtgtggcatctttgttcccagctcctttgattatccagggtgatggggatggtggcgttgcccttctgttctcagacagttttttgtttgttttttgagacaaagtctcactctgtctcccaggctggagtgcagtggcatgatctcggctcactgcaacctctgcctcccaagttcaagcgattctcctgcctcagcttcccaaggagctgagattacaggcaggcaccaccacgcccggctaatttttgtatttttagtagagaggggggtttcaccatgttggccaggctggtctcgaattcctgacctcaagtgatccgcccgccttggcctcccaaagtgccgggattacaggcgtgagccaccacacccagccttgagacagtttttatgtctgtttcttcatttgtgcttcatgccactgttgtgaggtaggccaggcagggaatggtgacttctctttttacagataggcaaattcaggttggactcctgtcccaaattggtaccagacccaaaggacctgattcagggttaaggtctttcccttccattacttaaatcttccttctggttcccactggaggtggtggtgggtggtatgtgagtttgtgatgtctggatccagccaggaagaaaatcccagcatccattaactgtgaccttgtgcaagacacttaactgttcgtgtcaccagcaagataggtcggatataaaataaatgagtggattcactcacctcaggagattgttgggaggattaagtgagatcagcctcctttggtgcctacatagagtcttaggatgtgggggcttattattgttcctgggacagagagccaggaggctttgggggcagggatggcaaggctctgggagtctggtctgccggagagtgatacccagctggtccccaggggacaggccacccttggggaaaacaggtagagagggtttagaatgaatac

SEQ ID NO: 53916 - DNA, 1038 bp, Homo sapiens
gaaggcagagcctgtgggtgcctgggagcaggggtggccccgggagcatgtggctgggtcaccctttgtaattgtagcactgtggtgaaggccccggaacctagggtggtggtggcggccggacaggtgggtgggggatgcctggcttcccatctgctcagcctcgcttggctctgaatggattagttctgtttgggttggagcttactgttgtgtgtgtttttcatcccccttcccatttgttcttctctccctggcctgagcgcctcttcagggttatgtgccttaggagccgcgagggtccccgcgtgggagggagagttgtgaagtggccattatccaaacaagaaagggagtaattggagtttgcattcttctgggcctctatggaaacagggatgtggctgggcatgggtagggggtgttgagacctcacaaaagtggggcacagtctgcagaaactcagggtacagcacagtccggatgagtgagcaccacctggtacagtgtgccccttaggttagcttgtgctgttgaaccaaagttggcgtgctgctgctgctggtcttcaacaccgctttattgttgatgagattctgaatgggcattaattccttcctgccaaatggtccaggtgaggcttctgttgcggaaaactgttggcagagaattaatattatgggcattgtgatgtggtaaaagatgagatgcaggtcttctcctaaccttgccgagtgacctctctgagccccagttttcccaagcaagtggggatgttgattcctgtcctgcagggttgttgaagggggaaatagataagctgtctaggagacccagtgccacctgtcagatgtgggaagcattcaggagatcctaagagtgtccatctcttaaatgccacaccaggggcacagagcatttgggatgttggaaatgcccgtggatatcagtggatttcctgatggggttcagggaacttcttcaaggtaacgcagatttgtgggaaaacaactttttgctttgcccttctctctgaaa

SEQ ID NO: 53917 - DNA, 1742 bp, Homo sapiens
ccccagttgtgttcagaactcgtcatggctcccttgtcctgcacaggctcaggagtaccccctttgccacatcttggttcaagtttccccttgtctgaaacttgacaagggccaccttctccggtctcctgtcctctgtctccgtgctacccatcattcgttctgcaaacacgtggaggcagtgctgtgtggagcagcgctgtctggtagaaatgtactgagggccttgcaggttatttcagagctccttgtagccacataacaaagtaaaaagaaataggcgaaattagttacagtaatatactttaattatgaccaaatatattcaaaatagcactgtaagatgtcatcagtgtaaaaatcattaatgacatcttttatatttttttcccccaaactgcctttgcagtctggtacgtattttatgcttatggtgcgtctctgaaccgcccacatttcaagtacttggtagctgcttgtggctagggcttccatgcaggaccgtgtgagtgtaaagatttaagagcacgagatttgtagcatggtggacctgtttaatgcagtttcttgactgctgtttatgggcattgtggccttgggtgggtgacttccccctccgagcttatgtgcacctcatagagttgtcgtcaggattgaacgggatgagtgcaaggaagggctcagcatggaacccagtgcatagtgaggggaaatgcgggtgattgtttacattgaagtaatgagccagaggctggcttggtgccagggcctgccccctgccccctgggctgactgtctaggcggggttgataacaaactgcccgaacaagggcagcgaggcatcagaagtgtcaaaagggatcatctagcacagggactggtagcaggagcaccaaggaggagggagaggtagtcaggagaggctgcatggcagaggcgcccccaccccaagctcatctctgctctcttggcctccagagctttctgtggcagcaccagcaccccatggctcccgtgagctcaccctttgtgctgtgtaattagcgcggtgtgcctcgctcttgtctctaattgtgttgtacagcgtgtactttattatatcaggatataataccgctagcctggcagttatcttgttcactaattgtttcacgtgtctgtctcgtctgccccgctagatcacctgcttctcctaagcagcaggcaccatcttttgtgtcttttgtctcccccagtagggcctagcactgccagggcatggctgggtgtcaggagcctggcatcagggcctgggttcgagtcctgcattgaccgcactgacttggtctgcagctgcaaacaagtcatactccctcctgtcataaatgagcaggtggtttctgagcccccatgcagccttaacatcctctaatgtggtggagattcctccactggttgatatcacgtcagtgttctcgaagtggtgagttgttattcctttgctcaacaaatgtttattgagcgcccactaagtgtcagttactggggaggcaatgatggataagacaggtggtatttctgcccttagggtgcttaaaagctagagaaagaaacaaatattaaaggaataaacacatcaacattatgctaagacgagaccaacctggccaacatgatgaaaccccatctctactaaaaaatacaaaattagccaggtgtggtggtgcatgcctgtaatcctagctacttgggaggctgaggca

SEQ ID NO: 53918 - DNA, 1105 bp, Homo sapiens
agtattattatcttctttctaatgataataccagtggcagctcctaagaaatgcagggtcctggccctggtgtacccagctagtggctttcccactcagccaagggatgaccgaggtaagagttgaagatggcctcaggtgaggctgcagtgtggccgggctttttacttctgttgcacagtctggtttcagataacccagtctttgccagtaatgagcctggtgtcctggactgaaactgtactcctgtttggacttgtagctgtcccctgttctccaatggatgtgttttttgacacacggctgacaccagcctggggcttatcacaccaagctgtgcgttatcatattcctctcattctttcacttagcaagtgtgtaatatccactcactccttgggagggacccagtgcgttctgtgctgtgctgccggcaagactggatcctgggggataggggatagtaggggtgcttacagtccaggaggaggaataagaaatgaacccaggagctgccagtctggctagaagtgtgcaaggagttggggataggatgggagagggagaaccttcagctgggggaagtctgggaagggctaccgaggaatgtggtgtttcccctggaccctcaaagttagtagtacttttacaaatgaggactggggaagggtatcatggtagaagacaacatcataggaaacagcttgcagataagagtgactgggcttggggtgaaactgacagcagggagagacggctgctagatagaaagcaagataatagtgaccatctttgagccccaaatccaagcgagagtttctttccacctatggcgtgtcttttataataaatccaaactcagccggacgcagtggctcactcctgtaatcctagcactttgggaggccaaggtgggaggatcacatgagctcagaagtaccagcctgggcaacataatgagacctcgtctctctctctctctctttttttttttttttaaagaaaaataactaaatgatggcatccaaactcaagttccctggcttctccatagctcccaattgcccagtctggcaaaggaagccagtggcctggagcctgaaac

SEQ ID NO: 53919 - DNA, 1014 bp, Homo sapiens
agagggtgttgaggttggctgcgcctccccgaggtccacacggcctgctggcagcagcaggcactaagacgggcatcttgtcagccgggcagatggtgttcacctgctcgggacatgctccctggtgctggggcccttggagttgctgggataataacagacagctgccagctctggaccgagatctgcgggtattcaaaggcttggaagtgtgcagggagaaggagcctgcccgggcttccctacatgctgtgtctcgccttttgttttgagatttgtgctccccccaccccttcccgcaccaacatccgagcaacaagagcattttaatagaggacagttctgttttggaaacgacaagaaagcgccttgtcgagtgtgacctggcctcttctttgtcctgccttcccccgctttgtgtgtgcctgcaatgggttttgttccaaggggcaaaggagttggacatggatttggtgtgttcctggggttttctttcttttcccttttttggcagcagctaaagcttttggttatttctgagtacagggcaaccggggagttagggatttttcaggaccaaactccagggtctttgagttaccaagtggtgtcaggaacaagtgagtggcacagaagccaactttctgactgcctggcgttgtctaagctcattgactgtgtgcaaaggacaaatgatttctcacggtgcagtctgccttgaatcctaaggggaatgtttccctagatatcagtccaaagcaaggctggctgtttgagaaccagcttcatttccctttgctgcgcagagaagggatgccgatgttgtcttggttatcctgttactgcagcttgactaaaaacttcactcgccaatgtcaacttgggctggcccgactcagtatcatcagctctcattaggctacttggaaaacttgtgtgttttttgggggtggctcagtttgaaatttataactggcctcagggcagggctcatgcctcagtccttcagtccaa

SEQ ID NO: 53920 - DNA, 1096 bp, Homo sapiens
gtgcgatccatatctcactgtaacctcaaactcctgacctccactgatcccccgcctcccaaagcactgggattacaggcatgagccattgtgcctggccactgcatattctttaacacacatcccaagctgcaccctccttgagaagggaagccctctttggccacttgcccccagcaagactttcttttgaaatactacagagctcagagctggtgctatgtgctggagccccttttctgtggaggcaaatcagccggtggatgctggagagaggcagtcttgggtttaggcttagatggatctgagagtctccccagctgtgagtgcgctgggcaggggccttggctgctgtagatggtcaaggagtccccagaactgtggctccggggaacaacacagagcttgctttgggtagagtcatacaaggactatttctacatgccacctccttgcttttttatagtgatgatggtttggctcattctccagccaaaaaccttagaaattggagactctgactcggcacgggtgcagggtaggacaggagggctgctgctcagtgtggtcaggctgccctcctgagtctgccgcccctccgagtgacggtggtgatgctgcagctatgggtgtcttacccttgggggctgtggggctggctcacatgctctcaatgggccccatgaggtaggcagggttgtctcgattttgacatcttgtgggtaggtcctttaatagtttttcaagctcttttacctccattgtccctggaggagcctcacgacaggtcctgcaagtcaggcaggcagggtgattgtcttcactttgcctggaaagtttcccagggcctgggggcccagtagggcttggacccactttgacatgacagaccctccacactgctgcctctctccttcttggcttctgttccgaagcagggaacactccatctcagcccttcctatggtgttctcagcagttggtgcattaagtcagggaggaccctggtcttcactggtggtggatttccgtcttgagcccagaggctgcccagcgccagaccttccctctgctgcccccttctgggatggccagt

SEQ ID NO: 53921 - DNA, 1008 bp, Homo sapiens
tttttttaaattaaaaaaaagttgtcttaatttatactgaggctagcaatagataaatgggtactctaactgcattttaacttgcactggaagttattaaacattgaagaatctctttttttgcttgctctagatgaaaaatgttataactccgacttttctactttctgtaccaaacaccaagtccatctgctgtgtgcttctcatagtaccaagtggtgtgtggtgagttctttcttttccttgactgccagggacttgcagctatgtaagagaggagggacaggcggcggctggaaacagaggtagaccaggcatggtcttgtgctattgtgtgcagttatgagctgcaggctgtctcacaagttaaggagagagagttatgtggcccagagagccttggccttgaggaatgggtacagacagtgcttgatctgtacagggaggctccggtagtagccttgattcaacattttgttcagtaatgtttatgggggcctcctgggcaccaagctcagtgggaatagggagatggataagagccagcagcctctccaggcagacagaatcacacgcggggaatttctatatgctgtgacagatggctggatagggtgccatggatgatcagggccgagtgacaagctctgccgttcttttgttcttaggattttcagctcccttccccctttcctgcttatcaaggaaggttggccagatcaacaagtatcccctccctgtccagcgtctgtacccaggtggctttgacttcatactgggaggggacactggaagcctcctcattcacctcctttgctgggacactgccagttgaccgggtgctcactgtcttaactaggcagctcactctccaattctggtgagaccagttccacaaaaagaacaactcttttccttaagagccctttgaggtcccttttaggcaggatctaaggaaatatttaagttcatagaatctttgtctagggaagcatgttcaaggtatca

SEQ ID NO: 53922 - DNA, 1011 bp, Homo sapiens
acctctgaagattcacctccctctccagcctggcatgaagcaggtacctgggacaggaatggatggcaagctgcctcctgttggtgcatttcagaggggtctggacactgagggagccttccttctgtcaaatcttgaaaaatcgtgaagtctgtctagacagtgagtttgaagccagtttctccagcattagtctttgtggttgcttcattcctcagatgcttcccaggccacctgcgtccttcaaagagaagaggccaacaaaagaataatacaaattttctggaaataccatgtcttagctgctgctttttcttcaggacttttttttttctttaaacctaataaattgatgcagaacctgcctctggccatttttcctgcaggtggtcattgtccccttggaaggctcgcgccagcctggaaggttgatcattaacaaattcagggagggtctgtgtggtacaagcaggagcacagaaagttggcttgcgtggaggtaggggatgctgaggaccttcccacctgtggggctgaaagtgacactgagtgggtaaggctgagtcctgaggctcctgctgcttctgtgtttggaaatttcccttataaaggggtttctgcttcccgtccttcccccagcacaggcagatgtcttatgtacctacatagtgccaggtgtagacctggatgggagttgcagagcgggtcactctgcaactcccattcacgtctacattgtcagaggagctttccatttaatggtgagggtggggagaaggtgaccgtcactgtgcaaggggacatgggccctagctcttaagtctatctggctcatcatttagaagctgtttgagaaggatgttagctcttcgctgagcctcagttttctcatctgtaggctgcggataaggatacttcctcacttctctaggttattagaaggattagaaagaacacatgtagaagcacctgcaggtccccagtgctcagggctggttggttctttgccct

SEQ ID NO: 53923 - DNA, 1046 bp, Homo sapiens
ggaagagctttgaattttaaacattagctaatgaaattgcagacaagggcaatgggtggaacggcctgggtattcccatgaaacagttattagagtcagaatgctctggggtcggccatgagggagaaaggcaggcctggctcgcgtgtgtgtgccacaaacatttatggagccctttcccagtgccaggagctgcgtcaaggaagagctttgagtcctgcccagggtgtcccagcctggtggctaaatagaataagcttggggcagagaagcagcttgactggcaggacctttctgcacagaggagctggtatctgcagagttggaggagataccaaaccaggcttggaaggaaaaggaggctgacctggctgcaaagaggaagggatgcgggagggtattccgggcagatgctggagaagctggaggtgaggctggagttccggtgtcccccggaatgggcatgacggtgggggctggaattcgtcatttcccctgcttctgcctccccctcttgttgctgcgccttgtgcagttgtgtcagagatgggactggctgttcattcatccgctaattgttttgataagagactctaattacccactgcgatcatcagattaccctgagctccaggagggagatttgagagtttgagctgcggctgctgctgccatcagcaccgccatccctgctaaaaggaacctgctcctatacctcggcccctgtgcctgcctctggccggtgctcactaagccatcacatgaaggtgtgacaggctgctgggtggggggtggcgggggggagctgcctgtgaaatccacccgagagtacaatcccctgatgtcaagcaggattttccctttgattatctttgccactgtgttaagtccgcagataagaggtttggttctagggatttcaaaataaggagaggagtgtggaggaaaccagagaaaaacagtagcgcctctaatgaattgacatcggcagtcgagacaaattcaaaatccttttcgaactgtttgattaagttctacttacatgt

SEQ ID NO: 53924 - DNA, 1056 bp, Homo sapiens
tccttctggctcaggttgattttcaggcctgccttctctgctttgggggctgcctgtgcgggggatccatgcaggtccgttttgttcttgggctcaaggctcttgtgtgtatgtattaggggaccatataatatcccaaccaggatacttttataaccaggcagtgctattcatcagtatggtggggcgccaggtgtgaacgtgcaaagtctgggatgcgtggtctccttggtgttatgttggaagctctccttccagctactgggtattgaccaaaatctacccaaaagcagtccagtgttcctctcccctccgtactccagccctagcagcccaagatgaattgtggggtgagaaggacagccaaccaggcttgtcccctcccccatttctcagggaggggagcggctgggccgctgttttgtattgaacatttgctgccatggcatccagattcccaagaagctgggggctccctgcctgtgattgtgtaacttggaacagttgatggggagggagatccctgaattagatcaggaaaatgtccttttctggtgacccttgcagagcctatagtctccttgaggcttgctcacctcccctgtagcctggggccctggaccaagcacaggcaggtggcagaggcctgacagtgggccctcttgttgttgcaagccccagcctggcaggccatcctgcctcctcccagtacacaatcagtattgattgtgcaggaggctgggactgtcacatgcagtaatccttgcttcacagcaggcatgctccttgaaggaagaaaggaagaggttttgtccctgatctaacatgcctttaaaaatgcaccttgatttaagattcagctttttgcagcatattttaaaatgtcagaaagataaatgtgcagccttcttaatgtgtctgccttgaacagccctttaaaaaaagtatatcattcatcctcagggtcacaggctgtttgcctccctccctgcctttgatggtctatccacctcttctatgagctgagtttgggtgggggcaggggaatagactcaa

SEQ ID NO: 53925 - DNA, 1050 bp, Homo sapiens
tgtatacatggttttcattcttgggtttttgtcttggctgtgaagtggcacgattttctgaactaatcctgtttcatgtaacccgaacccaagtatctggacgtgaagggcgagctttttcttcctcttccttaaccaaggatatccgagactgtagcatctggaagtggttgggcatctggtctgagggagtgtgtgtgtgcatgcacacacttctgtaatactgagtgactgtgtccagacaatgcgcctttgtctctccagccaggcatatacctgtgcttctttctatatagaggacgttacatgcggaggttattatatcggggcatatgtttatgtggcatacacatgtataaacctttatttctacttagaagaaggaaattttgaagggctttctgtgtactaaagtgtttgcaatgatggatgttgatgtatttttctttacaaaatgtaataagccatttaacagtgccttcagtggctgtcattagccatttcttcattacttccaggctctgccgaatcatgcattgggggatccctgctccctggcaccaggagcagtgatctgcacccacggtggtgtgctcaggaggtagcacggacttcagggtggcctgcgttggcgatctgttaagggtgtctctttgctgcctggttttgacgtgggtgggatcctgtcctgggagatttctgggctggttgtgtccttgagagttaggctctgaaagggatttttttttgactgcacaaggttggagcgttgagatttgggctgtgtcagcaggtagagcccgtgtcctcaccttgcaggtgacaggcagacagtgctgggtacctccatcagagggatgtgcatgaggaacctagggtgtactggtggtggggagggactcctgtgaacaaagcggtcgcccttgctctggtttgcccccagggactgctaggcggtggattcatagtagaattttacactcaatgccagaaagaacttggtatagccataaggatgaataaaatgggaatggatggccgtggaggtgt

SEQ ID NO: 53926 - DNA, 1036 bp, Homo sapiens
ggatgccttaggcttatgtggcctttttggagctcttgtcaaggacccctgggagcgtgtcacttccttggctctggttagggagtggaggcacaggaaggtgaagtgacttcttagaggccacatagctagcaaatgtgggccaaagctatagtcaggccctagtgactggggccaggggggtttggaaagatgatctcttctgcccagccctttcatttacagatgaaacaatgcagccagatgggcagcttgacctggctgaggcattcaaggtggctgggactagactcaggtctcctggctccagatcccacatcatcctctccacactcccacccctcccagcagctccctgctccacttttagtttccttgcatctcacttactgttgctgcctctcctgcagggctgatgcgtgtatctgtgactgccatgtgggagtcctttcacctactgctcctgccaccttccttggttgccagtatctgattattctatttgccaccccccttgcctcctgggagctaatagcaacagctggaactgaggggaaggctcacaggctttggctaggcagcctggaatccactctcagcccttcacttaggagctgtgcgaccttgggcaagtccttcaacctttctgagccctggtttctcatctgggagataagatgattcggacttgataacctccagtgaccttgcagccctgcacaggtctgtggctggtgattttcatgaaagggagcaagagccacactgacctgttgttggaagctgttgggaagggcagatgacatggactggtgggaaagaccctgtgttaggaggctcaggcatgcatttccagctctgccttcaccagagaacagttgccttggctgtgggtgctggcgggcagttggggcaaggcaccaccctccttgttgcttctctgccacttcctttgcaccaatgctgggggcacagacattgctcttcctttttggtgaccatccagggtagagaagttgctggtgagtgtgtgagc

SEQ ID NO: 53927 - DNA, 1322 bp, Homo sapiens
cctcggcctcccaaagtgctgggattatgggcataagccaccacgccaggcctattttatttatttttgagagagggtcttgctctgtctcccaagctggagtgcagtggtatgattagaactcactgcagcctcaaactcctgggctcaagtgatccttccatctcagtctctgagtagcagacaacacatcaccatgcctgcctagttttaaaatactttatatagataggatcttgctttgttgcccaggctggtctcaaactcctgggctcaggtgatcctcttgcctcagctgccgtagaagctgggattacaggtgcaaggctctgtgcctggctacatttgacttttatatggccctcactgtgtaccaggcaccattctaaacagttacatgtatcacctccattattatctctgttttacagatgagaaaactgagacacagagagggtaagtcagttgcccaagatgatacagcttatacgtggcagagctgggatttaaacccagatagcctgtcttggagttctttgattttggttttgttatgtagaaacggggtctcactatgttccctcagcctcccaaagtgctgggatttacaggcgtgggccaccatgcctggcctgttgaagtttttaattaccaggccatgcagccttacggagagtcaggtgggttggggtggtgagaaatctgacggtgttttttggcaggatgatggctgtcctgtttggatccagggcagagctacagcctgagcatggctgtataaatgggagaggcatctgctctcctgactctgcacaccaaatggccaggaataggcagaggaggcgggaggatgcaggagaccatcttctctcccgagagtctatgaggttatgaaaatcctttccgtattctgtggggtatgcaaggtctccaggcacacccacgtagctggctggctcccagggctttgttgaggacaaggtcagctttcctggacattccccacccccaagcagtggtgtgttcagtggtgatggtccctgcggaccacaggaggggaagtgaccaggtgtttgccaggtccagcctggccctattaggaagccctggttgtcaagcgcagcagaactgctgacagtgacacaggggaacaatgctgcgtgggaggaggcgcacgcgtgtgtgtgtgctcgcgcgtgtgtgtgcgtgcatgtttgcttactcccctcctgacccgagtgccagcagtgacacactttacttgtcccctctggtcccctgtgggcactgaatctgactctctgatgcgcttgacgccctct

SEQ ID NO: 53928 - DNA, 1518 bp, Homo sapiens
ctttctggaatggatagttagaagtttaagaagttatgcccatcagaggtacagaagtccctggctaagaatccagagtgccagtgctagaagaactttagagatggttctgtttattcccttctttctgcagatgtagtagctgaagctcagagaggttaagtaatcggtcgaagccacacaggaagcggtaaagctggaattggcgcccatctctctggctccagtgcccatgcttgtcctgtgacatcatcttggctcctgctcttaatcctcccttgcgagacttatttctcctgcccttcccccagctacttccttttcctgcctggattccccaggaattcctctgcgttgctgccttgtccagcctgggagaagcgacaagagctgaccatttgagtgagaacccagccccttgctgtttctctgacaccttccagggatcagagtgcttgtcttacgggattgtgcgtgcctccctggctcctgaggacaggcagaaatgagccttgcgcctttttgggcctctcggtctcagggaggtttccttgaatcgatgtgtttgggcaccggggagatagactttaaatgttgtgaaactctggggcccatggcagcctgtggtaagtctggccggacacatgatcttcagccctagccttaaatcagcctctgtctcctgctgtctctgccagccatgcagggcagattgcatgagggttcttgacatggatcacagttgccggggcccagagtctggaaggtggtttttgtctcttgtctcctttttctttgcacacttatgcacaagtgccttttgttcccagaaatgcagctttctcagtccccatcctagaaacattgtcggaatgtaataaatctgattctgtttatgttgaagaaatgaaacatattgctctccaaggaggaatgcagcggaggccttgaacagggctatgtttatgacaacagtttgcacatgtggctttatttttgaaagcgtagtgctttgcccttcttgatgggattctggtaacaagagctgattcttgtgtccgggtgttgggcaaacaaagggcagagctggctgaggccctcacagctgtggctgtcaccttagttctgagagcctggctcctctaggcccttgtcctttcctgggggttgcagctcttcccggggcagtgcctctgtgctgcttgagtcagagcttattagttcagcctcctattcccatttccaggtccaaaacaacaggatgaaatttaataggcataaatgtaaagtcctacaatgtgggttcaaaaaaatcaacttcacaggcacaggatgaagaagattcatttgaacggcaagtgagaaagtggcccttgaatgtagctgccagtcggctctgtgtggcagcagttggccatcactgaaagagagtaatacaggctcactgcacaggtatcatgtccgcaaggagaaagatgatgttgttattgttaataattcatcctaatagctaggtac

SEQ ID NO: 53929 - DNA, 1779 bp, Homo sapiens
attactgctatcattcctgttttctggttgatgaaactgaggcccaaggccccatagctaaaatgttgcagacaggattcaaatctaagcagattaatttcagagctcacgcttctaaccattagctgtatagacacatccacactgagaatgtgtgtctgccaagaatctgctatctgtccagcatcaattatcctcaataagtgctttctctttaaaaatcttaactatgctttccatttaatccttaacattcctagtaacccatgggataagataagacccccttctcccccatttcctattctttttctttttctttttttttctgttacagattgcaccaaatggtgataggtgaagggtctctggagagggcaggatactttggaggctggaattgaaccatgttgtcttaatccagagcctgtgggagagagaaggcccatgaaagcactctgcagactgtaaagtgctacatgaaataaaaggcatgtgagaaaaggtgtgtgtttagaagactagctttaacttggacctcgtgcatcctatttggggatttcttgcaccgtcgtcatgatctggtttcaggtacctgtgaaaaattatggtaattaaagtataatttagaataccctgttggctcacagcagctggtccagatgtaggaggctggggctgtttgttaggggtgtcactctcttctgccctttgtgttgttggggagaagggtgggggcaaagagatacaggagctatttttacgttgttcacgtcatattcagaattactggatgcttgtggttgggtccctgtttagcctcggctgggaagagagaactcccttggctgcctgggtatgtatggaaacttgagctcataccctttagtatatatattgccgtaaaggcaaatggacgcagagtgaccggacagttaccctgaatagttggctgagattttccattctcttcagaatgcttctagcgggtggagaaagtggggttaggggtcgggagtgagagggcgggaagcataggcgggcagccatgtgctcatcactttggttatttattcaacagatggtttttcagtgtgagatacatgctagatcttttcccaggtatttgcaaagtaaagtagaataaggtattgtccctcaaggattttacagtctagttggggaaatggaaaaataaacattcgctttagcatatgcaaggcaagcatatcagcccgccctgccgtaggtgccggctatgcagccccattgcagtaggggcaccgaggctgtgaacacaggagagggacacctggaccacaggggcagtcacaggcaacttcctggagcaggcagtgagtgcagaagctggcttcacaaactggagaagcacttccggtttagttgctgttgagtgtaatatacacacatgatgtcatggatggttacaatcattatatctcattttatttctcagtcggcctgggactttattctcattatttttcaaaaataaattaaaagatagagatgggggtctcattatgttgtccaggttggtcttgaactactgggctcaagtgatccccctgccttggcctcccagagttttggggttacagacgtgagccaccatgctcagccagattttattttttatgcccaaaaaactcactgtcttcaaaaagtttgaggaggccgggcatggtggcccacgcctatcatcccagccctttgggaggccaaggcaggtgatcacctgaggtcaggagttcaaga

SEQ ID NO: 53930 - DNA, 1669 bp, Homo sapiens
tcaatcattatactttaagttttagggtacatgtttcctccacaaccataataaaggaattaacatattttacggcaggtagcaattaagctctgggaaggtaaggactgggctatcctctttactgtcctgttcacttttgcccttggtcatccttgcccagcacagcacttactaccatgggagctcagtaaatccttgtggaatgaatggatggcaggtcggcatctattctctttggcccatggatgcagtttgggtgaaggcaaggaaataaacattataatcagaaatcactgtaattttttaaggtttctcaaggtatgggcccactgtgaggtcaggatatggcttcagagtggagcccccaacacattaaaggggagacgtctggccagcagtccacaaggccagggtgcttagcagcatcccagaacaggcagggaccttgaaaggtctctgccaacatgttgtcttggtaggtggaaagacgtggagcctagagaacagaaagcactttgccaagaccacacaacagtagggccttgggagacctctacttgagcctcagtttaattgcggaaagagagttaatccagcaccaggtgccagccggcttactatgcagacattgtttcactggcctggagagcgactcagtttggcagcaccgatttacagaggagggaatggaggcttgaggaacttaagttgctggtctcaaaacacagcagaggtgggattgaaattcagatgttcctgattccatagcctggttctttccactgccctgctttccagcagggtggagtggaatgacagccttgtttcttggattggctctggtggggaccttctgcctcctcttagccagtggggctgtacctacttgtaggagcctgcagccctctgggctggtatgggagtgtcctgggtgttcatggagtccattttttctccccaaccttgttttacgtcgtttctgtctcctgcctctccacctctgaaagaacctcagaaattcctttgtccccttatcagtcatttccctgggaagccactgaggatcctggaaaggtaccgagggtgatgaagcaaaatttgcaccattcccagagtaactttccatcatgcgtggctaaaaataaagtgtgtactcatttctccttgctgtgcgtggacttgcttttggggtttcacgggagccacttggcccttttgtccctccctccctgccacccctggacaggcatatgcccacaacttggggagatgggtgggcttgaagctgctcacatctctggagagcagaacccctgagcctctacaaggaagcacctctggctctcaatggcagcaaacaccacattggtgggttggcactttggcatatgcggggataccgactccctttgcaaatattactgcagccgaaaagagacaagctacctttagaggactttctttgtgcagggtgtttctttttgatatctggaatgcacagaggcaagagagataaaattaatttgttcaattaattttgtaaatattgactgaaccaaagttttatgccaagtcacatgtcagggacctgagagcttaccaaaaagcaaatgccttccttgaaggcgcttatcctctaggtgggggaagaaaggtgtgttaagaa

SEQ ID NO: 53931 - DNA, 1720 bp, Homo sapiens
tgctagtggctctcctagccccttctcctggtccaaagctttttgtgattgatgttgccaagaaccaatgtctttcctttgggtagacggggtggggtgtaatccttgctccagatcctagagttcaggactgctgtgccagggtgaccttatgtgtgtcaagtagatatagttatatgaagccatggtttgtaacctttatggggccgtagatacctgggagactgaaattcattgccctcctctctgaacactgcacattcacatgtattcaaataattgtgcgccataaggccaggggttggggtttgcaaaccctctgaagcccatccctgatccccttcagaggcagacctgctcccctgccactgggtggcctggacagctggcatggcctcttagtgtccgttttaccttcagtaggatagctacagtgatagtcaccgtgtggtttgattatagcagcagttcatgtctactgagctctgatgttgttcacccagtccccaccctggccccatgaggggaaggtactaccacccctgttcacagatgagcaaagtgaagctcagagagatgaagtgacttgtccagggccgtacagttagatccaggatggggacctaggcagggtggcttcagaacacatgccaaacacctgacacgcagcgaggaatgtatcacgtgttcaatacataaatggtagtagcaatatgaaaagcggcagagggttagggcacagcctcccctcttccccccacctgtcctaagtatccccctggtacaggatccgggctatggagctcgcaggcgggtggaggcgagcgcagatccgccaatcctgggaaatgtgtaaaatcctgttcctgaaaaccggccgggttctcaaagtgtcccggctggcgtgttttgctagtcacgaaacatgatccatacgctgtattttaggactccccatctgtcggcatcggggagcgttttcccttgaggaagctcaaagcgtgtcagctcactgggaggggaggcagcagaagggtctgtgataacagagtggatccagagggctggggtgtgggagactcggggaagggtcctgcccagggtgtgccaggtgcctttccgcatgacctcacataatttttacacagatccccacgttttacttaagaatactgaggttcagggaggttagcttctttcttgtccaaggtttcaaggctgctaagaggctgagcagcagagattgaacttgggtttttagattgcccagtgttctctgccttcccccagtctgtcccttttgttcctgggctttaccacggtaggtggtgaaggacagggtgtgggaggccttgcctgggaatgggagggggtggggagggaaggcataaatgcctggctctcaggcccactttgcagagagcccacacctgccctggccccacccactgctctggtcactgctggtggtagaggaagagctaagagggctattgatccacccatctcctcccagggagggagggccacacattcagggctttctttttaaaaatgcattaacctgaccgtaagaaggccctggtttaaaaacaaataaaaataagaagtgaaacaagtgggcgtgggggcaggagtggagcaaaccctttggaaaatggaaagggcatttgaggagggcactttgcgaagtaccttccagttccagacctggatgcct

SEQ ID NO: 53932 - DNA, 1253 bp, Homo sapiens
tttcaccatgttggccaggctggtctcgaactcctgacctcaagtgatccacccgcgtcggcctcccaaagtgctggaattacaggcgtgagccaccgtgcccagcctaattttttgtattttggtagagacagggtttcaccgtgttgcccaggctggtctcaaactcctgagctcaggcaatctgcccgcctcagcctccaggattacaggtgtaagccaccgcgcccagcctcagtacagtaatcttctgttaggaatctgctctgtgccatggtcagggcttggtcaggcacagagactttgcttggcgtttggggtgagacgctagttacttctgtggaaaccaaggattttaaaggaaatcttaaaaggagatgttcatgcaagcacttcagagagggcctttgaaatgcggaaggcttttcttttctgccctattacttttgaggccagctggctcaggtgagattactcttccttctctctgaaggaaggtgtggggaaaggagctgggaccatgggcttagaggttcttccagtgccttggtcttttccctggatgggagggctgagactcgggtggtttttagagtgcggctcttggtgtcctctcttccaggctgccttggtagctgggaactgttttattggaagggcaaatattgcgtagtgtcaataaggatgttttttatgggggctcctgtgtttctgcagtggataagcatgaagaagccaagtgtaagttagtttctaacggctgggttcagccctttttcttcccttgcagaagtttcccatccgagcagagagaactgagactgagcctgctggccacgcacgagaactcttgtaactttctagtctccccgtgtatcaggagaatttccgcacagatgacaggagtggagtagaaagcatttgtagccattgtattggaggaaacaagtgtaatataaataggaagtctgaattatacgtctcctcagtgctgtgaggaaaaaccacacgcaccaaatgcaatttacagctgtacgcacgtggactaatgggcactgtctgccagcgacgcgctcaagcagtgggagaccttgttgtgttaatttctttctttttaatttgagacaatgtcttgctgtattgcctaggctggtctcgaactcctgagctgaagtgatcctcctgctttggcctcccaaagcattgggattacaagtgtgaaccacccaacctgagaacctgttctctgttgc

SEQ ID NO: 53933 - DNA, 1331 bp, Homo sapiens
tctctcctccatagtggctctttttgatgtgcccaacattatgctgggtgttttatatttgttaatcatgttccatcctcagaagagctttgttcagacaggtaattgtcatcttatctttgcagacgaggctgctgagaacacataatgggtaggtgcttacctgtttcttgtcgaatgggtgaagagcagcagcttgctggtcatcgggctgggtttttagcctggttctggctctcaacaagacactaggctacctctcccaggctttaccggcctaattttgtgacttgccttgagtgtaggtgagtgccagagcaaggagaggaggtgagatttagaggccactcacttccgcagccctgtgaactcacttccaaggccttggccttgctcttccaggcacattggtgcctccatctgagctgtatctatggtggggaagtgagtgggatgcatctgccccgctgccccatgaccacagaccctaagctggcacaggtgaggcagcgtgtagaaccttgcaccacatctatctgcccagccatctccttggccttccagtattgacttggccccagcaagtccccggtattggaaatccaaaacaaataaagcccaacccctggacggaagtgggctggtattctcactgtgggagcttgaagtgcggcagctgtgtgggtagccagtgctctgggtgtcacctgtttggcaggctgttggaggctgtcccaggcagacctcaggtgtgtgagggagaaagttagaagcatgtgactggctgagggggcaaggcaggaggatgtctacttcctgttgttgcttgtgtgtcctcttgacccgcaggctcctttttgaaccttttcctttttctctttctttctgcccactctctgctaatttccacctgtcctcacccgcccccccccccccgccccccatgccttctatttcccaaaccttgtgggttacctcagactttccttggcggttctcagttggcggactgaggggcagagtccgccacccgataaagatgactttgtgtctctgtccccagatggatatggggactctgacctctccggatggtgtttgcagaaggtcgtggttggttgcacggagtcatataatcctgaagtggcaacagtgcacacagtgaggaaaggggtgggtgattgggtggctgagagtgttgagagccttggagtgaatgatttccagacctgttagttttctagacgcagtaacaaagtaccacaaactaggtggctttaaacaacagaaacttagtctcaatgttctggaggctgaaagttcacgaggaa

SEQ ID NO: 53934 - DNA, 2287 bp, Homo sapiens
acccgatgacttgtagatatgtgggtagaatgctggagggagaagcggctcctggggcacccgtgcttggccccctttggatgtcggctccctttgcagctcctaagctctgtgtttggggtgggagcggctgcgaggcggtggggggcttgtttggcagacggcgcccatcagacaactggaaagtgccagtgcctgcgtggccatctgtccccgccgcctagctcccggccgccttctgcttcccacagaagggcccgcgctgttctgtagcacaagggcacggggcctggccgggaggggcaggcacagttccattttgccattgtttattcccatctcctttgcagctcctgcgcttgggagttgccaggtgcgtgaaaagtttgctgcgccgtggccgatcaggttgtttggtggggcgctggcgggaaggaaaggtggaagtgtgcggcgtttcctttgcaccgtgtctgtttgttcaactgtggactttcacccctccccctggctgctggttttcttttttcttgctttaatttgtaaaaacgcacctagagcaggccagctccccgggatttgggctcatctgcacgctaccctctccgagctagttaaagggttaaaaattatggggaagttcagccggcacttgcaagatatggttgccgtagcaacaggccttctaatctggtaggtgacctgagagactggagaagatgtaggggttggtttggcatttcattatttcatgaggctgcctctccagctggtttctctgctgagcttaaagcttgctgttcctgccactagaattactggcacattccaaaacaacagtgttgatggcacgagcactgcgttaatggggtctggccaggcagggtgggcggaggagagggagctgggttccaggagccctcacgtgggatcgtgtcccctcgcacaaagcgggaggtgtggatagagggatgtacgcaggggtttgccctcctgcatacaatagccgccttcttgaaacaccacctcacgtaaagagggactggctttttaggaggactttaagataactcctttagttttccaagaagcctccttaaatttgggaggcaggggagctctctgaatttgggggagaggctggacgcggtggctcaacacctgtaatcccagcacttcgggaggctgagccgggtggatcacttgaggccaggagttccagaccagcctggccaacatggtgaaaccctgtttctactaaaaatacaaaaattagtcacgcatggtggcacgtgcctgtactcccagctacttgggaagttgaggcgggagaatcgcttgaaccagaaggcagaggttacagtgagccaagattgtgccactgtactccagcctgggcgacagagtgagaccctgtctcaaaaaataaataagtaaaataaatttgggggagatctccctgtaatgtctgtggttggtgccctcctcttgtatttatctccagatagatattgtccagaaattcggcttagttgagcacagtagcctcatgtctgctgtgtgcccagcacagagaggaacaggacagagagtgcctggtctcattcattctctcatcagacgtttgttggacgccgcatgtggcaggcattgcagagaaggggcaggtcacaccgttgtcctggcctgagagcctcccattgtgtgagggaccttcaaagcaagagcaggagaggaggaggaaacaacccagcctcaccctccccttccttttagagggaccttgtgtcgagggcagtaagcagtcttctggccttggaaaggcatgaggcattcatgatttttcattcacctttctcttttctacccctttgctcttggctgtaattactgggaagtccacaggctgggtagatggcatgtacagatgatgtgttctgaagtccactcctccctaaggcaccgtgtcttaacacagagttgtgtgttacattaggcccaggttcacagggatctccgattggttggcttcctgggtttcttgttttttgaatttctttcccctggagaggttagtgttcctgggatttgtgagggagcggggagtgggctggagaggagcttagagtacttactgggacttcaggtggctcactccccctccccatctcggttgtaagctcctgggggagaggtctgtgtgttagaggcccagcaggtctttgtggaagttccttgctcccacgttagatgtgaacgccgagaaccacatgacaagagtggtagt

SEQ ID NO: 53935 - DNA, 1639 bp, Homo sapiens
tgaagcaatgctgtcaggtggcagctgagtgtctgtgccaggaggttatgcgggtgacaccaggaagagggcccaggcacacagagtcacgcgtgcacagcccgttggtttgctcttcatcattcccagccatggggaaattatataaagacattgcattttttacaaaaacatctccccctgcctcccaacaaaagaatagaaaaggaagaagattgtagaaaaagaggaggactaggcatagggtctgctggagtcagggaggctttgcccttgtcctggccctaccgttctccagctgtgtggccctgggttaattgcctggcccctggggcctcagtttatccattcataaaagaggggacagggtacaggtatacactagcaatacaggtgtgcagtgctcagccccatgcctgatgctcctgagccctcaggaaaggattgtgggtggaagagcgtcggaaacctgcagtgggtgggtttccagtcacgtggtcaccatttattgagtgtagcctagatcctgccacaggtatggcactagggggatgcagacttgagccaggattgtgttgattgttgtctggaacggcagacagactaattgacaaggtaggtggtggtcagtgctcatggggaacacaggcagagtttgaagggagcccagagaggggagtcgctggctgctttaggggctgggaaggcttcctggagggggtgttgctgctgggcctcaaggagtgagaaagaaagtggaggggaaggggcattccaggcaggtgcagatctttgtcttggaggattatggccagtgaacactgatagtgcctgacatttattgggctctcagtctgtgccagcccctgttctcagtgctttcaacatgaggtagtttaatcctccagaccaaccctgcaaggcaggtattaccccattttgcagttggagaactgagccacagagaagggaagtaatttgtcagggcttacacggcatgtgggactcagtctggaaacctttagagtcaggctcgggagaccaggcacatgcctagcctgccttgcctgacaggaacccaggtctggttgttggagatactcattaactagtggtttgggagagttggtgagtcccttccaactcagtttccttatctgtaaagtgagtataacccatgtccgtgaaaggatgaggttctcgggtggagttggctgtatgagatgtgctcagagagtgcctcatgttgtgggaggcccttccctcggttcctgtaccaggtggtggttgcagggtagaaaggtgtttaatcttaaggtagccactcccccacccctgcccgactgtcttcgtttttgaggccaggagcctgtcagctttggcaggattagataaaacgtgggcacggtgcccagtgcagcaccggcacatgcacagtccctgtacgcagttgtcatttttattattgtgtcttctctctcgatattgatgattgttaactgatggtcctctcatcagtcctatgggtgattttagcctcactttagaagaggcggtagcttgggggtggagagtgcatccagaggcaccatcattgcagacacactgaaacaccaaactgggtgtgtctctctcccat

SEQ ID NO: 53936 - DNA, 1154 bp, Homo sapiens
tagcgtcaagataaagtccagtccagaggaaggctctggctgtgggtcaccctttaaaggctgttactttacatagatggcttctatgtgaactctgaggtgctcgcccctcaccatcctttccaccaggcgactggaggcttctggagggggactggctgggggcgcctctcatgaatggtttttctggatcctgtctcctgggcccacaacttgacactcttgaagaagcactggagtcacagtcagctgctggtgtgaaagtggctggcagcaggagtatactgtagcagcttcaagcaggcctcagaatgtggatgaggtggaggtgcctgtggactggcctgtgggaaagagctcagagcagagtcctctggcagaccccagtctggctggtccaccacacatctttgctaaataaataaattgaatgcatgcatgcatgcatgcatgcagtgtgatcccccccaagtaggaatgaataaattcccctaggtggtttgtcatccacgtgtgggcttttctatctgatccttagtttccctgtcagtcccatggtggtgacttttcagcactgtcaggctgtctgatgatggctgttgtgctgcggagccctccaggctctgaccacggggtcctgcccaacacctggggacacagagacagaagcaggccctgtggacagctagtggagaagacgggtagcatgtgcagggccaggggcatatcctggcccagcctcctctactgccttttttggcttgccccaggataaggttacagattgggagccaagactcccacagtgacggggtggggtgttgtgcatcttcccacgggatgctctcgtcccctccccctctctggcccctggcctcctgcccacctgagtggtgcttgtgcttcggctgtatgaccttttcatgaaatgaaaactaaagaatgtttttaagcaagttcatgctctggaagtcagttagctcacgttgatagccctgatatctcacgttggattaggtggggtctgcattttacactctgtctgggttcttggggtcagggttgtgtgtggttagcatggatttgctttgcattctgtcccctgccaggtggggtgggggatggagggagaaagggatggggacagcttgttc

SEQ ID NO: 53937 - DNA, 3134 bp, Homo sapiens
ggaggaaccatggggaggggaaggaaaaaggagggggtgtgtgacttagcctgtccagaccacagagcgagtcaatccccctggaacagtggcgtccgctgctctgcggggagggtctgcccatgacctggtgtgggagccgaggccgccaccaacttgggcgcccagcccagaccctaggagagggaggagcctggagcagcctttccctggcgagattggccacattccattttcctctctgaccagagagccctctcacccctgggtgtacaggctctttccgctaacagaggccctcctccagccccattgtccccactgtgagaccaggagtgcccctttcccagccccaaaaaatgagtgcgctcccagtgtgaggcacagagtgaaagcctcgtgttttagaacggcgggtgggaaggacttgatgcgccgtgttcttgcaggaagggcagggacgataccgccttgtgctttgcctggcacatggtaggggcctaggtatttgggcgaatggagtgatgtccagagaaagcaggactttggctcgggcaaggagtgggtggcagtagggaggactgtggtctgtggaagggtcactgtggctcttggctttctcctactgtccctgccgatggtgacagccagccagcctcctggccgcaccattgtaccgcctctttcttggcttggtcctgggcgtggatgtcagatttgctttgttcatgtaaaatgtggtgggatcatgtctccctcaaatcaaattccaaccaaaatcaaaacaaaacaaatcaagcgtctcagtgaagacagccctgagggttctgttgtctcagcctgggagcctgggagcctggtcgacctcacctgcttttcagattttgccatgtttattgcagacgtccccgtcctggtgctggccactcaccttcattacaggttaattctcacaacctccaggtgtggtatgcagtggttttaaggaaagagaaaacagaaaaaggccacacaggtagggcttcacagcatctgagggcacccagggtggccgaggtgtgctgctggcgaaggccctcctgcagactagaaaacccgcatgtcgctcctgcgtagcaagtgtcatgtctgttactggctgacactttgagggtttttcttttctccaaataaataattctttgtctctcttcagggtggcagatcggggctggagggaggaagccatcaaaagcaacctggctgactatgaacaagtgggttggggcggggacctggccaggcggtggcggggccaggagagccagcgtcttgtgtctggcctgggtggggagggtgtgggagacacctgaagccacctcggaaaatgttcggtggggcatttcttgcccagagctgtgtgagtgaaatatttgactaaatggggagttccttcctcggaggaggataaagcgggctctcttttcctgtccctttgtctcttgtcccctttgtcccagccctccagctctgcggcctcccctcccccagcggttccttcctttgtgcccgccggccactcaccagtgaaacttaactcagccccgggcctcactcccctcgaaacaacagaaggagctagtaggggcaggcctggctgtcagcgccttggactaaaaggaaccaaaccgccgtcccagcccccaatggtggcagttaattttgaagtttggcgttgactgttggcagtcccttccgagggagcagctttggagggggtgttgctgccccagccagagggattgggggctgtggctgaggccaggagacctggccttacacccctttccctggtaaagggccctgggttctccaccacagcccctctttgtcctgctctgagtggtttggagttctttgtgcagtggcccagaaatatggacgcgcaaactgtaacagagccccacccacacctctgggtagcgaagcacccatatttgttacatgattgtcttaatcctctttaagcaaggattagcgataactagggggttaaacaaaaatcagaaggaaaaactgtaagttggggaaaatctatccatgaaagaaagttgatgagaatatgggaaagttgggctggattcagttcatttgttataaaaatgggaactctggcaccttgtttctaagctgatggccagaggtccgagggcatctgctttttggggttgtgtggcctgcacgtcaggagagtgcaggggaccggggcctgtagaggttccgtagacttggtgtggatttgtgctgtgttgaggccgagcagaattgtggtgaatcggcacggcttcattattgctggaagtatttttccttacttaaaatatctaatttatttacccatacatgtttaaaataatatagcagataacatgtaaatttagagatactatgttccaccctaaatttacatgatatattttattctaggtcttcatatgcgtttttgttatcagtgtcttaaatgctgtcatcaaagccagtttttatcttctaacccacctttctaggacgtatcaccaacactccaagttgtttgacatatattatttttcagctttgtgtatgatgcttcctctgggaattttgtcccaagccacaggaatccattagaacatttaaacagtggctttgtaaaaatgtgtcttataggtgtctgtcgctggaaatgctccagcagatctgagatccctgctatgatgctggggggatgggtagggaggcaccacccttcctgagtgttaagagcctggctgctggcgtcctacctcaagccacctgtgtgaccctgctcttttctgcaacctcagtatcctcatctagaagaagcagacaacaatgcctagagctcacttctcaggattcagtgtgtgtgcccagtggcctgtatacactcagcactcagcacactgaggttgggctgttggagcactcctgcccttcgggtttacggagtaaccttgagggcttatcaggcagggcctggaggcagaccttgtggggaaagggaggagcaccgtgggtttcagttttgggttttggagtggggaaaccattccaggggaaaggggtatgctttcagtaatggcgatgaggcc

SEQ ID NO: 53938 - DNA, 2182 bp, Homo sapiens
ggggagcaggggtgaggacaaagacagctaagggagccaaatgcttttaggttaggagtgtttatatgtccccagcacaagccatgtccttgagaagggccagggatgtgtttcatcctgctccctgtccccaaacgatctttctcttcctaagtgccagcttccctagtccatctggggagggactgcccactgcctgccatcaggggctgtgctcaggcctcatctagggatctgcgctcaggatgacttcctacttccttcctggcctgcggtttgctcttttcttttggttaggaagtatgtccttccctgtccctgcccaggcctactctggagacgtggacaggcagctggggccaccattagccagagaggagacagggtgtgtcgacaactggaggcccatgtgagctgttcaggaattagaagctactgctcttggaaaactgctgcagaaatggaaaggtggtcaatggggagaggtgagaaggtgatgggccttgtatgttggaaaaaaaaaatttagagggacttaacggaatatttctgtgttttgaaataaaaattatttggggacctaacattaaaaagacatctgtgtatttttctgttagggtggaatgtgaagcctgagattcctgggctgtagttagagaagggccagctctctgccttggggcctttgcacaggctgttctcccagcttggagcacttgctgccattctttctcctctcagggaaccctgtttatttttcatgtctcagtttagacatcacataattctaagatgcttctaataatctttgagcctctgggggcagagcccatggtgggtcttgtaaactgaggccctgacgcttggtggatccccactcaacatttgttggctgaaagagtgatcagggaggatcaggaggctgcccacctcccagggcccctctgtgcagtctgtgcatttgaatggttccctgaagtcttaacgcccttagaacaagtccaagttcgtctgctcagttcgagccctggccttggtgtttgcctttcttttctgaagtaggtctttgacacatcgatggagcttcagatgtgaagtgtcctcagaggtgtgtgggaaaatgctctctgttcagttaacccagccttttgacaacttctgaggcctctcgggctagaagccccgtgactgttctcctgcccagttcttgcttttttttttttttttttttgagatggagtcttgcactgttgcccaggctggagtgcagtggcacgatctctgctcactgcaagctccgcctcctgggttcatgccattctcctgcctcagcctcccaagtagctgggactacaggcgcctgccaccatgcccggctaattttttgtacttttagtagagatggggttttgctgtgttagctgggatggtctcgatctcctgacctcgtgatccgcccgcctcggcctcccaaagtgctgggattacaggcgtgagccaccgtgcccggccggttcttgctttttataaagggggctggggagtgggtggacagggatgtgatcctggaatccagaactccatcactcagcctgtgtcttagtggggtgttaatggaggatgatggaaaatagcccacttctgatttctctctctccctcatagctctgtagaaatattttattattgaacaccctgtaattcagggttggtggcgattttatcaggtcatacaagtctacagttgacctttgcattatctaagaagacttgtgtttgcttagccaaggataaacaagattccagtgtgggtggcttagggcttggagctgtggtctctgtgtgcagggttgcttctaattgtgaatggctcttatctgttcttcagggagggtctagccacactgtagtacagggacttctttatttcttttttctttctttttttttttccttttagagacggagtctcgctctgtcacccaggctggagtgcagtggtgcgatcttggctcactacaacctccgcctgccgggttcaagaaattctcctgcctcagcctcccgagtagctgggactacaggctcacgccaccacgcccggctaattttttttttgtattctaatagagatggggttttactgtgttgcccaggccggtctcaaactcctgagctcaga

SEQ ID NO: 53939 - DNA, 3200 bp, Homo sapiens
ccctgtgagttaagttctgttattcctattttgtagagaaggaaatgaggcacttagagggattcagtcatgggcaaggtagacttaataggtttgtcttcttaatttaaaaaaaaaaaatttttttttttgagacagggtcttgctgtgttgcccaggctggagtgcagtagcatgatctcggctcactgcagcctcagcttccccaggctcaggtgattctcctggctcagccttcccaagtaactgggactacaggcatgtgccaccatgcccagctaacttttctgtttttttatttttttatttttttttggtagagacagggtttgccatgttgcccaggctggtctcaaactcctggcctcaagcagtctcctgcctcggcctcccaaagtgctgggattacaggtgtaagccactgtgcctggcccagatttggcatcttttctgtctcattaattgatgaccccctgcccagcctggagtggtttgatgctgaggctggcaggaccaggtgggtcctgacggagatgagccagctgaagcctggcctgggctcatagggttcctgactggtgcggtgcttctctgtgggtagagggattgggctggtttttaatgacctcgtccaggaagaaaacatcttggctttgggacctatgtgacttaaagaaaaggtttgctatctcttcactcaaaaggctcccttttattaaatctcctaccaccccctgtggactccaggcttgaaaatattttatttacaaagagattgcatgcattgagtcaccattaattttaatgaagaaatgtggaaaatgagaactatatagctgctgatgagactttctcatcagctcaggggaaccaacgtgagcacaccaggttggtagaacagaattctagtcaacagaaaaacattggaaatttcagttccatttcaattgaggcagacccgattcttctagaacttaaacaatattagcaatgcctcaagagcccccagtgaagttttccagaaacctggttagaatccttaggcaggacccacctagcagtggtgccttctcactttgtcctggcatggccagggttgacctctgtagagggacatccctcgtgtttcccccaggactgaggaaggttagaatgcagagttctctccggagatggctgagctctctttaggcccatccacccctgctctcctggctgtgcatgcaaggcttctctgttagggcagtgcagcttggagggtagacacactgagggtgtaagagcctgtgtgaacagctcccatctgcagagcctcctctccttacagatatatcccaaggcaggggtcccatattccctgcggttctgagctggcattacctgcagcagatggatcactggacagcgagtccggaaatcatccttctccaccaagctttcccacttaatagcttggtaacctttgacagatgatttctttctttcctaatttgtagcatggggacagtgagggatacaacagcagtttctgaaacagcagtgaccaccatttactgcatttaccccaggccaggcactgtgtgtgggcatggcatttaatcccggtaacactctataagataggggctgttatgacctcatttctccgatgaggaagccagggctcagagaagtgaaggcatgagcccgttgttatgaagtcattagatagtagagctgggatttgaacccagagccccactctacctttgagccatgctgctactttgacaaacttttggatgactttgggagatggggaccttggggaaaaatgcactttgaaagaattggatcatttcagtagaaacctgtaaacgtgtgtcttaaaaaaaaatgtcagtgacagtttgcttctcggtgagatgaatgcagataaacctattttgactgttaacttattttgttgcttaaaagccagtgacatgtagtgttgaatttatttttcttcacaacatttaagtgtttgccacttcttgagtgacgtgtgtgaatttgggaattgcctgtactttgggaatggaggccgttgcttgtatgtaaggcttttgccttaagagggacttttgggaaggcttgttctggctcggggccttgctaagaagcgactcgagtgcagcaagggtacctgtgtctgaggatattgatagagctgaagctcactctgaagttggggtcatggtggagagccgatcgcaggagtctttgtgactggaagcctaaatatttattctgttctgtccctaatgaaaacaaattgtcaacagttgttcggtaactgactaaattaaaatctgtaattagtcaattagattaaagagttggcacaacctgattgtatcatgctggttaggttattaagagaaagggtgtgatttttaattactgaatgctaattttgacagtttcaaatagaaacagacgtgtttttcccctctttccctaattctgaatggtttggaaagtaaagacactcaatgtgtaaatgatgtttttttgaagaaaaataatccgagaaggcccttctgtagagtaggagggatttcagcaaagagcccacgttggatttagttgaaagggttagttggaaatccttcctttcttgaagaggcatggcttggtttttggcagcttcgtttttgctgtcaaggagaggttggatttcagctttaagcagtcgaatcattgagttctttttaagggtctccccgattctctcaacttcaggcttttttctggccagtgccctggaaactataagcaatagtaaacgatccagggaggaatcccctgcgaaggaagcccagtgggcgctttgggacactagcacgtgtgagtaatcatacccagtgttgtatgaagtgtcttctcatacactggcatcccaggaagacagacggatggaacggatgttcttacttcatggaataaaagttttgctgactgcctgaggaaagctgagagcagggaatgaggtgccccggtgtggagggtcagggggagaatgtactcggggtgggtgctgacaggcaagaaggaggggactcctgttgagtagtaagtagctggggatgacaggagagaggcctcttgcttgggaggaagatgggatcggaaagtagagccagttcaactgggtgaggtggtgtgcgcctatagtc

SEQ ID NO: 53940 - DNA, 1054 bp, Homo sapiens
gcctgtctgtgattgaggtgggtgggtggagggggttccttgccccccgtggagcttgcgtctgaacagggcttaggcagtggcagtagtgagaataggtcgtaaggcatcctgtctgaccgaggttgacccagcctcccaaattccctgtcccctcctggtgacagctgtttgcacagcttccagggcaggttttgtgtcccctgctctttgtgtgtttgggtgaagcgcctgacatttcacttctgtttcacagtcctctgaccttaagaagcacaactgctccctggggccgctgcctgaggttttcctctgatccttctttcccagtcacaaaaggctgtttgagagaggaggcagtggagaggggggagcaggcctctcccacattctgggatactgctgcagcgctttgagctctgagaggggcagagcgtagctttatagaccggatggaaatggcagatggttggtgggcagttattgcccgctgcctgccgggctttgccattagatgcagtgttgtgggctgtacatgggatttggacttggatgaccaaggtacaagatctgattctttcagatggccttgggtaagttgtctggtgtctgcaaaatgataggaaacagtggccggcttttttctgcccctccagctttttggaagttgggtgagagcacgtgaaaatgctttgtgagttgtggtcccctttgagaaggctgtttcagatgtgcaagaagaaggagacactcagtttccagatggggacactgaggctggtgacacagcaagcctggggccaccactgacttgagaaaacctccacctaagaggctggcgcccgtgtctgtgtctgtgccatcctttaggaattttgcagctttctttgggagaggctgagagcttcctgtggcctttggccatccagccggtgctgagggggcagatggcccagtgggcaggcctggtgccgggcgtgtgcgcactgccggtctctgctcgccggcttttagacggcttccagtagaaaatgttctcctctctctggaggct

SEQ ID NO: 53941 - DNA, 1309 bp, Homo sapiens
aggggccagcagaatgacgttggggtgagaggtgtgtgcctgtgaagcgtgaaccatcatgggctagcttccctgttgatcagctctctggatccctgggtttcaggtacccctgggggattgtgggggcaagtcacattatgttctccctgccccagtgattggaggagcaagtcacatatgccgcttccaaaccagccctggtgcttgtgaggatgagaaaacagtggacgcacagatgcttctggcctgtgcctggcctgaagttgccccatcactgtccattttcttctctcctagtgacttctcattttctaggaatctggaacaggtgctttctccagccactttggcctcttcaccatgattcccgcttggtaccataccacctgagagggttttttcctcccctgccaattattcttctgtagagccaatgctagcctggaatgtggctgcctccaccaggcctgccaggacgactcctatgggaagacatccctcttctgttttttccccaggaactaactctgtaactctcctagtcgtttgttaccagctgcctggaaggagagttatttcagttaaggttgtgtctcttccttcccctttctggaatgaaagctccttgaggggaggaactttacttgccctttctgccaccccattcctggggcctattgcaggtcttgaatgcattctggggtctgtgagcaaggctctgagccttgagaagtgagaaggatttgattcctgcccaggcatcaactgtgctaagtactcgttttaatgaagatggacaaggggcacgtggtgaagcactgtttgtaaactgtgagctgtgacccattaatacatcatgaaaccaacttagtgggtcatgactggtaattaccaaaaaagaaacaaccgtattacacagagtaaacacaaatattgtttctggaaatgtctgttttcagtgatttatgtgtgcatataaaagtatgtgtgccctgggtttgtgttgtagtatttgccttttttgggggctcaacgcaaagtcagaaggccactagcccagagacagctgagactgaatcttagttcctacaagttaagtgacttgggtcaagagacaagcaattgctgagcctcagtttccagatctgtactagaaggaaatgatccataccttagagagttctcgggaaattgtttccccaccacatgttgtgctttcagagtggtgcctggcgggcacttggtaccgttgtctctgtggtttgctgccatagtcttagtgcattgaacacacagaaaatcccaa

SEQ ID NO: 53942 - DNA, 3142 bp, Homo sapiens
tagagtgtaaataagtgtctgttgactgaccttctgttttctatcaaggagatccaaagattctcagggtgtggggagtttgtgcagcctggataccagacccatcttcggtgggtaggaagtgcttacaggggcaacgggagcattgggggaactcacatctggagtggacttttctgataaattggtttgcattaaatcagaagaggtcccccgggtcatgggaggagggtcacgggaggagggtcacggtcccattgtaatttccttgctgttaccctcaggccagagcagtgcatctcagagtgttgacaaaagcccatgggatcccattggggcatctctttgggttctcttagacactgttgtctgggtcctgaccttttgtagagtggacactttcagctgcatgagtgtctctaactgtgtgcccagaggtgtcctggccaccttctccgctttgactttctccagggtggacctgcagggaagtgtctttggtgccttctcaaacaacaagcaatcctttttctccatgtggtagctaattttgtgttttccttttgatgtcaagaaatgagtggaatttggaaggccaagaaatgagtggcctttgagccaaagagactagagaatagcaatggattcttacactacacatacctgctgtacttttttataacatgttttcatgtgtgtgattgtggctgggctttgcagctgcctcgtcggttgggttttgttacaaaatctcactcccattttacagatgaggaaactgaaccctagagtttaggtggcttgtccaagggcaggcagccaggtgttggcagagctgagactagaaatcctctatctttctagttctgcctctcagcttttattgacacttacttgataaagaatccctgcaaaacagaggggaggtatttgcagttgacctgaagcatacctggcaccgggtatgctggttggtgccccccgacatgttcactgaagaaatgaacttaacagaattgaacggaagcccccgcaaggtgaattgtggagtcactggcagaggcgagacctgaactctgggaagggggtttgttgtggtgcaacggctcttaacttttggcagggaaaatgtgataaaagctatggacagtatttccagaaagccctcataaaggggactttgtgcatggtttcaggaggctcatggacagctgctccaaccccaggcctctctgattcccagtgaagaacttggggagtgaaatggacatggagttccatgaccttgatgaattttccttgcttgcctcagtttcctttctctgaagacctgagttccctttcatcttggctgttgtgtgctccacctcagtgaggctggctccctggccctgtcctcccactccagcaagactctgctctcccaccccaacaagactgctgactcctccctcagcagaggggagactttgccttgaggagggttggttaaagtaggaaagtgccccagagtcatgggcgtgggcaggcactgaggtatttgtggctgtgtggcaggggtccagcgtccttggtgggtttgaaatagcaaagtgatatttgagagggctctccttggatgtgctgagctgaggttcctgccaggcagggagtgtccatgcctgccagaaccctttcgggggagggggacaagagggtggcagtgcaggctggaataggtggagaaggcctgcagctgggctgcaaagagctgggggagtgtgctgccctgtgataagccaggctagctatctgcccagaggtcctggcaagttcacggcgttgcctttggctctgacccttggcacccttgtgtggcagattaaaaacacaaaacatacacacttctttttcccctctcccccattccccttggagcataggctttgggttgcagcccctctttaagctcccgccctgttttctgcaattcctcttaaccccagaggctgccagactcctccatcggtagctaattaaacattaaatgagaaactggagttgcattttgccagcacccgagcagtgcagccaccttaatgggtttcaagtggcggcaagaccccaaattgcaaatccttgccctttatttcaaggcgggaggtggggcggggggagtggtggggacccaaacaaaatttttggcagtggtcacttcatttgaactcccagagcagcagtgtgcaccagtctttcgcataatgccatctttgttagctaagcatttgcaaacttggaccaagagttagctctgtgccagccagcactcagagggagctgggagatacccagctctccccacagttccttaggtcgtctctattttgtgagggaggcagggtctcgagtggggaaccctagtcaagggtgcctggcccccttcccatgacttccctgcctctgtatgtgagtgtgtgtgtgtttaagccttaacagggagaagtggcagggaggtgtgtgtacttggggatctgtcagccaagataacagaaatgtggcactagctgtagcctttataatagtgtctgagggtttagagtatttagaaaaattaatcttttttagcttggtaataattctgaccacggcacaagtgcattagactattcacataaacttctttaatacatgttgctgggagctcttagagcaaatagacaatcatgactgtttgtttttgattcgctggggtaatggggttgttttttttttttttttttttttttttctgagatggagtctcactctgtcacccaggctggagtgccatggcgcgatcttggctcactgcagcctccgcctcccgggttcaagtgattctcctgcctcagcctcctgagtagctgggattacaggcgcgtgccaccacacccagctaattttttgtatttttagtagagacagggtttcgccatcttggccaggctggtctcgaactcctgacattgtgatctgactgcctcagcctcccaaagtgctgggattgcaggcgtgagccaccgcgcctggccggtaacggggttttttgtagccttggcaaggtgagttttagcagtgtttgtgtctgtgttgtgtatttctttccctgggttttgaatcctct

SEQ ID NO: 53943 - DNA, 2133 bp, Homo sapiens
tttcttaagatttatgaaattattacgagagggttgtctgccatctattcatctcccatagcagtccccttcaggaaaaacaaacatgggtttcaaacctgggttgcagtcacacttgatgatctgatgaaatgggttaggatctgtcttggggagatggaagaggacgtgtctgaaggtcttccatagcctctgttcagttcttcttgctagccctgtagacagttaagcatgtccatatagcaggtgatctaatggtcttgctcttctgtgtgcagtgggtaggaatgatcctgggaaaccatgggtccttgggagttggtttcttgaacgtcattgggtcccacctgcttggcccagccatctgagttccctgcatgtggaggtggaaattggctaagagaccagacccatctggttatttcacaagtggtcaaatcccatgatcaccaatgtcttcatggtgaaaatttctcctgtaatgtgaggagttagagactcaggtggtggcctactggttttgagaatattcaatgtgatgcagttttgttgtgaatgaaaagttaatgctcttggaatgtaacgctgaggaaattgagcagttcttgttccctcttcagggctgaaaaagagaagctgatgaatggtacttctggtctggtaaacttgcatggtagtgaaagggagaggtcaccaccggttcacttatgatgtggttcttctgggaaaatcccatggtgatgataaggtttcctgacctggatgttcagggaggctaagaggtacacagccatataaaaatagttgatgaatttgacctttctacctagtaaaaatcttgcatggtttttttcctaaacctgtgaacagccaacactgttgctagtttttgactgctatgtaaatagtttcattttagaatctggggatgggtgggtgggtctttcactctcttgatgtagcatatctatgctattttttgcctgtacctttcagagaagttaatgattttaaccaagttcggtgctctacaaatttgagagtctttggcaacttgtggtgtcgtcttccatcctgaaacaatatggcggccatgaaagtttgcacatgggtttgctttcagtaatttgctgaggaatggcagtagaaatgtatagagatcactgaggttggcgttgacatttagaagatgctactaagagatgaggtcaccctaattgaggcctacacttcatatgtgtggggtgtaaaaacctttttttttgaattgggctccacctggtatcatgtggcctgagagtcagagcctgtgggaggagggatggagtgatgaatggggattatgaaggcgttaaggggtagcattgagttggaggggtgacagcagagaagcaagtggaaaactaagaagaacttcagaaaattaggaaaaggagcccacttttctttttgtctttctccagtcttcatctagtctctcccttcttgtggctacagtctagttaaccttcattccttcttgctagaatgattgcagtagcttcttgctgactccttcctcttgcctggaatgcattcctctcttacccattcaaatcctattcatcttttaagacctccttcttggaggacttatgagatagttttctgcattctgtgatcacgccttcatctccatatctataaaaaccacctatacaaagcctctgttggcagctttccgtgtgccaggccactctgctaactgctgtaggttcagtccctcatatcctgccagagacccgatgagagaaggcttgttgttcactccattttgcagatgaagcagctgaggcacacagtggttaattcccagctgggaagtggtagttagaatgcacacacatggagtcatgactgactctggaatgggtgtttctaacaccacctggcttggccctgcaggcccatggcaagtaccatttgttggcactattccacctaacttctcacttagggttgtctttcgggcgacagcctattaattttttccatggtggagaccgtgaactattcatctctgtagctcccacagtaccttccatgtagcaggcacacgtgctgattgtatgaaggagttaggtaagaatgagt

SEQ ID NO: 53944 - DNA, 1012 bp, Homo sapiens
gggagggagggaaggaaagaaggaagggaggaaggaaggaaggacagagggagggagggagggaagaaaggaaggaaggaaggagggagggatggagggagggaggaaggaagggagggagggagggagggaaggaaatctttccttgctctggagctccatgggagtcagctgaagtgtttcctgtgactgcagcacagctcagcttctccctctaccccaccctgcttccctactacctcacatgagtccagcccagaagtgctccccaataagcttcctgcttgcaaatctcctgacccaagccatctcctcatctcagctccactgtcatcctctctgtccacttacaatgttgtcctatcactctatcaccctatcctattttatctttacagccttttgaaactacctctttatttgtgtctgttccttcatcttttgtctctctctctctctccccctggaacacgagttctatgagagctgctgtcccgtcctctgctgtgtccccagtgccaatgacagtgctggtgtagagttggtgctcactaaatatttgtgaactgaacaaatgtgtttgaaggagcgagtgggtgaaggaatggatgactgtgtgagtgatgtctgcctttcctgctctcccctgccccgccccaccctgctgagcccctgagccaggcgttggccccctcccccatgtgaccccggctgagttggggcctcctgggaggatggagcctgcagccttcttggctgcttgccctgtattgatcaaagctgggaggctgccggctgaggtctgtcccagcccctgggggtgggggagtagagagggcttctggctgagatttgtgcagggcttgcctggggcatactagtgccactagagatccatctgctttaggggctgacagcacctcttctccacacctctcaagggagtccacacttgccccaggaggatggctgggcaggagtatgcaggagacagaggtagggctgcaactgg

SEQ ID NO: 53945 - DNA, 1021 bp, Homo sapiens
caggctctgttctctttccctctccgtgtcaccctccctctccacacgcacacaacacacacacacacactcccaggctctgttctctttccctctccctgtcaccctctctttccacatgcacacaacacgcgcacacacacacacacacacacacacactctctcaggctctgttctcttttcctctccctctctccacacaggatatacgcactcagccacacacacagaagcatccacacttttctccctctccctctccctctctccccaaggtctagttttgaaaaatataggcaaggggaggaagagcaggggcaaggagttctgacctagaaaatgggccctgcctccttctgtccctcccaggcccgggaaagggggcttatttttccatttggtttcactgccctgggtcaaggctgcaggaagaaatggagccccccatgcagaaggtgggggtcacgctcctggagagggagggaaggggctgctgggctatgggcctagcctgttggacacaaacccaggaatcagggaggagcctcccccttccttccctactcatgcaacatggggcttgcttctagcacagaggaggaagcaggtttagggacaaagtaaccagggtagcttagccacagagggatggaccagttgaccttttgacttgacttatgatgaaggggcccttgacccttcttaagtcatcttacacctagagtcaaatcctggactagaattcttcccaaacccctgggataagtccttccttctttttttatttttatcttttagagacagggtctcgctatgttgtccgggctggccttgaactcctgggcttaagcagcagtctccctgcctcagcctcctgagtagctggtactacaggtacagcaccaccaaacctagctcctcccttctttttaacgaacattcttgctgtggttccctgtaggggctgggagtgtactctctgtgtgactctcagcctcctcatttcaatttcctctgac

SEQ ID NO: 53946 - DNA, 1068 bp, Homo sapiens
tcattggccacatgtggcaagtggttgccatactggatagtgcagctctagaaaatgggctcttcttggtcagggactctatttttcatctctctctttagtgactagaagggtgtcctaggtagaggacacagcatttgcagaaacagaggcatgaaagaacagagaatattcagggaacaacacgctgtttggtgtggccggcgtgtaaggtaaatcggtggggagaagtgagctgtggggctgcatatgtgcctggagccaggtgaagaaaggccaaaggaatttggacttcggttatgtgggcaactcaggtcatcgtttatttataagcagaggcatgttgcattcaggttaaggcttcagaaagagacttctggtaggcagcctggagggtaatttggaagggatagtgaggaggcaaggggaccggctagaaagctgatgtaacaatatacgtaggtgaggagtgatgaggcagcggggaatgcctggagagggagtaagaaggcagaacctcaggacttggagactggctgcctggaggtggagtgggaagtcaagaataactcccaagtttctagctcgtggtgccagttttccgagccaggacacataggaggaaggggaggaggagcaggtctgatgaggacatgaagagttccatcttggtaaatgccgactttgagatattagcaagacatcttggtggataccagcagcagtggttaggatagactgtgctagagttcatagacggtaagggagctctctgtcacttgtggtattcaagcagtggctggacacacactagcctgggatgttgtagagggcctttgtgtatctcaggtgagctgggccccgtgatttctcagcctggacagtttctgaccctaaggttttgctgcatgtgtgtgtgggatgctctctatcagagcttgagcatgtctataatttggagacctctgtggtctagaggtggtttgtttttttggaccttagctcacaactggaacaggcatgacggctgcacgggggcagaggctccacctcaaccggccacaaggc

SEQ ID NO: 53947 - DNA, 1034 bp, Homo sapiens
tctctcttttttttttttttgacagagtctggctctgtcgcccaggctggagtgcaatggcacagtctctgctcactgcaagctccgcctcccgggttcaagcgattctcctgcctcagcctcccaagtagctgggattacaggtgcccccaccacgcccagctaatttttttttttttttttttttttgtatttttagtagagacagggtttcgccatgttggccaggctggtctacaacttctgacctcaggtgatccccctgcctcagcctcccaaagtgctgggattataggtgtgagccactgcacccgcctggcaaccacaatgtttcaaaacaaagctcacttctgatcccttcccactccctcatctgcatgtactaaagggactgaggagcccccaccccaccacaccccacctcaccatctctgtgtccattcctccctggccacactaactctgcttaacgttgctggtattactgcacctctctctgccctctggtctctttgctttttaacactcagctctgttctgtcacttctttggccagaaagcttcaggtcccccactccccaaattgtctgagggataaaaagccccagcttctgcccctcctaggcctgggtcccaagacctagcctattcctaacccctttatgttttccacactccattcattcaatgtgcaaatatttgttgagcccttactatgtgccaggaattatgttgggcattcaggagattgttgatgcacaaatgcacagaaaccaagtgtgttttgagagctcaggggttcaggggctctgaggaggggcaccgaattgagagagggactgggctgccgccagctctcttctcactggtttcctgtttaccattagcggctgcccatccctccttagcgcacaaatgcccaagtgaaccttggtatgttttcagacccgcagctcaatcacaagcatgaagcaggcgaattgaaatccatctttagctgccttgaaaacctgcacaggaccccctttagattc

SEQ ID NO: 53948 - DNA, 1001 bp, Homo sapiens
agggcaccggcacttagttggccctcagtcaacagtgtgtgttattggttcatcgtggagatgaaggtaccgaggctccgaggagaccccggttctaggtcgcaatctagcaagtggcaatgccaggattcaaacccctggcgtcctggggctcccaaggcttctctccatacgggcaactcggctcggatcgaggaggtgggggacgaaggcggcggcgggatgggggtgcaaagcgtggctccgcagggcaagagggaggcaggcgttctggacctgcacccccaaccccgcccccgcccctgccataggcccagtgcgggtgggcgccgcggccccgcctcgccgagcggcggcggctgccgggctccgggagcgcttgatttattaagctaatgttctagcacattttctccatcccgtaatgagctgtttccaccagggggtgtctgcagagcgactgcggcttccggctgctccaggagggagcagggtcggcgggcgggcgtctgcgggaggctgggggcgcctggtcgcccggggagggttggggttgcaaggtctgggtagaaaaatcacccctggtggggagcttgtgaggggaggcgggaggcctgtccctccgcgctacagcctaggagcgaaccccacacttacccctgtgccatcctgccagcttcctaccaacctcagggggcctgagagggaccccgccggcatcctggcctggtcctttccgccccctcctcccctgctccccgatccctcagcttgtgaggatgccgagctcagcctgcctgccgcctgcttgttatctccccagagctggcatttctgtggcttcaggcgtcagttaggtcctttgcagccagacagatctaggttccaatccgagcccagccacctgtgagctccgggaaatctctgggcctcagtttcccatttggtggggttgttgtggggatctgtgataatgtatgtggtgttctgcacagtgataa

SEQ ID NO: 53949 - DNA, 1047 bp, Homo sapiens
cttggcctcccaaagtgctgggattacaggtgagagccactgtgcccggcctgtgttttctagtctttattgctgcgttttctttagcacgtggctgacacctagaaggtgctcagcaaggggtagctgtcactgcttttctcaatggagaagataccgaccgtcccactgaccccatcccccaggaaggacagtaggttgactatgggcctcttgggattcataccccattacacagtgccaaggtccactcaccctacccaggaactgtcactctatggtatagggcagggtggttgagtgccttgcccaagcacccacgatataagcggcagagcaagactgaaacactgtctgctcaactgactcccaaaccagtgctcccccgactcctcactggaggccactgagggagactcctggccttcagcaggccctcaggacaaaagtgacttctctcagcttcttccttgcagagggctaaccagtcttggcccctggatgaatatggacttttgtggaatcttttcaggaagggctaagattggagtcagatgggcttgcagggacctgcccgggaccccactgtgtacccatgtctgttcttcggtttttgttcctcactgaacttccctgactcctttcccacaagagaactgagccacccaaaagcattaatgagcaagtgggatgaactgaagattaaagcaaagatggacaaggccatttctgttcatgccctacagcaaagaacctaaaaagagccacctttgtttttttgttctcccattcctctgctcagctgcctgtcctggggtggctcccccgacttcacacaccactccctgccttgctgggccctttctctcctgcctccctcaccagcctttggtccctccttgtggcttccctctgcatggctggtgcctttaggcatttagtcctctcttagccacctcctccgggaggccttccctgaccgcctgatccagaaaagcctccagccagcctccatcacattaccagcatctgctgtctttgtggcat

SEQ ID NO: 53950 - DNA, 1058 bp, Homo sapiens
atctcaaatgatctacccgccttggcctcccaaagggctgggattacaggggtgagccaccacgcctggctcacacctcttttttcttttttttttttttttttgttgttggggggtgcagagtcttgctctgtcgcccaggctggagcgcagtggcgtgatctcagctcactgcaacatctgccttccaggttcaagcgattcttatgcctcatcctcctgagtagctgggcctacaggtgcgtaccaccatgcctggctaatttttgtatttttggtagagatggggtttcaccttgttggccaggctggtctcaaactcctgacctcaagtgatccaccctcactgtaatcccaaagtgctgggattacagacgtgagccaccacacccagcctcctcttttatgtttctaaatggaaatgtcatccttgttgattatacataattattaagaaagaactccagacactatgaaggaagcataagtcctctatgatcccattccctagccataaccatcgttgaaagttttgttaatgtcccagttccaagggttctcagaattaccatccagattcatgccaagatccctgctgttctgtaggctatctcagtaacctcgcaagaaatctccctgtttcgttaaaaatagttgatgcttttccttccaggtgtggtcaaactcaagaaataggagattttcccctccacctgcaatctacccacttctaccctacccacctgaggctggttgcataggtcgtagcctgccattttcattcgagataagctcaggaacaagctgtaatgtcccagcttctgctggttcttggtgttgccaaaagtggaggctggacaagaaggctctgtttctcgaggttcctggcttgatttcttgggtggtggggaggaaggagaaagatctaaactgcataaagaagcagcaggaaggccgagtgcagtggctcacgcctgtaatcccagccctttgggaggccaaggtgggcagatcatgaggtcaggagctcgagatcatcctggccaacagggtgaaac

SEQ ID NO: 53951 - DNA, 2080 bp, Homo sapiens
cttcatttggagtcaggcctggctgttgctcaggtgaccagcttgtgtctctgggagggcgctgctttccccggccacccggcgcgatgatccagaatgtcggaaatcacctgcgacgggtatggagggtgggctggggcagcgggagggctctggaagctgggcacccagaaagagattgatgtttccattttaactcagacgctctgcatctcctcacactctccacgggccattttctagctctctttggaaggagaaatcgcagaacccctgggctggtttattatcagcagcaatctccaaacaagccccaggggctgtcagatcccccacgggctggctgtgtagagtggaatcaccttcagcaagtgtcggcctctggaattctattcggtgggtgtatgtttctccctgcagagttctgtgtatgtttctgggggatgtctgagctccatggccttgtggtgcttcatgctcagagctcaggaccccaaagccacaaagctgatgggagtgacagggtgtgaggtatgggtgtgagtgagtatgtgtggtggggtgaggtcggcgttcttggggagcagaacctcttggggagagcaagcacaggatcacatgacggctgcggaaagctgtcctgcaaggtgaccttgaagagaacttttccctgcgctttggagctgagattagttgctgaggcacacggcagacccaagtgcccagcagcgcctggcagtggatggagtgtatggagatgggctcaggacagactggcagaggttgtaagactggcagaggctgacctctgaggatattttcaggaaaagcctttttttaaaggggctggaacaattaaatgtcttatctatcctctccctccatctgcacagccactgcacaactcagcatcctcaccgggccctgtgcatcttgtctcccctggctcccccattccatgtcagcccctttcagtccactctccacactggagggatgcttctaaaaagtaaatgtgctgactcctcacctgctcacacggctacccgaggatgattttcacatcccttacttgagacgaagggatgttggcactctggctcctgcccatgcctccctttttcttccaccatccccacccctctgctgtccctgcttcagccatagtgagctgctctccgcggcttcggtgtcccacttttgttctctcctccaggctgttgtacttgctatgtcttctgccggagttacccccagccttcctgcatctccccaaacttgtgtccccagcaagttccttctgagccctcagatctcagctcaggtgctgcctcctctggaagtccttctcagatttctcatgacaccatgagcctctgtgttagccccttttcacactggattgtgtgctagactggcacatacatccctcccaccagccagggagcaacacgaggctgctcttggtatacccagcacggggacgggtgtggccagaggccagggaatgcttaatgaatgaatggggacaggcagcttttcagcagcgaggctaagggtgggatctgagtagcagggccgcttgctcttgtcacctgagtgcagggcagagtgtctcccaggagggaggggctcctcgtatcttctcttgtgccctgttgtatttaaccctttatgactttttccttcatcagtaactgggggcaaggcactggggaagaggcatatcgttatcactgttttacagagataacaatagtaacaaatcttcacatagctctttgcatttatgaactcattcagttctctatgaggtaggtacagttatcatccccgtatcccagataaggaccctcacagagggtaagtgacttgcccaagatcacactggtaggaagtggcagagctgggattagaacccagcagtttggccccagagtctgagctcttaaggagcctgaggctcagccagatgaaggcgcagatgtgggattccaacccacacgtcctgactctgagcccagctggcattcagcttccttgcactacctttgttgagtctgggggtggaggtgggtat

SEQ ID NO: 53952 - DNA, 1031 bp, Homo sapiens
ttaacagttagccagtgctgggtatgctgtggccaatgatatatatagcctgtttcctggagctgacagctagtgcaggagagatagggagaaggtattcaaataaacaatgatgaaaatctgcaataagtgctatgaatagtagtaataacagtaaatgccatacaagtgctagctgtatgccatgcctgcagtaactcattattccttataacaactctgtgaagtagataattgtgtccgtattaaagatgaaactgagacagacaggttaagtaagttgcccgaggtaacacagctagtaagtagcattgctgggattaaattgagactgtctggagaacagggagctgtgagagaatgatgagggggtcaggggagagctctctgagcagacgacagctgagcagaaagctagcagctgagaaggcagccttgggaagatctgagggaagagcattccagccaaggggaacagaatccattggcaggctccaaggctggggcgagcttggtgcatctgagcagctgaataggggcccagcagcccctgctgctcactcctcactccacttggagtggagggagcaaagggaacagctggaagaggctgagggcaggcttccaggacctgcaggctgggggtccaggccttgtaggctgagtttgggctttcgagcgctgtgggtcatgttgtcttgcctacctgcctgtgagagccatgagggctcccttgtccccaggcttagtgccaagatatgcagttcccgcacgctgggctcagcgacccagggaaacacatcatcatggttccccttctttgtatggccagcaccttgaaggtctcagctgcctccccattcaccccctgactcctcacaacagggaggtgggtaaaaggctcagcccccgtgagagacgaggcacagagaagtgaggtgacatgcctgggtttgcacacctggcaagagacccagagctctcatctgctagactgggtccccgtttccagcccttgtcttggctagcgg

SEQ ID NO: 53953 - DNA, 1029 bp, Homo sapiens
agctcttttcctataggctcatatcatgcagaaggtaggagtgctgggaggcaactgataacaaggtgtccaaagtcccaggctgtgtatcagaagttccagttgttgggtgacctgatcgccctccagctgatgtcccctctgctgcactcctgccaggctctggagtcagaaggacccaggtccagtctcccctttgccttttactggccaggagtgcatgggtggccctttccttgttccctgtccatttcctttctcttatctgtaaaataaggaatgaggaggattcctgcttcagagtgagaattaaagggcccccaagaacgagacctggcatacagtaggtacatggtaagtagcagtcatagatttctgaaaagggatctttgagcttctgcaaaggcaattcttagcccccgtcctgtagaaagctctcttgtctcagtaggatccctcctactggatctgtcccaggaccagatgaaccaaccagctttagtatctcccagactctaggcaaacaaagccccttccaactgctaccttgtttctttgctgccttttcccacacacattttggaaagagttttctctgttcccatggtattacctctcattctttccctaattcactctaactggactcctctcttccccctccctccctccttcctaccttcctgtcaaaaatcagtgatagcttgtttccccatctgccttgactcagagctcacgcaccagcagggcccccttccctctggagagccagactctcctggggtcctcccacctcactgactgcttgctcgcagactcctttgcagattcctcctccccacgtgacttctaaatagctgagtgtgagggcaggcatggtggctcacacctgtaatcccagcattttgggaggccgaggcaggcggatcacttgaagtcaggagttcgagagcagcctgaccaacatggtgataccccatctctactaaaaatacaaaaattagctgggcatggtggcgcgttcctgta

SEQ ID NO: 53954 - DNA, 1059 bp, Homo sapiens
gcccctctctttgaggggagtggtggggatagcaactgcgaggcttgtctctcagtgtgcttcaggggccctgcttagaggagcacagtatttccattctgacagggttctagagcttcctccctgggaatctcagctgggtatgcaaatcccaggctgagttaggccctggactcctggaaccaggggtactttagggactggcaattctctgtcctacttggtgagtgacagatgtggcttgggaagggggagaccctgctcaggatcacacagcacttgagggacacaggtagaatttgaactcaagtccgtctctgtttgtccctccacaaacctttgacgatgtcctcctgtgtgccaggcccctctaggcccaatttgtctttgtattctctatctttgcccagggccccgtacagaggaagtgtttggtgaatgaacaaatgaacaaatgaaccagtgagcaaggcacaggtcctggctcccgtggcatagggtccaacaggaaggtagggactcctgattcacagaacaggaaacgggagtgcatgggaggaggggttgaccaggtgagaagcagagagaggaccagagcttaggtatcatgactgctggtccaggactgtgcccgtgttcccttgttggtgaaatgggtcaatagttcttgccctcgtcctcgtgagggctcagagaagtggcggacgtgcccaggctggtaaagcgggggtgctgtgtgtcggcgtccctgtgtgtgtgtccagactgcccagaaaccccaggcagtctgccccttttgttctgccccttttgttctgcccagttgccctctgcaagtgggcattgtctccccatttcctcagctctccctagggcttctttctggaatttcttcccaatacccctggctatgggaggggtttgggaagagtgtggacgaatggagtcctgcctaccacctccctctacccactcccacaccccgaaagccagccacccgtatccatgcaggcccccagcgcacaaccaagcgggaagtgccttggcagtggttaccat

SEQ ID NO: 53955 - DNA, 1130 bp, Homo sapiens
aaaaaaaaaaaaaatatatatatatatatatatatatatatatatatatatatataaaaatctggcccaaactagtggctgaagcaccaggggcattccttctgtctccccacccctgcctcctcagccggctctgccgtgcccaccctacgctgaaggccattgaaatgttccacttccgaggcccgtcccaggtcggcgaccgtctggtgctcaaagccatcgtgaacaatgccttcaaacataggtgagggtctgggatgggtgcggccacgtccattcagggctgagggctcttcctgaccctagaaaggaccctacttcaaactgtccaggagccctttgccctgcagacagggtctaaatccctgcctggctgatgggttcctctgaaattcagctctgattttcccttcttgggagccttccctggctcccagtcctgcccacccctggctgggtcagggacccctcctctgggatcccccagcccctgtctcccgctgtctcagatcagtgtctctgtctccctccttggctcctggctccatgcctggaccgctgtagatgctcagatcacagggccacttcttgccagtgtttggttatttatcaaaccctttcccacacatttcctaaaataattagtccacagagtctttgcctttgcaatgaattctgaaacctactcccatgaaagctgactttaaataagtaaattttttgagaatttcagaggtcattatttaattattaaaagtgagggatcaggagccaggctgccggattcgagtttggctccacctcttactggctctgtgaccttagaagtaacttaacccctctgagtgtcagttctttcacctataaaatggggctcatcacaactacctcagagttatgaggattcaatgagccgttactagtagaacgccagagaaaatgtccggtaaaggtcagccattgtggctgctcttactattattgttgttatttgcagtctgacttgcacacgttctgccacggtgcaggggaaaagcccttttgtaggagctgtgaagcctggattttagtccagattccaggaatctggaatccttggaaaaatcattgcccagttctaggccttg

SEQ ID NO: 53956 - DNA, 1042 bp, Homo sapiens
tttttaaatgaggaaaggatgtgaatagacacttctccaaagacacacaaatggccaaaaagcacatgaaaagatgttcaacatcattaataattaggaaatgcaaatcaaaaccatagtaagataccattgcatacccactagggtggttatactttttaaaaaaaatctatagagacagggtttctgtcacccaggctatgtttcgtagcactcggatcacacgaccagagtagtacataatccacctgttatactggctctttacttgtctgtacccctcaacccctcagtagactgtgagttccttgggtacatacaggaagtaaatttaaactgctgctgccactgggtctgacatctaggcatgtactttgtaaatgtttattgaactgaatctggccactggtattccttaacacaggagcttgggttggatagaggccagagataataatttaggagcaggctagtgcaatagaagaggaagccaggtctctagagctgatgcatctaaatttcatttttagcgaattgaacagagggatgtgaggaaagccaacttgaaagaaaagaaggagaggaatcagaatgaggctttactccaggccatcaaggtgagttcttaaaccttaggtttttatggtcctgctaaatccactaatcctgtgaagcttgttgggaacctttcttgggatgctttacctgaaggaatttgttcattttctttctactttggtaaagcagtgtgacagaggagaccaggctctggagtcaggccaccccagttcagtcagctctctcatgtgcatgtgttggtctcagtaacatatacagttgtctccacttacctgaagcagatgtattccaggatccacagtggatgcttgaaatctcaaatagttccaaacctgattgccatcagtcagaacacatttctgtttgtgtcttccacccacaaatataatgccttttctatcttagctaaagcacttatcacacactgtggccataatttttgcagtttgaggtacatcagcaa

SEQ ID NO: 53957 - DNA, 1032 bp, Homo sapiens
ttgtgtgtagagctgtccctcagggagctcccattgttatggtgtttttttttgtttgtttgttttttgatgtattaaagttagttgtccatgttcattcagggtacagatgaagaaaattaaattaaaaataaagttagtcgtgcagcctgggcaatatagtgaaactccgtctcttcaaaaaataaaaataaataaaaaataaaaaaattagccaggcattatggtttctttatttcagtaaaatgggtttgcatcctcccacacaataagatgtgcattatgtgtgtgtgtttctgtctttaacccaggctaggaatatcaggctctcagaagctgcctgtgaggatgaagattcagcctcagaaggtctaggtgagcttttcctggatggactcagcactgagaacccccatggagccaggctgagtctagatggccagggcaggctgagctggcctgtgctctttctgtacccagagtatgcccagtcggacttcatctctgcttttcatgaggactccaggtactgacttgcccaggagccctctgcttttgcttgcatgctgtctctgtttttgtggcaggagggacgagtggatttttggttgagaagggaagataatggtttagagggtttcacaccatctggtttgataataacctctctatcctgtagctgactgaaccttgactaactaggtttgcaacgacagacaaaagtctcatcgtcatactaactgggctagtacatgcaacaccacagtattgtgtttgccaaagagtggtacacatcactggtgaaataggaagtcattttaggtaatacatgcatagcaatttaagtgaatattaattagaaaaaaaaatatagaggctgggcgctgtggcttatgcctgtaatcccagcactttgggaggccgagtcaggcagattacttgaggccaggagttcgagaccagcctggccaacatggtgaaacccagtctctactaaaaatacaaaaaattagctgggcatctgtaatatca

SEQ ID NO: 53958 - DNA, 1079 bp, Homo sapiens
cctgagtagctgggattacagctactcagataccacgcccagctaattttttgtatttttaatagagatggggttttgccgtgttggccaggctggtctcaaactcctgacctcaaatgatctgcccgatttggcctcccagagtgctaggattacaggtgtgagccaccatgcccggcctggattatgcatatttggctggaatattacagaagtgatgctgtattctcattgcacctatcagatggtacataatctccatttgtcccattactcatgatgttcactctgatcacctgattgaggtggggtctgccagccttctccactgtacagttactttttctttatgattaataagtgttttatagggagatgctttgaaatggtgtaaatatcccattgctcgtcagatattcaacatatttatttatattggtggatttatagtttcctgtttcatttaatgagttttaatctgttactatgattgtttcttttatgctcagaatatcccagatttggccagtgggaatctcttcaaatttgtttctgtgtccttttgacttgtgtctattttttaagtggttgctttcttacataggatgttctaggttcagattgcgctttccttgccccagctctggaattagctattttttcccaagaagccctggttctttctagtgaagaatggtatttagaagccgagatctctgtgcaataagtgtataagtgtatcgattaatacaatgggggtagagaggcaagcttactgcctcaatgccttctcagtgccacagcttgggggagaaagagagagaaagaaagaaaggagagagagagagagagagagagagagagagagagagagagagagagaagaggagaggagagagaagagaggagagaggagagagagagagagagaccatgaagtctcattggtatctccaactcttaattcaacatccacaggattttttctccctttctatatttgtaacaatgactttcttcttgttctttttttgtttttgtttttttgagacagagtctagctgtgttgcccaggctgg

SEQ ID NO: 53959 - DNA, 1079 bp, Homo sapiens; identical to SEQ ID NO: 53958

SEQ ID NO: 53960 - DNA, 1079 bp, Homo sapiens; identical to SEQ ID NO: 53958

SEQ ID NO: 53961 - DNA, 1079 bp, Homo sapiens; identical to SEQ ID NO: 53958

SEQ ID NO: 53962 - DNA, 1061 bp, Homo sapiens
tgccaccatgcctggctaatttttgtatttttagtagagacggggtttcaccatgttgtccaggctggtctcaaactcctgacctcaggtgatccactcacctcggtcttccaaagtgctgggattacaggcgagccactgcacccggccagccttccttttcctaatcgtacctatacctatgtctcctgatgctctttcttttgtttgctttttcttattttgaatttttttttttttaaatagagatggggttttaccatgttggccaggctggtcttgaactcctgggctcaagcaatccacccacctcagcctccgaaagtgctgagattacagatgtgagccaccacacccagcccctaaaatttttttttaaattatttttataatagagacagggtatcttctccaggctggtcttgaactgggttcaagcagtcctcctgcctcaccctcccaggtagctggaatatcaagtgcatgccagtgacccggctcctgatactgtcatatgaagaaagcattggctcttgaagtcagacccatcatcatttactggctgtgtgactccaagcacacgctgcctctctgggactgccgcctcatctctggaatgggagtaatacatgcctacacatttctcaagtatttgagagccaatgacaggataggagttgaagtgctgttgtaaactgcacagggcagtcctgctataggagggcatctttgtcattagcagtggcagcaagttggatttggcagttgtctcagagaagctgtgaggtgttcctggactataagggaaagccctcagcagatttgcaaattgactcttggactacttttccttaagctttgagcaaagcaaagcagagaaaagcagatgcttttgcacttaagctaaaagagcccaatgtattagtgtaaagagagtggttggatgtggtaggaaatgaggctagaaagctaagttagggccatacacgaaggcctgaatgccctgctaaggagcgtaaactttatcctgattgtggtgtacaccagggttgatttttaaa

SEQ ID NO: 53963 - DNA, 1061 bp, Homo sapiens; identical to SEQ ID NO: 53962

SEQ ID NO: 53964 - DNA, 1061 bp, Homo sapiens; identical to SEQ ID NO: 53962

SEQ ID NO: 53965 - DNA, 1061 bp, Homo sapiens; identical to SEQ ID NO: 53962

SEQ ID NO: 53966 - DNA, 1206 bp, Homo sapiens
gggaggacatcaatttgcccaaggtcaggctgaatgaaacccaagtgtcctgatcaggaagccagtgtttcttctagtagccaggggcagtgtgatttggcgaaaagatcagagccttgaagagacataatcctagattcacttactggggatgtgacctcagacaaattacttgccctgtgtgcctctcagattctccattggtgggacactcgtgctaatggtacccaccttgtaagtggtttgggggttgaccaagctcacttatatgaaatgcttaattaccccttagtctgcactcagagacacttcccttacaccagacgacttaggaaatccccccactgggagctcaggttctgccgttaactttgttatctcaagacctggatcttgttttcttgataagatgcttgacaactttcctgggaaatgccacaggcaagaattaggaggcacctgcagaatagctgtatctccttagagaaaagacagaaatactcaaactgtgtaccttactgtctcatttctgaacttgccaattttacctcttgccataaattgatgaaatgggatgctggcaaaatagcaggtacaggctgtattatcattgctcattccttggggagatctagcagtgactgcctgggaaatatttagcagaattaatacttggggacaaaggctggtgcataacaaaaccattgtgtaaatcaggcttagaatgtaaatcaaggcctccgttaatattctgtgttttaatggaagaaacacctgctgggctatccataaaggagctttgcagaaatctgttgaaattgtcatttccttaactacttgagtgccaggtctccagagttcccatgatccgtttccacaccaagatgcatgagtgctttttagaatgggttgttacgcatccaagggcatgtgaggcttgttttagagttaggaaaaggatttttaagtttccttataacgtggaaaatgggaaaatatttttatgatgttattgcaaacttaagtaacacctgaaaaaagtcaaggtattttgcttaatttaaaataatgaggctgggcgcacgcctgtaatcctagagtttgagaccagcctgggccacatggcaaaaccccgtgtctacgaaaaatacaaaaattagctgggcgtggtggcgggcacatgtagtaccagctgtttgggaggct

SEQ ID NO: 53967 - DNA, 1050 bp, Homo sapiens
gccattacggccttaattgcctcccagaagaaactgtcctacaagcagcttcccttcctgctgtaccaagtgacaaggaagtttcgggatgagcccaggccccgctttggtcttctccgtggccgagagttttacatgaaggatatgtacacctttgactcctccccagaggctgcccagcagacctacagcctggtgtgtgatgcctactgcagcctgttcaacaagctagggctgccatttgtcaaggtccaggccgatgtgggcaccatcgggggcacagtgtctcatgagttccagctcccagtggatattggagaggaccggcttgccatctgtccccgctgcagcttctcagccaacatggagacactagacttgtcacaaatgaactgccctgcttgccagggcccattgactaaaaccaaaggcattgaggtggggcacacattttacctgggtaccaagtactcatccattttcaatgcccagtttaccaatgtctgtggcaaaccaaccctggctgaaatggggtgctatggcttgggtgtgacacggatcttggctgctgccattgaagtcctctctacagaagactgtgtccgctggcccagcctactggccccttaccaagcctgcctcatcccccctaagaagggcagtaaggagcaggcggcctccgagctcatagggcagctgtacgaccacatcacagaggcagtgcctcagcttcacggggaggtgctcctggacgacaggacccatctgaccatcggaaacagactgaaagatgccaacaagtttggctacccctttgtgataatcgctggcaagagggccctggaggaccctgcacattttgaggtttggtgtcagaacactggtgaggtggccttcctcaccaaagatggagtcatggatttactgaccccagtgcagactgtctaaatgcccccagcccacccctgcccccatttgcagccttggtgttcgttctaacactgcattttcctacacccctttcctggactgctctctccagaaacagca

SEQ ID NO: 53968 - DNA, 1075 bp, Homo sapiens
agtctgtggcgtaccttagggttcactcaggtggtgtacatcctgtgggtttggccaaatgcgtgacatgcagccaccattttagtatcatacagaatagtttcactgccgtccaaatcctctgtgctcctccagtcactctggttttaaatatttaagacatcgttcctgcttagaatagtgccagactcaatacatgtccaacaaatgaaagaaagaagaaatggatgaaaaggagctgggcagtagggtgtggcaggtgcatggtgcaagagactaaccccgccccgacccgctggttggggaaagactgtctgtttccaccagcccttgtcaggggggccttgaggctggcccggcctccggcctccgggatgtctgcacagcaggatagtaagtgatgccccattgcttttctctggttgcgggggagggttgagaaaggagctcttgattttcctggcatagcagattcctttttctctctttttcttagaaaaaaaagcccagggaactgatgaatttcaagagctttgtagaagaacttaactcacatcacaataagaagcatggggttttttctaaacttccccgaaacccgaaaacccctacagagaggatttactgggccaacctcagccagtgcccccgcacactggtgagttcactcctatggccggccttcctctctcggagggcagctctccttccggggctgggcatggggtagggtggctaatttcatagggaatagctcagtcttgggatcagactgacttggtttccaatcctggtctggaacattgggacactttaggtgagactttgggcgtcggtttatacccctgtcctatgaagatggtgaagtggttgtgggaaattagatgaggccctgtactcggagcctacagcatggtgcctggtacccaggaagcgcccagccagtgccgaccttccccctgcacctccctcctctggcctcagagcgttggaggatgggcaggggaaactggagcagggcagagtgcagtctacccactgggacctgcccacttgctccgcccaagggagtggt

SEQ ID NO: 53969 - DNA, 1054 bp, Homo sapiens
actgttaggctggggcatgattctctcagaggctcaacttcagcattgtccatgaagcctttgccctacttgggctcctggctcagaattatgatgccaggaggcacagaagatcgatcacaggtgtgaaggatttctttatgcactctttcactgactgattcatttgaaaaacctgccctgtgcttggttctgtcctgagtgcctctgagctgctgattgttttcaggtgaccagaaaaagtctgccattccctcactgaaaatttcatttttgcattcatattttttaagttttttaagttttaagagttattttttgtcttctgaatgttcctttgataacaatatgctctggtttcatgaaggcagtgctttctcatctttcgaagatattaagacaaatatcttcaaaagattaaagattaatatattctttttgaagatattaagactatttgcttgacattgtccccatttttttttcaaatctcatttttctgtatgttcattttggcctcagtcttctgtatcagaggtttttcctcgaatgtctggtgatgcttggctctgcatacctgtccagctctaaatccttctgaaggctctggggcacttgttgattatggactccaccacacgatgatcaagctgggtgttttcactgggtgaactcccaatgttactactgttagaactttcctctctgggggttgtaagcttggctgtccaagctctaggatctaagtggaagggaaaaggctacagttctcaatatttagtgattaaacttccatttaattccctcttttctttctttctatttatttatttatttatttattgagacagagttttgcttttgttgcccaggatggagtgcaatggcgcgatctcagctcaccacaaccttcgcctcctgggctcaagtgattctcctgcctcagcctcctgagtagctggggttacaggcatgtgccaccacactcggctaattttgtatttttagtagagacaaggtttctccatgttggtcaggctggtctcgaactcct

SEQ ID NO: 53970 - DNA, 1859 bp, Homo sapiens
ttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaataaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccatggctgtggggccgctgcttctgtttaaataaaagtggcctggaagctggcgtttgtcgtttcttgcttgggggaccaaaatgtggagtcagatctgggctcgggtgcaggctgtgccattccccaactcagttgctctcactgaacccatgagcccatggccgagggctagaagaacatgcaggaactgacaggtttatttctatcactgtcagagtgtgattggagtaagtgttgaaaggatccctctgtgtgcagggtggcaagcagaccagtgagaaggccaccactgcagtccaggtgagacgatggtggctctggttagggtggaggcctggctttgtcacttggttgtgaccaattaattttagcaagttaatcctgttgagactgttgtcctcatctacaaactagtggacccactagctgtccattaaaatgcattcctccattctttggacacatagctagactacctttcccagccttccttacagtcagttgt

SEQ ID NO: 53971 - DNA, 1147 bp, Homo sapiens
ctggactgcagtgattggagtccttggttgcatgcatgtgtcaagcttatccaattgtgtactttaaattatgtctagtttattgaaagtcaataacagattaaaggaaaacaaccccactgctccattagggaaggcagctgtgcctctggccaagcagaggggcagaagcccagcagtctgagctctactcctgactctacctccactgctaagctacctaacccccaagccccaattccctacctgcaaaagggggataagaatacctgcaccatcttcttcaccaggttaacggggttaaacaagagaaatcctccaaaagccttttctgggctgcagaatgagcagttgggtttctctcacgcctcgcgttccgtgtgcctcctggcgtcctcacccacttctctgcctctgcagcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcag

SEQ ID NO: 53972 - DNA, 1373 bp, Homo sapiens
tatatgagagaccacattttgttttgtcactcatctgttgatggacatgtgggttgtttcaaccttttggctactgtgaacagtgctgctacaaaccttcatgtgcatgtatttgtttgaatacttgttttcagttctttgggatatagaactaggagtggaattgctgggtcatatgctaattctgtgtctaactttctgagcaacaaccaaactcttttccactgaggctgtgccatttttcattcccaccagcaatgtatgagcgctctattttttcaacattctcaccaacacttgttattttctggtttttaaattattagtattattattatagccattctggtgggtttatggtattgacttgcattttccttgaaattaatgatgctgagcatctttttatatgcatgttaaccgttttgtatatcttctttggtgaaaagtctatttgaatcctttgccaccttttaaaatttggtcatttgtctttgttgttgagatgtaagagttctttgtgtattctggatactagaccctcatcagatatatgatctgcaaacattttctccaattctgtaggtttcttttcattgtcttggtaacgtcctttgatgcacagaagtttttaatttagatgaattccaatttatctattttcccttttgtttgtgcttttagtgccatatataagaatttattgtcaagtccaagcccctttgttttcttcaaagacctttatagttgcagctctaatctttaggttgttgagtggggtaggagtccaggctccattcttttgcttatagctatccaggtgtcccagcaaggctgcatgtgtttgaaaaacagcaagaagccttcggagccagcatgcccacgctgagctatggtgaggaatgaggtcaaacaggcaccagaggctagatcatatggctccttgtaggttaggaaggactttatattttattctaagtataataggaagccaatgagggctttgaacaggaaagtggcatggcctgatttttgttttaaaagaataactgtgacagctggatagagtggatggggacgggagtggacaagagtggaagagtagaagaaagaagatactgttgtctgggcagcagcagaggagaagtgtcaaatctgggagatgcagtgcaggctgaaccaaccagcaggatttccagacagattggccgtggatgtgattcaaaggttcagggccaaggttgactgccttttttttttttttttttttttttttgaggcagagtcttgctctgtcacccaggctggagtgcagtggcgcaatttcgcccactgcatgctccgcttcccgggttcatgccattctcttgcct

SEQ ID NO: 53973 - DNA, 1050 bp, Homo sapiens
tttgaaatatttggagacctgatctgattcccttatttcccaaggagaagactgtgaggcacagagagccttacccaaaggccctcccagaatcagcagcagagggatatttgccaagtgccccagtgagcaagaccctgatacctgagggaacagggctggggcagagtggtggatgccattagacatctgggcatttcattttagaagcattgcttccaaacatttctgtttctaagcattcaggaatttgtccctgtgtgccaggccctgtgatgggccctctgcaggcactgccccgtgtaaacattgctgcaatcctgtgagaagcagcctacccccatttcacagaggaggcccagagataggaagtggcttgcagtcaagggctggggtggactggagctcatgcagccacctggcctcctcagctggtgtgtgcctggaaaagacagactatctgggttctttcccatgtcctgggcttctctgcatggctcctgatgcatcagtgagcaccaggagcgcctgtatccaggtggccctaagtctcactttcattatgcagctgctgccactgccaggtatgtgacacacctcacctggggttagatcaggttgctctgtttcctgctgggttcccctgttcacattagcaggcagaggccagcgtgagtgttttttgcgctgccccataccatccacaccaaaactaatttgggcaaagaggctctttagccccagtttcctccctgcagagtggcctcaccagcagggtggccttaccagcagggtgggcctgcacaagcgggtggcacacagataagctgcaagtgctggaggccagagatccacggcaaagggttgcctggctgtagggtagagcaggtcaacaagggaatgggtggggactgatacttcagccacctgtggaccaggcaccgtgcttggcactttctacatcatctcttttagtcttccagaaatgctaagtaacctgcctaggctctgctaagtgtgttgtaaatggaaaaagcaaattggcaaaca

SEQ ID NO: 53974 - DNA, 1416 bp, Homo sapiens
actgggattacaggtgtgagccaccacacccagccgagacctatttctctgtgtgtgtgtgtgtgtatatgtatgtgtgcatgtcttcatttcattctgtaatatcccatttttgcatgtaaataattggcctaatttagcccttactgacatttatgttgcataaactgttttgctcttacaaataagattgcattgaagatttaagactcacatttatcctgtccttctgtacaaatatttgtgtaggattgagtcagaaaaatggactttgttacacaaaggtttgagcacattaaatattaatagatatgaccaaacagccctcgagaagagctgtgtttatgcctacttgtagtaatggtctgtgagaacacctttttccctacattcttgccaacactaaataggatcactctttcatttttgccaatctgatagcgttaaaaatagtatctcgttttattttgcagttcttggatcacttgtgagggtgagcctctctttgcagcattttgcagtttgtttgtcttcagcagtgatcacttggttcacatttgtcttttcttgtttattgttttttgttttgagacaaggtctcactctgtcacccagactggagtgcaatggtgcgatcttggctcactgcaacctccacctcccaggctcaagcaattctcctgtctcagcctcccgagtagctgggaatacaggcgcatgccactgcacctggctgattttggtatttttagtagagacggggtttcgccatgttgcccaggttggtcttgaacttctgagctcaggtgatcgcctgcctcggcctcccaaaatgctgggattacaggcgtgacccactgcacccagcctttttcttgtttattgtgataagcatttccccctgttgttacattgccttcataaccgtcattgttaatatccatcttttattagaactattacattgccttcataaccatcactgttaatgtccattcttattagaattaaagaatcccaattagaatggccaaccttgcattgcaccttgcactgaggaaatgaatgccctattgctgcccatagttggaaatttaagttgcttccaatttttttattactttaattaatggagcaatgaacatcttttgtctgtaatttgagtaatatcttttgtttttttttgagacagagtctcgctctgtcacccaggctggagtgcagtggcgggatctcggctcactgcaagctccacctcccaggttcacgccattctcctgcctcagcctcccaagtagctgggactacaggcgcccaccaccacgcccggctaattttttgtatttttagtagagatggggtttcactgtgttagccaggattgtctcgatctcctgacctcgtgatccacccacc

SEQ ID NO: 53975 - DNA, 1152 bp, Homo sapiens
agctacactgcctgacacccactaaagggtgtcaaggcctggccttggactcctgcccttgtgcaatgcccctgccattgtgggtcgttgggcagcagtgccagtcccagctttttcctgaatagcctctgggtcaggggctgtacctagatgggagaaggaggatgctctctcagtgagggtccctgagacagagggcagtattaggttccatgtcatgtcgaagctgcagggaggaaactaaagcccagcaagcacagtttgtaaagctcattgtttgggtttatacaagagagtgagagaatagggactctcccaggctttgctcccccactgactgcatgccacaatgtggggcccaaggtttcagctcacaacacatcaattctgtctcacagtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaaggtaagccagggtgtcagctgctgctgaccaagactggggaggcatgagtgtgctaggactgagccggttcccgtatcctgaccctggcagccacctcttcaaggctgctgcctgggtcaacccacctggggtacaggcaacaggatctatcatcagaaatgtattagacagtgatggaagctttcatctactctgcccctaccacctgcctgggatgtgcttgtctcttagtggatgtaatctttggtccttatagcaaacccattttatagatgaggaaactgagtcttcaagaggtaatgtaggctgggcacagtggctcacacctgtaatcccaacacttaaaagaggtaatgtaaacttccacaagattcgagtaatcgatttgatgccttggaatctagattgacattccttccacatataccatgcaatttttattagcagttttttctccatttagaaaggatttgtgcttattgtaagagac

SEQ ID NO: 53976 - DNA, 1162 bp, Homo sapiens
attagtaattctgaagaactaggaagggtgaattttttttttgtttgtttgagacggagtctcactctgttgcctaggctggagtgcagtggcacgatctcggctcactgcaacctccacctcccaggttcaagtgattctcctgcctcagcctcccaagcagctgggactacaggtgcccgccaccacgcctggctaatttttgtatttttagtagaaacagggtttcaccaagttggccaggctggtctcaaactcctgaactcagatgattcacctgccttggcctcccaaagtgctgggattacagacatgagtcaccacgaccagccaggatgggtgatttttgttttcttcttcacttttgctgtatcttctaagtgaatgagtatttctcctgtaatttagaaaaggttaagtcaaatatttagtataaagatacttgaagggcgaggttgaacactagctaaccgagagccagaaatcacattccctgtaattaaaggcaatgttctagaaagagcctgtaaaggctatataggaatccctgcagtgagtgtttgggaaggtttgagatgacaccttctgtgtgcagcagctccccttgggcctggcagcctccttttgacccagggtctcttttcttgtgtcaacagattgtccgtgtggagcccttggtgaccatgggccaggtgactgccctgctgacctccattggctggactctccccgtgttgcctgagcttgatgacctcacagtgggtgaggaccctatattaacgggcaagaagagacacacggtcctaggaccggagctgatgggccttggccaccctccatctagtcctggaattgccgctattccatctgtgacagaagtcattcagtctcttacttgcctgctccaatgacagggtgttcactgcctgctgttccatttctgagcagctcaagttatcagaaggcacttttaatttctggtttgaatctgcttccctgtgacttgttcccattgctccaattcccccccatggaacacacagaataagtatagtctctcttctcctcccataggattcatagcccccaaagcctcttcttcttcagggaaaacaccttcagttcttttaactattcccatgggacagggcttcctgtcacc

SEQ ID NO: 53977 - DNA, 1009 bp, Homo sapiens
tcttttcttacattgggtttaattttactctttttccagttttttaaggttaaagtttaagtcattgacttagaccttttttttctaatataaatgtttagtgctataaattttcccctaagcactgttttagaggcagctcacaaatttctatatgttttctttttatttcagttcagaatactttgatttcccttttgatgtctgctttgacccatggattatttagaagtatgttgattttttatcactagttttgagcaattttattatgatgtgctttggtatagttttattcataattcttgtttggaatttggcataatttttcatcaaatcaggaaatttgggggccattatttcttcatctgtttttctgtcccctcctttttctcatctagtttagagacagctaggccatttcaagttgttctacagctcaggtcattgaggcactgttcatttaaaagaaatttttttcctctctttcattttggttggtttctgttgctgtgtatttaagttaactaatcttttcttctgcgatttctaatttgctattagtgccatccattgtatctttcatttcagacattgtggttttcatttccagaagtttgatttggattttttttttttttttttttttttttttttcagatggagtcttgctctgtcctccaggttggactgggtgcagtggcgtgatttcggctcactgcaacctccacctcctgggttccagcgattctcctgtcacagcctcccgagtagctgggattacagatgcgcaccaccgcgcctggctaatttttttgtatttttagtagacggagtttcgccatgttggctaggctggtttcaactcctgatctcaggtgatctgcctggcttggcctcccaaagcactgggattacaggtgtgaggcattgcacctggccggatctttttaatatattcttaatgtctctagttaaattttcgaatatagagaatatagttattata

SEQ ID NO: 53978 - DNA, 1034 bp, Homo sapiens
gaaaaaagggtgtcatcgtaacttcctgggactgttgtaggaattacacaagacagtgtgcagtagatgcctagtgtgttgggaatacccagtaaatggtcctcatttttatacttgctattatcaccattacaaaaccttttctgaacttcccagctagagttaatgttttcagaacacttcgatcctctcttctagctctttcatcattctgccttgtggtgtagcaatatgttggcttttctgtcagccttgctggccagggaggtgccagagggtagggccagcaggccttttcattgttctgtttctccagtgcctgatggaggcatcattcccagctcgcccttgaagaaagcagggctgcaggctgctctggggattcccagtggggccagctcaccctctgtcctgtggttgcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacaggtgagagtagcacttttccgggctctgggagcaggtggggcactgcccctggtgcaagtgactcatagggagatgattttagccaagggcattgcagagtggacaggaccaatgcccacagtcatagaagatactccctgccattgctgtcctcaagcctcacagccaccaggggagagatgggtcataataggtcaggggaaccctttgcgtttccacaggaagtcaggaatggggaattcgtgagcaaaaatgagaggcaaaaaggaatctacttaccccttcctgataaggaagtgtgctggtaaaaaatgggctacagaagtgactgagagacatgggtcttgttacaagcttcctggaaaccctcttgtttaatagccttcgaaatgtacatactttttggcccatctagtaattttacttctcgaaacctggcttaaggaaaaaggaaa

SEQ ID NO: 53979 - DNA, 1097 bp, Homo sapiens
atattctgcttgctccgcgctgggtgcttcaggcaagagcatgaagatggatgcggagagacgttcccatgaggcataagacctggggcctggtgggagaacgcagtgtctggaagtgctttgccctgtagctctggattttgctggtcacagtcatggctccagagcctctgcgtgtcctccctccccacctgcaccctgtttcctagctcttttctcgagttcaaattctccatttacctgcttgtctcccctgtcagactgtgagctcctagaatgcagggactgttatgtgactcgcctgtggcccatagggcctggctcaaaacagcctagcgagtgcctattaatcttggctaagccacaagattcactgtgagcaggaaaacaggggcccagctggactagcctctaccccagacctgccatgtgccattgccatcctcacagcaaccctggtagatcttgtgcctatcttacaaacagggaaaattgagtttcagagtgtgagtcatgtgctcaggaagactagtcagtaaatggggctagaacctaggttagctcgatttcagagcctgaactctgacatttcttctttcccaggctttcccttcccccctataggtctggttcagttgcctcacacctggcttgtaatagctgtctgacctagttgcccttttttctgggctctctgtttggcctccagcttcagtgcagcacccctaatcactccctcccatctctgggcttgtgtcaaactccgtggctgcagattcaggcagggacgagacctggttggtcgtggaatcctacctatcatcccttttcccccaaatcacaggaatctcttccttaatacctgccctggcctctgatcaaagaaaagtccttccccgtgttgagctgtttgcctagccagctccagtgcagccttctccaggagacctgaccagtatttgaccagacttttggttgcaagtgaaagaagctcaattcaaactgacttgagcaaaaagggattttattggctcaggtcctgaaaagtctgggagtacaactggatcaggcatggctggatccaggatcctctgtcc

SEQ ID NO: 53980 - DNA, 1100 bp, Homo sapiens
ccggccaaagggtgactgactcagggccggggcgcctcccagccctccggcggaaagccactgcaaaaccgcttaaggcgcgtttggaagaggcggccccgcagccccgagggcctggggccctgagtcccaactgcccacccccagtattcgcagcggaccccaccggcacccagtccctggcacccccgcctcgcgcggcggcggggagaaaagggtggagcggtccgactcccgcagccaatgaaagctgcgggttcctggtccgatccccggcgcggctcgccattggtcgccgcccgggtctcggcccaccgaacctcggcgacccgagccaatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgagcggcgccgggtgcggccgggactcagggccggaggcggcgtgcgcggggatagcgggacgcgaggtggcgacgggagctgcggtgcgggggcggccaggacttcctgggggggtggggagctggcgttggagaggggttggaacgaaacaaaaatgtgatgggggcgggggaacagaacaggcaaagtgcccactgtgtgcagggcatatgcgggtacctggagggagatgaagaaggggaagagggggaggtgcgaagcactcaggtaactctcacccggcccaagcatttcagagaaggaaaggcttccgggaggtggagctgggtctagagattgggaagtatgggaaatgattgggggaaggtgtgtgggtggagggactggtgtgagcaaatgc

SEQ ID NO: 53981 - DNA, 1016 bp, Homo sapiens
gcgaaggggccgtgacagccgttgccatctgctgccggagccggcacctggcgcaggcctcccaggagctccagtgacagccccatcccaggatgggtgtctggggagggtcaagggctggggctgagctttaaaatggttccgacttgtccctctctcagccctccatggcctggcacgaggggatggggatgcttccgcctttccggggctgctggcctggcccttgagtggggcagcctccttgcctggaactcactcactctgggtgcctcctccccaggtggaggtgccaggaagctccctccctcactgtggggcatttcaccattcaaacaggtcgagctgtgctcgggtgctgccagctgctcccaatgtgccgatgtccgtgggcagaatgacttttattgagctcttgttccgtgccaggcattcaatcctcaggtctccaccaaggaggcaggattcttcccatggataggggagggggcggtaggggctgcagggacaaacatcgttggggggtgagtgtgaaaggtgctgatggccctcatctccagctaactgtggagaagcccctgggggctccctgattaatggaggcttagctttctggatggcatctagccagaggctggagacaggtgcgcccctggtggtcacaggctgtgccttggtttcctgagccacctttactctgctctatgccaggctgtgctagcaacacccaaaggtggcctgcggggagccatcacctaggactgactcggcagtgtgcagtggtgcatgcactgtctcagccaacccgctccactacccggcagggtacacattcgcacccctacttcacagaggaagaaacctggaaccagagggggcgtgcctgccaagctcacacagcaggaactgagccagaaacgcagattgggctggctctgaagccaagcctcttcttacttcacccggctgggctcctcatttttacgggtaacagtgaggctgggaaggggaacaca

SEQ ID NO: 53982 - DNA, 2517 bp, Homo sapiens
aagttgccagatgaagacatgtttaaattgcagaacacaagtcagcatagaaaaccttttctctaaccgtatgaactttaacttccttttcttttctgcagggttcagaatctcccatgatgattggtgagttgagaagtgaccttgatgatgttgatccctagaggaacatgcccagcctgagaggagtcaagacacaatactggatgctcagcaccttcttggaatcagaatctcgaaccctttggaagagcctggagattggactgggaaagctgctgtgacttgggcggatcgtgtatttctcaaggaaagcatttttaagccactagaaggtttgggagctgtttggcagtgggagaactccggcatgtggatcagctgtcccgggagcgtggtctatatgtggattcacatttctgtggagattttcggaaatagagccagtggcagacttttttgttacacgaacatacaagagtgagcataaagctgttgctttctctacgatgctacaaaagaaattcctttggtttttatattttaagaaaaagcaagctgcttttagatatgtgggggcaaatttttaatcttgcagtaatattaaacaggaatatccaatttaaaatgatgtaaagatgtaataaaattccttttcattgtaaaatagtaattaagtcaatttacacagacctttgtatttaatatgtctccctatttgtatagaatttcagatgggtctagatgagaaccctatgcataagcttggatcttgatgaaaggttaccaggatcaggatcaaaaattgggaaatactaagctcttgaagatatttttctgatataattagattgaaaagagcaattttgaaaatgctgtgttctccagaagtacagggtgcattatttgacatcaattacttaaagaagttatgagttgttccccaaacagattttaaaaacagcaaaataaaagcactttaagatataattttactgagtttaacttcacagaattatctttttaatgcttggagacatattgaataaactgtagtcttaaatcatgtgatctgcaatcgtttgcttttgcttaaaacataattactgaaacccttggtattggttgtatatgaagttaactatttgagttggtacacactgcttgtgagtttcatagttattgtaatgcagagaaggaatttgagaatttgtttctcctcaacatgactaattaacactgaaaagtcagtcaaggtttaagatttattttcccagaaataaatataaagcaattgaataaccatccatttagtcgtatttccaaagtatagcaccattcactcatttataccagctcccttttatggtgtgggggagaggtttacacccacatatttcatatatattttgtacattttgtattttgaattgctcacattttcggccctgttttgcctttagttacaggtcctgccttattttcatctcaccatgcacagaactagggagccttaggaagtgccaggttttcactgtcagatttgccaagtcacagaggcgcagccagccctgaagtgcctgtctggctgctgtggcattgtgtgggcatgtggccaggcagatggcatctcattactgtgctctcgccatggcccagtcttttcattctctggcagtgagggtttctgtgctgtcagacttcattgttattctgtgacttgctggaggttggcagtggcctttgtcaaacacactgagaagatggaagggccagcacttaagagcagaactgtacccttagagaaacggacagaggcgagtggcaaacttcagacggttccaatggtcttgcagtttgaaatgtgatgttctaccattggttttgagtacgtgaatacttcctgtcctactgtttcccctaccctattctcaccttctctccgcccacatcctcaccaagagattgtgtgggacatgaccttgaaatgctggcgatgatccacactgggatatcatcgctggcgactgcactctcaggagcccaaaatcaggagtgaaattgccacttctagtccccttatttcctatggaaacaacgccttccgcacccctagcacctgccgtcctcactgtaaagcttcatcaggatcgtccaccgtgtatattatacgcttcagatcatgttgcttatattgttgctgcaatgaccatcgttttcactttgctggtaaccacttgattgctgacagctacagtcaatgaacctgctgatgactttttttaatgtagtacaacagtgacagttatgacaggcttaccttggaagagttgtcatttttactgccaattttttggatgaagatgtttttataaacctttcaaaatggtctgcaaacagagcaggaattgcacaattaactcaataatgctgtgtgttctcaagaagctcccttagtgaggccgatcttaagatggccgattctgcccgttgaaggcatcctgggaaagaaaacaa

SEQ ID NO: 53983 - DNA, 1040 bp, Homo sapiens
tctcttctgccctgtcaaagcctctcttctgccctgtcaaagcctctcttctccctgttgcccctgccttcttttctcttctttgcagccaaacttcgactaattctctaaacttaactttccccattttcttatctctcactcgctcttcagcctcttccctgctaactccctcttctctccaactcagcagttggggtgacaggtggcctgcagctttcaggcctcatcttagccgactgctcggcagcatctagcgctcctggcgctcttcccgtttgaaacactattccagggctttcctgacacttctctctcgtagttttcctcaaacccttctggctgttccttctctgtctccttcctagtactgcctcttctggaccaccagtaaaggtttgtggagtctctaacctgtatcctcctgccctcactccatattctctccgcacccaccttggatttctgaacatgaacatccagctctcttgttcttgacgttctccacttggcataccttaaagacctcagactcgatgtgcccagcccctcctccctgcgcccaccaaagctggccctccgtcagtgttccttatctcacacacagcacccccatgtcatcccggacagctccctttgaaagggtgctcgtccctctcctccacctgtcatcagcccctctctgcctacatctgtaaggatcccctcacctccacccctgcttctctctggttcatgcactaaaacctttcaaaggctttgtatgaggagaaaagccagaatcctcaacacagtcctgcttgatctagcacctgcgcacctccccacccccattttctgattttttttttttttttttttttttttttgagatggagtgttgctctgtcacccaggctggagtgcagtggtgcaatctcacctcactgctacctccttctcccaggttccagcgattctccttgcctcagcctcccaagtagctgggattacaggcataagcgactgtgcctggcccattttctgaattttatttatca

SEQ ID NO: 53984 - DNA, 1021 bp, Homo sapiens
aaacatcaactggaaaaacctttcagcgaaccatttcagctcaggtgagagttgtctcttgtttttgcgtggtctaaatcacttatggaggattttcagtgtgtttctcagaaactgcaacctctgagaagagaggtatgagttgaagatgagaacaagcagaagaaacaattggatttctatgaaaagaaaacagattggtgtacacttacacaaatttgtgcagattatttgtctagaaggaaagtcatacaggttgggcagtctggtcacaaaaagggacaggggttgagggggttctggtgactgtgatgaaggcctcactctcaggcctccggtcccactgaaggtcagatgaaaggtagtcttccctggcggttgctgctgccactgaatgggccctaactttgtcgtcttgtgtttgaatcttctgcaggacacgttagcgtatgccacagctttgttgaatgaaaaagagcaatcaggaagcagtaatgggtcggagagtagtcctgccaatgagaacggagacaggcatctacagcaggtataacggtcagcatgtccttgtgtgcaaagggcagccttgctcttaagctttccaaaaagaatttccacagctgagggaaaacaagatgcttcctctggaatgtgagtccaaagagttaccagcgctgccctctagtgatctcagctcagcatatgcactaaccgtgtgtttacagggctgagtagtgctgcagtgtgaagtgaatggaaggcctcgaggtgtttgtggctggccaccctgatcagcctgcaggtagtcccgatgaagccagggcacagggggattcgttccagcttgttcactttattctgccttgccaggttactgaaagtccctcgtttgctctcaccagccttcctggaaatgtggactcttgaaagaaaagctcccgtgctcttgaagtatacctgcttgccaggggagtccaagaaaattttgacatgtatttttaaaaaaagaaaaaaaaacagc

SEQ ID NO: 53985 - DNA, 3097 bp, Homo sapiens
cacatagataggaaatgaatagacctttaagtataacttaatagttttttctcttagttttaagatatatttgagatatgtggcagccgtgtaatatttgtttgtattgggttttttgttttgttttgttttctttttttcaagacagagtctccctctgttgcccaggctggagccacagtcgtagctcactgtagcctcaaagtcctaggcacaaatgatccttttgcctcagcctcctgtatagctgggactacaggcacatgtcactgtgcccaactaatttctttttttattttttagagatgggatcttgctttgttgcccaggctagttcagaactcctggcctcaagtgatcctcctgccttggccttgcaaagtgctgagataacaggcatgagccaccatgcccgtcctgtattggtggtggtggtgttgttgttgttgttgttgttgttgttgttgttgttgttgtcaaacactaaattaatctcttgggtagaattataaagaaagcacccgtggctatgacaagttccttcttttatttactaatttttgtttcttcctttcccaggttattgaagatcctatacaagtagagcgagtcaaatttgtgtttgagacagaaaatggattactaggcaagtatgcctggtcttatgcacaaatgtctatagtaaatatgtggataatctattgttctggccagttctgcctcctgctactctcggtgggatctacagtgactgatacagtagaagtctggtcagggccactgggctccctcattctggtcagaaaaattaaaacccagggatcttctcaccctacacatttctcctcttttagtcaggaaggtgtagcttgggattcttttaccagataaggcaagattcaggggtgctgtgagtttttttcaacaagctaacggccactccctgatgcaagaaatttttcattctactctgtagccactggggagagaaaaaccaaaacctgagacgcaggatgttgtcaggctcatgaaatgtgaatgtctttttacctatagtaagcgtaaccatattttcacagtctactcttaagttgtttgggcagggctttctttttcagaaggctaaattggctttcctgagctatttattagaaaaagtttagttaagaataattttagccagcttccaccatttacctgtatttccacttaatctgaatcattttagattttgctatgtattaagagatttagggcctttttctgttgtagaaaaaagatttaagctaaaaagttttgtagcttcagcttttcaggccaccctttggaacgctgtactctagtcagagccacacacaggccgtctggaacttaaaaactataaactcctcaagagcaggaccaagtattattttttatttttatttatttatttatttatttatttatttatttatttatttatttttgagacagggtctcactttgtcttccagtctagagtgcagtggcatgatctcagctcactgcaaactctgccccacaagctcaagtgatcctcccacctcagcctcccaagtaggtgggattatgggcacatgccattagcccagctaatttttgtatttttttgtagagacagactttcatcatgttgctcaggctggtctcaaactcctgacctcaagtgatccacccgcctttgcctcccaaagtgcagggattacaggcgtgagccaccatgcccggcctatttatgtttaaatccctaaaacatagagcaggtgataattgctgaactgaccctagcatcataaaatttcatttatcaatctaaaagtactagaactactctcagtaatatgatatgtggaaaagtctctaggtgaataatcaggcagtaaaaagttttgttcctgttcagttctcctaaaagtcaaacttgcagcaccatgtatgttttttttgttgtggtttttttttttttttttttttaaacatacttaaagtagtgtttccacccattagaatttagggattctgttgagtcaggcaccaccatgcttttagttaagttgttccttatctgtttattaaaatagtttgtcgatttttagaacaagagagcttgttgtcacttggagccattttcagttgagtcttttattgttaaaatgtccttttctcttccctcagctttgatgcaccacagtaatcatgtggacagtagtcgctgctaccagtgtgtcaaatttcttgtcactcttgctcaaaagtaagtattgaattaaaatgcagggaggaaatggtgttttaattacaagtcacatatgagcagaaggggaacatgtgcccggttttgatacctggagaatctgactcagtcagggcctgcttgcttggaaggtacagaaacctatttgcatgatctcaaaaaaatatgaggggaagtattaaaagagtgacagatctttatagaatcccagaaaagctcacccatcaggccttatgtcagaaaggcaggaatcagggcagatatggaggctttaagagcaagagttcatgagctttcactcaaggtttctcattaatgtaacccagctaccagctcttcaggctctaggtccctaacctcagaatagcctttcaaatcatgtcacctgtagctcctgagcacttgtgaacccaggcaccgtgtcaagaaccttgcctgtattatcttatttcatctttgtaacaacttcatgaggttagtacagttgtgagtcatatatcatgggtagtttaagtgacatgcctagagtcatagagtgaaaacttgaacacaggctgattgactgcaaaatgaaggttcttttttttttaattgtggtgaaatgtacataacataaaatttactatttgaaccatttttaagtgtatagttcagtgactttaagtacattcacactgatgtgcaaccatcaccaccatccatctccagaactcttttcatcttctgaaactgaaactctggacctattgaagactgactccctattcctcccttcccccagcccctgggggaagcaattgtaatttctgtctccatgaattt

SEQ ID NO: 53986 - DNA, 1149 bp, Homo sapiens
atataaaatcggatctgtttagtgacttgaaatctcccctactctttcttttcttttctccttcctaatttcatagtaaagtatcagagtgttgcagctggaagaaccttagaggttgtttatttcagttcccagacttagcatttgagaaactaaggcctagaaagcagtattgacttgtccagggtcggccagaaggtgatagagctagaacgtggatccagcattgttaattgccattccaatatgctttccactgaagtttttatgcttttaaaaaatatttcagaaccaactagaaacggctccacctcatgagttaaagaatacgttccaactacttcatgaaatattggtaagtcataactgttctgactcacttttatttaggaatgtattagtcaacaagtgtttataaataaaaaattatatgtctttttattatttctccattcatttggtctgcatttattgagaccaaatcttcgtgtcagtcatgtgtctaatgcatttggtttagaggcgagcagtaataaaactacctcctaggagctcacagttgagtgagggagcaagacaagtacacaaacaactgtagtgcaggggactgaaggggagtgatagtgatggttaacccctgccagggcctacagtggagaaggcatcgtgttagcgcaaatgatattaggtttaaacttcacagtcaccctcagaggtacatttctggctttatagtttatcaaatcttagacactattgactgtatgtacgtactatgaaaaatatttttaagagccatgaaactgaaatgtaatcaattgtaggattctttccactctcagaagtgtgaagagcaggggaaaaaaaaatcctctggcagttgtattgaaggatggagtaaagaaggatgcaagattgggaactagaagaccatttaggagtctgggaatattctgagtgtgaaataataaggcctgtggtggggcaagggacagacagatcaagaggtattgtggaaagagaatcattggaatttggtgactggttatgagttaatgagtgtggttcagaggttccttagagagtgagggcctgggttcccttcgaattcttgatactccatagaggccttggcacagaataatcatt

SEQ ID NO: 53987 - DNA, 1084 bp, Homo sapiens
agtactctgtgagagtactcagtgtgtgtgcgagtcttgaaggaggcacattttcttatggatgtgtattttgtggagtaacaccaggtgagacaggttctgttttgtttctttggtctcctaaagctcctggcatatttaagcaacgaccacccattagcattgctccctcaagccctctgttgcccctccatgaggaggtagaagccttgttgttcatgtctgaagggaaaccttacctgttagaggtatgtacttgttattctaaagccatttttttccctcctgtttgaggaaaattgctttttgttacgagttatgtttggcatgaagagtattgttaagaaatggttctttcaaattaagttttcttatatgtcaaaaagaaataattagtggaagagaatgttattagtcttctgttcagccaaggtccagacctccaggtccagcccagccagctacccatcagggccccagagggaggtaaatggcacttcatccatcaaaatcatttcgttaattgtagagggtttcatccccaatctcttttgtgtgttcctggtcctggaatactacaactctgaaccacgtgtgttgttaaacctcaggagtgtgggtgggctgctctcagctctccatcatggtgcctgtgtggctcatcctcaatccaaccttccccttccagcagagccgcccccagctgtggactccatcttccagtccttcttccctacctgatttacagatatgtgaatctatgaacaatataattctggtttttttttttaaattaacagtgttgtgctatttaatacatatcttttttttttttttttgcttaatattttttggatctgttggtgattattttaattgtgggagcttttgcctttgaaaaactgatggaaacgactcctgaaaaagtgcacatttgcacaaaattgtgtaaaatttcagacaggcttagacaccctgaagtctatctatagacttctaacagttaagaaaccctgttttcaggcagtgttaattatcttaaaatctgggtagatttcagttaaaggcagcaacaacagatgga

SEQ ID NO: 53988 - DNA, 1423 bp, Homo sapiens
tctacttttgaaaacattttcacttttaatatttcatttagtcctcaaaatcacaaagtaggcagaatagggaggtggcaggtagccttacctctgccagtacatgaagaactcaagatactgttgtggtgaagaactcactcacattacgcggcacagtgagtggtagaggcagggccagacctgcagatctccagcctcagagtttttcccattatactgaggcacgttgtaagcactcagtacctacagtgaatccataaagggactggttttagaatatgagttaatataaccctttgagctggcttaaaacctgtgatttttttgtaccttgacctcttctgtcaagcactgagaaataattaaagcccagaatattatgaaccagcaaaccctgtcccttcctcttcatattatttctgacgacaacactaacagccactttatcttccctgatgacagatacgtcgatggagttcagcacaagcacgagaatttgggaatcttcacaatacagtggcgttacttgttttgcattcagatgtctcatcccaaaggaatgttggtaagcttaacatatcttagaatgaagagatactgaatttgtctagcttggagagtaattatattagcaagtaaatgaatgtctcttgtttctcattcgactacttgctagttgaggtgcacttaaaatttttgttttaattcatgttaaactttataatattttactagtttgccataagagaaagtgagtcatcattcatttgggagaggtgagagggtatataagtattttttttaaaacaactctttaggattaaaagctaattcagagctcatttatcaccttaatttgaaccactactgtgtggaaaatagccatggtgtgggctggagtctcctagtttcgtgaacctgaccgttctgatcttcagtgcaaaatgaaaatactcaaaacataattccccaggtataatgagataatgagataaagtactttgtaaaaacaaaggggatgcagatataaattacatcattgaaatatatttgaatgtaagatacagttggtagcattttccattttgtctcccagaactaataacacagtcatcatccaatacagcaaaaccacaaattgtcctatatgattatccagtgtcctaacttatgtgtgtactgtttttatactcttcctgggtcttgtcatgatagtgacaacaaccatagtaataatacaacaaaccagcttttcagtgttttctgtgtgctgtgctttaaatttattgtgtttaaagcacacagtgctttaaacttactgtgtttgatccccgtaacaaacctatgaggagtattcatcctgtctatggatgcaaaaactaaggcacagaaaggtttagtaacctccacaaggtcatac

SEQ ID NO: 53989 - DNA, 1586 bp, Homo sapiens
tgtctgtcttacgttctttttcttcatgtaattttatctttcctctaaccagttaaaaagccttcatcagttactggaggtactacttgctctgttggacaaagacgtcccagaaaattgtaaaaactgtgctcagtactttttcctgttcaacacttttgtacaaaaggtaaataatttttttcctaatatcttttcctaatacagaagatttatactctaaaaaatttttagactggatagtaaagttctatatggtatgttttttatgatgtttcttcctaaaaatcttgtgaattatattacttgtaagaattctgatgaggtgggtatagttactcattgatagcagtagaagtctgcattaaaactaggggttaattgtttagtagttattgtgaagcaatgtgaggctcaggagtttttttaattagattttaacaagtactttctatatggaaataatattcttaaaaaatatattgactccttaaaactttccatttagctgtgtttttaaaaccaatttttgtctggatagaaatataatttgttattctcaatatcttgtgacagcaaggaattagggctggagatcttcttctgaggcattcagctctgcggcacatgatcagcttcctcctaggggccagtcggcaaaacaatcaggtaaggactacttttatatccctagtggaatagctatggttttcatagccgctgtgtttctttttgtaggtgataaatgtttttaatttcataaaagtctaagtagtagtaccatagagacttgaaaattctttggagttaaattatctttacaacttcttcatacaatttagtctaataacccatggaaattactaactagtgacaaagtcataagagggaaaggtggattctgactggggagggggtttcaaaaacctttagggaataggtggtattggggtcttctacttcctctctggggctgtgaacaaggctgtcttggtggtggttcttttaagtcagatgctgaaaacacagccagaatccaaatgcaaagttgtgctgttataaactgaatgatagtgcagatataatactcttgttcaaatgaaaaggaagttgtttgggtttttttgtttgttgtctgtttgagacaaggtctcactctgtcaccaggtttgctgtcacccagattggagcacagtggtgtaatcaggggtcactgcagcctagaccttctgggtttcagtgatcctccctcctcagccccctggtagctgggactataggcacatgccaccgtgcctggctaactttgtattttgtatagaaacaggatttcaccatgttgcccaaactggtctcaaactcctgggctcaagtgatctgcccacctcggcttaccgaggttgttttgttagaatagtgttgaatatgtccaaaaccaactctcctgtttgaaattgctttattgcagtgtttctcccatccatcgtatttcttttatttgatagattcaaaatacatgaaatgctaacatgcagtggtaataagtactatttatggagtacttattatgtacttgatacgactgg

SEQ ID NO: 53990 - DNA, 1054 bp, Homo sapiens
ttttcagagtcctttctcaagaatttgtattagatctctctgaactgagactaatctgtgtctagagactcatctaggccagcagacattttgagccacctctggctttgtctttttcctcataagctattttcctgatctaaacctgcagctggcaaccaaaccaaatagtgctattcatccaggggcgttaagtccttacaggtacagcagttacttcccaagattgctgtttcaaacagctgacactacatggaaaactttgaaaaatgttattttcacaacaaattggcttcttataaacattagctggaggcattgtgcctcaatgaactaaatacagattctaggaattactgcttcaaatgcagatgttggctttgctgtgcaactttgagcaagtcctttaaggaggatgttgatccagatacagtgcctgccacccaagcacttagttccatgaacaaggcagtcaaatatgccccttaggaaggtcctcaaagactgtatctcaattccgggaatcattaggaagttgaggtttactgtaaggcagtggttttgatcagcttaaatagcagaaccattttttaaacaaaatcctacctagatgcaaaatatagaatacaagccacaggagcagctgaggacagttcaaatgccattgctccattccctgtggaagtttctaagatgcatcaagaatccttaacataaggaccatatcactctcctccttcctcccatgtaccaacccaaacaaaggataaaggcagagttagtgcagcctccctagagatggggtcaggccgtagcatattacccaccagcctctaaaggcaggacagcaggcggcagaaagagaagggaatggcggccatacacttggaagccatttgctcagtgaattctgtctgatgcccagctgatggattttcatgtctatttgcccccctccccccgtaaatggaaatggtgcctcttgccacccactttatcttgtaaagtactttgaaaatgaagtgctatgtaaatgctaaattttactgtattt

SEQ ID NO: 53991 - DNA, 1042 bp, Homo sapiens
acgggactcctgagcattgtgcaagcattagaatgttatagaaagatcatccatttggaaggaacatggcaaatatgcaaatattttattcattcccttatgtccaagcagacttgcttttaaatatctccagagaaactgtaacgtcctttgggtagtatgtttggtttcttggtattcctaatgctcaagaatcccagtgaattacttctacattcttcctgatggagtttattatagtttgtttctttctttataaagaccaatcactcatcactatcaattgctatgatttcgtgtttgaagaattaatgatctttttttctaattacttatttctttataatttttaagataggttgtcatttttgcaactaaaaaataagtatatatactatactcatattttagtaactttaaacatgaagagatattgtcttttagatcagccccttggtatagtcttctaaggcaattctttaaacataattataattgtaaaaaaattaattcatagtaaatattgcttacagattgatctaaagaattcagactactaacatgaaggatactttacatttttaaagagccttttattgtggaaatgtttaaacacacgcagaagtaggcagaatgagccctctcctgtacccaggccccaggcaagttgttgacatttgcctgtcttgccttagctatctcagctctcacacaggatacccacatgcaggcttttttgtctctctgaagtattttaaattgcagacattatatcatttcacaataaattttcagcgtgtatctgaaggtaaagttcatctctaacagcaaagttaaaaacaatgtaagtactttactgttatcacaccaacaaaattaatataattccttcatatcaccttatatctagtccatgttcagatttcctccaaaggtctcagaagtgtcattttaccattgagtttgcacaaatcaggatccagtgaggtccacacatggcctttgctttctgtgtctcttaaggctcttctgaccatcagtc

SEQ ID NO: 53992 - DNA, 1053 bp, Homo sapiens
tggagaggtttttggacagattttgcagtcaagaaactcttcagaaaaaatatatagtgacaacttcatttttatgtataataatcaaagatatattaagtgatctcagtctttattatctgaaaaagaaaaaataatgtatccctttcttttaatgtctggcataggattaactaattagtcactatgcctatcctggcataggattggtcacttttgtttgtgaaatttgctcatgctctttacacatggcccactatttccattttgtttatatggccattttacacaatgatcattttgggacattgggggatgtaagggaggtgttatgagggcttgggtagaatagtcattataccttttttctgcctgaatattttttttttattccataaggtaggatattaatgattttagcaataaagcataaaaatgtcaatgtaagctattctgaaagtggacattttgtgagtgtaaattaatgaaaaaaatgctatagttcaggccttttgtctaattcgagttgtttgatgaagatgcagaaggaaggtaaagtctaagacttaagcttctttacacttttttgtttgtggggaaagatgagccacaccacaaggagccaaggaatgcaaagcactgacttccagagtacactgagccatggtagtgggcagtcattaagtatctcttatccctccactctacccacgagagacatacagagagacattcatagatagaaaggataagaaccaacaagagtgcactgcatgaggtcattggctgggcttatgctcctaacattgctgtatctgcttttttttaaagggttgatactgaagaatggattgctaccattgaagcattgctttcaaaaagttttgatgcttgtcagtggttagttgaatattttattagttctgaaggacgagaattgataaagtaagtgttggagtcttttaattaaaagaaatttgtgtctcttccagtgatttagagctgaagtttcttataaccctttttatttcaacttgaaattattgttctgct

SEQ ID NO: 53993 - DNA, 1897 bp, Homo sapiens
acatatcattagaaatgtccttcacatattgaatatttttccatttcataaaaataattattaatcttcttttgtagatggtgagagatgagaacctcaagtttatgaagaatagagatgtatacagtagtgattatttcagttttgttttgtctttagcttcattgaatgctgtaagtaactaactggattgttagaaataagaaagggttacaattaaatatgctttagctaaagcattcagtgattcatcctcagtctcagtagttagcattcaggttagatgcaaaaaggttttcccgtgaatgtagcccgtattgggtaatattaaaatgcaagcagcattctgaatgtataatgtagatggtggggaggtgtgacttcccacatactggctttctaaagtgcccttgtttagatttataaaagaatcttagaatagctataactgtgagctcatgtcaatggatattggtctttgtggagattcctaatttgtaataaaatatcacaagactaaagattaactttcaactacttttccttgagtaccatgattgtaatttgccaataagggaaaacaacattcttagtctcttgatgacttaacatcctgcggtctaacaactgttttgagaggatttcataaaagaaatgaagacaatgtcttttcttaacctttttaaaaatttaaatggaacatttttttataatgaactggcaagattcttcttattagtatttaactttatcatgtgtgtatatcatattcatatattgtgtgtgtatcataatttagttcgtaactgtgtaataatctataaaacttctgtgaaaaatatcctctttcatgtttccctctcttagactaaattaaagcatccatattatccttgcatggcaaaggtgagcttacagcttgctattcaattcctttttcaaacttatctacggacaaagaagaaactcaggtgagaagtgatatgttttgataatctgttgtgacagagggcactggtgaattcaattgaagttgaatttataattaaaatattgtgaaagcagctacctaattttattcagaggactaagacatggtctctagctttaagaaacttctaacctaatggaaagaatagctcaaacaaaagagaaatacctaaaaagacaatttataccaaggtataaattctgtacatcttcgaattgggcaaaatcatatccagataaggagattagagtaggctttaagacactgatgttctcagagggtttcgaaaggcaaaacagagaaacacagagggctcattttaggcagaaaggaaagcctgagtaacagacaagacttggcctagggaaccatgagtgactaattgtgttttagtaggacgtgtgagagactcctggagctgaggctgaatgttgggtttagaactcactgagtgcccttagtgccagagcagggagtttgggctgtgttcagtgggagatcgtgaaaggtttttgaacagggaagtatgtccagagtaatgccttagaacaacagcctccaatatttttagcaacagggagtggtttcatggaagacaatttttccacaaaagggagggttggggggacaattagattctcatagggaacgcacagcctagatccctcatgtgtgcagttcacaatagggttcatgctcctatgagaatctaatgctgccactgatctgacaggaagtggagctcaggctgtaatgctcactggcacaccacttacctcctgctgtgcggccctgttcctaacgggtcccaggccggtactggtccatggcccagggcttggggacctctgccttagaaactttacagacattgactgtatcttattcatcattggttttatggtt

SEQ ID NO: 53994 - DNA, 1038 bp, Homo sapiens
tatagtattgtcagaatttgcctggatttggccgatcttggcagaaatggttaagtgaggccagttatcccatcttgtgccacagaacatatttttaaatgtcacttgctatttgcttacatttagacctccctaggatacttaccttctttctcttactccattaccatactgctcccttattccttgtccccacctatatcacttccaagtgagagatccagctaggcccacaactgaagtatcctgacttccatgctaagcagtactctaaagacactcacattttacttatactttgcattttacaaacttagggagtagttaactacttgctggaataatgggccctttgttttagattgtcaagacaagaaaaacttttatttacagatgtgtttcttaatgtcttgttataaagcaaacccatacactgatgtgcgccgaagatactggaatgcctatatgcttttctaccaaagggtgtctgatcagaactccccagtattaccaaagaaaagtcgagtcagcgttgtacggcaggaagctgaggatctctctctgtaagtgtctcttccatgtaatttgctgtgtgatttctatggtgatgatgtggtctgtgacaatatactatttgagattttaaagataattagctaagctggagagaaattctaaaaagaattccaaaaagaaaataaatcccttattgcttcatggttattttcttggcaagaagttgttacatatttagaaacatgcacgtaagttatttcattctagaattgaagtgttttgttttttgtttttttgagacagtgtggtctcactctgtcacccaggctggagtgcagtggcatgatcatagctcactgcagcctcgacctcccaggctgaagcgatccttccacctcagcctcttgaatagctgggaccacaggcgaggggcaccaggcccagatatttggtttgtctgttttttgtaaagataaggtctcccaatgttgcccaggctggtctggaactcctgggctcaag

SEQ ID NO: 53995 - DNA, 1513 bp, Homo sapiens
tcaattttcatattctgtctaccatgttaaggctgttgtctcagcattatgaagagccccttatcttaggcagctgctgttaccggaataggcagatctggaaacagtggccctcatttctagaaggcatcctagtgattactatgaaggaaaatgccttccttagggctcaaaccagaggctactttagacgttcccagacttaacatttctgagattttatacttgaactggtgaggtagttgttcctagcttaaactaggaaaacacttcctcttatttggatctcacttaactgggtactgctgtatatgttagtaatcaacgttaatatggtctttttgcttctacatagtttccctggatgctaaacatggagccttacacagtttcaggaatggctcgccaagattcttcttctgaagttggggaaaatgggcgaagtgtggatcagggcggtggaggatccccacgaaaaaaggttgccctcacagaaaactatgaacttgtcggtgtcatcgtacacagtgggcaggcacacgcaggccactactattccttcattaaggacaggcggtaagagtttcctgaggcagcacttactcactttctgccctcccctgctctccgttatcatccatactcaccgctgtggtgcagggacactttggcattgttcttgactgtgtttcattttgaagttttaaagcttcgtgcaactggttttaccccttcaatttgaaaagttgttttagaaattgaaataattgttgctacatatttcttagatattttcaaatggtaaacacctgctttatttgtagacaatacattgagatcaatgctaaggatgaggaggttgatttttttaaccttataatgtttgtctgatctctgggttctagagggtgtggaaaaggaaagtggtataaatttaatgacacagttatagaagaatttgacctaaatgacgagaccctggagtatgaatgctttggaggagaatatagaccaaaagtttatgatcaaagtaagtatttacaaatggatattttccattagtttttttatttatcgttttctataaaaattaatagtattctttatataaaaacacaacagattttgttatttttattgtactactgttctagcaatagaaccatgagcaagctctttaataaccaaagtgaaaatgttcaagctgtttataaaaatttttttaaataatttcttacaacaaccttgagggataggtaggggagctgggagtaagttaaaaggatgaaatgagcatcagagagaaagtaatgaatactgaaattgaaccttaaaaatagttttggaagtagttatccattaaaattttcagatttccttttcacttatgtagaggtgtgactaattagagaagacatttctagcacctgtgtttttaaaaccatatttattatgcagtgtggcaaagcagtctttccctctacaatccccactcccaggaaaaaagagtatg

SEQ ID NO: 53996 - DNA, 1756 bp, Homo sapiens
taagttggaaatggttttgattgatcaaaatggtttataatgctttagtttataggttatgttatgtgttactttagatgcatttatttaatcagatttaaatgaacttcttatgtttttccttacatcaaaaattatatcagcataatggaggcaatatctgtgttagataaatatttatatttttagcactgttacaaaccagtttttttttttaaatctatgctttggactacaaataaatttcggtgttaattaggtcttagaaataatcctgctgtaagtatatgtctgatgttaatgaagagtaagtaatacttaggaattccttgagatctagaagacctatacatttttgtctgctagttggttattacatggatgcagatacttaatatgtgcagatagcatgattctggtcatggcatgagaaccaagatctttgaatagcatttcaaagtgtaaaattacagtatccttttccacttgaagaagtgccatgttgaactttatccactatgctttttctggatcatttctacccagaaaagcactgtactggggtctatgttatttcaaaacacctgtaagtaaaatggtaggatagtcacctatttaattatatgtttactggaagaagtttaatagaagaatgttaccttctctaaaaggaattacaatatgagcctttttttgccatccagattggtcaggatccttcatggtaatcacttcgtagactcacattcctttttttcagagtactaccttaattcatgaatatatagtaggacatttgcttgattatgcctctttaccctaatagactgtaagtgccttgagatcaggggccgtgcacatttctgttctctcttatatcccatgcacagtgcctggcagatagaagggtatttaatcaatatttgttgaatgataatcaagtaattatataaataaacaaatacacacctatctgccaggtattttatgactgaaaaagcaacattgagatagcagtatttgataattatatcagcatctgcagaggtacttcatgaacataggttttgccagcatagctttcataacatgctggatgggtaaatctgtgaatatatctcccgcatagctatagtgtaaatgtgtctgtggcagaaatgctcattcttctcctctgctgtttctattcctctcttttccagtaccttcccccagtggatagcaggtccagttcagggtttgtggggctgagaaatggtggtgcaacttgttatatgaatgcagtcttccagcagctgtatatgcaacctgggctccctgaggtgatttcttttttctatcctttttggtacgatagataatacgtgcgttacttgaaaattgtttcatagttttttattgcttttggggtttcctaaaacaagacataacttgcaattctttagtagctcctgaaatgtgtaaagacatgttgtgtataatcacacatttttataaagttgctgttgtaataagctgcctgtattacagatggacttgacctaatgtgatttttgaactccaaagttgtttttaaattatattccataaagttactgacagttttagtattttagaaatatatagggtctaccatgagcactttacaataatatggtcagtggttttgagagtattccatgtgtactgggctacgcttatttcctgtagagaacctggtattactagaccagtttttcataatcagagtttaagg

SEQ ID NO: 53997 - DNA, 1053 bp, Homo sapiens
ttctgggttttacagctttcttttgctgccatcctaagatcttcttaggatgacagcgataaaatctttctacttacctattttatttgaaagacagttattcccatgtcatctttattacagagttctctttactctttctcctccattcttgctgatccattcattagatgagactattctgatcataagtgaaagaattttactactttatcatcaggccaagaagatagttactaattcctcctgtattcatgacccctggattactggatgtctggggttagacctgacttaagtatgtttgaggaattggagctcttctactttcatttcaactgttgatttagtttaatgagtaatttaagtagattattcattgttgaaattgacttgtgtcttttgtttctaggtgtagtacagcgaatagccgattggcagcctatgaagtccttgtgatgttggctgatagttcaccttcaaatcttcaaattattataaaagaactgctttctatgcatcaccagcctgaccctgctcttaccaaggagtttgatgtaggttttctagacgttgatgaacttaatttttttagaatgatctctgaaacatataattttaagactgtatttgcattctgctgaccacaaagaaagtcagtattactattttgcttactgtgttcacatactcaaatcaagtataagctatagtatcactctaatatactgaatatattatgaaatagtatccttttaattaaagagggagaggcattttcaagttgcttggtagttattctcagtaaaaagtagcattccaacctattttttcagtgactttatgctgggcataggccagaccctagagatacaagtcaaataaacattggctctatcacagtacagcctatgtgcagttaaattcaaccaaaatttattgagtttagtatgtgctaaaaggcatattaggcttttggaggtcaaaaatgaaaataggatcccagccctcaagaaggtcagtgtatagtgaaagagacaggcccataagcag

SEQ ID NO: 53998 - DNA, 1053 bp, Homo sapiens
cggagcaagtgtgctggtaccattattatcctcagaatggagaacaaataaaaatgtggctaacttggtcagtaacaaatgccaagagaaacgaaggttataaaaattatgtcgaaagtacaagtaaataggctctgagtaaaatcttgaaggtttctcaggagaaaacgataggtgctttagtgcatgaaccttgtcgtttgctgagtgctggctgtgttctgttaactgcaactgcttgtgatttattacagtagtaattttggaatcaaattttgtattagttttatgggtacaaatttgaaagatctctttgtaatgttgaccctccttgagtggtatttatactcttggaggtaggaagaagaggcagagctacaagctgctatttcatttgctccaaatctaactaactttgttcctttctcatgaaaaccagagttaattgagtaatcctgaagaaactatttgctgtttatagtgaaaagggttcctgtacaatttcagtggttattgaaatggacaaggcataataagcagtattttgtggaatcctaagaggtatcttatcacatataaatatttctctacttaaagttgcctcattagcaaaatctgttttaggtaagaaaaaaaagtaaaaccctttattagaactcttggggtattcctcaggctgtgactcccatcctcattgctaccccagccctgttttggaagatttggtgctaggtctatggtagtcttttattaaagcagcagaaacaagtgaatattttaattttcagtaaacacaaaagatatatctttagcagttttattattaataaaagtagttcctccataaatgaagaaggaaggagtgtttttgtaaaaatcatatacagtgccttgattaaaaaaggaaacatttgtttcatccctccccattgtactgaatggtgttgatttatcacagtaattcccagtcttttcccaccaaaaccttcaaggaagaaagagatttaaaatacacagaaactcttttcagaagtaatgctattttgtatcaca

SEQ ID NO: 53999 - DNA, 1021 bp, Homo sapiens
gacagagtcttgctcttttgcccagtctggagtacagtggcgtgatctcagctcactgcaacctctgcttcctgggttcaagcaattctcctgcctcagcctcccgagtagctaggactacagacatgcaccaccgtgcccgtgtaatttttgtatttttagtagagatggggtttcaccatgctggccaggctggtctcgaactcctgacctcatgatccgcccacctcagcctcccaaagtgctgggattacagatgtgagccagctcgcctggccttaatgatagttttttaaagatctgtaaagtgaaagattggggcttgactttgcttactttaattcaggactttgactccataaagggaaatccttctttctttgtaatggattttttttttccttcttagcttcagaaatggagcagttaaggatcagcccagctacgatgcttgaagatgagattacttggctggataactttgaacctaatcgtacagctgaatgtgagaccagtgaagcggacaacatcttactggcagggcacttacgcctcatcaagacccttctttcactctgtggggcagaaaaggaaatgcttggtaattattgctccatcttatcacatggcagattcttcagtgctcggttattgccagtactgtgtgtaagtgggaaaataagatagatgccaagtgttccatggaaaattgacccttcacacagtaggaaattgtccgttattttagtggctaacaaacttaaggtgtactttacctgtgtcattaaacaacatagagaattttatggtgttcaaaatagctggatcacataacttcctaataccaagtaagaattataattcaaagtagatttttctctttttgctgttatgtactttgtaatacataatttactgtctgtcttcttttaagggtgattctcatctgaagaggcagcccctaaccacccctgccctccagtggtggggtacatatgagattctcctagggtacacatgt

SEQ ID NO: 54000 - DNA, 1048 bp, Homo sapiens
gttatgcttaccaaaattatcttgctcacttgttttatgaatttgttcttacaaggaaaatgctttttattttcaaatcagcctcttattagtaactgaaacctttctgttttttagactgttatctcagtgtatggagtattttgatttgagatgccagttattagatgatctgacaagtaagtaaatgactaatatgtaggggagaggggctggggaagagtagaagagaaagtcacacggacatttctaaatatgatttacatatctcaggtgtaaatacaattacaattgtttgaagttgaaccttgttttcttgaaaatagcatataaacctgtgtaccagtgagctcttcttctgttacataaccagtcattaatgaattgagaacatttgttgattttttaaattgtcaaaggctcatattttaattacactgatacgaaactattgtgaagggtctttctctccggtgtagtctgttataattttaaaggttgattgttgaaggaaagagggactctttgttgcggcatgttgatagtgttagaagtcagttcattagtgttagttgtaaagtatcatggttagaaattcttttgttagtgtgctgagattttaatcatctgtacttacccttaaataatgtaaatgtactttggaatgctctgtgtaaattttagttcagatcatgagtttgttattctccgctcttcacaaagaatttgcttcagcttacaggaaattaataaaataaaaatcaggatccacaaaaatagcaattggtaaagaacgtcaagaccaggaggaaaaaaaatacctcagaattaatttctgaggttcctgaaggccagaggtaaaaaggaagcagcgtatggttagttgttcaaataccctgtaagaagaaatagaatagtttctcaaaagaagcaaatctctttcccagcacctaagtctaaaagaaatttcatacaaaggccatcatgtaatggacacataaagacagtgactaataatcctcaacaacatttctatggtggcagatgc

SEQ ID NO: 54001 - DNA, 1808 bp, Homo sapiens
taaataaatattcagaaatgaagttttagcaactccacttttaaaaagtgtactaatcctacccttagctgtttgatttcgtttaattttcctagaattgtttaacttagagatattttcaaatcaagatgaaaaaatgataacttccctccaagcttttatctgttatcatttgtaagtttattttaaggtatattttatagtttgcaactattgatagtttatcaaggcaagacatttattctgtaactggtatgtgcaaggcattgtgataaaatatagagcacaaaaataagacatggtttcttctcttgaacaacttagaattttatggggtaaatggacaggcatgaaagcaattgtaaaaggtcctgaattattgtatgtaaaagagaagagcttatgcttaagttgagcttaagaaattaatcaaaatttgaaaatgcattacctaacttgtttcacacacccacatcccccatttcttcttattagcatctttctataacttgccctgtgttgctgatttcatcattgatattctgctcggatcaccaagtgctgaggtaaggatttttcacattacttacaaaactcctttggtcctgttgttttgtgagctgtctcaactacctgtgacattgtcgggaatacaggagtggcattgagtgctctcagggagtgtacgaaggggctgcagaccatgaaagaaaagtaaccatttggactctactgcctttccttctactacctcctccatatgccaccaaaagttatgagactaatgttagtaagttatttttgtttataacaacgttacaaccagtgtctgatatccatagctcacaagggcagctggcactaagcatccacgttgttggtcagaatcaggaaagatcaacctcaacccataaactttcattagatattatagttctgacattcttacatgaccttgaggattaacttaaactttcttttttcttattttcatttacattaagttataaacctattgagtagagtagaatagtagaataatttgggaaatcagttcccaaaccgcagtgggttttaattagccattaaaaccttaccattaaaatctgaaacactcatacctttctagtatccttcaataacttgattgactaaataggctggactttggaagaaaatcactttttaagcagtctcaacatgttgattcatgtctgtcctttgctgctgatcatgtaatttcagattcgccgggttgcctgtgatcagctgtacactcttagtcagacagacacatcagcgcatccagatgtgcagaagccaaatcagtttcttctaggcgtaatcctcacggctcagctgcctctctggtctccaactagtattatgagaggagtcaatcagaggtaggtaataaaaatggaaaagctaaccttatacagagagaggataaatgataatttgtgtgctgctcccctgaagtccacagtgcattattgagatgactagaatttctttcttcttctgaaatttgggtcctgaaagatggcatttggataggagagttagaagaaacactaccaggccttcttctccatgtcctcagttctcacttcaccccatgtgattcatctaccccagagagaaaaaggagctcacctgattggtgagagcctggaattattggagcccggtcactgtgtaaaggttatactgatcctctccccttgtgcatcactttttcagtgcagatatcttgtagctccgtgtctagaggtagccaaggtatcctcctagcttgccttctt

SEQ ID NO: 54002 - DNA, 1418 bp, Homo sapiens
ataccatttcctctgggtgaggtaggcatggacaccagctcaaagcatgagcagaggatggttgaaggaattcctgaggggaggtctggcacagagaagctgggtagggaccttgaggaggtcgaggggatgggaaatagggaaatgatggcaaaaaggattcccaagtaccgtagaaggtgtggcacacatgtgtagctttattctgtgttccacactgtagaggtgtttttagtacaaactcctttcacatcactcagccatttacagggctgtcaaaataaagacattgaacatttggcttatttgtgtatgtcatttaattcatgtaccagatattgttcttaagcaatgagaacagagcagtgagtagattagaccaaaatccacatcctcatgaagcttacagtctagagggggagacaattaacataagtaaaagtatgtgtcagatggtgaggagagctgtagagaaaaataaagaaggaagcagggattcgggggctatgattttcagtagggtgatcaggaaaagcttcgctggggtgacatctagcaaagacctgaaggagataagggagcgagacccaggagaaagcttttcagaggagcagccagcgcacacccatgcgtggggacctgcctggtgccggcagaggccacaggaggccagtgtggttggggcaccgtgaatgaggcagtgtttcccattctcaaatgagacagaggtctgggacatgacattgcagagataccagaggtcaagttatgaagggtcttacaggctactgtgaagactctgctgtttttcagcataggaaataggaaaccattgaaggattttgtgcagaggagtgccatgatctgagttaaattttctaaggatcaccctgatgggtcttttgaaaataggtttggaaggtggagagtcaagagcagaagcagggagaatagttaggaagcttataggtatcataggaaattattatgatagatatatgtaggctctttttatgacagaatcatgtagaaactaagtaattgatgatgactgattacattacttatggaaaatttaaaatgaaaaaaaatagaagtctttaatatcctgcctttttttcttctttttgaagtttggttgtaaatgtcatgcagagagactccatcccatcagaagtagactatgaaacaaggcagggtgtttattccatctgtctacagcttgcaaggtatgtaaatatattgcattagtcttaccaggcaatacttgactttttcttcgcaaatcatgtttttaaatagtatgaatggactcagaataagtctagctgtttctttttaagatttttacttgtcggacaaacaatgcccacgttattagatgaagacctcaccaaagatggtatagaagcactttc

SEQ ID NO: 54003 - DNA, 1048 bp, Homo sapiens
ggtctcagttccctcacctataaagtaaaatacatatgcctgatacattgtagatgttcaataaataggagttagagttattgttgggaaactcatcttgcatttttaatatatgggctgttttataaaactttggtgtatatctttctaaagaatatatctagcatatcacatgaaattatctgttcttatctaagcctgagggtctgagactttcatgtttgccagtttcatgaaaagaacacaccagctttctctagaacggaaagatttttcttccaaagtaaatagaatagggaaaatgtgattattttatcgtgaaacatcagcttctacatatttctgggggaaaaacagtgtgcaacatttaaagagattctaactcaagttgtctgaatgttttatttagtaaaggagtaatttctgctgaaaatgtgtggatgaataattgtgcttatctgttccctaggttctaagctccaaactcatgccaacagctgatgatgacatggccagaagctgtgccaaatccttctgtgaaaacttcctcaaagctggcggtttgaggttagagtttcaatgtaatgttacatgagttgccgaaaatgaatatagttattttagttaatttcccctgcaaagtcttgcttattcctacaaggtatcatatgactcattgtgagagttattataagaaggaatgatgtttcagtcctttaaaatattttaaatcattttataacttctgattatttgaaaaacgtatggaagcatgtctctttcccctctggtagtgggggaaattttcaagaagagtagaagccaggaggctgtatctgtttcttttgtgtctcatgtcagtttgaaataaggtgaattttatcgctgtaaatccatattgtgcaaggtattagtgctggggatgcaaagataaattagatattatctctgcctttgagaggcagctgatggtttaacaaagaataacaaacagctaggtaactatattataagtattaaaacagggcaggcatggtggttcatgcct

SEQ ID NO: 54004 - DNA, 1030 bp, Homo sapiens
gctggtgtgatggcatgtacctgtagtcccagctactcaggaggctgaggtaggaggatagcttgaacccaagaggtcgaggctgcagtgagccaagattacacactgcactctggcctgggcaacaaagcaagaccctgtctcaaaaaaaaaaaaaaaaagagagagagagaaatacctttgctataaatggaaatcagaacttaatgttgacttttaaagtatttatataaagtcaataatgacatcaggtgtcagaactggaagagcctttagtaccatctacctttccacctcctcatgttatatattaggaagccaaagctcagagggatgaagttacttgtcccagatcagactctagttgtgattcagttgagacgtttttcattacccatgatgcctctttgaatctgatcattgcgtatgtctgagttgctaatataaatggattatcatttaattttttcacagttgatatttaaagttcatttttgttaattgttagaatgttgttccttaagggatttatccatatattgaaattgtgtcgtatctataatattgtttaattatgttctcagaataaattgatgtagaaaaagttgttagaactatattttctattttataatttagtggtagaaatttagatcagctcagtcatgtcatttattgcttatacactaatttaaaggataaaactaatgtaattataaaatatatcactagtattagcttaacagatttttcaagcctaccactttagcaatcttataattttattatcagtatttagagatacaaattttaaacacagaaactaattaaaatgaccttctcaggtgttgcttagaatacatgctcaaaagcattcacgtagtatttgaatcttattgaacatttagaatttgtatgatgaagtttgatgttttaatagttacggagtgatgtggttttatgaagttaatttttagaaaatagcattggtgtggcttatattaaagagggaaagaatattaggacgtgt

SEQ ID NO: 54005 - DNA, 1972 bp, Homo sapiens
tgcaaatttcagtctttgaccagtgagtgctaactgttattgtggttttggtgaaacagactagaactgagctcagatcatcacacttcaaatacattttaatactttttttttttaatctatagatctactaaacttgtaataattgagagattgctgcttctggcagagcgctatgtgatcactatagaggtaagccacttcctttttttaagatgtatgttgcttaggctggactcaagcgatcttcccacctcagcctttctagcagctgggagtttagcacacaccaccacacccagttagcctctcttttcttaaaaaagcatcttcattcatcatatatacatagatatgtatttttgatgtgtttatcagtggtgctgtccatctgacttgacttattcgttttttaaggatttttactctgttccacgaactattctacctcatggtgcctcatttcatggacatcttttaacccttaatgttacctatgagtctaccaaagataccttcactgtcgaggtaggtttacattaagaactacagccattttcatgttgtcttattattttcataaagcagtcttgattgagttagctgcatgaataatcattctaaaggtagtttggtaaacaaatgtagaataaagacctgaaatgaaactgtggggtacaagcagatatataaataaatattatataatgtcaagcggtggttaagtattgtaaagaacaaataagagtaaagcaggatacattggtgaggagggtgataagatgggaatgcacaaaatattttaggtaaagatggacagggaaggtctctctgaggtggtgacatttgagcacaaacttgagtaaagtgacagggtaaatgacgtttgcttgggagaacattccaggcaaatggaagaacaggtacaaaggcaagcaaggtggctggtgtgaggggagcacagtgagaaagggaaagagtggacaacgctgcagtggaagaagggcttgaggtctcattccacgcttgatggggaggaggtggagtgtagaatggaacataattatagcagaagggaagcctcacgagggcaggggttcttgtctttatgttctctgctgtgttcccagcttctagaacagtgcccagtacctagtagatgttcactcacagttgtttaaatgaataaataaatgaattctctcacaacgtgtttaattttattttacaggctcacagtaatgaaaccatagggagtgtccggtggaaaatagccaagcagttgtgctctcctgtggataatatacagatatttacaaatgatagcctggtaggtttaaataagcagttttgatgaataataaatgatataatataaatatttagcctgatatgaataatttcctcttccttttcctctcaataattaagaaaccactttttgcagctgacagtgaataaagatcaaaagctactccaccaactgggcttttctgatgaacaaatccttacagtgaagacttctggcagtgggaccccatctgggagttcagcagattcttcaaccagctccagcagcagcagcagtggggtttttagttcttcatatgccatggagcaggtactgggtgatcaatttccatttaaaaacaagaacttaacagtcactgtctttttgttctgactcttccaaactgtataacaaatgctgggattcattagtgttcaagcttgttgtgttatttcttccatcttaaaaaaatctcttcatcccacttacaccttcagttactgccccattctccttccaaaatcagcaaagctccttgaaacagttgtctgaactcgtttccagcttttcttttgccatcctctcttgatctctgttgataagaattagcctcttttcaagttggtctgtcacctccacctcttagtcctcatcttcttgacatttcattgaagctgatac

SEQ ID NO: 54006 - DNA, 4701 bp, Homo sapiens
cttataattagtttttaaatcatatggcctgctagatcaaattgccaaattgtctttttaaaatttcttagtacaaaagggttcattaaggtaaaaatgtatcaaggtatagaaatcctcctttcagatgtttcttttcattgaatttttaaattgagatataatttacataccatgaaactcactttttaaagtgtacaaatggtggcttttagtatattcacaaaattatgtaaccttcactctgttccaatcccagaacattttcattaccccaaaaataaacctatacccattaacagtcactttccattcattttatccagcctctaatctattttctgtctttatggattagcctaatctggacatttgatatgaatggagtcatacactgtgatctgtcgtctctggcttctttcattgtactaaggcataatgttttcagggttcgcccaggttgtagcatgtatcagtacttcgttcctttttatggctttataatattccactgtgtgggtataccatattttatttatccattcttgaactaatggacattttgattgttgccactttttgggtgttacggttaatactgctgtaaacattcatgtacaagtttttcagtgggtacgagtttgcatttctcttggatgtatatctagaagtcagattgttctgacatataattaacctttcaggaactgtctgttttgcaaagtgccacgctatttcgtaatcccaccagcaatatatgagggttccaatttcttcacatcctcaacaatacttgttattatctgcctttttttattttagacatcgtaatgggtataaagtggtatcaaaatttaatgggtgtttttttggtttgtttgtttgagatggagtcttactcttgtcgcccaggctggagtgcagtggcaccatcctggctcactgcaacctccacttcccaggttcatgtgattctcctgcctcagcttcccgagtagctgggattataggcgcatgccaccatgcctggctaattttttatttttagtagagacagggtttcaccatgttggccaggctggtctcaaactccagacctcaggtgatcctcctgcttcagcctcccacagtgctgagattacaggcttgagccaccgcacccggccaaatctaatggttttaatgtgcacttctctggtgactaattatattaagcatctatttatatgtgcttattggccatttgtttatattctttagagaaatcttaaaatcttttgcccattttaaaattggtttgtcttttaattcttgagttgcaagggttctttatatattctgggtactagctccttatcagatagttgatttgcaagtattttcttccattatgtgagttgtcttttcactttcttgttaatgtcatttgaagcacttaattttgattatatctgatttactaatattttcttttgttgcttctgctttggtaccatatctaagaagccaatgccaagagtcttatggttttagttcttgatccactttgagtcttttcattgattatctgtgttacgtagagtacatgaatttatttggcattctataattacaggttttaacttatttaaaactttttttgaaaatgtgaatctttgtgatcatcgattgaaaagacaaggagctcagttggtaagtacgttattctcaaatctagatagtttggataatctagtataacttgatattcagcaaaaaaaaaagtgttataattgagagataacatggatttttttggtaaagaacagcatctccttgactgccagcttctatgttgatgacagagcttctcctagtgtaagggaggctcctacctgcactaccatgcctcaccagctacctgcgaggacactgctctctctcacatctctctgtttctggctgatctagggacagccagtggcctcctgtggccacatgaatgcagagcagggatagttcacctaagcttcgaactcctcagatccagcaattcacatgtacctaaaaaagcaagaacagtcttcgtcctgggatcacagtggcagggatttggggagaaaaattgaggaatagacagtgaggcaggaaaactaggatgtacagcttatgtttatatttacacatgctcctttaaaaaaaaaaaaggcttattaactctttttccaagtcctttttattcaggacatggcttcctgggtggttagaatttttacaagattttacaagccctgggtcctactgtttactactgagctttagaaagaccagattgagccccaagaattagtgaccacttctggcttgactgtttccttttgaagaaaagctcctgaagatggtgcccatctcactcctgctctatttctgcttcagtagcctgttgggctgtgtgtccagtttgggtctagggatgtctgaagagatatctctgtacctatcctggttcccgtggaatttgcccagtgcttctgtggttggttgctttttaaagttccatatcagtataatattattttcatatagctgaggttttgcagccttaattcatattgaactgaagaggtgtggactcatgatgtaacaaaataattatctgtgattttgtaactttgtgatcttgatatgctttataatttaattttttttcttttgaacagtatgtagaaaagctggaattgataggaatggatttcatttggaaaatagccatggaatcacctgatgaagaaattgctaatgaagctattcagctaatcataaactatagttacattaatctaaatcctagattaaagaaggtaggtatctaaggaaagaagttatccatatacaaaaaagcagaaaattatatgtatattttagtgataagctgtgatccttggcatgaccaaaaattggcttctttattttgatattttgtcctgaataatgattacaactaaatgtcaaggactaattgtaatttccatatactctttcaggattcagtatctttacataagaaattcattgctgattgctacacaagattagaagtgagtagcaaattttatttaacatctctttgaggtaaatgctttttttctttcataattttatatttttagataatttataatgttgatgtttgtggctggatcctattgaagaatttatcaacagtaccatattgtggcatagggaacagatgtttgcccagtatataagtgtactctataggaaatctttctccctctcaccacctgtcttccccactccatccaccttcctccccttttggagtataggaactatcttcagaaaataggtcacctatacattccatatttgtaatagaatctttttcttttttttcttttcctgttcaggtattttatataagcactgcttctttttttgtttttcttcatgtttcacctagttataccataaatgttattaaaggccacagcaagacagttagtagtaggtggtattggttgtctttgtccattagaagcctgctgtgtaatgctagctcacatgtatctcttttatttccagcatgacggttaaagccttaaacattcatattcagttgatatgcttaagttttacatctaagcaaaaatgttccaaaagcataaaatgctactgcctcccaattccaataagttaagctttctggtgataaatatgtgctagaatatgtacggtatttccctaattgtgacttctatccaaatatgtcattataaaaaaaattcaagtattcgaataccccttatgaggtcccatgtaagtgttaacatatatagggcactagttctcagctggggcttattttgcctctgggggtcatttggtaatatctggaggcatttttggttgtccaactagaagcatcctactggtccctaagtaggtagaggccagggatcctgttaaacatcctacagtgaatgcccaggacagccctctgcaacagcaaattatcctgtccagaatgtcactagagtccaggttgagaaaccctgatagagaatgactgtttggtattttttaggcagccagttcagcacttggtggccccactctaacacatgctgtgaccagagcaacaaaaatgcttacagcaactgccatgccaactgtagcaacctcagttcagtctccttataggtaagtgatcagaagtgaaaaatacacaacacacatatgtcagttttttaaaatgattggtgttttttatgtaggtttctcagttattgatttcctcattttatatcataatttttgcaagctgtcataatcctgagaattacatgttccccatcatacatccctgaatctgtgcctctttggaagttctgtgtgtaggtcatcaccaggaccacccgagtacttccctgtccctatccttctacctggtggacaggtcttcttgttttagtttttatttgattcattttacttttattctatgtagtatgaataacttactgtttagaatgcaatacacatacattgtatgaaaactactttttttcaagttaaaaatatttacttagatatagcttttctccttgaatagtcaaactcagggcattaatagggtaagcagaatgaagtagaagatgattaattaaaagtatgcattatgcttgcatatgattagtg

SEQ ID NO: 54007 - DNA, 1473 bp, Homo sapiens
ataaagaggttgtatgaggtatctttgtagtgagggaacagttttgtatcttggtgtttgtgagttatctttcatatgatgaaggaataaacatcttttttttgtctttgatctgaaataataattgctaattcagtggataatgggttttgtttttcaaatcaattgattagtaacattattgttttttaaaaaattaggaaaaaaatcttaactcaccagttgtgagtttgtagtgttttactttgagattgctgaaattacattttattgacatccaaaatcaactgaatttctaatagacttgagatagatagcttctattacattgtactatcaatttgtaaacagaattctaatatttactttaccctaaattatatgaaaaaggattaagtaaaactgttgttaaaacttaaagttttgttttgttttaatgttgcttttaggaatgaatgcctggagttaactaattagcattatttctttttgcagtatttagaggcacatctaaaatttctagcgtttttcttgcaagaagctactctgtatctgggctggaatcgtgccaaggagatctgggagtgtcttgtaactggccaggatgtttgtgaattagatagagaggtaagaaggtggtattgtggataaagtaaggcagaaatatttaaatatttcactttttctgtgtgtctcacatcttctaaacacttttcagtttatataagcataaatagtatgggccaagaactgtaagtgctgaaaaaatgttttatataacatatattcatgataaaaataaatgtatgagttctttggtaattttgataccattctggataaaataccaaatttaaccaaatgagtataaagaattctagatatatttaagttttttcccttccatatgaaactaattttaagttgccaacagaaaactttgagttcctataatgatgttgcaccccaaaaacagtaaagaagaattagtacctggccacatttttttgtaaactataattaagcagccaaagatagattaaatcaggaacagaacacctgccttgacattttctaggagtaaatttcattttcctcatcttatttgacagaataatattaactacttcctagacttgtcgaaaggcttcactattgtgatagtgcccagcatagtgcctgttgtaagcaggcagtaaatgttgatggaaaaacccaagtataaaatccagtgaaaagtatgagtagatatttttattatctagaagaaagattgctagtaactgcttcatttaatttcagaattccaagcattttagctttgagtggtattttgacagtataaacatttgaagtattaaaatgtatctttacttttccagtttggaatatgtatgtgcctgaaatggatcttagttatagggtgatattcgtcttattccacagatgtgttttgaatggtttacaaaagga

SEQ ID NO: 54008 - DNA, 1676 bp, Homo sapiens
tatagactttttctttgaattttattgtataacaagttaccttcaaaggataattttcaatattaaataaaaatattgttaccataattgacttaattggccatcatgatactttttaatatatttgcttcttgctgaagagttcatatttatgtcccaattttgtaatccttttgggaaggtatctgtttggatataaaccttacagtttttattactgtcattttgcaacttttatagtgtagccagaagtagtctagctagtctcacaagtagttgacctttaatatataccttatttctgtgattctaagatgccagtgattgcaccctgcatctcagatttaataaacttgcaaagaagaaaaaaagaaactgtccgttttgcagttatggaccattggtttagattcttaatgagaggttgagcctaagcctttttttgaacaattatgaacaacttcatgggagcacactgctttgcattgtatatagtaatgctttggacctctctgaaatctttatgattggctgtataattttgaggcatgttgatgaatatggagttttgtgtgcttgttctcttttgtaaaactcaacttgctttttttcataattgagttatgtacactacaagttaaacaccttctcttgaaataaggtgcagcttaggacagagagacatttagtgctgagtggtacagcccttcacagggtatgagtctgtcatgccagcttctcctgacttcggaaaatgctttagtgtgagaccactgactgttttattttaattgtgttgatggacacaactggttagttagtgttgcattatagtgtaatctttttgataacatttaagtaacaaattagtgatccaaatttaagtgagaaagccattcttgtttggtactacctataccaggtaacaactaaaatgataggtagaagaacaaataccttttgtgtacagctaagtttgcacatactcaggtaagcacagctatataaaaacttactcctgtgcctagtggctggtgagtttcttttgacataattgtctaaagtgtcaatttcagatatgttaaaatatatgaaatctttgtcttagaatctaggaaatacagtatttgctgattgaggattggctgatccctatgaggcaaggaaaaaagtattgtgtgacaataacttgctcacatttacatattcaatagtgagatgtttctctacaaagacaacaaaagtgtatttcccctccacaagggtcttcatcttacactaaggctcaatagaacaaggaggcattaaaacaaaaacttcagcctctgaagaatgctgaggacttaagtttttactcagctttttggttagagatttaatagtcatgtttaaactgaaattcttaccaaattttgaaatttcatagtttgaaagatgctatttattaaaaagtagttctctttataaagagtattacacaaacagtagactttttagatctgtactatgacgatctggattgtcatataccagtttcagaaataatatatttggaagtgttttgaaaaatgtacagtgtaagtgtaaaatgtctgtaataataaaaatagaattacctcttatgaaagtgttttaactaggaaatacagattatgaatattttctttaatatttag

SEQ ID NO: 54009 - DNA, 2283 bp, Homo sapiens
actgtccttggaggtggtggttagcagattgagcggtaatgattgcagctctcctgttgttccagtccttaagcctcaagcctctcctctgagagggctgatcacagcagccagctcagtggactgtgcttctgttgttgcagcagccctaattggagcagcattgtcctctcacctagaccctcagggtgcccagaccaaacttaaagcctagcactggaaaggcttccgctttctgattttcattttattattaacataagaaaagttttggtagaataactagtggcttaataatttcattagtaaaacatattccttggcttttgttaagtatttctttaaaggatcttggatactgccaactaattttcattggtatattaagagactcttagctcagtgggcttttatttcttatgttgtgtttgatcacaaagtttagttgggggcattgaagaactttgtgttttatatttctgacactgaaatgtgaccaggtgaattttctacatgtaacccagctttagaaattttaaaaggtatttgcaaactggagctggtaattctcaggttatgaggaatttttcttttaactcaataacattgctttcttttcactcagatacaatttgaatttttccagtttccttagctcagtgattcaaataacttagcaacctctccttatgattaaaattcatccagttactgaagatgtttagaaccttcaatagtaagaggaaaagggtgtccatagaaaaatggtcttgtcttctcagcaacagacacgtttcttttatatataaaaggtcaaagctgaatggatttttccctccctccagggaagtggcgtttgaaaccagaatatccctcctgaccattattccttccttgttacagctaaacattacttagcttttctagtcagttgcatcactgcatctttattgcttctctttgcagtcatttcatttatgtctgttgttttataacaaaactcaaaaagtaaaaggagaatttttggagttattttgtgagactcgaaaggaatattctttcttttttatttccccactgctcccagtaaagaaatactggtgtaccattatttcattctaaacaataatatcttgccttttatatagcacttttcagtttactaagtgctttcatggacttttacaaagtacacattgctgaaggggggcagtgggaagatcaaagccccctggatatggctccaggcaggggggtgaattatttacttccactaaaggtgtttttctatgctatgccctttcctgccaggcagcaaggtgggctgactggggattatgtctccctgccaggctacacagaaactaagcaaagggtaagacaagatcacccacttcttactcccctcccaccctcagctacctctattcccccaactgattacccttccctctgcttttgatactcttaaaattcccaagttccactgttgtgttcagaaattctggccttgatttcctaactttatttctgtagattctgcagggtaccctcggctcccttggtcctctttcctttgctgcttctataccttccactgtctaccccaatccttccctcttatgtcacttctttttttcttcaattaaaaagtttaaatgtactcatccaaaaaaaattactaaaccaaaaaaaaacctcatttttcctcagttagttgtactgcatattccttaagttgtttatcttcaggccacctaccatagcgcctgacaggcttttagcaaatgttggtttccttcctcttacttcctccccttcaccctatgaggacaccaaaagccttacatagccatagctgagttgcctctacttaccaaaacacgtaacagaaagtaaaagtagcaagatgtcctcagtacagatactttcacatgatgtggttagtacaggaggaaataacttttagaaattgtcctcccaagcaaaaatttttgctgtggtcctagatagaaggataggtctggaaaaacaagacagatgaggaagtggggatgttcaactttgagaagagagaactcaagaaaatgtgaaagctttttttaaatacttagagcattgttatagagaagtttcattcaacttactttttatgtctccaaagaagttatgcagaagcatgtttcagtatcaatgaacttttatatgagaacagtctgaaaacagaattcagtcccttctgaggtagtgagttcctcatcagtggaaatactaagtcagtca

SEQ ID NO: 54010 - DNA, 1034 bp, Homo sapiens
acgtgttcagtcagacttgcttacttttaaattttcttaaaataagctcttttgaggtcctgaatacccctcctccccaccagttagcagtatttaaatgtacttttcttacgttgttaatgtttttagctcaagtttaaaatttttgcatattttgccagtttgatcgtgaagcaattcctgtgtcttttccgttctacagagctgggagactgagagtgatagagtaagacagaagcttttgagcctgattggacgaataggccgggaagctcgctttgagaccacttctggaaaggcaggagaatcaaatggatttttctagctacaaatgctcaaagcagctatttgcatattggctggctgatcatatgtaatattattgtaggttttagacgtactctgggaactggctcaccttccaaccctgcccagtagccttattcagcaggccttggaggagcacctgacaatccttagtgatgcatatgcagtgaaagaagcaatcaagaggagctacatcatcaagtgcatagaagatattaagagggttggtttcagcttttatctgattttgttgttagagcaacagtattccctgagtaattagagccaaataattttcctcccctgttatgtaaattaaactaaatgccatatctggaagctcttaccttaaagtccaagatcgggaaattataggtattgcttttaccaagtcacttatatttctcttaaaatgaattttcagcctggagaatggtcaggtttggaaaaaaacaagaaggatggattcaaggtaagaatttgcagatggaaccaactaaaaggtatactagtttaataatttcctttaataaattacaccacaattttaaaataatagtatgttttagtgtttcttaatgttcatattaaacttgatgtctaaaaatttgtttatgacctatgctttattatttaaagcttgggaggtgctcttaatgggaaaaaaaatctaggatcacattcaaagagtaattttattatataat

SEQ ID NO: 54011 - DNA, 1031 bp, Homo sapiens
gtctgttaacttcttataactggcctttgatatattttggctagttattgaagcacattgtaacattgtaaaaattatctatctatctatataaatatttgataatgtatattagactcagtcacaataatcttatctttttaggtaaccaaactaatagaagatagcactttatccaaatctgtgaagaatgctatagatacagacagattattagattggctagttgaaaactcagttctgtcgattgcactggaaggtaagttgctttcaaaaataaaaattacctaacacataatttaaataatatatctttgtattaaaaagtatacaaaattgttgctttgactgtattagtctttaaatgatcttatagtaagttattgttttgaatcaatagaattatatttagagagtcagtgttcactatatctgactttctctctcatgtttcttcaattaggcaacatagaccaagcacaatactgtgaccgtataaagggaattattgaactcttgggtagtaaattgtcgttagatgaactcactaaaatttggaagatacaggtaggttgatcagaattatttttgcctttggctaatgtttttggactacaggagagcgaaaagggtgatgagagagcaggaaaacggaaactttatcttgctttaaacagagcagctgtacctaacccactttacagtttcaggtttttattaagattgtatgtgtaaatccactcaccacaagaagtttcaaactgctgatctagtctggtcttctaattttttaaattaaaaaatgagaaggtcatatagcagttagtggcagagctaggaataggtgtgtgtctttgtttatcaatctagtgttcttttcattatattattaattttcattaataatttttttcccatttagtccctattaaataaagatgattggtgagtttgtagatctcatcttactaggactgtcaagaggtgtgacagaatccaacatagtcttcaatttttttttcttcactttg

SEQ ID NO: 54012 - DNA, 2442 bp, Homo sapiens
actcttcagagttagttttctggttgtgttaccattctggagcagtgtattgtatgaatttcatctataggcctcattcacatcagtaagcaaaaatcgttcatatgacagcataatttccatggtctgtgtttatattcagttttaaaaatcaagcacaaaatatttattataaaaacaattcatgctgtgttttaaaagttagactgtgtgtcttgagtcactcttcaaaattacctttataagatagtaatgacagaaaatgtactcatattatagtaaagaagctgaggcacctaagattaagcagagtcagttaagggtttatttggcagtattagctagttagtagctgctctgatatgaaaatttttatcttttcattgcaccttctcctttgtgaattgtagatgaagaagtattctctctctacttttgggacagcttcgggagttcttaactgtagcattttatttctacagcccatgctagacccagtcattcttactacaatccaggatgtacggagtgtagaagagaaagacctcaaagacaaggtaaatgccttctccagccagataggccccagtgccagttagttcacagaagcagagccaggacttagcagggttcacacaccatgctctttgaattctggtcacatgcattcacatcgaattaactttacatttcctaattaaaaagtgctgtttctgaagcaccattggtggttgttacctctagtcaatagagttaatacagtgttctcagtaagtgataccattcagaattttactaacatgattttgatggtatcacaattggcatagagaaagttttaaaataatacagtgttacaacttacccagagttgtttaaagcaattttaccatttaaatttaatatgacttattttgtctaccctaaatttttcacaggaccattccctttcctttactgctcacccatgtgctaagttttgtttctaagcaaaatgaagttaattggccttgtaaaatatcagatactgccagaccactgttaccctatattcttgtgtatgttataagaattgggatcaaaatgtttttacagttccttttttgtttttttgtttttattcaataaaagagattggttagcatccctgagctcttgtctgccgttaagttactttgcatgcgcttccaaccggatctggtgacaattgtggatgaccttcgactagatattctattgcgcatgctgaaatcaccacatttcagtgctaagatgaattctctcaaagaagtaagtttttcatttgtttctacaagacttaatgcacagatactaagttctgccaagatgtatgcttattaatataacaattttgggaaatatgaataatttattgtaatcatataaaaaagagaatgattgtgtataaaatgttgtatataattgttggtaaagacatcttctgtgttactttcaaaatttacatctgaaatatttaaaatatttactgtttttgtgaaatttcctagaatataatcccttagaatatacagtttgagatttacttttgctctaagggtacagttggttttgttttatttcaggtgtaagtttacttaaaccaaatcttctaactggggttgggacaaaaactaaatgactgcagcagtgttggtcaaagcaaaatgatggaaataattttctgtagctttctgaatttgttatcatatccacagaaacagcacagttggttttggtgtgtgacacatggagccaatgcagttcagttataattcacttattttttccttcggttttgtattgttaggattcttgactaccagtgaaagaaactcatcttgaaccattttagaccaaaagaggagttcattgaaaagaggctgggttattttacatgaatgaaaggtttactagccagacaagaaaggatgggcacatgtgggcaacagaacaactagaatttgcaagctgaccactgtcaggactctgtccaagtcttgtccctgcttttcttagtatgttggccttgctgcctctctacctgcatttggcatttttcatacggtagagatcaagacaatgaatagatccgatgtttcacatcctgcagttcccatcaccggagagggactgactcactccttctgcatatgaagtgtcttcctgacacttctgtatactttccacatataaaatttggagggagtgcctgattgaggtttgggttagatgttcatccctgagccaattagcagtggtccagggaatgacagctgtaagaatgactccatgttcttttttttttttttttttgagatggagtctcgctctgtcacccaggctggagtgcagtggcacaatcttggaccactgcaacctccgcctcctaggttcaagcaattctcctgccttagcctcctg

SEQ ID NO: 54013 - DNA, 1048 bp, Homo sapiens
agagtcttttctgccatcccccatcaggacctttgccattttagcctctctgcctggactgttctttaaacggctacatctgtcttgtcctttaaagattatgttttcagagaagtctttcatgaccaccaccccaagtagaggaaggtcctatttttctttcgaggcctttttgtttttcctttcgtgggacttagcacaatttgaattgtcttctgtatatgatgctctacttggttttgttgaccctgctagaatgagcttcataaaagcaggtacaacatctcttcgtagtcactgttctgtatctagtccctagaacagtgaatgctcaaaaagaaaagaaaaagaggagaaaatagagcttgcttaagagcattaattaatgatctaactgggactaaaacttttaatctctgctgatttactgcttcttatgttaataattaagttttaatttctaaaataaaacttttttggagaatttaactcaggttatcctgtatgttggagagcttaaacaactgatctcagctatccaaaaatgcatagatgctccacattgtggcagttccatcaaaatacagacttacagactcccaaaatcatatacagtaatgttaaagacatcttaggaagcgtttgggaaaaaaactttgaaaatagtttccaaacttttataatttttcttctgacttttcatttaggataaaagaaatgtaagggttaatggggaagcttttatattgccatctcaattttgtttttcttttctcataggagcctcatggatgggttgtggatttggtaaataaggtatatgacttttgttaatattgtcatgtagcatattttcaattttctaatgagacgtcctagagtttggtatattaagcaaatggcagctgcagagaataataaaaaaaatgctttaaggagtggatttcatattttcttcctttttttgtatgtacaatactagcaggtaaacatcagcttttggacttagtactatctgcagtatgccacaggagcattagaaggatca

SEQ ID NO: 54014 - DNA, 1666 bp, Homo sapiens
aaccccagtttaattggtgttccagtttcttagagagagttgagagactatagcatttaaaatgattacttgtacctagaaaaaataatctagtacttaatctcatatatattttcttttgaacttcatatgcattaaaacttgctttttcaggcctggaaccagtatattttatatcaaaagactacagtctgccaataagagtatactcacaagaagtagataatctaaacagtcctttagttaaaacactgtttggtttcagaaacagttgaaagaagttgagtttaatcaatagaaaactggttcattgctttagtggaagcagaggtttaggtcagcaatcatttatttaacatttactatgtgtctggcattattctaagtttgaggtataaacataagtacacagtcctgtcttttaatataaacagtaataagatgtgattactagcttgtagtatagtggaggaaatacgaaaacaaaaaaatgacagcataataaatagtaggtggaattataataatatgtactgtacatagaatccaggggaaggggtagttattgccaccttgaggagtcagacagttccccagagaggaggaaaaagctgagtggaaaggacagtgaatatgtactttggaatttaatccccacaatggctctttgagttgggtactatttttacccccatttcataggtgagaactgaaacagacagaagtgaagtacttgcccaagtccacatacctagttacagggagaacccatgcaggcagctagtctatgttctttaaccatatgcagtattgcctccccaaatgctaaactcttctcttcagatgtgttgtgaagatcaagtgacaaatacacatagaaatactgaacgtggtggttcactctagtgagcgctcagcagatgttcattctctttttttcactttacgtatgcatccactgagacccagaaaggtgcagtctttgtgtttcctctcattaccacaaaggaattctctctcctctagatcccctcttctcttgccttctcaagcatattcctccttcagctttctattttttctttggtatcctcaatctttccctcactgttgggattgttactcttgtatgcaacatgatgtagtatttcccatctttaaatattctgcctttaatatcatatccctctgtatggtcctctgctccccttcccaaccagacctcctgaagattccatgtcctccctctcagttattctttcagtggttatcctaaaatgttaacttactaaacaaaatctaaatttcactagtatctttctcctccttgagcagtacataaagaccttagaatgttgcatgtgctcgctcccctcttaaatgattcattacctctttattttacttgtgcattgtcttagtcccctcctatcattttttacccggtaaagttgatagtgcattctataaagaatcctttagtaaggttctgtttgtgggtaagtcttggtttttgatggcctgaactttactttatttcccattccttgaagtatgtattttcactgggttcaaaagtctagatgatatttcttttctctcagaatattaaagataccatttcactgtcttgtggctttgattattgctgtggagaagttggcta

SEQ ID NO: 54015 - DNA, 1127 bp, Homo sapiens
agagatacttcagaaaactgttttgtctcatgccttcagctgttaggagcagtataataaatggtcacatggttggtcatttttctgtaaaactgtgagtacaaaggtaccatgccttatattattcagttttgttaaagtaaaaatattaaattcttttgcactttagagctattaaaaaggttctcctccccgtcaattaggcatactttcttttattaaatcagaagagctagagttctgtgtgcctttaggcttgtctgccagaaaactcagtaggatttgatataattggtactacttacctagctgtgtttctcggttcgatgaccatccctctccccaattccccaggcttttctcacgagctgtcacacattttcttttagaagtaagggtatgaatgatatgtgattacataaataaggtgcacaaaggagctttgttgtcatttccaccttcttcaccttttaccttcaggctagcctggatttttactagtgtattcaggcagagaagataattcaggtttgaccatagtgcatggttatgtttaaaccttgtgtgcatcttcttcacaaggtactgcctgcctttccctatctcttctagaatgtaggcagaattgcattttcaaagtgaaaaatgagcaaatggaatggtgccagagggattgctgcttaatccacatacatttttattttgtagtcacttgaagcttcttaattggtaatctctgctttgttttgctttattatttaatttttaactataggaggaatatatagtcaggcaaaaaaaattctgcaaaaaatagtaacttactggtttacataaaatcagtcttatgacttctgctaatttgagcaagtagtgcggctaattagtatttagaaaatctggaaccgaggtttttctctgcagctattacagtttgggctcttccagcctgctctttttaaagaggttctcagtgaagccaagatgaaatttttgttgtatagtattttccctttgaatatttgttgcatagtattttccctttgaaaaatcttacaaaaacatgaaaccaccataccaatttaagtgaaatcctttgatttttcatttcttgttctggcacttgt

SEQ ID NO: 54016 - DNA, 1105 bp, Homo sapiens
tcatcaaaggtatatattctacttttaataatttcgtaagaactaaggttcctatgacatagttccatatgtatggatttagaatgatgtatatgatttttacgaactaccaaagacctaaataacgtgtattatttcattcattttactaaggtctttctgagtctgacttaaataaagtatattatttcatgcattttactaaggtctttccgagtctgatgagaattgtagaaggtttatggacaggtgtatgcctgaagcatttaaaaaggtaagaaaaatgtgctgctgtgatattttgtgtgtgtcggggtgggggcagggtgaaggaagagaagctttttgttttaattttagttttttatgtataagaccagtttatgaatcttgtttaactgaggaatcctctaatatgaaaaacggaactctgaatttggggcttataaatgatttacttcttttatattgtctgtatgtgtctttggttaaatataacttttattaataataaatacttcctactatttaattgctaaagaatagattaagacttaattatactagacttaatagattaagacttaattatactaggatattgcacatattagtaaacaaaggcttgtggcacttagaaagacagtatacacttatcaaaatatgagccattttaagtgtgtgagacaggagaagacattttaaactactaaaagattgactaggtattctcactgacatgcataaggcaccatctctattagagccagagtgatatgcctacttccatttgggtcacatctcttagaaagcagtgtttcttaacaatgggaatgggagatcacaagaattgtgtttctaaaaacagactgaatcagcctccctttttagcagatgagccttgaatcctcattagagcaaggactgtgtctgttaacatactgccctttcccccagcatataactaagtgcctagctcatagaaagagctcagaaaagttgcaatgaatgattcttttgctggcttaactgctggattttgacacccatttttgtccaatatgtaaataagtcactagaactacagatgggtaatgtttgcgtt

SEQ ID NO: 54017 - DNA, 1049 bp, Homo sapiens
caagtgatcctcccacctcagcctcccaaagtgctagggttacaggcatgagccaccatgtccggcctagacagttctttttatttatttatttatttatttatttatttatttatttatttatttatttattttgagacggagtctcactctgttgcccaggctggagtacagtggtgcaatctcagctctctgctcactgcaagctccgcctcccgggttcacgccattctcctgcctcagcctcccgagtagctgggactacaggcgcccgccactacacctggctaatttttttgtatttttaatagagacggggtttcaccgtgttagccacgatggtctcgatctcctgacctcgtgatccacccgtctcggcctcccaaagtgctgggattacaggtgtgagccactgcgcccggcctggacagttcatttttaacgaaagagatgaggtcaccttctaagcgagcgagtagagatgccaaaatgataaaagttgagaatatttgagatattcttggtgaaagatgtgattataggaaagaaaggtagaatccatgctattggtattaatagctaccattgattcagtatctgctctgtgttacataggaaatttttagagtaatcactaattagttttatttgctttttatcttaatcccttttcgtcagaagaatgatgagaatggaaactgctcaggggaaggaattgaattccctacaacaaatttatatgaactggaaagccgtgttttgactgatcattggtccatcccttacaagcgagaagaatcactaggcaaatgcctgttggcatctacctacctagcaagacttggtaagttttcagaccttagaacacatgaggacatttgtttcatagaaggcctgagtttaatcttagcctttgttgttgcctagctgtgtgttattggacagatcatttattctcttagtcttcacttatctcctgcagaagaaaagctttgaaccaaattaattgttttcttctacctttgatagagtataagattatttaaaat

SEQ ID NO: 54018 - DNA, 1035 bp, Homo sapiens
atagtacttatgaattaaatgtatttctgaaaagtgttacgctttaaaaactgaatttttcccatgcattgtgattctaagcgtacttagttcatcaccccctccttctacccttgtccaatttacattgtcttctatgcttaattaccttcctgttttttgttttatttagttacagactttgttggggtggggggagaaatgtgttggatttctttagatatcattgatatggcattgaagttagttttcttctgtgttttatgatttctgctttatatttatgatctttttcttcattgaggttaaacatgatttttaaatgggattattttattttgtaatgattaaattatatagtaaattgtgaggatatgtaggtttccaaaaaaaaaaaatacaaactagtgtgcgtattaggcaatttggggtcctgtttgctttgttacaaattagcatggtgagaactgaaggaaagtctggcagttaccctattaatagttgaagctttatatggattatttttccatttaacaatatttattaaatacctactttatgctaggtgccagcttctagagatacagaggtggtcaaaaatagataaggtccatgcccttaggcagcttggtctagtgaggggcaaacaaatcacagataaatgtaaaattacacctgtgagtagtgctgtgaaggagaggttgaggatggtaagggtatatgataactgaaggaatttgtctattttagaaattctggaaaggcttccctgaaagaattaaagatgtgtaggagttaagtaggttaaagagaacagaaagatgagttcaggaatagtggcgtaaagcaaccattgattgtgcccgtagattctgtggggatgggattcagacagcagtttatctctgctccatgatactgagaacctcagctggaagactaagtctggggatgacttgatgactgtaggctggactcatgtgaaggctcctcctctggccttcaggggctggttgtccaatgagaccttagtga

SEQ ID NO: 54019 - DNA, 1048 bp, Homo sapiens
gtagttgttatactgtatataaatacattatttgtaatgtaaattacaaaatgtaaatacattgctttctatgtatttaaggactaatgacaagaaaaaaatgtctagatccgttcaatacaaatgcaaccatccattttttcccaaatattttcagttcacaattggttgaacccatgggtgtggaggactgactttacctgaataaccaagaagggttaatgcagggaaccacatacaaaagtcagcttttgttgaatagtttaggaagttatttactactcataacatggaatgaagatgcattccaggaaaacatttgcagacttcagacacaatgtattcatacatggggactgcatacacttacttgtttatcatcttctctttttccaggaagcaatattttaggaattattttctctagtctgaattaacagggaatatcagatctgcatataaccatctccaaattgctttgaaaaatatttagtaaaactgacaacctcaatatttaatgaaaggtattataaattagtgacttgcaatcgaatgcccatgtttgcatgtttttccttaagctcttcacatatatgtttctaattgtttattataatacacaagtaatagacaaatctgtttaaaatcatcgtgaagagatcagtctgtcatcttcatttttctatatattgatcagaggttcttttgagcacatgttggttaatagcatagttcagtaattgaatttagtattcaaataaactttaagcaacactggtagtctcttatccgttaagttgaataattttcttttatctgtatttgttgagtcagtgggcagacaggagcttatctctaaactagcaggtggtaggtacctccccagtaggttttacttctttcaacaaagaaggcttaaattacagtaatgtatccttgttgggttcaagagtaatcagtttattgtctctttaaaaaaataagggtactttttctaaataaatattaaactctcttattaacttaaaagcttgcatgttgatttttt

SEQ ID NO: 54020 - DNA, 1049 bp, Homo sapiens
ttgtacaagtgatcccctgcctgagtctatccacagttgctcatggtattgaatattttaaaaataagctttaagagtcagtatacaggccggatgtggtggctcacgcctgtaatcacagcactttgggaggccaaggcaggtggatcacctgaggtcaggagtttgagaccagcctgaccaacagggtgaaactccgtctctactgaaaatacaaaaattagctgggtgtggtaatgggtgcctgtagtcccagctattcaggaggctgaggcaggagaattgcttgaacctgggaggcggagtttgcagtgagccgagatcgcaccactgcactgcaacttgggtgacagagtgagactccatctcaaaaaaaaaaaagaaagaaaaagtcggtatacaaatcgcttgaaacagtataccacctaatttaatacttttctgtttcagatgtgtattgtttagtttcttaaaatagccttttcgttctctgtgtatcaaacacagtaatgacggcaaatatcaaccgggatgtattatatacttgcaggtttgaagttaaacattttgaaatataccttggaatggtgtaaatatactgaaaatataacacttgccttaggttatatattttaatgaatacaaaaataaagcatggtgaatattgatgcgctcttagaggatacttaaaaaggagatcagttttaaaatttgctagatcctcttatgactccttgcctgtgcacgtgcattttctcctgcctggcatgccctcctctctcacctcttgccatagtgggctattccatagcactgtgtgtgtggtatcaatttgatccttgcacttgatcctttcactacaaaatagatttaacacagccttgcagttggcagagatagggtaggaacatctccttccttaagtcaagcaagtcccaagagactccgaatgctaacataccacctgtactgttaatcactcttgctaatggttttctgttagaacttgatgccttgcattatacctcctcccgttctttcttcccttc

SEQ ID NO: 54021 - DNA, 1025 bp, Homo sapiens
aaaaataagaagcatattaatttgtagttccttaacttacctcattcctatttctcttgttcccctttggtagtaagtggtaattataaatggattaaaattgtaatactgtcaatgtgtataattaaggtttatggtaaaattcatgttattcttttcctaaaatacaacaaccctagtatgagtgtggagtaaatatcaaatgagtagcttttagttaactattagtgatttggtacatgacctgtggtttatgaattactgtgatttggtaaataaaaaaaggccctttaaaggctttagagtaaaaaaatgaaataatttcccaaatcagttgaaagtagatgaaataaaaatagggaattaaagatgaatcagcatggcctaatttttaaataagaatttctttctgatccagtatatgtatatatatctcctttgggaattaggtctgtgagttaatctaatggttggagtctcaccttgtaattacctgcccattcacttttagaatgaatgtaatttggcatgaagagagtacctttcgtgtgtctgtgagtgtggttttagtgaaatcatagtaggttgtgacagctttatacagcataataatattgttagcttaaattttgaaaacaatttcaatgttagaaaagcaaatgttgtaatgttttagcaatttgaggaaaaggtttcaacattaatagaaaaatatgtccatatacttaagtatttttatacttactgcctacaatatcatataccatttacttgatctgagtgtgaaggagggcgttttttacttttaataagaaaatgttaaaaaagatttagtagaatctgaaatctggagttcagttttcctggaaattttccttatatggaaccacagagagaaataagaagtaaacacataagatggaaccatttcagaacaccttcgtacatgcattaaagctcatgcactccactcactaagcgctctaagtgcactaaagctcatgcatttctttcatttgtgttta

SEQ ID NO: 54022 - DNA, 1024 bp, Homo sapiens
agagtaaaaaaactgggtgaagattgtcagctattatatagttaatcctttttatttctaaaaactgagtaccttattttaaattatatacatttctatttgctgcacaggacatttcagtgtcattgtcttctttaaaaatgggaaaaacagaataaaatctaattgattagaaaagaaagaaatgacttaagtttttttatatttgtagtttggggatagcaatggttttctcttaatgccttcctgtcccaggggcagggagtagagtgttgaacagaacgtggtgtttacattctagtgggtcttagtccaagcctctcattttacaagaaaagactgtccaaggtcatgtagctagttaggtaaatcagtttgaggccctgctgtaattagggtttggtttaaaaattaatatttgaacagtgaaagctgttaacttccggttcagtagaagcaaggagaatgcagataaaaaagacccagatatctagcaaaacacacaactgcatagaaagccaccttgttaatatcctccaattaagtaaagatagtgttttgcagaagagatgtgtttggttctcactagtattgttggatgtaaatgttcttggtctctgggtctggaagggactttgagaagctgtccagttttgattttgaatagcattacttcaaaatcattccacggcacataagagtctgttctattattaaagagagtgagctctcacagctgctctaaataacttattctgatttttaaccacccccctgtcagaattcttcactctttactgcatggctaatgtaaactctggcctgccaagtgcgtaccaattggttctgttctctacacaacaggaagagttgggcctttgtaatctctccaggggatcagtagaaatctgaaccaggtatcctgtgcatctcacagaacttaacaattatgaaatgtaccttatccataaggaataccatcaaacattaatactataatgaataccttattcattaagtttgt

SEQ ID NO: 54023 - DNA, 1012 bp, Homo sapiens
aaggaagcgatcgacctaattttagaaagactcagactctgaggctcctaaggtatgagacgtggaaactcgggtgaggattatttatcatttatcagccttggcttccagaggaggggttggggctgattcagctgaaaagcatcccccatgggctttgaagtcagatagatctagggtcgagctgaacttggctgagtgactaatttcaccagtctgagccttggtttcctcatctataatatggggcaatagtatctacccaatagcgtttttttccccagagttaaatgagaaaatatagaaagggtctaataaattacgtggcccagatggatactcaattaatgtcattgaatgaatcttcatggagagagcacatgtttataaaaaaaagtcttcagtgaatcatgataagagtattgccaatggtctctaatttctttagattagaaaagaggttttcatgttgcttgcatttggtcttttccttatttaatgtctgccacactctgaagactttaagaatgtttaataattgaatgattctgtatttatatactcaaaccctggcataaaatattcttgctaattacataatgcactctggtttacattataggacttttgggtttttttttttttaacaccataatctctttttttcttcaaaattgagatagctttatttattttttcctggttctaagaataataaaattttgttgaattttttttttttttttttttttttagtcagagtcttgctctgtagtccagactgcagtgcaatagcacaatctcagcttactgcaacctctccctcctgggttcaagcgattcccctgcctcagcctcctgagtagctgggattacaggtgtacataccctcggctaatctttgtatttttcgtagagatggggtttcactatattggccaggctggtctcgaactcctcacctcaagtgatccccctgcctcagcctcccaaagtgcttggattacaggtg

SEQ ID NO: 54024 - DNA, 2712 bp, Homo sapiens
ctggattcctttgtgaggaaagggaaagtagtgtgaattaatgactatcactaattatgacctgcttcctttgttgaggaacttatctttcattgctattcgtttgccttgagaaataaggaagtatgggttgcagatatgggcaatggactgagagtccttagaagtggattctactgaaccagtgttgtgcaacctgggacatgtcactgccttttcccgggtctcagtttccctatctgtacaataaaccttgatgatatgatctctgttgtccttccctattcaaagagttatgatttggggccccttttcctgaagtctgcgctcctctgaccttccttttccctctgtacccagacccccgatgtcagttactgacttcgatctctgatttgtgcttctaggttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgactttagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccaggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagtttccctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaagcctggagtgtttgagagatgtttgtctcaggtgtgtgggtaggagaaggaagcatcgcgggctggcctctttgagtgggcttgcctcatctcagcgcaccaactcctgatttttttcagtgggaaatgtggtggtcatagggtagataccgatgtctgccctgctctttcatctctgaaagcctgtttgcagaatgaggccctggctctaccctcatctcaggctcttctaaagagcttttgtattctaaagaggatttttccatcagagaggtaggagctgtaggaaccccgagggcagataagcagccctcactctagataaggtatgctgggggagcttactgagggaatcctgtacacagcccacatcaa

SEQ ID NO: 54025 - DNA, 1033 bp, Homo sapiens
ggtgattctgaaacagatggtttgaggacaacactttaagaaataccagaatagatgatgctcaattttcttgaggttctaagattctaaaattcttctgcttttatagttatctaccctttgctagcattttagctcaatgtgttacgtaaggatgggattcctattttcaaggagttcacttacactcagggaccctaggaacatttaaaggataattttattgtcataatctgcccttaacaaaattaacaaaatgaccctcaaaatttgctgattcagccattcctagcaatgaaaggaggaacctggctacctaccagacttcttatttctggtgtacttggttcttggtgacctctaggcaggcagcaccccagcagggctggactgtgtgtgctccctggaaggctgacatttccggagtgtgaatgctggcagtaagacatcggaagcatcttcctctttgagtgtgccaactcttggccaaagatagctctagaaattgtaagaactttgagagcagattctgtttgtcctatagaaaactcccatcagcatattgcctctacatccagctagaatgtgtcagatttcacatgttcattcatagtctcaaccactcttttttcccccctctctttttatctttttccagttttttgtttgttttatctcttcatcacggtgaatggggttcttacagcttagagttgtcttgtttgtgtgtactcatgctcttgaaggaaggggctacattgtccacagtgcttgggtaaattagatcatattccaccctgggatcacagaacagtttactccttttgactcaggaggaggtcagaatcacttccccacagataaatccatagaaacagaaagtagattgatggttaccaggggctggggagagaagggaatgggacatgactgcttaaagtttatggagttttattttggggtaatgaaatgtcttggaattagataaaagtgatggtggtacaacactatacagtactacatgccactggcg

SEQ ID NO: 54026 - DNA, 1269 bp, Homo sapiens
tttcaatattttccaacacctgagtttctgtattagatacctgtcccctttgatggaacacagttccagtgtcacctcatctctgatgaaaccttctgtattagctgcctctggctgctgtaacaaattaccacaaatttagtggcttaaaagaatgcaagtttcttttcttacagttctggaagttgggagttggaaaagggtctcactgagctaaaatcaaggtggaacacattccatctagaggatctaaggggagatctgttttcttgctttttctagctttctggagctacctgagttccttgactcatggccccattctccactttcaaagctagcagcatagaatcttcacttctccctctctctctcacacacacatatactttctctggcctttgcatccattgtcacaccttcttctgtgacttttgtccttttgcctccctcttttacagatgctgggaccaccttgataacccaggatgatctctccatctcaagatcttaacttaatctcattttatcatgtagcatcattcattgcttctgggacttaggatgcgggcatctttgggggacattgttcagctttccacaacttccccagtccctggagacagtattgtctcacttccttccagtcccccatggccttttgcactttcttcctaccatggctttaggcctcatctactcatggcctgctcatatgtctgtctcttcagctagattgtgggtgccttaatagcagaatccatggcttaaccttctgattatttattctcggtatgtagtacagcagctgacacaataggtgcttcatcagcattgggtaaatggtgaatgatgaattagcttgtggcttcaggccagacacttcccttctgggcctagtttcctcacctgtgaattgaagctggaggccttgtagctccatgacctttgtgcacagacattctatggcacagctgactttgtagtaactgactgaggtacagtgcattaaccctagaatgctggttccataactgcagagccttaggcaacaggcatgacagccgagaacttttacctgggtctgttgagggtagatcctgtcacaacaggcagacttgtctagacaaaaatcacatgtcaaatggaagtctggtttcctcctccattgcttactaattgaatgctttccagaaaaggaagacaatggaagccagcacagacagaaaacctatacagtgtcatgaactcaacacaaagacacaagca

SEQ ID NO: 54027 - DNA, 1047 bp, Homo sapiens
cctctgcctcccagattcaagcaattctcctgccttagactcccaagtagctgggattacaggtgtgtggcaccacacccagcaaatttttgtatttttaatagagacagggtttcaccatgttggccaggctggtcttgaactcctgacctcaggtgatccacccacctcagcctcccaaagtgttgggattacaggcatgagccaccacccacctcagcctcccaaagtgttgggattacaggcatgagccactaggtttggctgatttgcaaaactttctaaagaaaattgaaaggacacaatttcggcccaccagaggaggtgggaaactctgcagtcagtccgagaagcccttagaccctcccccagggcttttatgttgagctgcaggaagttctggagttgggcaaagagactggactccccggtgtacccagtgctgtttttttgttcatgcagcctgtgattcatagcttccctggggtgttggggagaatcacatttgggtcagccaggtttagcactgacagttttgtctttagaatcaagcagatgtggaatcaaatctggctgtatccatgaccagctctgaagccatgagtgggttacatagctttagagcctcagcatactcatctggaaagtggaagtgatcatgtctattttgcagagttgttgccacttttcctctctggaccccactttccccatctgtcagatgaaagagtgggatgagatggcctgtctatttatctctcaatcacaatggctctatttgaaaaaagtttgaactgccctaagtgctaaaaaggaagatggggagccatcaagacaaacttaggcctacattaccatcgagttcagagaatggcagaccggaagcaccagccagctccactccaggcttttcacagcagccacttctagaggctccataactttaagggcacttcatgttaggtcaatgaataaattttgccaaatgatgagcttggaaaaaccatgccccaaacaccaaattatcctgcacacagaagcttaagg

SEQ ID NO: 54028 - DNA, 1447 bp, Homo sapiens
ccaaaaatctatcctaatttttcttcatatttcctctccataacagttaaatatttgtaaatatgtgggcagttgagctctttttcaccagaaaagacaggaagaggagctgtcttgcagttggagccaacctctctccaaactgcagcccttctcaggcaaggactgatccctttctgtccccttgtagcttaattgcaatgctttcccattttattagtttccagattctgtgccaagtgctttaaaaggcaggtaggggagaattctctgcttgcctggcagcctgccatcacccccagaatctgttgcttgctgtttcagaaagggatcaacattgaaggcatttttctcagcagtgaaatttacatatcagaaccttgctgactgaggcagaaatgagggctctaggggcaggagtctgggagtggggacagagtctttgtaggaggagggggagggaagagcttattttcttacccaggaataaaaacattgtgagtaatgaataaagtccgaaagcagtaaatctgggactcgagagttaggtgtgtaacgtgtcggagaacaatttaagccttcgcctcgtctgtagaggtgaggtattcaggctgcctttcacaacccaaatttcattaaatagacttttaagggttaggattacaagaagccaagtccgcctggttcataatgatgatttatggctgtgttgtcgactccctgacccttctgtacaaggggatagagaaaatacataatttgttgctcattcactctaaaatctgtcaaggctgccccagaagccatgtggtcctggagtcatgtgtctgctaaatggcttcagcctggccctctccttaaaaatctgcaattgctcttctgcagtggaaattggttttaataacaatagaaatgataaaattatctcagtgtagtctgctgtgggtctttgagcttaagagtcagaatacctgggctctactcttaactctgtcacttactggcctcaaatccttcagaaaagtcactgtctcccagagccttagtatctccatctgtagaatggaatatcttcttcacagagaagattcaatgaaactacagtacaaaataaatgtaagagatggctgctgttaacattattattaggaatttgaggtactgcaaaatgttcttttcatctccttgttttcccttgagtgaaggaaacattttactttgcaatttactatcttaagactgtgacactaaaaatggaagttttagagatgggacattagagctgaaaagaatccctgaattgtaatcaaaccccgtctccctaaagtaactggagcagaaaggtgactcatctgagattaatcagtaaattcataaaagagatgctaatttgcattggaaactcacatgttctttctcagcatcaaacaggaaatcgtgttgactg

SEQ ID NO: 54029 - DNA, 1051 bp, Homo sapiens
agcattccgtagctgtctcctcccccaccttccaaaggtcacagagaaccctgggcccacctctgtggctgcagtcactgtgctgattgtcatgtctgtttacttgtatatttcttggctaccctgttagctgcacaggggagagacagatctgatttgatttggtattgctagtgtgagacatagaccttggtgctcaatatatgtttgtgaaaaatcacagaagaggccataaactgggggcagaaaatcaaaagcattaggtcaaaagatatcagaggattcacagagcaggggaaaatgtcctgttttcttccttaaaatctcaactatgctccaggaggcacatgggaacacactctgtaccacatgcaaatttcttgctggagagacaagaagaagagcttagtacctgcaagacttgtttattcagtatcatgcttcactttgcccacatctggacttcattagttcctccccacccctccatctccctttatctacaagagccctgccaagaaaacaaggttcctcaacattgcctcctcattaaaggctagtcgagttttcaactctgaaaaatgtgcagttgtgctggcccagtggtgcattagtgggagacccagtcccccagtttacaatccactacatctgtgcaattaccaagaccaccaacagagagaggccacattaatccttcaactgtgttgtcccctgatcagatggctacagagttcttctgagaccttcttatccctgggggaacagtgggagggggcatctatttgtgatttaacaacacaggcatggagagtgcactaaattttcatctgttccctttctccaccacccacactcactctcatgtcctggaagaagtgagaacagcagcaattcttccttagttaggtacagctcttagggattcatgactatttgaaaaacgtatcaatacggaggtgatgatatgctccatttgaagtcataatgcttaggaggccgagaaatactttctgtgaggggcagtgtgtgttggggatggggtggagag

SEQ ID NO: 54030 - DNA, 1031 bp, Homo sapiens
cagctctgctcactcttattggtagttctttgaacagtgaaagaaaagcctggaaaatggcattcatgaagcagctactatgtgccaggcactgtgctagaggttgtgtgtgcgttgatctcctttagtcatcaccacaactcattttactgtgggaaaaaactgggactcagggaaatggagtgggaaccagaggaagtgctggatctggggttcacatccagatttttttactccaaggccttcactaccccaggcagcacagccttagtgaacttctcaaaggggaaatggttaagagctaagaaatgaatgcccttggaagcataaatcatgagatttggggctatattagtaaatgttgcgattcgggctttaatttttagcagggtattgtagaacagtgggaaaacccctgctctggctctttcactgcctacctccgagctcttggggaagagaagaggataatgcctctctcctcatgggggtgtggaaaggaggaatggggttgtgcatagcgaaagctctctctaggcagtagatctctacaaatggaaggaacgattatcactctcagtgatatttgggatggtcttttcttgaagttcctctttggcactgatgttttccccttcctttttttctttttttttctggtatatgccatggttccacctggaccagcgggcctccccttcctcatcatcgagacaagcaccatcaagccttaccaccgagggttttactgcaatgatgagagcatcaagtacccactgaaaactggtgagacaataaatgacgctgtgctctgtgccgtggggatcgtcattgccatcctcgcggtaagtgtccagactctgctatggtggatcctgtctgacttcttcctgtattgtcatattatagaatgtctgagccaacagagacttataccaagtagaagccaactttctctggcctatatttagccaagaaggaaggtagttaatcctgagaacactaaatgtgaagtaagtgctatcaccccc

SEQ ID NO: 54031 - DNA, 1019 bp, Homo sapiens
aaaaaaaagtaccatgaactccacaatttttcaattactttggtccagaccagcagtgataaaaatgctcactttctaaaaagtgtatttatgtatcactgtgcatacacacatggatttatttggttttattctttggatttatttgaattctatggctatttattttgtgacccctaactgcttcctgctagaacaacaatttactttatcaaattcatactggtgctttgaaaagaaagaacagcaacacaccacagtattgtgcctgaccttctcaaagtaaacacagaggggccatgacaggcaatagccattaggttttaaaactttgtctctgcaatggaggagaggggggcagggaaaggcagtggataaacgttctggcttagaaatgatctttaggggttaggagcctgggagagaaatcatatggtcccgaaccatcttcatgccactgcctaaacattttgaaatgcaaccaagttggctatgaaaagtagctgagaagccagcagtatgatattattaatagtctgcttttaaagttccacatattgagatttaaaagttgagctgcagttgctctggtgcctaggagccaaagtgttgctaataaactcaggaagggaacagaccccaagttccttacatttgcactccactctcagacctccagcttctatttttaatagtgctcacatgataggcctgtaaaacatatgtttctatggacaataaaacacatataaaagagttttggagttagacagaactgggttaatgatcttgactctgctccctactacttgagtaagttatttcacatctccaaaactccctttctcatctgtttaatgggaagaatgaaatctaactttagggtggttgggattatataaaaattaaagcattcattcaacaaatatttattgaggcttaactatatatattaagttacaaggaacacaaagatgacccagaccctgccctcaagaagcttacaatccagcagggga

SEQ ID NO: 54032 - DNA, 1268 bp, Homo sapiens
gctatgacccaaccaacacctatgctctttcctccaagaattaagattgcaatttgaattttcactattagtttcaataatgagcatatgaagaaagcaagcaagtcagaaaatttaaaaatgaaattatcacaccttgtaaagtgttcagatttgacttgaagtttaaagtcttttgtccatttcagtatttcctgtttctttgtaaatccgtagaggatagacgtgaactccaaacctttacactggaagagagaggcatgaactttactgaatacttaatatgtggcaggcagtgagctaggggcttttcatacgttattaactcacttggatttcacaacaacactatgaaggtggaggttgaagttcattctgtttttctcagaacttggtcagcaatgtctatagcaatcctcattgatgggttggtgacacactgttaataattcagctaatcagtagcagaggtcatttactaacatttcagggaaaatgctctgctagaatctgctttgagctggtcacttgggccatctatccacttttactgaaaatatatcagagagaatctcagttccagttctgtagagccttagaagaaaaggtcaggagccatggtaggagaatacttggccaattttctacagaaatggaatatcttttctgcagagagacagcaatatcagattgtattgttaattcttcttatcagtcttctccaaaggtgttaaaaagccagggaaatgaaacattttgagtgaaggagcctgcactttggaaaacgctccgtgtatttcccaggctattgtagggcccctattcagttgggatttgaatggtggtgtgattagcatgaaagcaagtgtataaagtaggtcttttctccctttcctaaaagaagttttgtggcatttctttttctgacagagttggcatgaagctttgacaaacacagacccatggaaaagttaaataggacttagagtaggtccattttgtacagatcctacacacttagaatgcagagcaggaaagcagctggcaagaggcccctcaaaccataggaatcatagcaagggctcttcctccactgtggaccaaggatgaataggaaacacccacaagaccaatgggaaagtatatcctgggctgttgatcattttctgtattaccagaaaatgacagataagcacatgcctgtgagtccactgcctatctctcccagtatttgtggagataaatacaaagtgctgagggaaagtcta

SEQ ID NO: 54033 - DNA, 1771 bp, Homo sapiens
cctaggatcatttagtaggtaagccctgttgacttttctagtatggttaaaagcttttattcactgtccataatggttagggtttttttttttttttgagacagagtcttctctgtcacccaggctagagtgcaatggcgtgatcttggctcgctgcaacctctgcctcccggattcaagcgattctcctgcctcagcctcctgagtagctgggactacaggcacgtgccaccatgcttagctaattttttgtattttagtagagacagggtttcaccatgttagccaagatggtctcgatctcctgactttgtgatctgcccgcttcagcctcccaaagtgctgggattacaggtgtgagccaccgtgccaggccccttttctgcttttaacccttttgattacctgtcaattttagattcttcctttaccctttcttgtgcagttgtttgggctagaaagcccagttggtcacagcgtgatgctaatgagaccatagtcaagggcttcttccctgtgtaggcagttatatttatggagaaaccctgtcctgtgtgtcagttcaatccagtacacgttatgtgaggagtaatactttgttttggggttgcctattacaccagtatttcataaactcacctaacatggggcctatctggtatgaaatacagattctcggactcttctccaggatattcagattcagctggctttgagccaggacctgggattctgtgttttataaacgctgccggtgattcttatcaggccaattttagaatcactatgttgtttaacagctgatatcttaagggcaatttaattatgtagtgggctttttgtccctgcactgaatgttctggcattttctgcattgttaggttgtctgtactttttttgtttgtttgtttgtgaccagtgcacctgtctttttcagtaaagataatcaagtttgcaagaattcttccgaatggaaaattacccctggatgcagacctgaaggtgtcctgtgtctttcagtgcaaagacttggtgttgtttctaatgccaagaggctaaaatctttatgtattttctggttgtaaaccgaactctatgtaattgaagttgccagccatgtgactctttggataaatgaggtgttaattttaaatattttcttttgagatattgaagtttgtgcatgagtgcaaggtgaagcaggaataaattagattcctaaatagagcctttagaagataaaataagcttggcaaagtagtgtagaaacaatacaagctttggatttccccaaatctgtgtttgaatcctgacataaagcaaacagccaccttttgccagcatgtaattttgggcaaaaattatttaacctcctccaggcttcagtttcctcatctgtaaaataagcaaacctggtaatacttgtttgttgtgaaacccaggtgagataatgaaactgaaagcattttgaaaagttcaaaatcacgttatcattatcaggtaggaatgaagttgctgttgttcttcatagagtcgaattttcattttcctcccagttttcttactcctcaatggttctataaaatcctcttatttcttggcagcaaagttgcctgaactatattaaggaaaaagattctgagaagaatcccaagaaaacaccaagcagagtggacacaaatgttttccattagctgaagaaaagcagtggcaggtttcctgaccctttctgggaaagtcaaagtgcaggaacctcaataggctttggtgg

SEQ ID NO: 54034 - DNA, 1051 bp, Homo sapiens
tacgtcttaggcagcttaaggaaggggctgtgctttcggaatcccatccgagccaagtaaggaggtccctctctctctctccccccacgtcttctctttttaaaggacctcgtgaaataaaagtgcagaaaacaaacccaggcgatcacagcagcagccgccgcggcagcagcaccaacagcaggaggagcaggaggagccggaggaggaggaggaggaggaggcaaagttagagttggggctggcgctccggagttgctgggctcagcgcagctcccattcattaaggaaccagctgcggaggaaggtggccgagcgcccgcgctgcccactcgctcgctcgcgcactcagacgcgcgccacaacagcgcgccccaagctgcgcagctctgcaaaagtttctgctcgggatctggctctcttccccttggactttagaacgatttagggttgacagaggaaagcagaggcgcgcaggaggagcagaaaacaccaccttctgcagttggaggcaggcagccccggctgcactctagccgccgcgcccggagccggggccgacccgccactatccgcagcagcctcggccaggaggcgacccgggcgcctgggtgtgtggctgctgttgcgggacgtcttcgcggggcgggaggctcgcgccgcagccagcgccatgcaaaactacaagtacgacaaagcgatcgtcccggagagcaagaacggcggcagcccggcgctcaacaacaacccgaggaggagcggcagcaagcgggtgctgctcatctgcctcgacctcttctgcctcttcatgggtgagcccagccccgctgtccctcggcccctcggcccctcgtccctcggcgcgcgtcccagcccagtccggggccgcgcagcgccgcgccgcgccgcgccgtcagctccggggggcccccgcagccttcctggggagcctttgcgccgcccaggcccgaagcccccgccctccccgatcccaccgacttcttggcctgtacttgagtgggtctgggcgtgcttaagcgttcgtgggcaa

SEQ ID NO: 54035 - DNA, 1037 bp, Homo sapiens
ccagtctcaccccctattttcacccccttcggttttcctcagaaagggcctcctgcctccctcggcaccctcgcctacccccctcgcagcacctgtcgcctccgcccctcactcggaccccgcgcatctggcgcagcccctcccgcactcccgcccagcgccccgcgtccccggcccccgctgtcgctgcttcgggttccgccgcaggagcctctcactcccgggagcgggcgcctcgcgctccctccctcggccccgccccgcccgccgctcgcccgttgcttcccacctgggcccgaagcgcccagcgccctctcccgggaccccgcgcccgccccgcgcccctcgcggctcggggtccgccccctcgcccgcagggcccgctgcactgtgggtaggcggcggcggcggcggctacgcggagcggcaggcggtggagcgaggccgcgcgcgccgaagatggctgagaagcagaagcacgacgggcgggtgaagatcggacactacgtgctgggcgacacgctgggcgtcggcaccttcggcaaagtgaagagttgagtacgcgctccggaccgctgtgcggggctgcctgacttgcgggaggccgaggggagaggcgggagccccgggcctccggcgggcgcggggctcggcggcaggtggagcggtcccgggtcgcgcggagctggggccccgggagggtggcgcgcaccgcctcgcctggcaccggcgcccgggccccacagggtccagggaagagggcgggggtgtgagctgaggatgggcgtcctgggttccaggttccgcgcccatctgcctttctggaggtcggagcaaggcacttctgtgttctctggacctcagtgtcctcctctgcaaaatcgggagaactggactcgttctgcgaggcgccttccagctctgagcctgtaggcttagggcggggatcatccacgctactgaggactgaggcgccgtttcgtgccgggtgccctgttaggtgctttacatggaatctcattgaatcctcacagtga

SEQ ID NO: 54036 - DNA, 1117 bp, Homo sapiens
gtgggagttttgggaattaaatatgtacataaagtactatttaataaatatggtacttatttaataagttgtagataaaaaggaaaggaagtctcttgcttccttgtgagaaccatcctttagagaactttaaaggattttcagggaaaggaaatttggagaagagcaatgagattgttttgtttcaccacgggcagaggtgaaaggagcgttgtgttgttttggcaggagtctggggatggtaggggtcggaacatatgtgcattacataacgctgctgatcaccagagttacggcttttgacatgaatgagttaaggttgctgaccaccccatgaggcccaactggctgatacatgtgtgatctcttggctcgtcacagcttaggtatatagtgtcctccaaatgttcttaacgtttttattgtactccatatacaagagtatactggcatcttttacgtaaattctcaataaattttcacaaactgaacacatccacgtaaccaccactttgataaagacatggaaaatgaccagtatcccagaagtccccttgtgtcccatatccccttgtttccaacctccaccccaccaatgggaaccactatccatggatagtttcacctgtttttgaactttatagagacagaattctactgtatctggcttctttacatgggattatgtttatgagatctatccatgtcattgcatgtagttgtaattcattctcattgctatatagtattgcattaagactatactattatttgtccattctattactgatggaaatttggtagtttttacatcttggttgttatgattaatgctattttacacattcctgtacttgtcttttttctatttttattattttagaaaaacgtgaatttaaaaccatatatataaatattattttagaaatatatttttttctactgtcacatttcagattcttgtcattactgggagtattttttcaggtatctaccatggctttctagaataccatatttattgttatttaagttgtttgagatgcaatacttttgaatccatacacaatactgtaacaggtacctgctaatacaatgttacaaccacaggtgtttt

SEQ ID NO: 54037 - DNA, 1098 bp, Homo sapiens
gtgtgaattctctgttgaaatagtaattactgtgaatttttgatttattacactatttattcttctataatacaatgactggcattaaacagaagaagagaaacaaagagattaatgaaacagtgagttctctcctgtccaaacaatgttctaaagttgattatgtttttagtaagaatatagaattcagtaatcattttcacaaatattccacaaataggaacgtctctgttaggtgcaaaagatacagagatgactaagatacagtttctgtcctcagagagtgcatactctaatagaagaaatagaagtaaaaagaactgtagttttgtacaacaagggatataaagatggtatatatgagtagagaagtttagggcacaatggaaggaagcatgaataaatgattatgttgatatgatagcacattttttttcctttttcttttctttagttggagaacatcaattaacaggccataaagtggcagttaaaatcttaaatagacagaagattcgcagtttagatgttgttggaaaaataaaacgagaaattcaaaatctaaaactctttcgtcatcctcatattatcaaactgtaagtatttttgtatctaataataccaaagagacacctatcttaaaatgttttttaggaattttataataattgttaattgttaaccttttacaaagattttttttcatgttcatattcagcaagtgttaattcatttaacctttatcagtcctttttttgcatactcttggttagactgaacagacattgtttctaaattagtactcaatttatgtttctaaattagtactcaatttatgtttctaaattagtacatcaattctcaagtgatgaatgaagttgattcatcacatttagaagttgattcttatccaactttaaatgtcattcagggctttgacatttctagattcatttttataatttttatctagtcaattttcactaacattcagggtattttttcctttggaaagatagaaagtatatgtcaaagattatttcacatagtatattacttgtagaactgaaagtagtactataaccataaagcttttag

SEQ ID NO: 54038 - DNA, 1031 bp, Homo sapiens
ctgcgcccaggcccgaagacttatttttgatgtcatatttatcagtgttttcttgcctccatttctatatttactttcaatcattttatttttgtttgactgtctcatcctgattatttaattatttgctgttttctgaaggaattatagaagattgtcagagttggtcagaaagtaattggcagaggtgaatttgcagtttaaaacttttggcttccagccttgagattaattcattcagccacattgcctctttaattgtagatctgatcttaaaacaaaaaacaaacaaacaaaaaaacactcatgtatttttgctacagaagaagcttattgacatcgtctgtaacagtgttagtgatttaaacagagagagcaaccttaccctttcagtggttttcttttgtgtagccttggactgtcaggaatagtttccttattgcaaaagtgggactctagaattagcaagaaagtttgagcattgaatgccaagaatgaaggatatttattgcatgatttctttattaacccaaattgaaaaaaaaattacaaatgaatgacctaaaacccactggtagaaaattaaaaggcacaaataggatttaaagaaaaatccaaactttcctatgaagtagaatttgttgaattgatttttgtccttttttttctttcctccataattcttaatgcaacttgattttacttggtcaaaagatgcttgttagtctggtagagatgatcttgtctaattttttttttttttttttttgagacaaagtctcgctctgttgcccaggctggagtgcagtagcatgatctcagctcactgcaacctccgcctcctgtgttcaagcgattctcctgcctcagcctcctgagtagctgggactacaggcacacaccaccacacccagctaatttttgtatttttagtagagacggggtttcaccatgttggccaggatggccttgatctcttgacttcgtgatctgcccaccttggcctcccaaagtgctgggattacgggcgt

SEQ ID NO: 54039 - DNA, 2793 bp, Homo sapiens
tttaaatttttatcttacttttggataatatccactgcaatactaattgagaaacatgaattatttccaggggcacacaatgctattgaaattactgaaaacaaaatatctgacatcttatttacttgtagaaatctgtaattctattgtgcctatgataaattcacataggcaatatctttaataggttaatatcaatgaagatttttaattacaataatgagttcactacagacgattaacacaccacactggcgaaccatctcaatgtaagggtggtttggcaacacctccttgctttgctgtttggtgtaggtaaatctagtttacttcctaaatttcagtaggctttatgctgtgtttatgcccccaatttattttaacaaaagaagattaaaaagtaaaagaaccacgagtaagatattatttaaatgttgaaatcttaaaaacctgcctccaagatttcagaagccaagtttttctaacagtatttgtacaaatactgcctagtgtattcaacagaaggactgtggtcatgtaacaggtaaccacaattttcaggtttcttaaaaacagctgtaactaactcaggatttttatcttgagatttccctgaataatatatttatcttaagagccttcaagtttcaaattaatattggaacatctggaattgcaacaacttttgtcttttacataaacttacgtcatttaaaaaatgtcttcaaaatctacctttctcaaattctttttgcctctatttatttttgcatttcaccaacagtgataaaatagttaaatgaaacaaagcaaagtatcaacagtcccttaaatgagaatccttatctttgatctttattttctgtgttaggtgttagggtcctggtgcagctcataatgctaattcttcattggaagccactcccttcacctcacctcacctagtcactattgtctttgttcattgtttgatcctgagtggttgattgatatagctttgaatcttttctagtccaagtttgaaaacactgttctggccctaagggctggctatgacctttactgttgaacctgatagggcagggaagctttgaacatcaagaaaaaatttttatcttaaataaataaatatatatattcacacaccagtgcttttaagcaaaaaccagtttttttgtttgtttgttttgctttgtgcaggttttctttaagattaaaaaaacacaaactatagcagggtagataatagtttattgattatattttgttttagtaaaagtatttaattttaaattctgtgtaatttatctaatttgtatttattcatttgttatttttatgttgtaattaacacttatttacctggattaccctaaaaaaattaagctcttgaaaacaaaaaaatgacattaccttgacaggcttctctttgccaaaagtaatgtatgttctgccaagaagcaaatgagaatgttagactaagtttctcctgtgttagtggaaaacaagtgtgtctatctttaaatattctttgaatcaggagtttgcgttgtgtcacatcatatggctttgcagatcttttaaaaactgatgttaaataacttataagtccaacttcttaatatcaagataaatgaatagttcaccaatttgggaaggagggcgggttgcaatttgagatagtttaaggtttaattattgaaagactgccatcttgtggcaccaaaaggtaatttttacatgattatttgtatagtgataagcagtcctgctgtgttagcctggtccattatagatatggcatagttttgggttctctaaatgggtccatacctcttttgggaaaaaacagggccacctcataatatttgcctgattatgaatggaattaccttagaaataaggaactaatcagattacttaaccccaatgacaaaatccacaaaaattttgaaggcagagaaacagaaggaatccagtgatgttttagctccattagtctaataggtcagatattaaaaaattgttcatatcaaaattaccttatatggattattgccatgttttttgagagttaattatttactgttttctaattcttgccagtatttatgaacagctgtagcttgatatttacctactgaattttaggagaactaatggtcacagtttgggttcttttatgtgtatgtttttaaaacagctattttgtgaatctaggtggttggtttttagaagatttcaggagatgcagtccagcacaattagagctggaacattgttacagcaggctttttgttgctcatgggcagatagagggaaagaatcagttgttagccccaaatttccacatttcagtgttgtaaactctgaatgtgataggtagatgtgggctaagaataatttcctccagtgaagacacgggagaagagcttctattatgaggttatagataaggccttagttatatcatggaaatggactccatgtagttctagaactgcatttcccaaagtatatcctgtgagatgctccacagaaaaaatgattgcatggactaagtttgaaaaatgttgcatgctactcttcccctcgaagatgacagtggatgtcagcattaaagactttgacaggtctttctgtgaaaaaaagaaagccacataactttgttgaactttgcccaaattaatttttcattttaaaaaacttaatagcccatgaaaagcaaatttgggaaatacattttttaggaaaatactgtcccagaatgccataattagggtagttaataat

SEQ ID NO: 54040 - DNA, 1077 bp, Homo sapiens
ctttgaaaaagaaaaaaaaatccataggttgatacattgacccattgaagtacttcattacgtatttattgaaaattttttttaattgttgaaattgggaccactttttataattggtttcaagaaaaaaaaatgaacagacttccagtgcttttctgttcaaataaactccgattcaaatttcagttttgtttgttatatactttttgtgagtgttaaatgatatgggaaggatttgtctttcattaaccatatggaaaagatgtcttcctgaattacatagcatttcatagttacagattcttcctaattaatgtttgcaccatatgaaactcataggtaacaaacacaaaggagaaaagcagcctgtctgattgcttataagcttttttcacaaaatcaaattaaaagtctctgattcatttgaaagctatttttgtttctgctccatcattatgctggtattctgcacaccaactaatagttacaggaaagttgttagtggaaaagattgcctatactcattggtgatttcacaccatcttttttcatttttgtcatcttagttgtacattatagtttttaacttgagttattgcattggttttctactgttgctgtaacaaattactacaaacttaacgacttaaaatacaaattattttattgttctatatgttagaaacccagcaggcttagctggtttttctgcctcaagtcacacaagctgaaaaccaaagcattgatagggctgggctgtggaggagaatctgtttccagttgcattgagttgttggcagaatttcattccatggtgctgtaggattgaggtccctgttgcctttttggctgttggctaggaatcatttaaagcttctagaggccatcatcccttggcccttggctcccttcatcttcaaaaccagcaacaagtggcttatgggttggatctcttcttccttctcttcaactacatgtttctgacttgctgagactgactttactgccttccttttcaaattttaagggcttatgtgattaagttgggcccacctggactatgtgctttttgaaaag

SEQ ID NO: 54041 - DNA, 1128 bp, Homo sapiens
gaaattgtgatatgttattatctactgcaaccctgatgttacttgattaattgaaaaacaacagtgaggcaattacttgttgaaaagacccttatattccatccaatccttttttccacctctgtgtgttttttattgtttcatgtgtgaaagatattccatttcctgtatatgtgtataattccattcttattacctgtagtgggtttccttgataggccatttcaataatttttgtccagctcaaatcataaaacgttgtatagctcacttgtgccaggcactgggggtacaaagatgaataagactgtctactattttcatttgataagacagtatgttattaaattctataataggaatagatataaagcatagttaagacagtaaattatatatggcagtcataacagtcttcatgtgaagtggttaagagacataagagtatttcaagtaaacagcatgtattcaaggattgtcatgtagcttgatgcagcttcagtaaaggggacaaagatagagggatggggaatgacagtatgcaatggaccccaaatgtcgagctaagcagtgtggatctcatcttgaaagcaataaggagtttttagaactttgtaaatagaagggtgaccaattagatttgtattttaagaaatcactatgaattcacagtgagtaatggcctgtaaaggataaaaaagccagtaaggaagcgattactttaagtaaaggaaaaatctgtcttgtatttctgatctcatttggtataggttgatcttgtaatatatgatccaaacacaggacacttctaagagtggaaggaggcactcttaatcataataataaatagttatagatagatacattagttataaacagacaataccctgggcaaaaggagatatttggtcacactaatttggagaagtaggtacctgtaatctaagctgcgtattctggaactatttatttgtggtcaacagatttcagtgcattagaaagtgatgtgctgcagatgtataggtcagtttgtcaggaaaagatacccaaggtcaggaattgaatttctcaggagtttctaacaaaatgcctgcctgcctgtgaatacaaaaggagactgggaattgc

SEQ ID NO: 54042 - DNA, 1088 bp, Homo sapiens
aatcctcatgtttcatgggagggacctggcaggaggtaattgaatcatgggggtgggtttttcctgtgatgttctcgtgatagtgaataagtctcatgagagctgatggttttataaaaggcagtttccctgcacacactctcttacctgctgccatgtaggacatgccttttcccttcctcctttgccttctaccatgattgtgaggcttccccagccatgtggaactgggagtccattaagcctctttttctttataaattacccagtctcaggtatgtctttattagcagcgtaagaacggactaatacatcaagttaaagtgagttcatgagtagggttaatccagtatgactgatgtccttataaaatgggggaatttgagcctggagagatgcacagtggtgagacaatgtgaagatacagggaagacaccatgtgaacatgaagacagccatctacaagccaaggagagaggtctggtacagatccttccccaacaaccctcagaaaagaaccaaccctgctagcatcttgatcttggacttttgcctctagaactgtaaggcaatacatttctcttgttgaagccacatagtctgtggtacttgctgtgacaatcctagcaactaataagtgaaccgtatcagcaaataaaatgagagaatttatgtaaataactgtgtgcactactcttcccccatcaacctgggaagtgttttatatcatgttgttattttgacctttcccaagagaagaaatctgagaagtgtttattgcccctcagcatggaaaacggacagaaatgatcctgcgaccatggtcagtgttcctccctgatcactgacttctgggttttagcttttcacatctgtaaaacctgaaataacaagcccctggggagatttttaaagattaatcaaaataatgaaacattttgttaggacctattaaatacagagaagttacaaataaagtgcttcagaaataataattaagcaattttgtatcataatactggaaaaagtggtggttttacttattactcttcatggtattgttactgttaatcatcttccccatttta

SEQ ID NO: 54043 - DNA, 1049 bp, Homo sapiens
ttaatttcataacaaaaccctttcattcactttatcttccaaggtacagagatctgaagagggaggctttttgaacaggctttctttttactctttgctgaagaatattaatgactgccaagtggaaaaatgtctaaatattcttgcgagatggcagcctctggtgacttgggtctttaatcttccgaacaacctcttgccacttctatcactcactcggggggatcacagcttggagtggggagcaagcaggaatggttggagatggaagaagcaggtcttagagctggcatactgtcaacactaaaatgccacatgcccttcatactgtacctttagcaactctaccttatctcacctttggagtgaaatggtgggagaggtgaactctgaagtctatcttatttcagattacaggtcaaagtcattcacgtgtagctcagggccatgagatcaaaaatctagcaacttagttactaaagaaaagctgtttcctttttacctgtcttgtgccctttcagaccttcatagaaggaagaagaaaggtggtcaaccatcacacagcccatatttatccttttaggataaagcaacatggtgtagactaaaaataaggaaaccctaactcagtgattagtcccactttcatcagaagaaagacaaatgatgcaaaagtcaaggaggcagataatcgttttctttcttcctggtgggcgctaaacttaagcaaaacctgagaagcagggtatgtaaccaaatcttcaccctgggcttattgttcgttgcttttctcatttaagtggagcacactatcttcactggtgagtcgatatagaatagtttccacatagtggaccctgatttcagaaagtctttgacttgccagttgtttcacctcagacaagtcacttaaactgtctaaaatttcatttactcacctaaaattgcagctattataagaaataaatttgataatttcatgcctggaacatagtaaacgctcaatgcatgttacctgttgttaatatcaaagaaagtctaatcactat

SEQ ID NO: 54044 - DNA, 1449 bp, Homo sapiens
tatatgtcaatatcatcctaatgtggaaggtccgaagaaccagaaaagtgagaagggccgtttacctccctctgtagctatcacctgttggtccacagagtttcttgagaaatgagcaaacattttatgattaggtaaccctttcacatgaacgggaagatgggaaaggtggaatgaccataagagttggcctgagaccagtttgttttctggggatttggtaagataggcagttcccatgggaaattgcttaaattgctttgttgcctatgatttgattctaaacaagtggtgctatcttctccctcaatatggctgtcttgagtttgtcttgcagtatcacaccattataccaattctttgggttgcttctgacacattcaaagtgaactctggctgatgttgctgtttcaggtataccatctggagttaatttcctagcagaaggtgaaagtccaggagaattgtcctctttcattgaacatgattgaaaatgtaactggctctgaacttcaagaagatagatgcccaagtgatgcattaaagtaagggaaataaagtcaagtttttcaactgccatccatattctcattggcagaattctgatttttttccaagcactgtttggtgagcctggaagcaccgtatcctgtcccaggagtacagtgaaatttccaagcaagagctgaggtgccaataccaaaagaccatggggagtctgcacggttctggttagatcaatagaaaatccatgtgtacaactgttaattcctcatcctccactagcactaaatttgtcactttaaattttgaaaccagggaaacaccacctgtcattctgtccccattctccatagctcttcaatctttacatgccgcaagacttttttgatagctcgtactcatcccagtgtctcctgaaaccccatcatgtaatgtactgggcaccttcttttaaacaaatgtttactctgtgggtttggttcatttcaatttctgcgttctgacacatatttttttaataaagatgagaaagagaaaatgactgttgcagtacctttctagacctactttaactttacctcagatgacagtttgttaacatatatggacacattatttttaactttatgtacaatgcattcaacagaacagcaaaatttttagaaattttccattaatttctgtaacacaccatgtaaaactgttacaaataaacatgtttgagaacaacactttagcctggctttattctacaagtttccactggatattcaggcttggatcggaagaggaaattgctttacctaagattccatctgaccaagtgacagcctgtgtttccctggccctgagctaaaaagagcaagctttattggggagtaaggtcaatttgtcagccctcggttgaattcaagtgcttgctatgcttggaaaagcagccccaga

SEQ ID NO: 54045 - DNA, 1037 bp, Homo sapiens
ggaagggaagaaaaggaaagaaaggaagaaacaaaacacagagtcaggggccttaggtctgatttctacttccaaagcaggtcaccttaggtaagcatacatcctttcatatggataaatacagataattgcaatagctctctccccaagctgtccaagaatcaaataatatcataagtatgaaagtgttttataagctttgaaagtaaagtacatgtatttgggattattattaccattctctttttaaatacaaccaaacaacagacccttaaaataaagaaccacaaaacaacagaaaatgacctattttatggacacagaactcaatgacaagtccaacctaagtttttggagggcacagtgtcccacttccttggacctttatgaacagactccctgtcgaggtcctgtagctagaaagtgatggcactggatcaggcagaagatgaccagggtctagctaagggcagtgtcagccaagacctcaggcatagtgccaagagatgtttaaaagctgaaatcaacagaaggttaagaccgaagagacatgggaggtgaggaagaggacataaggtaggatgacacccaggttcctggcatggggatctacatggtgccagtcactgtgctaaggaacacaagcagcatgtttgagcagaaagaagacaagtttactttgggaccaactgaactcaaggtgcccatgagacttccaagtagagatgccagtaggctgctggatacaacctctggagatcaaaagagaaatcaaggctagacatggagatttccatatgggtttcagccattggagtagtgagtgcaagtagaatacacagatcatctaaccagaagttgccaaactctctgtaaatatgtgtgccttgtgggccatactgtctctattacagctactctaccattgtcacaggaaagcagcaaaagatgatacataaatgaatgaatgtagctgtgttctaataagactttatttacaaacacaggcagctaccagaattggctaacagaattag

SEQ ID NO: 54046 - DNA, 1042 bp, Homo sapiens
aataagttaggaaatagcatcatctttctatatatagattcatcagagtaaaaagtatgcactaagttttacaatcattcactgtctgatttctaagttctataacattaggaaaattcagctgctaaatgaagtcatgccaccctctcacttgggtcttagccagtaaccagtattttcagtgacaaattagaatttattaaaagaagagtggtatcaaatggcatatttgttctaaacctctaaaacaaatgagaggagatgtgggtgggtcagcccagaaaatgcgtatcctttgtccttatagaatcaagtaccagctgtgaagttgccatcagctacatccattttcccagatcactgagacactttctctttattcaacatgtgtttattgaatacctcctatgtgccaggattcagaatctggttctaccagttgccatgagcaaattagcaaacttcactttccttacctgtcaaattaggataacctctacctcaaagatgttttatgaggattagagatattgtctgtaaagtttctaacagtgtttgacacatgaaaggcgctcaataacgtgccctctgatgaaacacagaaagaagaaagcaaaccatagcccagtagttctcagcttgatcatgcatcagaataacctgtagcaggttgttcaaacacagagtctgtgattcagtagatctggggtagggtcagaaaatttcatttctaacaaattcccagatgctactgctgctgcttgtccaaggaccatcctttgagaaccactgccttacctatcagtgtggacgagctccttcctgaagtcagatgtgtgagaggaaagatcaatacgtacagagagagaattcaaatattcaactgattccactggaaataggaagaggaatcctaagatttgacttcaatataagcagattcctgaggtttctttgggatacattcatggcagccaggcacttaagatgtctctttttctgtggtctctgtgtagctccaaccccagcccctagacagagc

SEQ ID NO: 54047 - DNA, 1017 bp, Homo sapiens
atttctgtagctattgaatcccgatctccttgtgactaattgtccagccagtgataaggagacagggaagtgaactggagtatgtgatacaacggatggactggctcctgggggcttttgaatctaatgggccaggtttggatcctgattcagccattatttctaagctttagactcctgggcaaattacttgacctgtcagagtcagagtttcttcatctttataactgagtgtaaaataatacttactttgcaacaatatcaagagaattaaatgaatcactacattaactgcagctgtagaagtggtatcactacacactgaaaaatgctggcacatcatcaatatttagtgtagaatatgctgtattattatgattactctgatttctacagtagatgaatatatgtcctgttctacctatattttttcctttacctggaaattagtgcctgtaataaagtttaggtcttcagcctcttgactgcttatagcagacagcaggagaatgggtggcctggagaatgtactatgtatgaacacaagctctgccactagccagctgcaccatactcagataaatatcttctgagcctcagggaacttaccccgttttaatggggatgatcataattctacctcatagagtttttctaaggattgcatgagtaaatgcacattgtaaaataggtacaacagttcctggcagtgcttccatcagtaagcactcaacagatgtttgctacatggttcttcaggagccttggatctgctattcatacagtgtgtagctgcatcaaatctttccctcatggagttgcaatttctcctatacaaattaaagagatagcaatcacactcaccccagaggcttgtggaaaggatcaccttcacaaaaatgtaagctgcacagggtaagaatttttttttttggtgactgttttgttctttgttttgtctccacacactaaagcagtgattggcacctagtggaggtatttttgaatgaatgaatc

SEQ ID NO: 54048 - DNA, 1505 bp, Homo sapiens
ggagcagtaaactttgcctgaaggagtttaatgatgtcttcacccagggtatagagcttgaatagaatcttaaaagatgaggggagtttgtctctggagaaagggtggaacagtattcaggaagaaggaactgaatgtttaaaagcatggcaatgtagaagagcctgtcatgtcacacgggctgatgactaagtctgaggtggcaggaccatagggtgcctccatgggagcaggagatgaggatgccaagggaagcccccaaggagcaaagggtctgaaatgtggtgctgagaatctgggagctgttaggaagtcactgatgctttcaggtgttagaatgacaacatcagttttgcttttttcagtgtacctctggtggcttgtggcaggtggcttggcaggtcaggagaccattaagaagctaatggaatcatctaagtgtatccattcaggatagagtcagaaaaacagatcccatgccaggtagtttaatagaggggatctaatatgaggaactagttacaaaggtgttagaagagcggaaaaaccaaacaagggacagcagggcaacccagattaataataatcagaagtggctactgtccttagggatagaaggacagaagagacagtgttagcagagccagcaggcactgggaccagagagagagcactgcccagtgggagcccagaggacagagaaaggggctgcctggtggaagctaaacccctgcaggagactcagccactgccacaaatactgccagaagagagctgggagagaactcactgcttcttccttctacccactattcaaattccaactactgcctccttgttgaccaaatcaaagtggaagtgtgttggcaaaggagcccaggcaatgcagtttatggcaatcagcctcctgtgttacagtacaaactagaggaagggcaagaatgggtctgagggcaaagaggttaaggggaggcatgtgagggctgctgtgggtgtagcctaggggcaggcattgcagatgaaaaagcgagatgagtttgagtgtatgactgggatgagacaaacagggagctggagctagctctgaggtgacatgctttggaaggtcaagtaaccagaagacagggaccaagcaccctgtctcctccctgtaggctctgtcagttacatgcatgggaatttccgtctctaacttctttttttttttttttttttttttttttgagacggagtcttgctctgttgcccaggctggagtgcagtggtgtgatctctgctcactgcaacctctgcctcccgggttcatgccattctcctgcctcagcctcccgagtagctgggactacaggtgcccgccaccatgcccagctaattttttttgtatttttagtagagacagggtttcaccgtgttagccaggatgatctcgatctcctgacctcgtgatctgcctgcctcggcctcccaaagtacgtctctaacttctaagactgtttgtacatcag

SEQ ID NO: 54049 - DNA, 1089 bp, Homo sapiens
ctcactgagccagggattggcaactattctaggggattacacaccctctctggaaagccttccttaccccaaatagagtactcagtctctctgggctacctctaatacttctctttgcactgatcctaatggattgtcattttctcttaacatattcatgtgaaccattggactttgagttcctcaaaaaccttggcagagatcacatctcacgcggctttgcaatttcagcacctagcatagtgcctgaaatatagttcccgctgaggactgtggtagtaacctaagctatgagagataccggggtttgaatcctggcttcattactggctatgtgaccttgagtgagccctttgctctattcggtctttggtcttctcagctatgtaatggtgatgtgaaaaccaaattcactgagttctgagagtttagattaataacagtgatcactcagtgtacattagcaattaatagacacttactaaatgttttgttgcactgaactactcaccaggagttgtcacttttactccatacctccttgctttgtaagtccgttgaggacaggaatcatatcatattcatgtcctcattacagtaagcatcgacacagagtagctgctcaagtggtaaatgaatgaataaaaataaatgaacaaatgaatccctgtgtgaggaatgaatgaacaaatgaatgcctatagactcaaagctcatctattgtccattaagttctttttccttctggggccaaagacgccgtgtcaaactaagacagtgttggttctcaaagaagccctcttgcctggcccttcttccactttgtgtttaaccattctttccctgttccacctgcagcctccataaatatgtgttgttttttcttcatagcttggatcaccaggcggacaggtggccttctaaacacaaacccacacactcacgcacctgcattcactcccctcctacatcaggaactcagcatcaggcaaagccaaaacatcttgcttccttggcagggttatttttgatttttgttttttcatcctacctagggttggatttttcctcctggggccctgtggaaag

SEQ ID NO: 54050 - DNA, 1025 bp, Homo sapiens
gatatttgctatattttaaatagcccagatctcagcctcagcattgaacagtttaagctcagctgcaaactgtttttaatcacttcaggaacagtatagcacctccctacgcctcatttttgtctaaggaaatgaggattttttttttttaccgcatgacttctgaagtctatgtaagtttctagtctttgattctgcgagaagcccaatggcagagacgacctataaacctttgttaaatgatgcccactccctgtccccatctgatgctcctaagggagggagcctggcttgatactttcacaattagagcaggttcccatgggcttgtccctggggccattctcaggcacccttagccagcttgcagttgaagtctggttgctttgttctttgaaattggagtaccagagtgttttgactgtgctgaatttaatttttccataggttcccaccagccaaaagaaggaaggtgtttatgatgtgccaaaaagtcaacctgtaagtgtaagtacatctcctctccactgccaggtttccgtgacctggattcacactgaggctgtctacagcctgcggaaggaaacccttctcctggaatgagtgtcatggccccacatgtttctgctggggactgcatgctggggcatcttcagtgggccagaggaaggagacatgaggcagaaatggtagcactgaggaaaagttgccaatctggatgaaggtctggtcccatgagtgggagtgagttgaatcacgtgaactactctgtttaagggcctcaaggtcataggtgttctagggcaaaagtctccagccatggtttagaagaagtaattcttctaacacattacagtattatggtatctaatagtgttgtgtatccaatatccattttctcactccatcctcagaataacctgagtaagaggcagagctgatagtagtgaagctcagagctcagtgacctgctcaagtggaggatagtgtttctgttgtggaaagagagctgcccatctaatttg

SEQ ID NO: 54051 - DNA, 1075 bp, Homo sapiens
tctcacccatgggagagccaagtagaaaagcgttttcaattatgcacagtttgagtttatccattccactgctttttctccatttttagggataattgagaggcagctgcggttcaactgtgctaagtgcccgtagtgagcagtgaattacgggcaacagaatgttcttcatttttctcagtaaaggttgagctagtaaaaacaaaagtgagggctggtaatttattggccctcattaacaaggactctgtaggcattcttagaggatttcttttagatggagctcagttatcaggagcaaagaaacgacattcttcactggctacttgcacagtgaagcttgcaagatcagctctggaagtgtaccactgacacggccatgctcactcagtcctgttttctgcaagagtgtagatgagcttctgggaacataggatgtgatgtcaaagaaaaggcccacttgaaacaactgtctgaatagtatagcagtcaaatggcaaactccctgggctcaagcttttggcttccccattcacagactgcactcatggagtgagttgaatcacacaaactactctgtccaagggcctcaaggtcacaggtgttctagggcaaatatctctactgccagagatatttttctcctctgcaacatggggccaactgagttcttacctgaaagacttgtcttgaggattgcatgagaatgtatgtaagacacaaatgtttagaacagcgcctggcacataggaagcacccagtccatgttagctcacattattaataatagatgtcttgtttggccaccagaaagagctgggtttgaacctggtcacttaccagctttgacgatttgggcaaagtccctaacatctctgagcgtcactttctcctatttaaagtagagatgatactaccaatttcttagagttattgcaaagattttaagttaaatgagatgaaaaatgtcaaaggacctaaggaataagctcaaattcttacttcttatagaacaatggtgtagttagctagctcaagcccaaaagatacttttccttcactattccccacattc

SEQ ID NO: 54052 - DNA, 1030 bp, Homo sapiens
ttcccttatgatgtgccttactacctttcatcccaggctgaacctgttattctggacttgagagatctctttcaactcatttatgaattgaagcaaagagaagaattagaaaaaaaggcacaaaaggataagcagtgtgaacaagctgtgtaccaggtatacctgtgaatttatccttgcgctggagatcgggccttcaaataaacacatgtaaaaactgacagtcaggccttctcttcctgctgccaagtagaaataaacgaagatgaaagattcctgtgtaaattacaggacccaaagcaagccattagaaattattccttattctcttaaactctagacatgttagatgaagtgaaatctcgaatccagagaaagatttcaggggtggaggacccaagaaacacaattgcttttgctgttgttaacagtgcgggtggaggtgggagtggctctaaggattttgacttttttgtgttttttctaccttgatggcccaccagcctcttctgcccagagctggtttctttactgtcctgtaatttctgaatgcagtctcacatctcttcctttatgtcctctgcttttcaccctccctctccttactctgcaatagacaatattggaagaggatgttgaagatcctgtgtaccaggtaatttctgaaactagtcggggttttagattcaagagtgactagacctgtgccagagccattttgtcagaaacctgaagaatccactgactgcaaaacctggagagagaccaagattatttctgagggtgagggctgccagcccctccaggagcaaatttccataaaaactaacagaagtttggccggcatcggtatcttgggatttggagatccgcttctcccttcttgcctctgcctcggcccccttcacagtctgtaaaagtttgatcccagagctgaatgttttcaagagtctcttgaatattctgagttcattagagagaatatgaataatgaggtggcttctctgagttaagaaccagaggtgggggc

SEQ ID NO: 54053 - DNA, 1042 bp, Homo sapiens
agacctgtgagagtaaggaagttcgttccaggcacgaacattggaggaattcatcagttcagtgtcattagaaagtaaagttctacagatacacaaatgagggtggaattatttctccagggagacagaaggcatgccttgttcagaggaagtttcactcaggtggtactatttcatacggccattgaaagagaaagaggatttgggcaagtggataaaaagagttgatgttgcaggcagagagatctaccaatgaaaagcctgagatatgcatagccccgcctctacccccagtggtgactttgggcaaaacagagaaaggcatttattcctcaacacactctatcaccatcagctggaaaagtgttgtcaccatgcacatgtatagttctatgaatgttaataatactccctggagttgtgtagtgtagctcctccaccacagcacacacggtccccgagtatttaagtaaattaaatatcaatccaaaagttggactgggatgtgtcatgtaaaacgatcaaacagaagcctacccattgaattaaactggctggctctagcaagctgaataaagccactgttgcagatgcttattcagcatatgaacaatcctatgtttctctctggtcacagcattaagaccatagagggaagcctccatttctcaaggacaggcatagctctttttctttccatctggactaaacagcttttccaaagcccttcgggcctgttcacacgtagctgaaacacatttcttattgatcaacagctcgaagggaaagtcccctgaaatatgttcttccttttttttctctgataggcccttcagcatcatcatgctgttcatgaaatatcctacattgcaaaggacattacagatcaccgggcctttggatatgtttgtgggaaggaagggaatcacagatttgtggccataaaaacagcccaggcggtgagtatccctatccaagaagggagtctttccttggaactctggggggacagtccagtgactccgttggtctttgagggccc

SEQ ID NO: 54054 - DNA, 1076 bp, Homo sapiens
ttcccccgtcaccctgcacttcccctctcagggcacctggcacaccatgttgttattgctcaggcatgcccccccacccccctcccccgccagaccactgtttgttcgttctcacactgctattaagactgggtaatttataaagaaggaggtttcattgactcacagtttcacatgattggggaggcctcaggaaacttaaaattgtggtagaaggctaagaagaagcaagtaccgtcttcccaaggtggcaggaaagagagaaacccaggggtaaactgccgtttataaaaccatgacatctcatgagaactcactcactatcatgagaacagcatgggggataaccacccccatgatccaatcacttcctaccaggtccctccctcaacacatggggatttatggggattacaattggagatgagatttggatggggacacagccaaacaatatcaaccataatcttaaaaggagcaggcgccatgtctatttcagcactgtacctctagggtccagtatggtgcttgaaacgcaggaagtagtcaataaatgattttgttgaatgagcaaatacgtatatacaatggtgagaaccaatgtccccctaaggggtaggtagggtgtctttctaacggcatggtttacccaggagctgcactttcttattctaggccaggacagagagacttcattcaggtccttttctgcatctaatcccatgtgccaaagagagatgaaatgcaagagagagtcaatgatgcatctgaaagagtcagacagacctggattcaaatccttactctcccacttcttaactggatggagttgggccagttacggagtgctctcaactgtaggagaaggtacatattcaaaaagaaacaaaaaccaaaacaaacaaaaaccacacacttaggtaacatttattaggtgccaggaactgtttcaagtgtattgaatagtataagctattgaatcatcacaacaccataatgttggtactgtggttatccatgttttacagataagcaaacagaggcacagaaaagataaatctttagcaaaggtcaca

SEQ ID NO: 54055 - DNA, 1103 bp, Homo sapiens
ctaacgccattcttccacacaaagcaaagaacatgaggcatgaggccggggttggggggtgggagggacaggcattctgagcactgaggacaaaagacagtgattttttgatgctgactcaagcctcaagcctgacagtctgtctgatgagcacaaaatcagatgcagtatgcagccatttcagccctaggcagcttctgtattatggcttcagccaaatatttctattgtgatcaccccaattctcagtcccatctgcaggagcctcattcatatagttcagggatttacctgccagactagatttgacttctaaaaactatttagaaaattaggagattgcaaatctgcaagaaattaccagagaagtgtggcctcaatatttaaattaaaaatgccagcaactctaaagcctgagatctgaatctttcatgatgtctaagagatgtgcagacattttaaagttatatatttaaaattttgaaaataaagattttactggcaattgtctaaactcaagacagttataacctcacttttgaggagaagatagttcatcttccatataaatggctccaacgagagtgtctgagactctgagatactgagatgcatcatctcatgactctgactgtgctgtatgatatatttacccatgtgaatagacacgcatactctttcatattaatttccatgctgtcaaagtctgtgtctatattttcactcctttatctgtgtcctatggtacaatcacctttgcactgaacaaaaacttcttcatctgatacaataataaaaggaatgtcttatgtttgggaatctttttttgttgttttcaaagtactttcactttttccttaccactgatcctcacattaatcttacaagatgcatatgacacatgcagttttactggtggtagacctgaagctcagagtgcttaattgctggcccaaagttacacagtggtagttgatagagcctggtccttatgcttttttcagtttataaaagtattatatatttattgtagaaaatttataaaatgtagaaaagtcataaagaaaaaaactgcaaattatgtgaaatctcaccacttagat

SEQ ID NO: 54056 - DNA, 1038 bp, Homo sapiens
ttgctgtcatccaggtcagtgagacagtgcacaggactctcaaaagactggggataagggctagcctgtaaacatgacagtgtggtttagagcaggctttcatggatctgtctcatttacatccaacagttcctggaattttttattatcccccttttatagatggatcaactaaggtacaggtaggttaaatgacttcatgaagttccaccctggtcatttgacccccaggctgcactctggtcacccaaaagaaattgaattcaaattagaactctataatacctaagcttattttctttcttttgtttcagagattctcaacttgactggttctgtgtctctaaggagtggttaggaaatgtgtgtaggcagttttgtagtcacaactttttgcagaggggttggtaatgcagaaatttaattgttaaaagccaaggctgctaaataatctgcaatattcagggcagacacatatggcaaaagatattttcctatgctatatgactttctaatgtctttctagaaattcatgtagatgaaaaacctgttagtaattatgtgaatttaaaaagctaaccctatttagcacataaacaaagtattttacccatatacataataccgaattttccagaaatgcaactagactaagagaaagatgaaattatttctatttaaccaaaattttatacccatttactaacatctctccaatctccccacccaaccctccctctgataaccaccattcaactctctgcttttatgaattcagcatataagtgagatcatgtgatatttgtctttctgttcctggcttatttcacttaacataatatcccccaggctcgtccatgttctccaaatgacaggattttcttttttatggcctgatagtatttcattgcatatatataccacattttatttatatattcattcgctggtaccacacttaagttgattccatttcttggctatcatgaataatgctacagtgaacatgggagtgcagatagatcttcaatacactga

SEQ ID NO: 54057 - DNA, 1040 bp, Homo sapiens
agataaacaaaatgttgtatatacatacagtgaaattctatggagctctcaaatggaagaaaattctgacctgtgctacaatgtgtatgagccttgaagacattatgctgagtgaattaagccaggcacaaaaagacaaatattgtatgataccatttatatgaattacttaacatagtcacagtcataaagacagaaagtagaatggtgattgccagaggctagggaaaaggaaaaatgaagtgttattatttagtaggcatgaggtttcaatttgggaagatggaatcttttagagatgaatagtggttttggttgcacaaaaatgtgaatgtatgtaatgccactgagctgcacactgaaaaatagttaaaatggtaaattgtatgtcatatattttaccaaaataaaaaatagctaggtgtaactcgcattattgagtacctcccatgtactagctgtgtgttagtcagtttacatacattattcagtttcattcttgcaacattcctatgaggtgatactaacaatagctactttatcaaatacatattatgtgccaggcattgtggtaaatataagtaccaggtcatttaatcctcacaacaaccctaggatgtagatggtactattattctcattttattgttgaagacagcaaggacagaaaagtttacataacttgctggcagtaaggggtgacagaggcaggattagaacctaggcggtctggctcctgagtccttttgtttaacaatgatgcctattatctctcaagataaatcttttctaacttcacccacgttttgtattctttttctttttaaacttaggttcaggggtacatgtgcaggtttgttatataggtaaacttgtgtcacagggtttgttgtacaaattattctgtcagctaggtactaagcctagtacccaatagttattttttctcttcctctccctccttcactacaacctccgcctcccaggttcaagtaattctcctgcctcagcctcccaagaagctgggattacaggtgttc

SEQ ID NO: 54058 - DNA, 1068 bp, Homo sapiens
tcactaactcatagacatatcttcggcttataaaacatttgagacagtgaggaaacagtttttttgataaatggaatgtgagaatgagaggaacaagggtagtggtaaacacaaaatatctttggataaaaattataatcaataggcatttaattatattgatcacatttttttccagcaaaatggacagtctagcatttgtttttattttctattatctaaaattgattcatatgaaaactttttccagaattataaaaaataaaattatatgtaggaatatacttagcagctcaccttcatttaaaagattgaaaccatatctaatataaaacccagaaaagacattaatatgaaaaccatattgtgtctatcttgggacccccaattctgagctgaacatctagacaccattctataaattttgattagttaagtgagtgaacattcaaatatttctctatacaatgtgttagaaacactaggacaagcattaccctaaaacaccaaggagatgtgagccgcattgagtagagaaatatggaagtgcgaagggaaagcagtgtgcatgattggtggcattggttgatggtatcggacatacctttgggaccagagagaattttcaaatgaaaacacttaagtaaaaaccatgttcttcctttcaacagggcgttgttgctggcgctcgttccaaaggagaacacaaacagaaaatctttttaaccatctcctttggaggaatcaaaatctttgatgagaagacaggggtaagtaaagcaatcacatggcattgtgaaattttatccattgacagatgtacccttaaaagcctctactctctgggcaggaatatacaacaagcataaaaacacataaagcaactgacaaacttgatcaactctgatcatccatcaaagcaggtctctttgctgacttggccacagtatggctgcactgtgtttcttatagtgtaatggtgataaaagtgtcacactatcctggtaatctgatgggagattgatgagctttgaagatcaatgggtaatgtgacagtttaagttaaat

SEQ ID NO: 54059 - DNA, 1004 bp, Homo sapiens
gggtcaatccaaagcagtggtgagcctaacagaccttctcctgtacttcacctacagagctgttcagaggactcaaggcagtaaagtaaagcatataaataaagtgactggtattttaaaaagtgatgagtacaaagcaggatctcagaaaattataacttaatctgttcttcttgtttcaccctgtcaatccaatcaatacattattgttggattgttatgattggtttaaatctctagtttttctactagattatgagcctgctgggaataaagggcatattataatcattttgttctcttttctatattgcttagcacctggtagtccttctgaaaatgcatttaaatttattgcagtcaaggattggcataacttctaggggacagcaggacaatcctgggccaggtctgtatctggtattggaatgcccagagcagatattatggaatggttgtagagagggtggggtaagtcatgaaataccaatacagatagcaagtctggaaggccagtgatggaatactgataggaattgtggggcaagaagttctaaatcagaccagttttctccagctcccactctaggaatttccttccttttgtttccttctatcctgcttctagctaagatcagtttatcaaatttcatgtagctgtttcctgccaggcaagaggatgcttgcagaagtaaccaagcataattccaatccagggacttcataagggcagtgatcataccttgttcattttaaatataaaagataaattagatatttaattgggaaatcccatgaaatttcagacttacaaatcaaacaattaagaactccatagccccctgcaaggaatgaaattattgtaatttttccttcttggtgaaaaaaaaaatgtactctctaattgctgggaactctgttaataagaatcaaatcctctttatctaaaccatatctaaaaggtgaaatgctatttgggccctatgccaagtaacaaaagaaaa

SEQ ID NO: 54060 - DNA, 1022 bp, Homo sapiens
aggcctgtgccttattattagccatgtaacattccattgtttcaatggaaaatggaacctgtaaaacctgattcacatgaagatccattggcccactaataaataatgttttatagcacactctgctttttatatccctataatccttatctgccagagaagtgagaataaataagcacacctcacactgatcgattggggatggtgcttgtgtcaaagtggtggagagctggacacaacatgtgggtttttgtgagttggtttttcccatactaatcctggacttgagagctggggctgtttttggagaaacacggatacatattggagagaatttacattctaatgtaattggtcagtaaagaggtttgatttagttagtaattctaaccacttggttataccctaaacttacatagaacacgtaataaaccattacctgggcccaacctgcagggacattgattcacctggtctgagtggtcccaggtggtattgatatacaggcaagactgaggatccctaatctctgctctcaggaaaccaaacagttaatggacagtgatttcgtggctgtgagctgtgagtcccaactccacaggaggctttctgagtttaaaaattgtccacggttctgcttctggaatctcgtactcggggagggagtttgttccggcattgtggcacacaggaaaggtctcaacttggagtctttgagatacagtgtcctggtacttcctagctgtcagacactggaaaacttacctcactctctggaaaaaaagaccaaaaacaaaaaaccagaaacattattatgaatttggaatttcttacttcggagacagcattgttagttcagtgtctgagtaccaccttccatctgcgctaatactgctgagtgtgaggtgctaccaagaggatgtccctttttacttctcaaggctgtttgaagatttaacggggattatttcctaaagggccctctatgcgtgaggttgcctgtgaggtttgtcccattcttg

SEQ ID NO: 54061 - DNA, 1136 bp, Homo sapiens
atttttataaatgaacatgaaagtattttctgctctttctttaggggaactcatgaactgaagggttcaaagttttatcatctacattttcacgatatctggagcaaatgctatttgttaataatgaaaatgagtgtgggctgggagcagtgtgtcacgcctgtaatcccagcactttaggaggctgaggcgggtggatcacttgaggtcaggagttcaaggccagcctgaccaacatggtgaaaccctgtctctactaaaaatacaaaaattagccaggcacagtggcacatgcccataatcccagctactcgggaggctgaggcaggagaatcacttgaacctgggaggcggaggttgcagtgagccgagactgcgccattacactccagcctgggcaacaagagcgaaactccaaaaaaaaaaaaaaaaaaaaaaggaaggaaggaaagaaagagaaagagaaagaaagaagaaaagaagagttgtgtttgtcatttaagtgtctgggatgtgtcacatatcatatacatggcataacactcacacccttgttttacacatgagatgaaaaaggggctaaatcagggtttaattccaggtctttctgactccaaaacgcctgtgtccttttctgtttctacatattgcctcttgatgaagccccttgcttaggactcagttctagtttatagacactggccagcaaaagaaccaaaaggatctggattttaatatccagaagcaagagaaacagtgtgaaactcagacctaagcttcaactccgtttttgagcaaagagagaaccatgagccccaaactggggtaaatggcaccaatttgttcagtaagaagaacaaatgggaagagacagcgaggaggcacatgcgacctgagattttaacttatgtataaaagggaggtaaaaaataagcccagtggtgttaggtcactgccttttttaatagaatcatagactgtttccatattacaaatcttatcaatgaggtagtgggggctaggaatttgtgtggagctggaaatagaacccaaatcttttgactgccaagtgcagccctgtctggtagagggagataccatctcctttcatgccacaggctgtggagggaggttct

SEQ ID NO: 54062 - DNA, 2099 bp, Homo sapiens
caataacaacaataataatatttttctcactgaatttttgcaaagatctaatgagaaaatatttgtaaagggcgtaacagtgcctggcccttggaaagcagtaaataaatgctagtttctggccagtttctcctaaatggttactttgggcaaataaaaataaaaagtaacacatgaaaagaaccagggacaataatctataaagcaaaaaaaaaaaaatgacatttaactactggccattttaggatagaacatttctgttatttaaatatgaagcagagggtaatgttgcagttaggagatgtcttggggcattttgcaataggaacagaaaaaatggatattttttgtttacccttctctgagaaaatgaaccacaaatgtctgtctttctcaaggccaaagtagggagagtgtgactgctgaaagtacagactgagtatcctcatgatgttattctcaaaggccttactaattcaggagggaaggacacaggaattatggtctctagaagtcatgcatccaagccccatatgtgctaggcagttcaattccagagtatcatagttttgtgaaaatagtattttgtaacgttttgtgaaaatagatttgggtaaaagaaatgtcgctatcaggtgaccttaagcatgtctttttttttttttgtaatgccacatatggtcataccgtgttagccttttttaaaattattattatactttaagttctagggtacatgtgcacaacgtgcaagtttgttacatatgtatacatgtgccaagttggtgtgctgcacccattaactcgtcatttacattaggtatatctcctaatgctatccctcccccatccccccaccccacaataggccccagtgtgtgatgttccccttcctgtgtccaagtgttctcactgttcaattcccacctatgagtgagaacaggtggtgtttgaatttttgtccctgcaatagtttgctgagagtgatggtttccagcttcatccatgtctctacaaaggacatgaactcatccttttttatggctgcatagtattccatggtatatatgtgccacattttcttaatccagtctatcactgatggacatttgggttggttccaagtctttactattgtgaatagtgccacaataaacatacgtgtgcatgtgtctttatagcagcatgatttataatcctttgggtatatacccagtaatgggatggctgggtcaaatggtatttctagttctagatccttgaggaatcgccacactgtcttccacgatggttgaaccagtttacagtcccaccaacagttttgttcttatttctccacatcctctccagcacctgttgtttcctgactttttaatgatcgccattctaactggtgtgagatggtatctcattgtggttttgatttgcatttctctgacgatcagtgatgatgagcattttctcatgtgtctgttggctgcataaatgtcttcttttgagaagtgtctgttcatatcctttgcccactttttgatggggagcatgtgttataacttctctaaggctctgtttccctggttgtacaatggatatgctaataatacctgctattagaagactgataaaaggaccacaggttatgatggataggaagtcttatgtgaaatctgcaagtagtactaatgttaattatggttatggttgttaccatccaggtctccatttcaaacctcaccccaccaagccctcctgggaattgttttacattgcatgatgaaacgatgcagctgaatgattttagctcagagcatactctctatgggtatgttccactagtgtccttggaaagatcctcctggctttccagacagattatagcaagatgaccaccagccaaatgaacccctcaaaggacttttgaaactgcaaagcctaccatgtcacattcttcccagtgcttttggggcctgaaaaacataaattattactgacagccttgaatcagggccagtacagttcaccctggagcatttattctttacatttatgtgcagacaaccattctaggccttgtgagatcttccctcaagaagcttgta

SEQ ID NO: 54063 - DNA, 1039 bp, Homo sapiens
ggggaaattttagctctgttctctccagtacagcagctacagcagtagtagcactactactatttagatgtaaatttaaattaaaaatacagttattcagttgtgcttgccacattttaactgcttaaaatttacatgtggccaatggctaccatatcagcacagaatatttccctcacgatggagtcctatggggcagccctgtgactctgcctcctccgcattctctcgtaagacctaagggcctggcagggccagtgacctcagtctcccaccagctctctgccccttcagtttgacttgctctaccatggcatcagagtgatgtttcagagtgatgtgttctactctcatatatcaagatttctcattctacatgaaaatcagttgttggcttcctctgcccatgagaagaaaagataagctctgtagcatgacgtaaaaaggcattgttgatttgtttctcctgtgtcatccctgtcccatgtcccattaatgttactggtatactgaattcaccatttttcagtcatgccttgaagttcgttcttctagcccattgcctagaatgtaaccccctccctccttttcacgttctttgtgcttgtccttcaaggccccagttaaatgtctgctacaagttggccccttcttttctgtgctcctgtaactctcctgtagcgcttttcaggtccggccgaagtgatcttcatctttacatgtttcttcccctactcaactgtgagcttgtggtcttgcccaagtttgtgggttagtcacatttgaatcccctgcttctgacaaaggaggaagttgaaagttacatgttaaataaacagatcctgcaccaaggaataaattggtatgcaggtagtgaatgaatgatgaacaaactatctccctaggccaaatgaggattaatgaactccgtaaaagcctttgggtacccagtccaattctgctctcgtcttctttctgtaaaactctgggtgatcactcagcatccagagccaaatacctttgaactcaagatgttaaa

SEQ ID NO: 54064 - DNA, 1074 bp, Homo sapiens
cttagcccagagttaaaagatgaaaggcagaagaaaagcacctgaaaatgcttttgtcactaagatgctctgaatctccaaagggaaaaaaactataaagatgttttcaactcttagaaaaagttcagggtaagttgaagattattctaggaccttggagttggcttgtaaaatatgctgtgttctccaacctttaacaatttcagccataaacctataaccatttacttgtgatcccttttcatatataatatatagaaaaagtctagtctagtttctagtctaaaaccatatggttgtcatcactcaaacagactcttctatgagatgttctaagtctttaatataagattgagaaatataggaatgggggaaatgacttgactgtgactgaagtcactgacaagtagtattcataagagctgttggaaacctgggccttcctttagcttagctggcattagaatgcaagggtgttgatatgtggatggggcctagcagtagacatatgaacgataagtgtttgaagcccagcaggttagaggaattaaccccaaagcttcccttccatggaagatctcagccaagagctcagagtaagggaagtgaggtccttattccaaggacaagatctggcaaaggctagactcagaagggctagactccatatcagtgggtggcattcccattccagatgaggagcaatgtacaactgcaaaccttggtggcagtggtacagtgatatatgctgaccaaatgcactgaagagtgccaactcaattattatttcgatgtccagactccactctaagcccaacagatattgagtctatagcaacgtgatcaattctaggccctatttgctaatgaggctgatggtctattttgtgccctggttggtaggctttagatttgatagaatgaaacctgggtgttttatactaaggtcataatgtctcaattagaaagacactgataaggaagggacaaactgaaaaaggtcataccagcatatagcagtgtgtttctcagttttatctctgttcttctccttccctcaattacactgtatat

SEQ ID NO: 54065 - DNA, 1027 bp, Homo sapiens
tggcctccaaaaccttgagaaaataaatttcagatattttaggccaccaagtttgggggaatttattacaatcacataggagacaaatacaaatagaaagagaaatgacctgtcaataaaagacatagatcaagtccaagttctgataccatcacctatcttggcctcagtttcttcatctttaaagtgggataataatacattttctatatggattattgggaggatgtaaaagagataatgcatgcactttatccaccatagatacttacaaagaaaatgctaggcattaagtttttaatcaggctgcagttagcatggcagaatgtcacaggtcctaacagagcacacttttggagactggatgtggcagttggcattgtggaagcagctggcagtgttggagacatctaggcaatttgtttgcaggagatacaaccatggccaccaagtaggggctaatgcccagttcttgtcctagagcaggcctgtgtgctggggaaggcaattcagcaaaccccaagagtggagaccatggccaagaggggtttattatttcagtttagggaaacaaggttttggcaaggaagtcatcctgaagactcttgatcccaggtctgattgtcagtgaaggaaactcatgtaggacagctgagcccacatcacagctttctaaaaacaacttaaatgccaaccctaaaattctgaaaccatggtataaatcctgcttcagtcagactaggtctaggcactgggatgggtctggtccaggaacagtggctgctagactgccagggcttactggaggctgctttggcaaacagaggccagctagtccaggaagtctgagctggaccccagagtccagggtgcttctggagaaagccaaggcttgtcccatgtcaggaagaaacaggctagctgagcagcaaatacaaatcttgatgaagaagaaaattgagaatacagaactggcaatattattcaaggcttggagtctgaagaacaaggcaagatagtaaaagga

SEQ ID NO: 54066 - DNA, 1049 bp, Homo sapiens
tggttgtcttcagagttagctcttttaaccatgcttccatgctctacagtagaaaccaactccttctgactgaaagagctggcacagggaggcctgagaactgcccaggccctgcttgcatgcagtgatgggggaaggtatatggagaaatcactctgagtgtgagaaaaccaagagcactggatgctgcaaacctgctttgtgaccttaggtgagtcccctgacttctctgtgcctcagttgccttatctgtaccatgggggattaacttagaggatcctgtaaaggctcttttctgtgccatgcagcctcaggatctgtggggtttgtgtcatgtcattgactcttaacaggcagtctagttctcaggggttaaggtaccaggctttgaattcaaattgactcatgtttgatttgtggctctatgtttcactgctggatgtggaatccggatgtgtagcttaagttggacaaatgaagccttggttttatcatctgttaaatggatttgccaagagatcccctcccacaggttactatgaagatgaaatgagatgatatgagcaatgagctgactttactgcctgacactcagtaagcacccagtgaatgagggctttacccactcgtagtattaggtggactgtttggtcactgagactgaattatgatcatcgtgaaggatactagagactgtgtcatgctcttctctctgtgtctaagcacagagcacagccctggtgtattgttgcccttggtgagtatttgtggggtgaagggtttgcattgctaaatctctacactagcggggcaggctggtgaggctccttcttggccgagttctctatgtgcctaggatttaattcactgatgtttatattgtggggttcttaaagtcttctaaggataatttcagttgcgaattaacaatcaggaacaaactatgaaatgtgtaaacttgtgtcctgctttttaaaaaatctctcttcctcagaaaattagcaaataagaagaaatagaggttgatgttgaaaacaacaacaacaatt

SEQ ID NO: 54067 - DNA, 1034 bp, Homo sapiens
tttagcagttgttggttcatttctattttcatccttgaacggatacagtgtttatcttctgtgttttgcgggcaggggaagatgctaatttgttctcctgtagtgagaagaaactgagactttggagtgggctcccctttgcgggcatgtcaccactggggaccaccactctagtaaagcacgggaattaagatttgccaatgaatggctgtgaaccggagtgtgctttgctgttcagatcttttaacctcagcttatcaactttaatatgttgtcctggtgtcttgattttttggttcatctgttttaatgcgatgaaatgtaaaaatagagcttagttttgtcccctcacaatgactttaggggtttttagctgataaccaacccttcttctgtaaaggattcaaattttaaacagctaaaaatacatttttctaatatctgtcatcaagtgattagtgcaactatttagttctggtcatctttcctattcttggtagatttatattctcttcttagaattctactgccgccctctctgtctgggagactggagatgtcatttaaacattgcttattaggattccattatttgtctctcctatacagtcagctaaatcaaaaagtcagacagtgtttttaaattgcaaatttaaatgacaatttttaggccaggtctactggaaattttctgtccttggcatccatcattgcttgtgagtatatagttttatattctctctctctttttctctctatccttttctctttatcttcttgagagcacagcacacatatccatcagaaggatcagaactgcttgcaatcaaacaaaaatgcaataaagatcttggaaggaaattaagacaaacacctattctagaccttgcttacatattagttctcttcctcctccttatgctcccttgcctcttaaagaggaaacttgcataagacaatttttttttaagcagttaagcccatggcttagattaaaaaaaaaaaaaaaaatttggctgagcgcggtggctcac

SEQ ID NO: 54068 - DNA, 1032 bp, Homo sapiens
tgcacttgctcttggcgactcctgttcatccttcaaaactcagtcacctgttttttttttttttttttttttttttttttgagaagaaggcttgctctgtcacccaggctggagtgcagtggtgtgatctcagctcactgcaatgtctgcctcccaggttcaagcgattctcctgccttagcctcctgagtagctgggattacaggtgcatgtcactgcacccagctaattttttatatttttagtagagatggggtttcgccatgttggccaggctggtcttgaacttctgacctcagctaatcggcctgcctcagcctcccaaagtgctaggattacagtcaccttttggttaacattgtgagtttcctaacatcctcaattaattaatcactgattatcaattcatgtgagcttctacatatctttcaaatccattcattccttcttccccactggcccccgtccccgaaggtagttcaggctaccttcatctctcatctggatcatcctagcaccctcctaaatggttttcaggttttcactgctgtccatctccaagccattctcagcactgctcactaatgcggagatttaatcagatcacactcctgcataaaacccttcagtgagtggctcctcctgccctcaggaaaaagtccacactgcttatcatggcatcagagaggtgctgtctggtctgaccccttcttatctgtccaggcgcattcctcaccactcttgccaatcatacgtcaccgagtggtcccactgaatcaattgcagttccctgaccctaccatgttgattttttacacgtggggttttgtacatgttttttcttctcctgggaatacattttttctgtatttgtttcaaagctaactccatgtattctttagtctcaagttaaagattacttttctccagaaatgctttggtgacccactgcaacccacccacatgccccccagttgtgggtcatgaccatgctgtgtgctctcaaccactttgcattttctccattattta

SEQ ID NO: 54069 - DNA, 1051 bp, Homo sapiens
tcccaagatcagtgcaatagttcaaagttgttatcaggggctcaagttctttctttcagccctgtgccatccttagattaattgcttcctggtcccaggatagctgctatagatccaagtatcacaccttcatagaacttcatggaaaacagaaagaagccagggcagccaggatgataagaagaggtttccttacttatctcctttctttgatcgaggttatttttttttttcccagaaggaactcccacaaagcaagacaacccacctaccctctgtttattcgtattttgccagaactgtatcatagtgccacttctagccagaagggagtccaagaaagcaagtatctggctttttcaaaatctctgaggaaagtgggcaagaaaaggcagtgtaagggaaaaagcttcctatatgtcaatgcactaatgaaaatgtgagagctcattgccttaagagaggtcacacaaaatacctgaattgggggagggggtgttttgtgttaagaaacagacatccagagaaggaccaagggaattagggagggcttcaaggaccttcaagatgccttaccctaaacaggcgtctttccttggtgactcatgcagaggaagtggctggattccaaatatgtgtatagaaaaactgccacagaagaggcagcgatttgttcatgtttgcagctgctgactctgacccaaatctgccctcccccaatcctcagctgctggtaccaatgcatccttttgggagctggaccatgagctctgccaggaagaaggtgcccatctcaatggttccccgcttcaatccccaagcaagctgtttccagagaaggggagtagcacacacaatagtaaccggtttagtaattagcagcagccctggggccatgcaacacttctaaaaagacaaggtggttcaataagatctgccacgacccctgagaatgttctagatggaaagacaggtggggatctccaatgctgatgacatggaggcctttcaccctcagtggttagagggcacaggttaggaaatggggaac

SEQ ID NO: 54070 - DNA, 1113 bp, Homo sapiens
caactttcttattatcttattttgcacccttttattgcaatcattcattagcaaatatttcctgagctgctgttctgtgttgagttaaaagacagcagtcagcatacatggccgctgccctcaggagctcaccttttagtgaggagactgagaaacaagcagacaatgcctgtagagtacagcattagaaataaggtggtgtggttgggctgtgggtggggactgtcagtgaaggttcctgttacaggtgataccggggaatgtgatggtcattgcaggaagaatgctgttcaagacaagggctgagaagaaatactgaactgggaagaagagagttagcatgatgccagggcagagcacaggccttgatttaagacccaacaacgtgacttcgtagctggatgatcttggttcagtcactcaatactcttatcctcatggattaagatcaggatgatcgttataacacttaactttcattgtactcatatataccctttcttgagcactaggtctctggccttgagttaattacttggatattaacatgaccttcacattttagaggaggaggtttcctagcaggtgcctagcagagccttgatttcatctcaagcctgaatccagagtccaagctcagaagttgtgccacctctgagagtacaagactgttgaagattcaatgagctgatataattataggaaaatagacattacaagaatgttagttgttttttctgcatcataaaacgtcctctataaccactttgtaggccaatgcatggatatatatgtgtgtatcactcatatttcttacctgccatttttatattcatggtggaaaggcaaaatttgaaaaaggaaaatgttcattaagaatataaaacacttgggcctatagggaaaaatgtttttctgacttttaaatttccactttttagataatcccttgaatgtatatcttgatactacgtgggcatcaacccctgagggagtgttggatctccttcctgtccttccccattatatggtttattgggtttttactctcattgattaaactcttgctatgtcctagccactgtgatgaatcctcacagcatccatagcaga

SEQ ID NO: 54071 - DNA, 1092 bp, Homo sapiens
ttatttccgtgcaaatccaattgaataatttgtcttcgattctgtagactttttcttagaaaaaggaaccacaggcctctctgctaaattttctaattctgtaaatattcttgagttttaaagtttgacctgatgctttaaaaatagtcaaacataccttaagcaggatttctccgtttcagtagtattgacattttgtgccagatagttctttgctatgcattgtaggatgtttagtagcatccctggcctctacccagtagatttcagtagcacctccccacatcacaagtgacaatcaaaaatgtctcaaaacattgtcccctggggtgtaaagtagcccctggttgagaatcactgccttaaagtggtggccaaacaaagatcttcaatgttctacatacaaaatgaagtgaatctctgagagtttaaaacaagatgtagatgcaaacctgagcactacaaatacttgttcctatattgacttcccctgtagagtgagtcctgagagcagggctgtgagttttgtttccccatggcctagtactgccaggcaagtcatagagccccagtaaatattgagtgggtgaataagagaaataaatcacctgtcattagacgcttccataaatgtatatataaatatgagttgtatgtattcacatagttccattaaaaacttactaaatattactcttttatatcccagtgtctgaatagtaatgcgcacagatcagacattgaattggtattggctgaacggctacctggcacataaaaagtacattgaaatgataaattaacagaacacccatggccatatgccatcagacatgtgtttttgtggcgatttcaacagtcagtgagttggatgtgggatactcgacggtggccaccctgcaaggtctatttactttgcctcgtttgaaattcagtctccatgcctcggttgtccaggtcccccgtctggtctttctgaatccacactagtgagaaggagaatgttatggttcagcaggaaatggatcgttttgttttaaatttccaggtcaccacagctgtgcatatagccgctacttattcccagatctc

SEQ ID NO: 54072 - DNA, 1050 bp, Homo sapiens
tacttgctcttacatccaaatagacacacacagacacacatgcatgaggctactgtgctgtgtgcccagagttagggcagggtcatggcagtcagcgttacctaggctccagtgtggtggttaagagagtggggtcaagtggttcagagtttgggctctatgacaagactgtctggattcaaatgctggcccttatgtttagtagccctgtgatgttgggcctactgcatatatttctgtgtcccaggctccttttctgatatttactttaatctacgtaaaagagcttccttagagcttgcctgggacatagcaagcatcatataactcttggctgttgtggaggttaataagcatggcctttgtcaccagggttggaatcaagatctatctctgctacttcctagctctattacctgagcaagtgagttcacctcagcttctgcccctgcttaagtgatctaataatgttctctgacttgggattgttgtgagggttcaatgagatcctggagatcgagcacttagcttaatactaagaactcattttcaatgagtgtgcttagctgtgggggaggaaatgagtgggagaggagacagccacctgctcctgtggagggcttctgtggggtgaagctcaatcctagggtgatgggagttcctttgtctccatcagttgcacagccagggacagagagaagggttgggacctggaaatcagagtggcagaacaagcactaaatgaatgttctattgttatgatttgtgattctggaactgggcagaagcctgtatcctgggacagaatggcaggtcatagcaggaccagccattacaaaatgggctgctgcaccttatgaaaatttaggtagggactttcagccttcctgctcaaaagggtgggctttagctacactcccggaccaaacagagcccctactactggcttcatgtgaaatattttctagaaaatactgacgcacaggccattttcagaccaattacacctttgtccctagaggtgctacccaggtattttataaaagattt

SEQ ID NO: 54073 - DNA, 1045 bp, Homo sapiens
ttttgttaggatgtgacggggctgcttcccggacctgaacaaaatagagatcatccatatgaaaagagagagaacacagcaagcattctgcatgagtaatgcatgcaactctgtgataccaggctgtatttattctatagacattgcacatcatcagtattttaagagcaacatcttctatataaaaatactcaagagccttatgctttatactgtggactccaatgtaattacactctcttgttgactagatgtaagaagcttgagttgattacccaaggcttgttccctgcatttctgtttctctctcatttgacaggtaccatatccatttgttctattatcttctaagtttgaattggaaaaataaggtaaatcagagcagtctttcttaagttataaaaccaaccatgtgaagatgctttgaatgctgttctgcttgtatataactaagaactagcgcctcacggtaattttgcaggtgattagcctgccatgtagaaacggccctttgggaatgacagggaaacatgaggttgtatttctttacaataagcaggttacatgagagaatttctgtctccttactccttctctctggaagtcttaccaatattttaggatagggatggaatataagcttggaggagatataggagactcatactcatcaactcttacatttcaaatgtaatcaacaaatggattgaggtgctgcatgtgctaggcctggagtttgaaggaggacttaggcacagcctttctgttgagaatatccttttattgtatgttcatcaagctcctgtacagcctgcatgttataaatcaaaggctacctcctctgtgaagcccttctggattcactttagacaaacccacgtcttagttactgctgtaacatgttattagtgtgctttatgtctccccactggacctagccctgtaagagcctagaggccaatgccatttcacctttgtattcccattgttggcatgcaatataaacacattgtactcattatgatcatcattatcattatcatca

SEQ ID NO: 54074 - DNA, 1036 bp, Homo sapiens
gtttctatggggggagttaggtatctaaattttctgtatctcggaaagtatagggctagtgacctgccagatacatttcatttggggaacaatttagttataattactatggaaatagctattggtcacaaattgtacccatgtactatgcattagtatgctccttccttccctctctccctacctctctttctccttccctccatttatccatccttcatttcttttgttgagttggacccagaaggatgttaggataataggataaaggccaataggagttcatcatatatgcagtgggtgtggaaacatcatatttgaggcagggccacaggaactaccatggtgtgtttcccttagttgaacccacatgggtacaaagcagtcccgtgttactgttccccagggatcttggattgtgctgagtagaggaattgagctgtggtggtaggcaggggctacggcatgcagaaccttacatgccatactggagagtttcaacttcatgctgaaagtaatggggagccattgaaaccttgtcagctgggaatctaattgatcaaatttgctttttggaatcagtctggagtagaaggtgtgaagggcagatgaaaattgacaagaaataagtcaaggatgtgtgtttacgggtgtaggagagaaataattagaaccagagccaagataatgacaacaagaatggtaaatagaggctgtgtttgggggtgcataggacaaggttccacccatgtctcctgtttaaaataaggggggagttgaggcatgcattgtcagttacttttgtggtgtgaaagagaatatctttgaaatgtccttctaaaagaataacctaaaaaggaggcaggcagagctgggacagcttcaagggccctgaatgaaagaagaggccatgcagagctagggcacgttttgaaataatgtttgttgctgaggcttcagagtgagcaagaggaggagtttgtgagagggagcagtattctgtgaagaagagagatttagggtcatggagtaggag

SEQ ID NO: 54075 - DNA, 1060 bp, Homo sapiens
gctgtctccctcttctctctctctcctctctctgtgtgtgtgtgtgtgtgtgtgtgtgtgtgtgtgtgtgtgtgtgtgtttattcctctgcctttaaaaagaccagaagaatgcacagatggattagggcaacattgctccagaagcatcttatatagttattttcatctgatagcatcaagacacatttgtggggtcgtgagctgtattgtagtcttcttgttttccagaatatatctgcatgtagtagatgttcagtaaatgttggttgttaaataaaataatgaatccacaacatatggggctcatgctcttggagattcaagcttattgaagcattaattagttgatgtttttagtatacctcccatgtgccaagcagggaggtagaccttaaagattacagaggttaacatgactcaattgcttctcttagttgttttatgtttcatggattctataataaggaactgtgagttgctatgctcattaatgctatatccttgcaacaaaatagatcatgaagaagtaacagatgcctctgttgcagcctcttcttttttcatacatctttgagtgtgtttattatattcttcttgcttcttagcctgaatttcttgaatatctgagcaccaagcatactactgggttattaaatgcttgtgaatgaatggacattcttggaaccaaaaacatggagttagggcggcactgtgctatgctagaatgaactttggctgtgggtaggggatctggattcaaagctcagctctgtccctggctggctgtgtgaggtattaattaagcttctattcagctacagaaaaagcatggccactgggagcaaggtggaagaacttaaactatttgtgggaaaagattatttagatcaagaagttagaaggacagcaatggaatgcttgtcgtacagatgtatttaggagaaggaggacagctaggaatttgggttttcttaaagcagatttccaccttagaatgacctgggatcatagtatgcatggctaacatttgtaagcaggaagttgggagaaggaaaaca

SEQ ID NO: 54076 - DNA, 1073 bp, Homo sapiens
catcagaagctacctataatttcagtgcaatgagtgctgggcataggtggccattcagtgagtgagtaccccaacctttgggaagataagacaggctattctaatccagctgtacccatatagagcaattatcattttcactctggctcccaatgccttagatttactgggtcttcattgcaaggcaggaaccttggagttaattgaattcattggactatttatggctggagctgatgcatatgatttttctctcttgaatatgaatgatcagcttccatgggaaagcaacaataaagtcagtccaagctgtgtagcttactagctgtatgaccttgggcaagtcactttacttctatcagtctcatttttcttatctgtaaaatgaaggcttcttaccattgacgttctaagatatatagataagattctggtttttaaaatgtgcttactagaccagtgagctgatgagaggcatttaggtcatatgtactctccagattactgggattcttcaacttggcctaccttctaaagcatatacttattatacaagcaaatatgcctgtcagtgtcctaatttacttcagaaatgatttaagcctagaatcgcaggtttgaattaatattaatatttgatttaattaggacaattccatcttgagatcaggaaactatgccatccatccatccatctatcatgttatggtcttattcagtatttattaatattaagcacctgctatatgcttggtgctgtgcacagtgctgaggaaacaaagaagaataagattcagtcgctgtccacaaatctctcctcaccttccacaaagaaaaaaagaccctcacactaaaaaccagttgctcttaatggcattgccttttggttctgtgtggctggcatcatgttaatggtgagttggtgacctccaatagaaaagaagaaaaaaaaagttcctcaactctggcttatgcaaacatctttaatcatttcaagcttcaactacagaccaaattggaaggaagagctgtgaaaagcccatttataaacaaaagcccggccaggagtcgga

SEQ ID NO: 54077 - DNA, 1027 bp, Homo sapiens
gtatgttctgaatactgtgctgggctctgggcttacagggtgaggtgtgatggaaacaatagctgccctcatgggctagtctgtctactaagacacaaaatcaacgttctccatcaggggaccatgacaaagttggaggcatgtgccatcacatatggggagtcccaggtaatttggtatgaatggatcataaagtggcggggtggcaggaaccaggggaaatgaggcagggaaggtttgcccagcaacttcacagagaaccttgtcaccaagtgttagcaatgagattttggttgtgcacatggatgtgaaatagcctttactttgtgtagccttctctgcaattaactttattttcctattgcctggggtcaaagagcaatctaagaagaaatatatttatttaggtgaaataaggatgtgtgtgtatcaggtacggtataatttaatgatccttcaggtgtctcctgttataagaactacaagctcagatgcttacaagggccaggtgtttgtgggtgaaacagtgtgggtggggaccaggtaaaccgctgttaaggttcatctgatggttgcagtaacagaatactggactcatgtaggtctttggctttttcaagaaaagctagacatcttgttttcgtgtgaaatccctctgtttaaaaatttggcactaaattaggtaaaacaaaaaatattttgtggactaaagataactggcctaagggcttttcttagcttatgaaccaccactggtgaattctggcctgttctttataattagtatggtatgactacatagatctccctcacgtgcaagttcagtcaatataccaaggggtacattggaccatttccggtaaaggaaaaagtttctgcaggatagccgaatggtgcaaattggccttcatttatttctgtgtgtttcctcaatcccattgtttgtttttctttatcaaactcttctgttacatggcacaagcttccgtgaaaccagtgtccatggcaattctggggtgttcttagc

SEQ ID NO: 54078 - DNA, 1050 bp, Homo sapiens
ttgagaaggcatttgaatcagagctgggatatgatcctgcttttcttgatctcaattcagtatacttttcatttgtttatgtatttaaccaaatttactgagtactgattgcagactgggcatacataatccaatgctgcccttaagaagccagtgtctggggaaatcagacctgactgtagagcagtgactataacacatgttgaagatacagtgacagggcacagacaagtatacaggaggaagggctatcacagaggagcaaaggttcagcctcaggacacaggagaagggactgtgctgtgccatgcagcagagcactgaggatgatgataatttttccacatgaacaaggaagcaaaaggccgttctaaaacaccccaaaacgggaactcttagcagtttctatttcatctctatttttatcggtgttgggttattcttcaatttgacaaaaaagaaaaataaatcacagagaatagagtcccaactcaggcactcaccaacaggacacatttcctatgggtatttcctgggcctgtcccttaggcttgggcctgctcagctggagaagcctgtaaggggaggaagtggggatcggtttgtgttcatcagtatgcatttcttgaaactggccaccagcaaagaatcaaatctccttggaatattcttaagcttcctacatgtttgattagttttccccagtagggaatgaaataaaggaagcagctgttgagagagggatctttctctctgcatggtccgagactagctcatagcataatgttgatcctcacaagacccaggaaaggtcagaattattcagtatttaatagaaaggctactagtggttggtctttgtggtcaatgggggcagaggaggacaggagaatttgagggttctttttgactgttccatagccctttgacactcttttgtcttaatttccttttccattaaagaagatacggcacacatacataaggttatttcgtgcattcattttcttaatagcccacggagcatgtaccatgcagcaggccctctgc

SEQ ID NO: 54079 - DNA, 1115 bp, Homo sapiens
caggttgagtgaggccagaggggaaaatcagagtttacaaagtgtgtcatcaattagggtcctagtagaaaatagaaggtacactggattagagtaattcaaagagggtttaataaagggattgtttaagtgagcagagtatagggaaaacatacgagttacagcagtgtgcagggctgctaccacccctagacatggacggtgtgggtgagggagcaggtactggaaccaagactaggaagtcctgtgaagaagccaccttgagcagagcagtgacttttggttgagaaaggaagccatcctaaggtgactacaaagggaggaagccaacggagtgaatacactaacttggtctcttgtcaagaacctgttggcttacctcaaccggaggacaaaagagaacaagagagcccatggtgtagtccacatggatagcatctgggggccctgggctgagtgaggaagcctgaagcatggatctggaggatcagacagaagacagcttgcactggggcattgatgagaaggcagagcctgagagccagaaaatgggggagttaggttgtgatgagcaaggtgacataacccaacattaagaatgcacatgagctctctctggtccgtgcctccaagatgacaaagaaaagaaggaacaatggtcgtgccaaaaagggccgcggccacgtgcagcctattcgctgcactaactgtgcccgatgcgtgcccaaggacaaggccattaagacattcgtcattcgaaacatagtgaaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccatcccgatttagacctgcgggtgctgccccacgtcccccaccaaagcccatgtaaggagctgagttcttaaagactgaagacaggctattctctggagaaaaataaaatggaaattgtacttaaaaaaaaaaaaaaaagaatgcacatgaggccaggcacggtggctcacacctggaattttagcactg

SEQ ID NO: 54080 - DNA, 1034 bp, Homo sapiens
tttggggtgatgtctgccttccaaacattcctcaaatcagagaggctaagtcacttacctgtattcatgcaataaatggcagagcgttgatcccaacacaggcctttctgattccttccagtgtgtctcagccttcaagacaaaactagctctgctaaaattctacgacagtgaggaatgagaggcacagcccaaatttaatgactaacttcttgtttgacttggagcttcaagttgatttactccttgaatattcttttctctcttactctggcttagcattgagaatggcagacattgccttggcaaggttacaggataaacttgctgcttttaggacgtctgtatccagcggaatctttattttctgtcccttgggcataatcttggaaaaacacatctgttattccgggtgcttacctgactgggcttatttttcctcccttggatggagaaaaatgtgctatcaacagatgaggaagagttttcacatcttttgaagtcacggaccctttgggtattaaaaaacaaactctcagaatcttgattaagtcataaagtgttattgaaaaaatgagagatcagtccttcagctcgaagatgtcaaagtcactggacatgaatttggggtctctactgattaagtcactgaagtgtggacaatggttgggggttgagcacaccttaacagatggactgtacatttctcaaatacctgtaccaggacacatatcccttcctttcccattggctaagccacatttacatgcaactgcctcgaaactcatcctttctggtaactttccaggacctgaaaaacagaaacaaaggctaggatgagagttaaatactttgatctaccttattcattcatttcaaaacacttatgaagcacctatgtgccaagctctatagtagacacttaaaattcgatccctgaccttatagaggttttagatagtggaaacatatgaaaataaggcaattaaaagatggtatgctcggccaggtgcagtggctcacacctgtaatcc

SEQ ID NO: 54081 - DNA, 1031 bp, Homo sapiens
ggccatccagcatgtatcctttaaattcatccaagctagcagaaataagagagcttttgattttcctacagtacaaacaaaagttctgcctctcaatggattgagtcttgccctcaatcctgaaccaatcactatagccaaggaactgtaatccctaattggccaggctgggtcatatgtctaatcttggagtcaaagatctgaatcaattctatcagaaatagatgactgagaatatagaagaggttggttacgagaggaaaatgtactgatgtaccaaaggaaggcatggacattggacagccaatatgtaatgaccttttttgtgagcccaagtcccagagaggttcaaggacttgcctaaagtcatacaactaatgatcttgatgacacagcctatccacaatgaatctgtcttattcacctttgcctatctgctacctgtcccagccactttttgaatgaaaaaaggaataaatattacgtgattaagacttatacccatgtcttctgactttacaccttaatactctttccattgactatttccagggctgcacaataccgcttacactatgtgtgaagattaataaacaattgttgtttgctataaaaggtggctttgagttcctcaagggatatgctgctatgatgctgggacagctctctgtactctgactttctctctcctggatgcagctgtcgtgacttcttgatgaactctatcagcaatgataagggattcagtgaaatggtggcatttctgcttagtcctgcctaccatgatatgatgctgacagatccttctttgaagagtcacttcatggctggtactattggaactgtcaactactgtacttgggaatctcaatcaaacttgtgatgatgggaatagatttacatttacagctttcaagtacaaagcaatattaatgcattcatgttgaactaacattatgcctggggctcaatttccaagtgagagtttgcttgacaattattttctcagaagctggtaagtagaaattaag

SEQ ID NO: 54082 - DNA, 1062 bp, Homo sapiens
ccattgtcacttctaattgtgttgttcatacttgctagaaacatatataagttgacaccatgtcagaaagagcagagataatatctttatagtatatgaaaaagattttttttaaccagtggaattaaatgtaaaagaaatgttacagttcagctcaatgctttagaagaaattaaatagcagttgaaatacaagatgtatatatatactttaaattttatatggaaataagctgtatgttctacacttagttgcagaactactttgttcctgtcaatacttttcatgtgcctataggatttagatgataggctggttaacttagttgttaggagcatgatgctaataaatccaaggcacaaactcaacccgatcttttctataattcagatagggtgagactatcctctaaaactaaaggacagtgtgtatatttactgctatatacttataatgctttgcacattataggcattcaattaacattgacactgtacaataattatctgttcaaaggattgaaaaaaaggagaaacaatcatactctgtaaaatctgcttctgtagttgtggaaccctggacaagtcatgcaaactctctaaccctcatttcttaattgtaaaatggggacaaaaaaaatcctcctaggttgaccaatgaccaagtgaaatgatatacttaaagcatttaacacaaagtctagagctgcaaatgtaataaaaattgttaccatatactgaatgcatactttgtactattagtccattttcacactgctataaagacatacccgagactaggtaatttataaagaaaagggatttaattgactcacagttctacatggctggggaggcttcaggaatctcacaatcatggcggaagggtaagaggcatgtctcacgtggtggcaggcaagagagagtgagtaagagcagggaaaactgccccataaaaccatcagatatggtgagaagtcactcactatcaggagaacagcatggaggaaactgcccccatgattcaatcacttacctttcttgtcacatggggattacaatt

SEQ ID NO: 54083 - DNA, 1015 bp, Homo sapiens
atttgtttaccctcaaaacagcattagggcagttgttacagattattaatactattgttgttgtttttaaaataatactatttgaccaaatcatgaaaacaactgttcactgtagatttttcagtggttctcttttatgtgttataatcaagataccttttattaaaaaaataacaatacattctttgttttacatggagcatattagggattactgaaacaatctgaatacattgatgtatatatatagtatttttttattttattatttctttataggctctcaaaattagagagatgtgtaattgtccaccactgtctaatccagaccctcgattactattcaaactcagcacgaagcattttcttgaagaatcagagaaagaagacctaaatatcacgaagaaacagaaaatggatactcttcctattcaaaaacaggagcaaataccattaacatacatagttgagaaaagaacgggcagttgaattaaaatttatgagacacaagatatatgaagaatgttgcagtccttatcattttatgttactttttaaaaaatgatgtttgaagtgaaaaaaaaaaggatattcagggtcaaatcatgtacattacagatattatctaaattcttctagaatttatttttcatgaaatattgatgtattttaatctatgttaaaatatcttcaatgaggaaaatgtcacagaataaatttatattacacattttactctgtcttctacttgcttttgatttagaaggcagacccctagtggatgagaaatgagcccatacggtagtttttatagtagagaatgtttcaactgagcctaaactggatttctaagtctgggtcgttatgatgaagggggaaacagtctgaaggtatctgtttgcaggaaatagtttgcattggggtgggattatgtggaaaagggggcctcaggatagagaatttccttgtcttcacctgtggatgactggagaaaatgctactggcagaagccatt

SEQ ID NO: 54084 - DNA, 1059 bp, Homo sapiens
ttggtttaggaaacatacaagaccagggtatgtcccccattaagctagtgtcctccttacagctcttctacttgctgatttctctgtctgaaacattcttccctcagttctttaggcaaatgtcactgtcctggggaggctttctttgatcccataatcttaaatcgcttcccttccatgtactcattgtccgtccaacacacctcactctttagtttcttcatgtacttaactaaaattaccttatttgtttattggcttttaccctagtgtgtaaggcctttgtacactgctgtatccatagtacctatgagaagttgagatgattagtgaatattagttaaatgattgcatgatgtgtaataataggcaggataagcaatataatagtgggtgaaaaatagaaaaattggcagtagaattgaacagtccttccactcccttatagaaatttagcatgtaggacattaatagttggtaacgggagaaagatggtcgcaggaaatagtaatataaagataacagtggtcttaggagtcttcggttttaattctgactcagccatgtaacttggagaaagttacctaatccaacctttagttttcttcatatgtgaaatcaggatagcaatatctcctagatgttggatgtacatacttgtgcatttctgtaggtaaggtcctgctgtcttctttgccttgtccccctctctttggcatagacattttaatgataagtattttatgtcaggcccaagatttcaaaagtggttcaaattccaatgtcaatttagatgtgtaaaatacctcacgcagtgaaaggcacatagaaagtgaacagtagatgttagtttctttcactcatagttgtagtctttaggctggctaattctatatttaacttcaaatcttcctcaggattctcagaaccatatattcttgctattaaaatacattcctgctttttcttaaaccataaactcctaagagtattttctctatgacatttatcataatgatttattcatagctggtgttctataaatgtttgtttaaaatt

SEQ ID NO: 54085 - DNA, 1033 bp, Homo sapiens
ataaaatgagctttaagaagtgatgccatcagcaatattggaaaatgatgaacctgtggaggtatgtgagactgaaatgaactagtttctggtagatgatgacaatgatgattgtagtgtataataatcaataacatttttaatgtgctgggcactgtcctgagtgtattacatgtatttattcttttgatcttcataacaaccctgtgaggtataggtaaacctgagggatggaggagttaagtaacttggcaaagctctcatagacagtaaggtttccctctcccaaagtggaggtacattcatttctgaaagggaactttccatcttatatttgcctgctggaaacaattttggttttctgcagtattgcttctaaaataatgatcatttttatatctgttttggtccctttacatcttataacagcctcagtgtatttttctagctgtaggagcccagctccccctgccacaatcctttgtagtattgtctcagatgattattttacctatcacatgtctatgtggaatacaggagaggatgctacaatgactgggacaagtgtagggtgttaatggtttcctaaaaaaagattcagattcattcagtgtcaggatttacctttggaagggggtgatggctaacaggagctttgttggagtgtctagtgaatacagacagcaaaattcagagatacttttcatctttgcatttctaatgaaaacgttggctacaggtaacggtacagttaggcttttacttggtctagatctatttatacatatttctctagtattgttttggcattgggaaatggtgaaattataagaacaatttttatactgctgtattctttatgaatatcatatcccactgaatttataatttaatagtagcaaattctttctcaatatgttccttaatgcatattcatatacatttatattctctggattgtactagaaccttcttgtaaattcatgacatcatcacttaggaccaaacatagcattttgcaattaccataggc

SEQ ID NO: 54086 - DNA, 4691 bp, Homo sapiens
agctatggctgtaaaaacaccgaagggaattttaagtataattaaaaggagattggagagttaagaaatagttgatgacaatgtgcttctttatgcttttctaggcttaccttacaaatttgaagtacagcagatgttagaagaacctcagtggggattagtatttgaaaagacaagatggataatagaaaaatacaggctctcccataggtatgtactgtggtttgagatggttgcacatctgcagtgttgctcattaaattatgtttcagagaaaacccaagttaaatataaaattgtgatgtatggcatccgtgatagtttattatgaaactgattagtttatagtattcgtttcaccagtttgttttcatatttcttcctacagcagcgtccccatggataaaatctttcgccgggattctgacctgacttgtttgcagaaagtaagctgtcttcattttaattggttccattgttcacagattctgaagctattcatctcaatgtgttttcccatgatgcctaatactttgtggataattttctgtatatttcttttattactttttcctttggaaaattaatttctaggagataattagtaacgttttttgttgcccaagcttgcacatagaaaaaattctattttagaataaatttgtcagtgttggctgattttagcagattattattatacacaatggagaacatttttcttattttattaaatttgaaagtgccatgtttccattttagccttaacaattggtcatttttaagaatgatggtataaatctaacaattaaatttaaatagtcattttatttaactttctaataggaaataagagttttgaattctgtcagttcacgtctaggttttgcttctgtaatgattgaaggctagtagatctgcaacatttgtctttttaaatagcaattggggatagaaaatttaaacattaagtttctttttaatatgttttactcctttctgttatatccagttttttgtgtgttgttgaaaaagtatgtgcacatttccaaggaaatagactccagctagcatcctcattttgaaatgcagaatcctatgtttttatgtacctagatttttgtgtgtgtgtatactcaggattattttgctttgtaagtgtaactacaaatggagaaaagtcgcaaatacgtccgaagtagaaagcatcacataaacaatctcaggtttgtctccttatgtaaaatcataaaagtactaagctgagtgttcctcagcagcaatttcctacattccagctctgtgactattaaacacaagttaatcttcaaccatttttaaggagagtgtttctcatttgagcattaggaaatgtgaggtctggaaagggacgaaatagtgatagtaatgcaaaccctcatactttttctgtatttaaatataaaacttttcttttcaactagcttttggagtgtatgaggaagactctgagcaaagtgaccaattgctttatggctgaagaattcttgactgaaatagaaaatttgttcctttccaattataaaagcaaccaagagaatggagtaaccgaagagaactgtacaaaggaattgttaatgtgattattttaaagttaagacattttaatcttgacacagtagatcttactttcaaagttataaacttgaagtgattgtagttaacattggcacagctttggtattttttctctatttcacaaaatccaaactttgccacataaatcatgtgaaaaggaagagatacaaatttgttttcatatagtgattatcagagtgttctgcaaaccagggtccaccacggtgttctagtcctttactgagcaatgctgtaggctgtgaaactaagcaacctggtcggctttactgttgtgttcagcttgggatttggactatgtctctaagtcatttcttccctgaactagtcatttatgttccattgtggtatctcctatttcatttaaaagcacttccattctttccatatattctgctgagatttgtttatggctataaatgagatatggatgggtggtcactgagataattaatatggtttagaactactgattaataaatctaacaggagaccaggagaggcatgacaagaaaatcttaaaaacaggaaaaacccaaaggagagaactaaattaccagtttctaatcatagatactatcttccatttcattgtatagcagtagtatcataagatatgccattttctcagctatctgaaaatttttaaccaattttacacacataaaataattagcttcaattgtgagtccacttacattagtaggtgtgataaaacctcatttaactggaacataggtaatcataactcaaactttttttctactgcctactactaggagaaagaggcaaatgataataaagctggaataaatcagagatttaatttttaaaacaagcctttcaggacatgttacatattcagcccagtttcatatgctttctgaatctataatggaggtcagtgaacttttttaatgtaaagggccagtttgtaaataattttggcttttcaggccacatatgatgtctatgagacattcttctttgtgtgtgtgtgtgtgtgtgtgtgtgtgtgtgtgtgttttacagccctttaaaatgataaaaaccattgttaactcacaggcctcataaaacataggctgttggctattattctccaacccttgatctagagaattttaaacattagaattttgttttacatttgttaagctttacgtcatcttcaaatgacaccaaaactcagaattatgatctgcatttaagccaattttaaaataaaataagcagtcaatgctgcctcatttattgaaattcagtagattttagtttatttcttagtagtcagagaattgatttatagctattcaccaaacattcttactaacgtttccttatatctaaatcagattgattctatattttgctttgtttgtaatcaatagccaatgaagaataaggagtattggaagaagcagtgagtcagctttaggtgacctggttcttgtctcaactttgtgatttggggagatacagtttactttccctgagccttaattcttgtgtaactgaagtctaacttaacttcttaatgtccttccagaactaaaattttattgttcattctaatcgttggactactcttgtgaagtttatattttgagttaatacagtttccaaattaacatacatttaaaaaaaaaagggtagtatttttccatttctctgtgtgcacttaggataaacagtgaagtatagcttataaaacaattagtttgagggctgagagtgtaagaggaactataccaaaagtcaggaaacctgagctcttaccctaactctgttaccaactttgctgtgtgaccttaatcaaaacacataacctggaccccatgctcctcaccagtaaatcaagggcctgaattttatggcttagtattcccttccaagctccgaagttgcgtgattctgtgaaaggcagtgattgattcctttgtactcatcttccttttgacctgtttcctcatgatatattggggaacaaatactaaaaagtgttttatactagctttcttgattgacatttccctataatactgatgaatttgggtgatggaaagtaatggaaattgttaaaagttctgctctcaaatctgagtctccttgccctgtgtgccaatgtttaaccatatttgctaatctaagccatattgcgaggatctcaaggatgatacttgtcaagagtttggggccttgagagcacagttttcaaaataatacttagtattttctgactatagagtacatttgtcttgtaaagtatattttaaaatacagagaagtgtgaagtacaaatatctcagtgctactatttaaaaaaacacaattagtatataaatccttccccatttttttgacagtataattttagtatgttaaacttggttacttctttctctcttcctccatcattttccctgcttcctttttcttttgtcatattcttaaaacaattttgcaaccacaggtacccacattgctggcactaccagccttgggctactaccgaggataatggagccagggccttgtagaagcacagaggaagtctagaactgagggggcctatgatacaggaagttcaggaggcagagtctcaaaggaacacctgcctttaataatgtttacagaagtggagaaaggactaaaggacttaaagacatgcaggtgtcttcatcctgattctgtctttgttattgcacaatgactataaaataatgacctaatttttttttttttctggcttggctaatggaaatcgacactagcgcttccccagtattagacttaatctaattccaaagtaacattcaagaaaagaaaaaccagtggaacaggatcagtaagctcagactctccatctccattattttagccttgaccattcttctctaatccttttaaattatcttcagtttccagttcaagttacattgcttcagttacagtttgtttgaccctgtattcagagctgcattatgattcttgtgggccctagatagttttgccatcttagaccccttcttccatacaaaattaaaagtgatatttta

SEQ ID NO: 54087 - DNA, 1017 bp, Homo sapiens
atgtaaaataatggtatttaaacacaacatttagcagcaaaggaatacgattgctaagagatgggaaacaaatgaaaagagccccacattaccctagcttactgcttaagagggttttcagatatggcacaagaaggagaaacccacccagagccaggccgactcaattaaggtgatggagataaggagaccaagacagctgagtttgtgagacagagccccaagagaacagaaagcagaatggagagtgaactctggagatttgtagaagagtatccctggagtatttagcaaagtacagatcagcacatgtatgtgaataaactagcccagatgggaaagaactacttgaaagcattagagggaactatccatgatgctcccatgagctaccattggacagagctgtcttgtaaatgacttgtccatgcttaacactgcgtattagatcttaatcctaggtcttttgctttgcccttagaaatcctctggtgcaagaattaaggttttctagaagccatgggataccttgtgctacagtacttttaactcaggtcatatctttacaatatctctaatggtttaatgttttctttacttgtgacaggcaggaaatatatttagtgatcagttttcttctgatattttagtggataaaaatattctctataaaagaaacttattgactttaaaagtaccttttttaacttaaaaaatattcttaaaaataccaaatagacctgtatataatttgtgtgtatgttttcatgtttttgcatcagcatagattgaaaatgcattatttacctctctttattttcatcttcaactttcattgagagtaggagtcactctactggattcagatcccagctctgacatttattgcttattttaccttgggcagtctactccctcattctcctttgctacatctgtaaaatgagaaaaaattactaccttgcttacagtaggtatatggttgtaaggtgtgtcagtaatatatgtaaagtgttt

SEQ ID NO: 54088 - DNA, 1037 bp, Homo sapiens
ttgtttatttttatttatttttattattattttttttttgagacagagtttcgctcttgttgcccaagctggagtgcaatggcacgatcttggctcactgcaacctctgcctcttaggttcaagtgattctcctgcctcagcctcccaagtagctgggattacaggcgtgcaccaccacgcctagctaattttttgtagtttgagtagaaacagggtttcaccatgttagccaggctggtctcaaactcctgacctcaggtgattggcccgcctcggcctccaaaagtgctgggattataggcatgagccaccacacccagccaaaaaaaaaaaaaagaaaaaaaatacatatactgggggttttaaaagaacatgcatttttttttctgattgcaagattgataattgtttatgtaaacatttagaaagtcagttattttattaagtacaaacaagccatgaatgtatcactggtaaatactcccagagcctttaaaaattgatgggaacaactaggacagggactagatacaactgaagtaataagaaacataatgtattttttatagctgaagaaaaagttttattctgggattttacacttgatatgtgactgggtttgctgtagggtatttgtaaattattactgtattgataagaattacagatgtagggtggtgaatacaattagtaaatatattcatggcaaatacagattgtgtaggccattttatatttttaagggtcattttggatttggttgaacacatttttgcctgaaaaatgtaccgtgtgagatgaatatctaaggcatttgatttagttgcagtttggatgtgaactttttttttttttagagacatagtcttactctgtcacccaggctagagtgcagtggtgggatctcgactcactgcaacctctgtctcccaggtttaagggattctgctgcctcagcctcctgagtagctggggttacaggcacgtgccactacacctggctaatttttttatttttggtagagacggggtttca

SEQ ID NO: 54089 - DNA, 1080 bp, Homo sapiens
ttataaaagcatgatggctatacttacaaatgactttcttatgataagtgagttttgttactttgtcaggtgggtttgtgcgtttgggctaagtctgtcttgtatttcttttagcatgctcatgtttctatggcagaagtgattggtctgttaggaggaagatactcagaagttgataaagtagttgaagtaagttctctcttttaaaaaaatgttttagttatttagtcctactaccataccaaatatttttatagaattcagttaatataattaaaatacagactttacctatgatatatatgagaatatgcaaatgtagcaagttatatattcccagaagtgacttaacattctatatgcctagcgcctgtttctttttaccaccgagagaacattgccaggccttgggtcctcattacctttattagtaaaaagctacaacttctaagaggccagaaacaggtactaacactttagttgaaagtttgtatgcatcattctgttgaaattattgtcataagtaacaggagtcattgaaagaatacctttgtacaggtattatgtgggctgacctggaaaactaaccattattatgaccttgtttgagtagaaaaatgcatgctaagttcctagcatataatcagacttttggagtttaagtcatttgcaagttaaaggcaactgtggtattgttaaataaaagtcttggccttgaaaagtttccgtatctttgaaagaattataacattagagtaatagaattaacaggattttagtataatcatttgaggatcaatcgtttataggtctgtgcagcagaaccatgtaacagtctgagtacaggactacagtgtgagatggatcctgtatcacaaacacaggcctcagaaaccttggctgttagaggcttcagtgttattggatggtatcattctcatcctgcttttgatcctaatccttccttacgagatattgacacacaagctaaataccaggtattacatgtatatttatattctgtaaatggttgcacaccccctcaatgctcccttttaaatagataaactttaaacattt

SEQ ID NO: 54090 - DNA, 1494 bp, Homo sapiens
actctaaatgtgagacttatatttattgtgattttcaagtcattgttcaaggtcttcaggatctttttgaatccagatccacttttctcattttagcctttgtagcactgtatcattaacatttcaataagcttgcctttcctgccattactcactgattgcaatgtttaattgaataaatgtaaacctcattgtatatatttaaacaacgaagacattcattcttcaatcagctatatagattaccacaattaacgcatatatcttcatcttatacagaaggataatcatatcggatgtcttgtttaatttcagataaaatatatttaagtctttagtttctaacagattattcctatcaatagtgtctacaataaggtctacttatcatgacttttcatgaactcattattttacttagtcacctcttcacttggttaaggatcacaaatcagctgtttcataattttttctagaattttactactgttcaacatctagttcctccttttctgcagtctgcttttttgtattgtgaaacaagctcaataattgtctatttctagtccttcagcaactttcccattctctgcagttcctcaacaaacactgacagcggttccatatccgtggttcttaagtactccaggatgttctttctgtgctattttctcatctatcttggccttcagtttctttttgtgttgattaaacactttctaatttaaaggtctttctttattcaacaagtatctttgaatgtgtactgtatatgtcaggcacggttctgatcacttgggatacattattaagcaaaacaaaatgttctcttgaagctaaccatctatggttgaatggaaatggaattgccctgctctcttccagttgtgttaatgcgaatgtattcctgtgtgtttttctttccctgaagatagcctaaaaaacctttttattgttcttaatatagttctcaagcctcaattctttactgacatttctgagatttatgtgtgcttttgaccttgcttaggttctctctttttcacctctttttactttttcacttttttgttttttttttttttttttttttttttggagacagggtctcactctgtcacccaggctggagtggagtagtagagtggtgaaatcatggctcactgcagcctccacctcctgggcttaagtgatcctcccacctcagcctcccgagtggctgggactacaggcacacgccaccacgctcagctagttttgaaattcttttgtaggggtggggtttcaccatgttatccaggctggtctcaaactcctaggctcaaggggtctgcccacctcggcctcctgaagtgttggaattacagatgtgagccactgcacctggccactttttcacttgaagagtttatgataggagtaatacattaatatctttaccagaactgtttgtcattcattcattcaaaaaatgttttaagttcctattctata

SEQ ID NO: 54091 - DNA, 2522 bp, Homo sapiens
ctgcccacctgctactggtgctcctgcccttacctcgccatcactgatttattatatttgtaactagagtgctaactattgaacataaattaataaagtttagtcagtcattgccagaggttatactatttaaattgatagattaattgacttttagataattattgttttcattttgtgtattaatgtgctatgatttctccatattaatcttgctaccttttgctttactttaatctcatcgcagcgtacaaggagacgtagggtccgagacccatggggaaactggtgtgatgcaaaggacttagaaggacaaacgtttgaggtaactttgacctttcaaatggctcatccatgaaaactggtttttaaatatatatttgtacatcttaatgtcatatgtattgtacttgtttcatacattaacatgtatgtgttcattcccatgttaatttgtctggaagtcaccagtaaacaccaaagtagaaggcattggtggtgcagttaactaggagtttaactcatttcagaacttggattctctgtctctgtattcttgtctctaactcaagataagggtgtcaagaagttggtatgcccaattcgtttcattaaacatttattggaagaggttctgatataccaattaaaatattgttctaagcattagacattagacacacatgtgttctaaatatatatattttttgtaacagctagtgcagtagaatggatagaatgtgtgaatgtgtacgtactggctttgttactttaagcaactacttaatctcacagaatctcatgcttttttaacttacgaattgtgaataataataatacctccctcaaagtattgttgtaagaaagaaacgagatagactatataaagatgctagtactaggtattcagtaagccttgcatgcacaaagtactcaaacttgagttctctttcctcctccgcattccctgccctcaacttctcacctgagtactattctaggcacagtaattagtaattcatccttcccataaggggcttgtatttctaataggaaagacaaaacctatggtaagttcaataaggttggtcccaagaattgtaagtttctcccaaaggctgtgatcagggcaggtttcgtagagtatgtggggtataatctgatctgaaggatctgcagaagaatctcaaaatggagatgaatacactttaggctgagggaacaaagctggagacatgggaaaatactagatatattctggaaaaggtgcatagttcatttggactagggtgtaagttggtcgtagaaatggaatagagatttactttattttataaacacttataaagggcttactgtgtgtcagacaatgtcagtattttataaacattaactcagtcttcacaataataccatgacagtggtattattgtttactttttattattaattttattgttcccatttttaaagatgaggtaactgaagcatgaaagctttagaatttgcctagggtcaccaagctagtaaataactgggccagacattctagatccagaatctgttcttaatcattactctgcactgtctctcagttgtgaaagaaaactcaacacagtagaatatggtaagtagaaatgggaaataaaagactcaggtgattctgacgtttttgaacctgggtgactggtaccattgattgaaatgggcaaatcaagagaaggagtaaattttcagtttgggatggccgtgtcttttgaaacaattttttaaaaatactgtccagtctttctacatgttggtagcaaaaaggaagcccatctatatcaatttagtctctcttgtcctcacatgcccttcaatttgattttaaaggactatttttattctgcctcttagtagatgatggactccttaatcaattggcattttgttttagcatctctctgctgaggagttggcaaaaagaagagaagaggaaaaaggcagacctgttaaatctttaaaagtgccaagaccaacaaaaaggtgtagtgttatataaatgtggtttttaaacatttatcacaaatggctagataatatatgaaaaaatattcaatagctgcattatattgttcacattaagtttaaaaaaatactgctacaattttttagattttttttgtttcactgattatgaatttggaagaccttgaacaaacattttaaatttgttcagattcattgaacatatgatccaacatatgttgtaaaggggccctgtttaggacaggttggtcattcaactctagacgctatggacaggaaccttcatgaaatgactgggttttctttgggtggtactaattgttagcaagttgttgcatggtttgttgttttctaatgcatgtgtaatctaaaatttgagccttttaaaattaagggtcaccaaataagttaaatgttccgattttctattccctcttcctgcagatgccccattgaatagactgtagttttgtcagtgtaccttttaaaag

SEQ ID NO: 54092 - DNA, 1091 bp, Homo sapiens
caaatataaaatgtttaagcatttgtaagatagctgataattgaaagacactgttaagcaaaataagagtagatgaatctaagtaatatattacaaattggaaacgtctaatactaaatcttttctatatattatcaaactgctctttgtatttaaagattcaatttgtgtctgtacataaatttctgaattcaaggtcctgggataactggaatctatgaatttaacattggggaagaaatattgcttgtaaaaaattatgctaataagttattgtatcatttaaggatattttatttcagaaaaaaagtacatgggtattatgtattagtattgtatttattacacatttatacattgaaaggggttaaaatttagagatatttcaaatattgaaagttttccccagaaatcttttttcacgtttttatttatccaaaataattgtacttctgtctcttaattagggagatatgcaaaccaaaatacttaaataagacctcagtacgtcctggcctgaagaactgtggagatgttaattgtattggacggattcatacatacctcgaattgataggagcaatcaattttggatgtggtaaaaataaaaacccaacaacatcttttactcgacattttttatccttacagcacttattcatttctatgatggttagaattcaagtagttataggtatatagaattcagaggtgctgtaacattatttaataaatgttttattaagattttactgttggttaaactgtgttttcatttgacctacactgaaaattgagagtgtaactttaaaggtaaaatattcaatctaagtaatagaaataatttaagaatacagttctttagcagataaaagtaaaattattttatgaaaagtctaataatagcccatttaatttgcaaatactgtattcatgctagaaatactacctagcaatgtttaaataaaggaaataatttgtgagcctctacacttacatgtgataaaagcgtcaaaatattttttgtggaagacaattgtaccttagtttttttcaaatttaaagttaatgaatatacatattttaaaata

SEQ ID NO: 54093 - DNA, 1231 bp, Homo sapiens
gtctatggtcctaccaccatgaacgtgcccaatcttgtctaaaatgcagttattataaaccctttaaagaaaaacacattgcctgtaatcccagcactttgggaggccgaggcaggtgcatcacaaggtcaggagatcgagaccatcctggctaacatggtgaaaccccatctctactaaaaatacaaaaaattagccgggcacggtggcaggcgcctgtagtcccagctattcgggaggctgaggcaggagaatggcatgaacccgggagctggagcttgcagtggcctgggattgcgccactgcactccagcctgggtgacagagcgagactccgtctcaaaaaaaaaaaaaagaaaagaaaaaaaagaaaagcgcattagaggtataatgtaccatttacatgtattcagtttaataacactgtatatttatccttttttgtgtgtaccagtgattaaatttttaaatcttaatattatggggattttattttgatttttaataaggtcaaatgcggtctggataaagaaacaccaaatcagaagaccggccataatcttcaagttaaaaatgaagataaagggacaaaggcatggacaccatcatgtttaaggggacgtgctgatcccaacttgaatgctgtaaaaattgaaaagttatctgatgatgaagaagtagacatcacagatgaggtggacgagttgtcttctcaaacaccccagaagaattctagcagtgatctcttgttagactttcctaatagtaaaatgcatgaaaccaatcaaggagaattcattacttctgacagccaggaagctctcttttctaagtcttccaggggctgtcttcaaaatgaaaagcaagatgaaacactttcaagctcagaaattacactgtggactgagaaacagagcaatggtgacaaaaaatcaattgaattaaatgaccagaaatttaatgaattgattaaaaactgcaacaagcatgatggaaggggaataatagttgatgccaggcagttgccttctccagagccttgtgaaattcagaaaaatttgaatgataatgaaatgctttttcattcttgccaaatggtagaggaaagccatgaggaagaagagcttaagccaccagaacaggaaatagaaatagatagaaatatcattcaagaagaagaaaaacaagcaattcctgagttttttgaggggcgccaagctaaaacaccaga

SEQ ID NO: 54094 - DNA, 1405 bp, Homo sapiens
ttaaattagtgagcttcatcagttttatttttaattccttgagataatgaattttaaaagcaataaatacaatgctgtagtttttgacttcttttctaaatatttacatggatttacatgaaagaactaaagagatagtatttgtggaaccaatttaaactcttacatgcctttcaggatttgggaatgtattaacacctgctgctttgtatccagtctaagggagcctatttgtttgttatcacattgacttcctttgatgtcttttagtgttaccctcactcagacccaaggattatgtcttttggggctcccatcatcctgagctagagacacgtgacagggtaaatctctgcccccaggtagaggctgtagccttcttgttttgtttgtttgtttatttttaattcctagactcaaagtattgaatttagcccatggctatctataacctttagttacataaatatggaatgttccatttcagaaattttttttgcaattcctttttttcccctcagggtacactctcctacaaaaccagccagttactcagtaaagtggacgatagaagaaaaagagctgtttgaacaagggctggtaaatagagcaattttaaatttttagtaaaataattctagaagcaaatattggtaaagttataaggttaaattaatttatagagacctgaattttctttttaattacagttttaacacctttagttcttctgtagttagagtaatgatgtttatagtgtagtgcaagagaattccttttaacttagatctaaggtactaaaatactaaaatagatttagatctgtagttttcacgttcttgtggtattatcaaaatccaagaaattgaggtatatctgtatacatgacaccaactacctggattaaaaggcaaaattatttagtaatctctttttttttttgaaataaaataaaaacttgtatatttgaaactgttggggtgatcagctgagtttttattcagataatttggcattgtatacactgtctaaatatttcagcgactctaaatgaagaccagaaacattttttttttgcgtgaatgtctattacactgaaatctatttaaatgttcacaagttgcataatggaaaagatacgtattctggtttctaattctgaaaataccccttaatatgaagaaactttaaaaaaaaatacttaggatttttttttaatttttttactatcaagattagtttatatcttttcctttaaggtgcatgatacctagtaatgttctaagtaattttgaaattatgtatatttatacattacatatatagaatatttgtatatataaaatttatgtatgctaattgaagtatcattaacatttctacagatgatgagaataaaatgttt

SEQ ID NO: 54095 - DNA, 1030 bp, Homo sapiens
ataacatgtatttttctttaccaaaacagaagataatttcaaaaagcaataaataaaaagacaaatatattctcttttttaatagccttggaccttggataacaccatcagtgaagagaacagagctgttattgagaaaatgttgttggaagaagagtatcctttaatgattatgaggaaagtacaggtttcagggtgaaaaaaatctataaatgcaaaatttacaagaggccactgtttactagatggattttatacagcaccagactgctattatataatttcatgttacctatgtatgcaaaaagcagcattttcttcctcaggttctgttttactgtaacatctgagatctgattgcatattttgagtttctgtcactagccaactgtttatgatatctgaatattgagtagaaatgatagaatatttaagtcattttgaaccttaagtccaagcttgcatttttaagttatataagctgaaacccagagatgttaattttccaagggcacagagttggaacatgtaaaagttcttctcacttcataatttacaggtgttacgtgggaggaatctaaataaaaagcacaaaacaaatactatagaatgaagatgttttccctacatttgtggatccttatttatagctcagttttcgtacatgtaaaaggagaggattgaatgaaatgatttctgattttatgatttataaagatagctagtcatagtctaataagtagtggtttattaatctccttcatcttcattttatggatttctccttactaagccagaatttctctgttcccactatttccacttattgccatgttgattttagagtgtctctgtacctttaattatcataggttaaccccatttaggctttcttattctctaattctccccagacattgcagttatagcctagattattgctattcagagaaagtcacatataatttaaaattttccgatatcctcatttaacacaaaggaaattaattttaactatatattatataac

SEQ ID NO: 54096 - DNA, 1096 bp, Homo sapiens
tccttcttccgttccctccttttcaggatctcatcgacagtaactagaacaagagcggctacggacgagacctgaggtcagggactcttgttctatggcttgctagccgtgtgaccttgggcgagtcgtttcatcccttcttccacatggggatagttgtaaaacttcccgagaagcaggttgacttaaatgggccaggttttagagttggacagttctgggttttccttctgcatttgctcgccctaccagttaatagcaatgtgaccttgggcaagacacttaacttgtctgagcctcagactgctcatatttaaactgggagtcatgatatgtaattgggaggatcaaatgaaatgattatgagatatgctttagcatacggtaggtgccctctgaatgtattctttaccatcctgttaccctcggggacagtactgtgagaatccagtaagggatcacattttttaaaatacctgttccagcagaacaaacagcccagtgtgatttgacacagaacctcctttgactccttgctttctgaatcaaaaatgagtctccttttagtcatgaagagtcctagactagccaggaatcagaaagcctgagttctaaagtcagccagctatgttgtttataattatgtacaatttccttagaactgtattagcttgaaccatatgaaattgccaatatttagaccatttttgttctataaagcggcaacttcatgtagttcagcctaatattagggcctctgtgaacaggggagaagtactaacccagcgcttgaggcactaagatagtgtgtttagaagtgtatcatgaactctaaagccctataaagacgtgaggggtgattaaactcatatggtcattgtccctcaaagctttgcagatgagtagggagcccttaataacaatacttgttgacattcatttagtgtttaaatcttgaccaagtgcttttgcatgtttgatttaatttacttttcgcaacaagttaatgaaataggttggcagggatacttatctgcagtctagaaagaaatgagctggccttggaaacactgaagattggtcacctgagggcatt

SEQ ID NO: 54097 - DNA, 3562 bp, Homo sapiens
cctgagagcgacgcgagccaatgggaaggccttggggtgacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagccaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcacgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccacagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttgcgtcctgacggcgcccccagtgtgcacgagtgggaaggacttggcgcgccctcccttggcgtggagccagggagcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgtacatatatatattttttaatttgatgaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaagtttggattgtatcaagtggcatgtgctgtgaccatttataatgttagtagaaattttacaataggtgcttattctcaaagcaggaattggtggcagattttacaaaagatgtatccttccaatttggaatcttctctttgacaattcctagataaaaagatggcctttgcttatgaatatttataacagcattcttgtcacaataaatgtattcaaataccaataacagatcttgaattgcttccctttactacttttttcttcccaagttatatactgaagtttttatttttagttgctgaggttaacattgctgcaatctgaagtgatttgaaaattaagaagcaaagaatttaggaagagtcaaactagaagttgtgatctgaatgaaacagtctcccaatttcattaattctttccctct

SEQ ID NO: 54098 - DNA, 1432 bp, Homo sapiens
atggagatagagtcagtgaacttgaagatgaggaattaggctggccatcttttcctgtaaaggaacagatagtaaatattttagaattgaatgaccataaactatgtcataactcctcagctctacaattatagcatgaaaacagccatagatcatatgtaaattaatggaaatagctgtttcaataaatctttatttaatgaacaggcaagctagatttgtcctgtgaaccatggttttctgaccactgagatagatcaatagaagctatctaatctgaaaaatacagaaaagtaactgaaaaacaataagcagtctcagggacaagtggcctgatatcacaagatgtaacattcatgtcatcagagtgaaatgacagaatgatagaaaagagaagaaagagattagtattagaaaaatatttgaagaaatcacggctaaaacttctcagattcgggggaattcatgtggaggtcaaagtggaaacaggtgtgagaggtccagcagaagaaaacatggctgccaaagtgtttgagtccataggcaagtttggcctggtctaagctgttgcaggaggcgtggtgaactctgccttatataatgtggatgctgggcacagagctgtcatccttgaccgattccgtggagtacaggaaattgtggtaggggaagggactcactttctcatcctctgggtacagaaaccagttatctttgactgccattcttgaccacgtaatgtgtcagtcatcactggtagcaaagatttacagaatgtcaacatcacactgcacatccccttccagcccgtcgctagccagcttcctcgcatcttcaccagcatcggagaggactatgatgagcctgtgctgccatccatcacaactgagatgctcaagtcagtggtggtttgctttgatgctggagaactaatcacccagagagagctggtctccaggcaggtgagcgacaaccttacggagtgagcagccacctttaggctcatcctggacgacgtgtccttgacatatctgaccttcaggaaggacttcacagaagcagtgggagccaaacaggtggctcagcaggaagcagaaagggccagatttgtgatggaaaaggctaagcagcagaaaaaggcagctatcatctctgctgagggtgactccaaggcagctgagctgattgccaactcactggccactgcaggggacggcctgatcgagctgcgcaagctgtaagctgcggaggacatcgcctaccagctctcacgctctcagaacatcacctacctgccagcggggcagtccgtgctcctccagctgccccagtgagggcccaccttgcctgcacctccacaggctgactggaccacagccctgatgatatttaacatcgacttccttctgcccccaccccagaaatcactgtg

SEQ ID NO: 54099 - DNA, 2138 bp, Homo sapiens
gccacttatcaactttattacctctggcaacgttggaatgcaaacccaggtttctgactctaagaaatgaatttgaaaaattattgtaaaggttagctggtcaaacaccagcctttatcacacaggtacccctgtctacagataagacatcattggagcttacctaagtaaagcaaagcaagcaattagaaaatgagagctctcttattttgctgattaattattcattattttcttaataatgactttatttttctatcatttttagtattattacttcactttgattagagaaagcaacttctgatggtttaagttaaaaatcccagataacacatttgtttggcataaatttttaaggtaaatatgaactctagaataaaacgttatcaaagttattaaaagtttagctgttcaaagttagactcaaaatgaaagaatcatacttgagactgggtgagatctgtttcccaccactatgcaaactctgacccagggcctcttttgtttgtattccagcacattatagttacctctccaagagctgactttgtcctcttctttgcattcccctgaggtatttgtagtgagaaagaatgactaaatgatggaatgagttcattacctcttctgaacccaggggtcttggaagtgctgacacagctaagacctccctggaggcttgtctgttcatccagaatggccactctggattcctataaaggctcctgtctctctgaatcctccctgtatggagaggctatggattagataaacttcagagtgtttagtaataaaaacaagcttgatctcaactctgtggccctgtcaatacccatacctgcaccctcttgaaaagctacatcagtgtagcttctaggcttgtaatctgaatgatcagtgtcttttggctcaaaaatgcaaagtgaaggaatattcagaggaaattagagagctgcctaagtggctctatcctacctggcctccgtttctcattatggctttgctaaagggtctgaaccgtggcatggacgtacattttttctcagtaacgccacatgtgtagagtattgatgcttacccaagcaaagcaaaacaagcaattaggaaatacagtctctctctcattttaccgattaattattcataattttattgataataagaactttatttttctatcattgttattattattattattattattattatttcaccactgattagtgaaaattattggtcctggactatcaccagtccctgttctggcatttgggaacaactggtgcgtgtaagccctgaaactctccttcgtgctggcattctgtgaacctgagagagatgagaagagaaccagggactagagtgaagcctactgcagttgtcttggcatgaggctgtgtggcttggctttggctgggagtcacagacaagcccacggacctgagaaagagagtgaatcactgtacaagtatttatcgagcacctcccatgtcctgggaagcagtagctggagagtggtgaaggagtactgagttttggggttcaagtggccagggctttcccccaggctttttacctattatctgcattatctgggcaattcagttcacttatgggccttagttttctgtctaaaaaattgtgttgatatactattatgtatcagaaggtatttgataaattgcagaatgctggtggtattgatagattttcagatgatagtgacagaaaaagttgattgttggaaagaaaattagtgaggtctatttttcatatacttacctttagaggcaggtaagaaatctaagagtgaagggaaatggaattcacattgtttgaagggtaggaaattttaaaaatagtgctttttaatcgtccggaagacttggggagagggtattattcctgtttgagtgggtgggaacagtctgagagacacttacctcatgcagctactgagtgggtagagctggggcccagctcagatctaactccagcctgtgctgtttctacagcagctcagaaaccaaagttcaggggagcagaggagctggagacagtgaatccatcctgaggcccccctgagtaaatgcttccagggcaattccacttgcactattattaatacctta

SEQ ID NO: 54100 - DNA, 1847 bp, Homo sapiens
cacacctgactaatttttgtatttttagtagagacagggtttcaccatattggttaggcaggtcttgaactcctgaccttgtgatccgcccacggctgagtgaacagataaaaactttactatttttatccctccctctcccctcttaaactctaatctactttatgtctgctatgaatttgcctattccagataccccatttaagtagacttatatagtatttatccttttgcgtctggcatatttcacttaacataatgttttcaaggtgtgtctatgctggagcatgtgtcagcctttcttttttatgactgaataatcacatcctattgtgtgcatatactacattttgcttgtccattcatcttgtccaaatggacctgttggtggacatttgcatcgtttctaccttttggctattgtcaatgatgctgtggcgaacattggtatataagtatctttgggtctctgcttttagttctttttggtgtatatctaaggagtgaaattactggttccatagggtcattctaagtttagcttggtgaggaaccaccagatgtttccactatggctgctccattttacattcccaccagaaatatatgaaagttctaattcctccacatcctccccagctcttatttccctctcctttaaaaaaattatacccattgtagtagatataaagtagtctcttattgtggtttaagaattgattttttaaaatactagaaatctgtgggatgaaagtaaaattgattgaatttatatcatcctagaagtaactttttttggcaaggataccccagggagtgtcataaaattaaaaattaaaggtgtctgagagtaaggggagaagcacagttacttctgatgtgcttgatgctaaagctccttgatttgcattgttttatggttgtgttgaaggatgatttctcagaacagtggtatttaaagcagctcttctaagttctaggaaggattcagtcatcctctctcaccagcttattttttagtatatttaatagtgctgagaaataaccagtaaatattagatattctttacccttatttttgagaaagaagagtgttttcactctctacagaagaaatatccttatctcttcactaatgatagtagaaataataggcatttcaaaataacagttacttaaacacataagggctcattctttcctgtgaataaatatagatatatggagtcttgggctactgtgatttccccataaagtcatcaaggacactagcttttttgatgttttttagtcctgagttctattttcaagatcacctcatggtccaagatggcggttgaagtttccattatcaagtccacagtccatgtagcaggaagaaggaagtgggtgtggtgcatacaaaggatgtgcctcacattggagtgagccttctttaaacaatcttcttagaagatctacgtcatacttgtgcttgtatattattgaccagcagctaggtttataatcaaactgaggtgaaggggaatcggggcagtgtaggcttttatctgggtgtcttcctatccaaatattggggttttcttactaaataaaaagggagaattgatatggggtgggtaaaaagacactcaaaatcataatttctcagcaatttacattgaccagtatcacagacaccaatttatagtccaatgatagtcacaaggtaaagggagaaggtggtgatcatgagggagatagtatataatctgagcaatgtaactcacaagtttcattattcattaatacattcattcattcacttattccttacatatatattagtaaagcatctgtgaggcatt

SEQ ID NO: 54101 - DNA, 1044 bp, Homo sapiens
ctccctcaggatacagtgggcatctcagtctttgtgaactcttaaattcatttcttacccagggtggctaactctgtcagtggactattttgtgaacttcatactttcggaatatgttatacttatgtgattcttggtagtctcaagaaccttggtagaggttcaaatcagtcaatctggttaaaggtatcagtattcagtcttggaatcaagtggcactagagctcttaaggcttggcggttttcaggacctacatcacaagatacagaagtggtgtggcttggagctcgtaagactcgtgtctggtccaaccaggtaacttggggcccctggcacccatatcagacttttctcatctgcaaaatgtgctgcttggagtgggtgatttatttagtacttcccaggcccaaagttctgagtctgtaagatgtagtggggttgaccagcatctccttttggattctcctttaaaactcattcctttgaaaggagattgctaaagtcaaaccttagaatccaaccctttgggctatgatttaatgttaaaatgctgtaccctttcctttcctcctttttctcctttactacttctattttgtttctttttcgaaaaaatataccttcttttaaaatttttcttcatttttccttcttctctgtaaattatcaagggcctttgaagagaattcttacatgttattaagaaattgcagtcagggagccctctgttcccagatcatttagaagattgcttttccttttgttaaatacaaaaaattgtcaacctgtattgttaaaatgtgccaaaaactgcattcaccaataaaaaatgtcagctctcattattgcccagatattattcttttcaaaagcggagcactcttgccaggctttctaaacaatcttcagctcattcatcttcctggttttgttacattttgaacctctctgggtctatataaggtggcagcctgtcttttaaaaattaatggattccaaatgccattcaaacctatttccgcccttaacctcctcctcttctc

SEQ ID NO: 54102 - DNA, 1024 bp, Homo sapiens
ccataattaacaggtatccatggagactttttacctaagcagggatgtgtcattatctacactggcttattccacttctttaatacctctgcagatacctggacgggtattttgcaaaatataaaggaagcctcactcatatggtcagttctatctatatctcttctattttcttaggtctctctgctccctggtgtgtaagtggacatattcagcagagaaaggctgggacgacagtttctggaaaatgattggtttggaagactttgttgcagataattacagcaaaataggtaaaagaataaaacatctgtagagtgattatgtgcattggaggatcttgatgggtttgttgttattgtggtttgtatgtttcttgtttttgtatgcatgaaaatacaggaatgaagttcactttttccaagacaaatgagttaattatgatgggtaggccatgactagtaggctcttgccttaagatttatatgaactgagtagagatacatgctatgaaaatctgcattgaaatatagaatcagaaattgcgctgggcatggtggctcacacctgtaatcccagcactttgggaactgaggcaggcagattgcttgagcccaggagttcgggaccagtctgggcaacatggtaaaaccccatttctacaagaaaaatacaaatgttagcctggcctcgtgcatatgtctgtagtgtcagctactccggaggctgaggtggggggattgcttgagcctgggaggcagaggaggttgcagtgagctgagatcgtgccactgcatgcagcttgggcaacagacagagcagaactctgttttgagggggaaaaaaaaatgggctagactgaggaagatatttgcaaggagcagcttgggaatagcatactcaaggggctgtgtatggactgcttccagtcagtactacgaaaataattttacaaattaggttcacaggacaaggcaaggctgtgaacaggtaaaaaataaagctaaaagatcaatattagaaa

SEQ ID NO: 54103 - DNA, 1036 bp, Homo sapiens
tgactgtccagtaattggaaccatctcggctcctctgaaattctaggagaagaataagtgaacagtatgatatcttgcaaagcttcatgtgccttaatcacattaaaattcacaattcagttttggatttatttttccttgttttttgaaagttattgacttgggacttgcttctggatctcagttggacatctgacctcatgccattattgtcatccatttagaggtcatttatttcagtgttcttgaaaggcagccattcccagtggttggccttctctattgcatgtgacacatcgcagctcttctgcttagcttttcttggtcacacagctatcaggtggtgactttggcctccaatgtggcccttacctctgactttgtagctcctctgcagtactcttcactctggttctgtggagttttgactccgagatacccatgaccttttaagtttcccagcaccagctaacctttctgagaatctgcatcagagggctgcagtggtcagggtggcaggtcaccagttgactaatggcctcctccaaggtttgctggcagacactgcgttgccatgaaccctattgatcccagaagtttgcctgctgcttagacagtctttgcgggcgtgaggaggtagtgagtcatggagccaccacccctgctacccatctgttcttgtggtgaggagaacaaagatgatctctttgtggtatcataaaacctagaaagacattaaaaattccgttaaattttcatacgcttttagctgttgaaatgtacaatctattatgaggggggaaaaacccactgtaattttccccccactgcccttacttcagaggctacttaagggaccaggtaatgattttacgatgtttattaatacttcatgttctgcttccctcccccattcatttatctttaaattgaaagcacagaaactgccagggatctttaaaatccagagtttttgcaatgtcataggttgttctgttatggatattgtatgtagagatctattgttgactcagag

SEQ ID NO: 54104 - DNA, 1140 bp, Homo sapiens
gactttgggggacttttgggagggcatgattggttttgaaatgtgaggacctgagattgggaggggccaggggcggaatgataatgatttggctgtgtctctattcaaatctcaactaacttatatctcccagaattcccacatgttgtgggagggacttagggggagggaattgaatcataagggccagtctttcccatgctgttctcgtgatagtaagtctcacaagatctgatgggtttatcaggcttttctgcgtttgcttcttcctcattctttcttgctgccaccatgtaagaagtgccttttgccctccaccatgattatgagacctcccagccgtgtggaactgtaagtcaaattaaacatcctattcttcccagtctcaggtttgtctttatcagcagcataaaaatggactaatgcagtaagttagtaactttcccccatatttttgttagtggaaagatagaatagtttttttttgttttaatggaaagatagaataagaatcttggattctttaaggcctgaacttagatgccagcagtggctgggaagggcacaggaaggtgatagtccatgatgacgggttgatacagacttacttaatatatgttgactatgttttatccttattatgccttcttatgccttcttatgcctctttctttacccttcaccttacagccaatccaagagttggatatctcaaaaaaattaggaggcctgggtgcaaatgtttcctttcatttctacctttcctatacccctattaggatgtggaggtgaacagatgcctgaaaatcttgaaaaggttgtccatgggtccaactctatattaactaaatataattgagtgaatgcaacctgtcagtgattggtctaggcactggagattattagcagtgaacaagtcaggcaaagtccattcgttttggaaagaaaattctcattgttctcccctgcctgcatgtttgtagcttaatagtataggtttgggacagctaatccctgagacatattgtgatgctatgacaagggcactcaaaatggaattttaagttctggatttagattgtgtttctgcctacaaatatggtgcttcgcagaacttttgtctcctgttatgcagtgaga

SEQ ID NO: 54105 - DNA, 1035 bp, Homo sapiens
agaatagatatttatcttacacttagttcttaaggcaactttatacatactattattctatttgtcagatgagacagttgaggctcacaagactacctaacattctgagctacacagttaaatgagagatgcgtgacttaagcccatgctttgtgcacacttatcactgtgttataaagaatggcctacctatttaaacatgatccactctgctctttaatttgaccctaaaaatgtgagcaagtaacaaattttgaaaaaggaaagtctttaatatttattgacgacccactttactagttcatggggttagacagtgactatgagagagaagtggacttctgggaatttgtattctagtaaagaaaatagacaagtaaataaacagttacggttacttgtgccgtgtatggaaggctttggaaaaacataaaatgggcctaaaattgagacttaaacaattattaaaggattcctagagggagtgatgtccagtaatctaattacgacactgctttccctgttattgcttcctggtaaagtggaatttatatattttttgcgacttttaaacttcaactaggcttcatttctaataataaaataataacattgttaattagaacaaatacaaccaccactctgactggtactactatgatgaccatttcttacatgtgtcctatgtgccaagtactctacctgatactgctcagactttatatcttgctcctcacgataagcctacaaggtagaggttgtttccccattctgcatgagggaattgaaggcagaaagaataatgtttccacaatcacataactaatctcatagcaagatttgaaattgagtctgcctccaaggttcatatatcttttctctaggccagtggttctcaaccaggggtgatttgacccctcaggggacatttggcaatgtctggggacagttttgtttattgcttctggggaaagggaaatggcactggcctgtggtgggtagaggccagggatgctgccaaacaccttacaatgc

SEQ ID NO: 54106 - DNA, 1049 bp, Homo sapiens
ttcaaagctgaaaaccagtctgggctcactggagccagttaggcatttgtatatagaaggccaagtgtggcttcttgtctataggagagagaaaatgtggaggaacttttggaaggcttcagagtttttttggctattctctctctcttgcaaagcaatctgggtgcattaactataaatgaatgagaaacatatggattaaattttatctgtgatcacatatgagtttcaagaatgataaagaataaggaattcagtgtttaaggagtccagaatactttgcaagtaattcaggatattgcaggcaacatttggctgcctccctctatccaaatttgaggactgtttggtagggtgacagacctgctcagtgccctccccacccactcagattgctaaacctcaggagatacctgtggataggttttgtgtgtatcttgttttgctgagactgaaataaagagattgggtttctaggaaaggcaaactctatgagaacactcttaaccactttgaaacccccaaatagaagaggaaaatttggtaagcccgatctttattaaccatgtcttgcttacagataatattagatgtgttttatatcctattattgcccttaatgttagtgtcattgtcctgttaatgataatggtagccatgtcctgcacttgtgtagtgatctaatttacaaacaggtacacattacctgttaatacacattacagatgtatttgtagagatgtacacttacaacatatgcagagtatgttatgacaagctacaatacaggaattacagagttaagtgaagatgcaggcaggagtacctaacccagcattgtggtagaagtcagggtttatggaaggcttttcagaggagataacattgagttcagtcctacacatgttcgtttgtttgtttgtttgtttgtttttgagacggagtctcaccctgtcgcccaggatagagtgcagtggcacgatcttggcttactgtaacctccacctcctgggttcaagtgattctcctgcttcagcctcccaagtagt

SEQ ID NO: 54107 - DNA, 1020 bp, Homo sapiens
ggatcctgtgtggcttttgaaccctgagcagccagccgtgggcctcccactttagccccagaactgactggactcaccagcccaaacaaccagccagagaagcccaccagtcccttggtcctcacagaaagcaagtttcatacagctcttgagattgatcttctttgttcaagtccttggccctcagtttcctcatcaatacaacaggaaactcaaatgtggtgtaccttatggaatagctagcattgtaggaattttcaaagagtccttgccgtctggtatatatgagcagtttctattcacaaaaaattggcgtggcctttgttttgtggtgtttgggatttttaaaaattattttcctgaaataaccactcaaccactcaacaaagcaatgaccttggagacatatcaggccctgaaaacacaccaaatgcaccctattcatcattggttgaaacatgttttctctgcttcatgttaaaagtacagaactacccagaacaaaaagtgattttctgcttctttgaagagctgtgacttctaacatcagagcgtatgctactcaaactgctggagaggttgaatgctgctccaacaactcttcaaagcaaacacagagatagtgtgtatgtgggagaccaggagagagtcagggaggaagcactgggagatcttagccagtttccaagggactgaatcccagctagctgtaggcatcactaaacagatccagatgtggaaggagtcagcaactcagggtatctgcaagagctcaatagagagcagaggttgcacccctgtggcttttccgatagggagatggatgatagagctggaagctcatgagctaattgaagtagctttcaaatgatgtatttataagctttggaaacacatggtctctttgatatgagtttgtggatgtttttgctgttatttaacactgatttattcggactttttttttacatatttttgcttatgaaaaatcaaatcctataacaaagcttaatatcctca

SEQ ID NO: 54108 - DNA, 1036 bp, Homo sapiens
gctaagaggaggacatgaaggatgaggcaaacaggagggaccaaggggcaccatcacatagtggtaatgacagttacctttcgtcagacacgactgtgtgccaggcaccaaagacggtgccttgcctactggtagcttaacactgtaaccctgtaagtaggtgggtttgttctcattttacagacaaggggaggaccatttgccgaggtcaaacagctagagtatggtagttggaatctgaacctttctccatctcactcccaggcttctgctctttccactttaccatgctgcattttcctttgatctgtttgtaaaagctacatgggtgaaataagctttcagatattcctaagaatcgtttttacttaatatatattagaaaatatcattaatttggccaggattgtctcacagaggttcctttcctggtaagagtactgcagcagaagtccagaaatgtataaatgaggttaaacttaatgcgggcaggagaggggaagaaaaaaagccagctacattttctcaagtaccacacacttggaaaatcaatcttgtatttaatgggccgtacatgtattaaaagctatcatatttattctgtccattgtcttaatgacctttataataccatgaaaggaaggcattttaagacagagatttttttcaataagccttttttgtggagtcaagtgaattgtgaggggttcagtctgttttgcaaatgtatctggatgtgctgatcttttaggcaaaaaaatgtgcattttaatgaggtattctgataacagatattttcccataatgttcaacttgggaaaaaaaaatgttgtttcattagccctgaatattgccggagcacttatttgttgtcggtcaactgaaagttaagcaaatttctctctatatatagtcatatctttgggtgctgttttgtaggggtgaaatgaaattaaagaggattgtaatcaagttaacttgggactgtgcaaaaccctccatgaagtaaaattctctcttgatcatgcttaattga

SEQ ID NO: 54109 - DNA, 1040 bp, Homo sapiens
gctggaatgtgttgagtaaggagaatactgtggggctcctctctctttcctttctctgctgccaacacttgtgttttctgtctcagactctagtttcactgaattcaaagaaatggtttggaattgcaaaatcctgagatgtcatccactgggagtgctggggatagggggacacgtgcaagagaattggcctaagaaaggttataccctgagtatcttccatatatacccatagccccacacatttttatcttgcaaagtcagttaagatgaacataaggcagaagtggaatcccagcacagttcatcctcagtgctccacagcacggaacagaccttggatatcgtacttcacacaagtttggtgactctttttttatgtctgcctctccactagactggaaattgactgaggacagagcttatgtcataatcattcttcagtcatttttctttcttgcattcattttatcagtaaatgcttcttgagtgccatctgtgtgccaaccactcgtactaggcccatctatctctgcttggataaaattccaagcaagaaagatacagtccctgctctcaagtttccaacagtattgcagaagaggcataccataaaatagcatcatacagtgtgctatgcctcagctttggggaggcagagaaaatgttccaaaggaagtgacagttgagtccagtcaggacttggaagtataaataaaggcgagtatatgtctgtatgtgtgtgtgtttctgtgtgtttggagaggggtatgcatgtgtagtgggcccgagatgggagagaatgtgtgcagaattttaaaccttgggaacaaaggattcatgaactcagaggtgaactcaactgtgtactggatgaaaatgtgaatgaatgagtacatgaatgtataaatgaatgaatcagtgagtgagtttttcagaggcagctcatgaaatggagattgtattagcgtgtttttacactgctataaagatactacctgagactgagtagtttaaaaacaaaaaaaggtttaactgac

SEQ ID NO: 54110 - DNA, 1019 bp, Homo sapiens
cttagagggtggtgaacatgaattccacacctgttccctactgactggaatcaggattcaaaggcaaaaagttgtgtgctttccagcaacattcattgggatccgcagcccaatttaatcaattgataggttgccagtgtctaagtcaagtcccgaaacacttggttccccttgggtcaatgaaatttggtcttggttctaatacaaactttaagttggctaaaaatggctgagaaaactactggttttagagtcagtcaagcctgtgctctaagtctgactctgccactatgagatgtcagatcttggagaaactgttcagttacttctgagctttagtttgcttcccggtaaagggacatactaacacctattccatgggtccattatatacacaacagccaacatttgttgagtaattactatgtgcagagcactgtgctaagagcacagtctatgttaactttttaatcctcatacagacctaaggaaatagattctatattggagattggcaaactactccccacaggccaaattttgcctactgactgtttttgaaaataaagttatattgagacacaatcacatccattcattcacatagaccctatggctgctactgtgctacaactgcagagttaaataattgtgacagcgaccaaatggcccataaaacctaaaatacttactatctggcccttcatagaaaaaagtttgcctctgctttaaattatctcaacttaaagatgaaggaaataagccaaaggtattaaaacctattttaagtaggttagctggggccacaaagctggtaacaggtaggactaggatttgaatcaaacagcctgactccagaacttgtgttagtcaccagtatcttatatataatatatatgaaatgcctagcatagtacctagcacacaggagatacttaatacatctgttttattagcatggtattccctttctttttacctcctttcccagtttcctatcaattccagttaccttttgc

SEQ ID NO: 54111 - DNA, 1050 bp, Homo sapiens
cccactctcactctctacccaaggctcaggcttgtctcacgttgattggccagagcccacgagggcacgtccaatcagcaatcccccctgcgcaacctatcccggttcttcccgcccccgccccgccccgcccgcccccccgggtacctaccgtctctgtgactggtgcgcggccaggtcactcagggcggcggggcgaggtgtgcgggagtgggcaggacgggtgggaggaggggaggggtgggagaaggcggggctcaggtgcctggcagcgcggccggggcccaggaaggggagggggcgaacgctggagcgaggcgggggcgggtgaggagggggtgacgccggacgcgtcgacagcgcgagggttcgcgcgtgagctgcgcgggtcgggcctggtaccgagctttcctgggggctagcaggtcgtggacgccggctcctggaggagagccggtaggagggagtgtgaaggtgtccgcggcgtcgtcgacggcggcgccggccatggaggagacgcagccgccgccgcagcctaagctgcccctgtgcgacagcctcatgatctgggtgagtgcgaggaggcgagagggcgagggggccagggggccgaggcgaggagcctggggcgcccggttctcccaggtgagctggggctacctgcacagggtcccggcgcaccctgcccttctcacctcgtgcccttgaccgagagaatgccacctgcgggtcgacgggcaggtgtgtgggcgcgggttggtgtccgggggtgggggtaaaggaagctctgggagcgtaacagtggaggctctggtctcaaccagaggattcgacctgcctggtgccctaacagctgggatatgaaccaagcacccatcctcttttctccccgctgccccattttctccccctgaacagcgcccgagccctccactttctggatcgccgactctcttgccttggtccgcttgggcgtgaagaccctttccgaaacctaaccctgcatcctcaaactaccttgctctacctggacacaggtggccaggaggt

SEQ ID NO: 54112 - DNA, 1074 bp, Homo sapiens
aagctaaatataaatcattttactatcctttcaagaaaatatattttacttcataaacatcacattgttatacttaattttattattttaatttcctagttgatgagtaaagaaatattgagctctcctccaaatgatgctgttggagaattggagcaacaggtgagtattttagtatggaagaaaaatgttgaaagcaatgttagggtttctttgccaattactctcataaggcttacaaagagagcatatacaataatattttcttctgtgaaatttggtttattcttctgcatgatcccaattgaatggcagtggtgttggtctccagagatttttgtgatcatgttgaaagagttgagtggcattgaacattccttctgacacttgtatatttggaccatgctgtatggtaacacagtgaaatagaggacaattaaaaacaaactctgctaagttttaatttatttaataatgtaatttttttcactgttgctatcctctcacttgatattgaagaaatagctcaaaggccctgtactcaaggctcctttccttcaggactgttttacagggggaaaagacactcttctcccatttataacccaatctgggttatagagtaaagggtaaaaggagaggcaaatgcattaagtactttttctgttatatttttaaacacttcttcttttatgagtgtcgccagtcatctcaagaagtatttcaaaagaaaatgtttaaagaaataatttatttaaatgtaaacatgctgtgttttttcctaaacatttttctgtaataaaactaaacaatgccttctctaatacttgtaaaaatattttgcagggatttacataaaatgtagttctgtgggactgtagccttcaatgttaatgaggtcatgtaaaacaaagacaacaattttttttattattattatactttaagttctgggttacatgtgcagaacatgaagttttgttacataggtatacacatggcatgatggtttgctgcacccgtcaacctgttacctacattaggtatttctcctaatgttatccctttcctagc

SEQ ID NO: 54113 - DNA, 1006 bp, Homo sapiens
atatgtgactgataattttatactctcaacctatcatgataactttgaacatatgtgtgtatattttggcttagcaggtgacatcattctaaaaattagtttatacctaaaagaggagacaaattaattttttgaagtttcatttgtgcatcaaattttagagacttgaaaacattttcttccccaaacaaaggcaggcatagcattttaaagatatagttactctattttctccatatgtgtattgatttgatttcttttctttgacttacatctcctagactctgaattctgcattcagaaggatccttagaactcatctagtatgacagaccaagctatttaatggcttagtcagatctagaatccagaactctagactctaataagaatttttatttttttgttttttttctactggtgcttatgtatgtgtatttgtttcttaggtgactacacttcaagatgaaaagaattcactggtttctgaaaatgagatgatgaatgaaaaacttgaccagttggatggctcttttgatgatccaaacacagtggttgcaaaaaagtattttcatgcacaattacaactagaacaattacaggaagaaaacttcaggtagcatttttaatggaaatcattttatggagttctgtctattataccagtagcaaaaagtcacagtattaacagctaattactaagcattgttaagcatctttaggatactgattaagctcctgaaaataccagatggtataagtggttcctgttatcacagggctaacatccagttaggaagtgggagatacacataaaaacaaaaccatttaaatatgtgttaaggaccaaatcaaggccataggacagccaataggagttcaaggcagtgattgctgaaacctggggagaacaaggagtttctcaaataagataggtaaccctgtaataaatggaaaaaaatgtaaatcgtaagccaagtaggtgcttttcattttaacttgtata

SEQ ID NO: 54114 - DNA, 1100 bp, Homo sapiens
tccttccttttccttccttccttccttccttccttccttccttccttccttccttccttccttccttcctccctcctccctccctccctccctctctctctctcattctttctttctttctaacatagacctttaaaactgagaggcactggtttactgttgtcccccaaatttgattgcttgtctttttgttattgtttagtttgaaactttttctaaattctgttgtgattttttttcttgacttgtgggttatttaggaatgtgttgtttaatttacaaagatttaaagcttttctagacttcttattgcgactgatttctaatttaattaacctttattattagagaacatggtccatgatatttcagtcttttggcatttattgatacatattttattcatcatatattttattgtgttgagtgttatatatgcatttgcatatatagtcatgcaagttacaattatataattataacaaatcatggaagttataaatacttacttttttatttgttcaaggcttgaagctgcaaaagatgattaccgtgttcactgtgaagaacttgaaaagcagctaatcgaattccagcataggaatgatgaattgactagtcttgcagaagaaacaagagccctgaaagatgaaatagatgttcttaggtatggcatgtcttaaaaaatataattatgccatttctgagctatttagtcaatttgagtatttcatattttaatcagggattcataggattattcctgtatatcaagtattgatcagtttttaatccaggctgatagttttaacttcttttatgtttgttgtttgggcttgcagttcatggataatactcaatttttattaggacattttcacattagaacccataaacccaaaatgagacctttaattaaaattttataaatggagtacttatagatacatttaacttgacctccctgtacctgtcatattttgtgaaatttttgtgtaaggaaatttttgtgtaaggaaatgtcaatccatattttgacatttgataaactatagatcaaatataggcaagaatcctaactttttttgggggaggattgt

SEQ ID NO: 54115 - DNA, 1035 bp, Homo sapiens
gatctagaaactttcttattgccattataaggtatatattaaaattttgctcaaactatagtttcttaaatctattgcttttcttttatgtgttttctaagcatatactatttgtttcctttagcgaatagtttctaaattaccaaagtaatataatttctattatctcttcaggaatggcataataacaatttaatgatttatagcataatcttatatggtacctataaaatttgactgcttttttttaaaggcacagtcttgcagtttacataattttttcttaaacactttcagaagcttttgttggagtttaagagtttcataccctaccagctatgctagctggtcctgcttgcatcttaaaatggtagctattgagtggacaggaatttcctttttttaactaaagaatataatgactcatatttttaaaaattaaaaaagattttgctttgtaacatcagggaggtgtttattcgactgcaacatgaaaataagatgcttcgcttacagcaagaaggctctgagaatgaacgtattgaggaacttcaggagcagctagaacagaaacaccgtaaaatgaatgaactggaaactgagcagaggtgatatgctccttagtaactgaaaatcttggtgattttattaccgagccataaaatcttgattcacagaaatggaaaatattattgtagctaaagtaattagaattacctagaaatagtttaatatttttgttagtagtctttcatcactataagcttctctctgtgaaagaagtcaggtgattcatttcagttatatttataaaatatatggataatccattaatttcagcattcttggttaaccaggctacttattctttttattctttttgagacagggtctccctctgtcgcccaggctggagtacagtggcgtgatctttgctcattgtagcttccaccttcccagttcaagtgattctcatgcctcggcctcctgaatagctgcaattagagacatgcaccaccatgcttggatagtttt

SEQ ID NO: 54116 - DNA, 1207 bp, Homo sapiens
gctttgactttcaatacaagtaaatgcttatgacccatcttacaataggctgagcaaagagcgtattagagaattgcagcagcagattgaggacctccagaaatctttacaggaacaaggttccaagtctgaaggcgaaagtgtaagtaacttagaaattataataattctgctgtgtatggcttttctttaatagatcatgatgtccaaattaatcttgtattggaaagtacagcccttatcattgagaatacccttaaataccgtatatatctgcataatagatgcagtgattttgccaacttggagcctgtcagttgatcatctacattggaaggtgatttctgtctgtcctgcttcaacagctataccaaagttcgtgataattcttaatcatcattcaacatcatttagcagctataccaaagttcatgatgattcttgattgagagcatactacaattgaggccttcatagttctgctggaattccaacagggctggcctgagaaaaatccaaatgagagtaattagcagtcagaattgaggaaaccttctaataggaaaagagagaatgggaaaatgatttctacctaaagagcatgccaaaaatggattatacccgtctctgaaggacagaaactttaatgcagccttggaggcatcactcatttctttctccttccttaatgattcatggccttaccgttttctgatggattttgacagcagctactgtgagagcagagataagaggatttaaaagagatcaaacttagccaaaatctgactatacctagcaacttttctacagtttgatctttttatgtgaagagaaaaagaagtaatgattgagggattgttgtacttaattaaaaataacaagaaaaaaggactagatatgtgttagggatatcttgattgattgagattagataaaatgctaggtgattatacctgtgttgatgggggaggaaactttgcagagtaaagagatgaaaaggaaaattgaaagagttgcattttctttctgtcttttatgtgctttatattattttcttttttttttccctgggggcttggaaaatagaaatcgtctcatgcatggcggcatctcatatgtgcatatatacggtattgtaacttctctaatacaaatattattttaagccatactagagaatacttttaaaatgaggtattttgca

SEQ ID NO: 54117 - DNA, 1022 bp, Homo sapiens
aaaatttttattctgaataaatgatttttaaaatattttaatgtttgatactcctcagtatatcacattcagcttgcatttggtgtttttcaagttcagatttaatttttattacattcagaaacatgaggcatttttctttctgtttttgtacctttttatatttcattttctatttttcctttcctttttgaagtaaaaaaagaacctaaaaagtttatgcttcttaaagtgtgttattggaaatacaaattttaaaaatatttataattttgcctggtacaccttcaaaaggaggtaaagagatttcgatgtctggaaaattgacctttgtcaagatagtcatcttacagcaattttttttaaattttatagtccagcaaattaaagcagaagttggaagctcatatgtaagtaaaactgatatttcttttcaaatatgagaagggaggggttgtaaaagcctctaaagttaatctccttttcggattttgtctagaaaagcaaatatcctgatgctaattgatacacctgctgcaaaagtgaaaagcatgctaaagattcagcctccctactacccccgttccaaactcctacatctttccattgttaatatcatttgaaaagtttaaaaaaacagattaactatcacaactagattatatgggatgttaaacctataaaatattttactttcttaggaagcaagggtggcaagggaaataatttaacctttttggcacctgccgtgtgcctgactgtttacatcctcatgacaacccctgcagtcatgcagatagtattcccatttcacagatgaggaaccaagggtcagaaagcaacttgcccaaggtccacaaatgttatatggcagagaccagtctccatgctttttctaccacttagggaaaaactcacagaggtccatgaagaattacagaagaaacaagaactcattgaagatcttcagccagatataaatcaaaatggtaggtatctgtgaaaacttggatcagacaaca

SEQ ID NO: 54118 - DNA, 1071 bp, Homo sapiens
acaggcattatatggctatccctgactttctaatagagacctgctataatgtttcttttaaaattatgcaaatatgatttcatctgggggatataaacctgacctttaccgtttaaaaaagatactgtgttgattcagtcaatcacatttttcttgtcttcagccgtttctcacctgaacctaaacaaacttattaatagtggaatttctgggagaaggaagtactcacagaattccagtgaactcctgaactaaagtggaattcttagttattaatcatgcaaaattatattagtaatggcatgctctcatcaattagctgagtctttaaattttaaagatatttttgtgttagtggttatattatttttatgagccttaggtaagtatgtcactatggaattctgtattcttagatttataattgagcacgttctggtttcctttgcaaagtgttttacaaagctactgtatttaatactgtagtgagatttgatgctattcttgaagtaaatatatacttccttttaataacatatgcataattgcagagccatattgaattctacatactggccttgaaattctcataaatggtactcagtttcttttttttttttcttttgatatggagtcttgctctgtcgcccaggctgggttgcagtggcgtaatctcagctcactgcaacctccgcctcccaggttcaagcaattctcttgcctcagcctccctagtagctgggattacaggtgcatgccaccacgcccaactaatttttgtattttttgtagagatagggttttgccacgttggccaggctggtctggaactcctcacctcaagtgatctgctctcctcagccttccaaagtgctgggattacagacgtgagccaccgcacctagctgtattcagtttctttttaaatcatctaggaatgttatatttcaaagaaatgcactctatttatgtgcctttttcttggtatttgagcaagtaggtatgaactgtggtagaaatatttttatttaaagacttaaagactttaacaccccctcctccctacatcca

SEQ ID NO: 54119 - DNA, 3406 bp, Homo sapiens
tgtgacatgtctgctcataggtggtacggtgatggcccaaacacaaaaatttttataattaagtctaattccaggccattcttttaagttactgttttaaataattttaaatttagtgattaaatagagaaaatggattttgtgccttcttactagcattaccatttcatagattaatcagcttctgaacccttattttctataaaaatgaggaaagccttagctttataggttggttttaaggattaagtgtctttatgtgagaagcactcggcaaactctgtttagtcatgttaaataaaaaatatatgtttttttttttcagagtctagcattccagaaactggggatggaatctagacttgtgagcggcggtggtgcctgcagtgacactggtgcgtgcactcctgcgcggtctttcttagcgcagcaacggcacatcaccaacaccagaagaaatctctctgttaaagtccctgctacaacatctgattaaactgcaaaaaaaacaaaacaaaacaaaaaaaccacataaaatagaagtgtccttaaaatattttgtacctttcaactaactaccagattgaaaaagagtttatgatgcgggatatcaggtattttaaaatcaacatgcatcaaattaattttgccagttgactttaaaaacaaattatagaattagccatctctctgagggagcacatttgaataattggagatgcagttatacacacatttcaaacaaacatttgtcttttgagagtattataatttcaaattggccttgtatattttagttaaatgttttcagttgtattagtaacttaattaattttcaatagctattcagtaatacttaatcttagaacattaattggatttgtttaatctttttttgttttttgttgatttatatgaaaacagtcttgaggcagggacatggagaactatgcaagggtgatttctttgacttaatatatacaaggctttacttctgtcccctaattcttccattgaatgtgtacctctaccttgtcatgtcatggaagatacaacatttggaagatctgacaattggaatgactttggaataataaaattgactaattggaaattttgcatattctgaaaatctaatctcatagttctaatttgtacctatggcaaataagggcttctggacatcatgtttaaaatgttaagcataagaaataaactgacatttgtaataggtgactttctgatggaaagcaagctatatatatatatatatatatatatatatatatatatatactttttgtgaaatgtctatatactttttaaggtaattaatgaagatttcagttattgcttttaagcataaagttgtatttagcttctgctgaaaaattgtatcatataataattttgcttcattgaaaagggatgttgcagtgatgaaacaaggtgggatcagtttgattttgtttacttattaaggagtttatcttgggctcagtttgtggtattcagttcgtttctgcccaaagctcttattttcagaggtgttacttttgaacttttggggtcatttttaaaagttagcacttttgaattttagttgtgttaaatatgtgctgtcgtatatcatagccatgagccatatatgacaatttaaatttaattaattataaactcagtctcttggttgcaccagccacatttcagatgctcaatagccacatgtggctagtgggtaccatattggacagggcagctatagaatatttccatcattgcagaaagttctattggatagtaccataatctttttatagtaacttggaaatactatttgatattagatgttagaccacaaaaagaagaaaaatgttaggactatttcagatataaaaaggaactgaattgtgacataattagcatcttacattccatacagttgaataccttatgctgtgacaaccatagttaatcatttcagtgctgttcaacatacatacctatcagcagtgtgtttagaccaggggtctgcaaactttctgtgaatggacaaagagtaaatactttagtaaatgtcttaggctttgtggcctacatgatctttgttgcaagtactcaactctgccattatagagttaaagcagccatacacaatatataaacaaaatgggcatagttgtatttcagtaaaactttatttacaaagacaggcggtaggccagatttggcttgcatgctgtagagctgtggtctaaattttattcatagactttctttgcaaatacagtgtgagtattgttccatttacagtattattattttttagatacctggtttttagattcttgcctggtaactttttactgaaaatacaagaatttcgtactgcatttgcatctccgagattagggagcacctgtcaggatatgttgttctatcagggttacttctgttgactacctcttagattttgatacagttatattgttgagtttcattttcatatattcttgtagtgtctgcttgcctgtgacttctggtaaaataaaataagcctttgaaaatattttagcatggtatttaacattttctaaatattatggcattttgacatattttagtcagcgaagacatctgcccctttggtgtttctacttgcttatgattgagattttacaagcccttcaaactccgttttaaaggaatttattgtaaaacattaactttaataaattagtgttttcacagatcagatcattatacttggaacttctaaatcatgcaatttctgaataaggacataaggctagattcatttttcttaatagagaaaaaggaaatttctgatttatcacttttctagttgataagtaggattcaaaacgtttgatatgtaagtatttatataagactaatgtaatttaaagttctgtattattgtgattaatcatacagaaattcaggaactgatcagaagtgagattcttttccacatctggttaatgtagtgagttgacaccctgtgggtggtaaagcattataaacatttcatcttgaaccatgatttatacacatctgtgttataagggaggcttgagtacatataccaatgaagagatattcagcatttgtctatttgataaggaattaaatgtcctagtgattataaagtaaaaccacagaccaatttgcaaatgatcttcaatgttaagcacttgctctaagattaaaattccttttctttttaaggttaagggtgtgtacgtatggcagtgatgtctatgttgagattaacttatgtattgaggaaaatttgaagtttattttttcgatgaataaggctgtcaaatgatttagtatagattaatgacatcttttttagaaatattaaagtgagtattcc

SEQ ID NO: 54120 - DNA, 1070 bp, Homo sapiens
atggctgacactgaatattaattcaataaatatgaatgatttgtatgcaatttaaattttaggttttgagctgatgattctttagtttataaatgaactaaaagctgcctgacacacaggtgtttaaataagaaagctaaacagatgactaaaaattgtttattgagctgaacaaggacagttaatactacccgggttaacaggtgcttaattgccatttcctgcccatggaacatgttcccaggagctgtctgctccagtgggttcccagggcactgaagccttgtgtgaagcctctctttgaacacctcttctagaggtacgacgtgtgtattttgacaatctgagcccaaagtggcccaatattttcagcaagattcagagctagagcatcttttgcaataacaaccagtttagcttaaagctggaggctgtgctgaccaaaacgaaagacagccaatgcttacttggcaactggagcacacagccagttgcagccaaaatgctatcgccccattcacaatggggtgccaatcacagcagtctagctcttccaggaagggtgctcatggtgtcccacctaggtcccctttatgaggccaacaacccatctattggtgatgtgagtgtttgttgctaacagctcagagctatcctcttcctgtgggaaatgccgttggcaccaaagaggttatgcctcctctctccctggagatatactccaggaaatgagtgattaaggtgggtctgcagaaggctggcctcttgcctgaagatgaggcaattcatctcgctccagtacttgctgcaggattaggctgaagctagtctccagttgagaccacatctgtagttttttccccttgcctgtcctggtcctcacactccctttctcctgggaatataccctttaataaatcatttgcacaagaatctccatctcagactgcctctagggaacccaatcacatttaaagcattgaattgtttcttgggaaacctaccaatgtaagtagaaaggcatctgtgatgccacaaagtaagacatcagagagtcatagctaagagta

SEQ ID NO: 54121 - DNA, 1078 bp, Homo sapiens
cgccttgtaaagtccccacaatgctctaatccagggctctgtgtccaaccccatcacataggggtttctgttaaggaactcgatttatatttggcatactttgtgcatgcagcaggtaagtgcgatggtgagaattcctcccactttcttgtgtgtgtttctttcctgatggcctccgcgttatgccggattcttcctgagctccccaagttgcaggccacgtacatgaagccagtgtggtttcaaagattgagagaggtgccaccttcattcaggtgaaaaagcatagctttgagcgaattctcactaagttcagctcttttggtaagtagtgttttcagaggcgttggtaatcagatatgtgatatgtttaaatcacattttttgatgaggggatgagagaagcctcgtgaaaacccttttaataaagagtatattttaactgacaaatgatctagtttaaaagcatttattttggtattgaggcaatatttttagttggttttctgctgggagtgtttttaacctactgaggcctcttgaaccccttgccaattaagaagttggaggtagattactatcaaattgctgatcatttaggaaggaaaaataatcacattaatacgcagacttagtagctttgtatttaggaattcttagtgttgtctcagatagctaagggaaacaaaccagctctttcagtaattgatggagaggttaatattaaaaataaccaacctgtatattgcatgaacacattgaaaaattgctattgataattgatgtagtgagttgctttgattgtaaaatcttaaattttttttctgttttttcaaggcatgtcttacctgtgcatgtttcagtgtttagaatagcatgcaggataaaactattgaggactggataaaataatgcatttttactttgttcctttcgtcttgttttagacaaaaggctcattgtgctatgtgaacgctcaggtcttgtgtaacttgttgactttatatatgtacatatcggtcttgctagattaccttcatggcagttacttgagccagatggaagaaagagggttgtg

SEQ ID NO: 54122 - DNA, 1957 bp, Homo sapiens
ttgaggagtccccttttttcctcccctgggagagtttaaatatgatgctgatttcttgtcatcttagggctcctcagctacaacaaagttaaatggtataaaagcaaagcccaaattagagaccctaaaataaccttggagaaggagagttctcagttatcagtagaattgtcttaggaatttgaggaagcccttgtatacagtgaaaatgagaccctaagttaattaacaaaatgaaaataacttacagtacatatctgccacttccagtactgctataaataattgcaagtgtaaggatttttagtgcaaatatgcagaaaacatgggcatagaaagtttagatgaccttaatgaagaaacagagttggctctgaaactgtgcttagcaggaacaacgttttgtgcacttgataaacactgtcagttgttaaggcatcttctgataggtgaaaagcggttttttgatgcagtactgcctggcatgcatcttctcgatggtctgttatcttgtgggaatgacattcgttaagttgttttctgtgtgcatcccacccaaataaagaatgtttcatcagcaaagtgaattgccgtatagtcatcagactctagaaataaattatcaacgatgactgcagtgggtgaggctgtttgtttatcacatcacttgagaacagagtaaagtgagtttcatattttcctgagtcttgaattctcattttagacatctgttcagaagctttctaagccatggagtattctaaatgagcattttgttaaatggatgaaggaagacttagttttccattgttaggtgaaacctaattaaaaattaaataatgaccttgtgttggcttgtaaattccttatttcctgcatgtgtgagtgtattttgttagaacattccattttaaagcatgccttttttatgacaagaaatacttttaaaatactatttgcttttgaaattacagtagggaatcaaaggatagtctcttgttgagaggaaggtattagaagcatgtagctttatgaactatattttctgtgaatatagcagaattagtttaattgttcaatttcaccctctccagcatgattgcacccatcagggcagttaacagagacaccgctatttgtgttatactaggaattctttataaacttaataaatgaaagctttttctcttataggcccgattctctagtggacttctggtgaaattatgtggctaccttccattaatgttaatggaggttatggatataaatccctccatagtgatggaagaatgagccccagagagaagaatgtttctaatgaatcactggattgtgatataggattaacttggtgtccctaataccatttttttttcctcctgaaagtttaaggtcttatgtttaggaactagtttctctccaccttaatcctttattgtcaagtctgcaataatgttaagaacaggaaaaaaaaatgtagattcctggataggcacagtttttatattaatgtaactatataggcatagtttttatattaatgtaactatacagcacctatttttgtgttttactattacttggcagacatcttgagtgttttacaaggttatcgtatatttcactaataatcgttgcttgataatttggtgtcctgacagactgcagtttattatttagtattaaagctctcaaatgtatttattgagcacctgctgggtacaaggctttgagcttagtgatgaaagcatatgacatagtctgtagcctcaaattttctataatctcgtgataaaagtaggtaccagttcattagttgctttccagtggggcacaaattatggaacatcgtctggctggccgggcgtggtggctcaagcctgtaatcccagcactttgggaggctgaggcaggtggattgcctgagatcaggagtccaagaccagcctggcca

SEQ ID NO: 54123 - DNA, 1089 bp, Homo sapiens
aattgaaattgggtgcaagggcagatttgcatgtgtaaaaacctttctgttttaccagcttttatcaaattatttaatactgggcaaaacagattcctttttcttgaagctgagaaagatacctcctcctagaggaagagttgcttcagtgttctaggaagaacaattggttttgaaagacaataaaataatgagccattaggatcatgttttgtaatatagggagttggtgtggaagaggagagagaggactgctggtgtagtgagttcttgttctagctgtgtatgatcattggccagtcgttcagcttcttggccttcagtgcttcctttgactcaagtcaattcagcaaccatttattgaggcaaatgtgaggatgttctgtgggctacctatttagctaggcattgtggatccatagacaagtatgactgggtcctatgcttatgaaactccaggtcttacaatggaaacatactgtggttgaacgatgtagagagtgttgtatatgagatatgggtgcacaaaaacaggaaaagtcaattctgtctggtgtagacaggaagaattgtattacaaatccttcttaaggattttctattttgacatgcaagaggagcaggcattccaggtatttgaatactgagagattcaaattatcagcaaggttctttccagttccacgtttgttgtgttatcagtgtaaaattatttgaatagctttccactgatgagttattagctgaaaagtgtttattgtcatggttgaaagaaaataataatgaaagaagaaacgattacctttagtgataaagttggggccggatgggacgaagcagtgcaatttttttctttataattattcccctatttgaaaaatcaacttgtatatgaggcagcaaacaccttgcagagcagcattcccttttagtttcaggacgtggtggtggatggaaccactgtaacctggcctccctccatgagaggagggaatccaggtggccatgttgaaatgtgcctgtgtgcagcaaggcttctgaaatgacaagagagcccagcagcttccaaagcagctgtgactctggatc

SEQ ID NO: 54124 - DNA, 1079 bp, Homo sapiens
tgcgttaatttcctgtcgatctttcattcagcaacagacctagagatggggagcagacactgccccccccacccaggctttttaagactgtgctttgtgtagattaaaaagacgaaggaaaaaagaataaactttttccaaacaagatgtccatgtgcattctttaagatcctgtgtgtgcttaaaacgatcctgtaaaaaagccctctccataattttgaacctctcctttttctaaagacttttataggcatttttttttcttcttctcagcatgtgaaccaatgtgtaactcaaatagatgttactttgctgtttacttagattgttttaaaaggctagctgtgtggaggaatgaggaaggaagggaggcgggagtggctggagtttttttttttctctgttgacctaatgaatgcagttcttaaaaaataataaatatttatatgtggtcttaatttttaatgagtctcataaactggctggtatagaaaagtgtatgaaaagccatatatattaaactatagttattataaatacatgcatatgtacactagaatgttttatgaggaagggaacttactagtcttgttcactctttgttttcccagtgtctagaacagtgcctgacatacaactggtactcagtaaatatttgttgagtgaacaaaatgaatgtaaattgacagcattgcctagtgggggtaccattagactagaattcagaaaacttggagtctggttccatcactgccattaatcaagaatatattgttgctgaaatcacataacttctttgctcctctgttttttataaaaaactgggactagcccagctattcaggagtctgtggtggaaggatgacttgagcccaggagtttgaggctgtagtgggctacgattgtgcctgtgaatagccactgcactccagcctgggcaacatagtgagaccctgtctcttaaaggaataataggggctgggtgcggtggctcacacctgtaatcctagcactttgggaggctgagggggtggatccagaccagcctggccaacatggtgaaaccccatctctctaac

SEQ ID NO: 54125 - DNA, 1030 bp, Homo sapiens
tgagctcaagcaatcctcccatgtcagcctctcaagtagctgggactactggcatgtgccatcacacctggataatttttaaaaattatttgtagacacagggtctccctgtgttgtgtgggctggtctcaaactactgggctcaagctgtcctcctgcctcagcctcacaaagtgctgggatttgaattttcttaaacctaaatcaatattataggcctcaccttaggagaactttccaaaatattgttagtgttgaccaccttagcattacatttgctaacgacagtcatccaggtttactgaaccaggaaaccaactttcaggttaataagacagtttcgtctatgtgccatccttatccttgtctggacatatccatagagcacgcattttaaatctgaaagaatatatgtagtctcccctaccccagctttttttaagtagcaagggctattgaaaaaaatcagaaccctccgcttacgctcgcatacatgtagcttaaaatatatgttgcttattgaaagcattgtttaagttgaactcacgagatatactacatcatgtaatatgtctgcatttgtccatgcattcttttcggaaacctgatcttacttatgtctgcatttaacagataggctaggttaagttatgttaaaacatgttgtactgaggttggattcaccgtgtcacagcctggctttcttccttgattagctttaatcaaactctctgcattccgtgaccttaataaagctatttttcctgacaactgaagactgtcttaacaagcatagttcatctgtgctgaaactaaggctgagttaagatggggtttaggtcctcattaaagtccacagcatggagtgtaagaagaaatgatgaaatggtgctccctgaaacatctcttctttaaatttaattagacaaattatacgcaaactagtagatgccctgggaaggcaatcaacattagggctaataaaaagcttgagtagtataaaaaggctgggggaggtgctgtggagcct

SEQ ID NO: 54126 - DNA, 1061 bp, Homo sapiens
attttcatttgttttttttcacctagtagtgcttaatgataccatgtgaatttttatagtcccagctgcactgaagtgtgtgccctgaaacttcggttggattaagaaaagtagcttggtgtgagggctgaaattggtgaaatgggagaacacagggttgcatctatatatattgcaattaatattgacgagtgggcagaagtccaacattatcctagggggttggctaatgttctttgtacaccaatgcaagtgagtcttttccctccaggtgtgaatagtttaatttagtaggtcgattagtagaagcaaggggtgttttcttgtattccagtttacattatacactcaacattaactagctgtttaaggtacagtgcattgttgagtagttgtggtacaggtatcctgagacgttgctaacccatcttggtatctccagggcctggcatctaatgtagtaggtactcattagcatttgcaacatgaataggagaatgaatgagtggttgttgtggcaaagtctcttaaaaatcctggtccctgcgtacctctgtagccttctcatctccccaccttctagcaataatattctatttgtagcttgttaaatactccacattctttccggcctttggacttttgtacatttcattccctctgactctcacaccaccttccctgtcccctatcccctttgtctggctaattcccgctggttctttatgacttagcaccttctagaagacgttttaggaggcatcatagtgggtattttgttgaaggcctggtttgtttttcatatctctatgataacatatctctttgggtaacaacagagagctgctgactagtggcaccgttgaaagctgcatatctgaagcttcttttcaggagaatgtggatcatttcaggtgcctgcatcatttgcatgtacatcttccaaactctattggtactttccatttagatatgggcagaacatgatgctacagtaactgaaacagaagttaagttagcagcagattctcttccatttatagcatcagtatcagggtaaa

SEQ ID NO: 54127 - DNA, 1033 bp, Homo sapiens
gtgattcaaatcttgtctgtactgctgatgggctgtgtgactttgggcaagtagcttaacttctctgagttcccctgtctctgttttttcatttgtaaaatggagtggaggggacaatattaacttgcaggatggcttgatgatgagaaatgataaatgtcttagtctatattagatcttcagtaaatggtagttgttttgaccactgttactgcaatgagccaaggtggctataagcccttcagtgtttcagtaaggacaagcttacaggtaaccaccaagatcagggcagaacagctgatttaggtctaaacaggttccatcgtgtgtcttcaaaaaggttttcctttttttcctctggagaaaattcagactggtttaagaaggaaactgagagcctcttccctccctatgttctgagtgtttcagagatggccagaaatggatactagttactaagcaagacctttaaaaaatacacgttacaaggcaggttggtatgaaggaaagagcactgacccgtgagttattctcgcggggccaggctctgctccactcagctctgtgttctctgccaagtccctttagatcaatgtgtcgcatgtccccccattgtgagttgagtacattggaccaaaggattatagtttgttttcttcccaggcaagtgcctcctcctgatggggagttagtatgatgtgggtggccccagtaggactgggctggtcttactgttctaagaagtgttagcagaaaaatggctaggcattggagtaaccctgtgatttgacattttggggcatcctttcatggtacgatacacctggccaaaagtctcccagctcagaaattctataactagaaatgctttgaataaatatatactgagaaggtattttggggggaaattttaaaattcttatctgacttggctagagcaactgcttacgacactggacttcttaggggtatcgataatggttgtctttgaatggggagtggatttctcagcttcctgggaacagcaacaaaa

SEQ ID NO: 54128 - DNA, 1050 bp, Homo sapiens
tggtgaaatcccgtcactactaaaaatgcaaaaattagctcggcgttgcgtgcgcctgtagtcccagctactcggaggctgtgacaggagaactgtttgaacccgggaggcggaggttgcagtgagctgagatcatgccattgcgctccagcctgggcgacagagcgagactgtctccaaaataaaaagaattaaaacccttgagaaaactttaaaccctcctggactcatagagctggaggggacctaagaggttatctcctctaagccccattttccagataaggaaagtgtattttccaaggtaaaataagttttcaacagtgaatatccttcataatggctttttaatttgtactgtcactggagtcagccctcatttgccatgttatgattatgttcttcttgtgggacttgtatgtatttattagagaccattgagacgtagcactgggcattacttttgtggcaaaggcaccagggcagtaatcattattaatggatttcattatttgggagagcattttactgactatagagaattcattgcattgatctattgtgccacagttttattataccgggtagtttaaaatgatattctctaaactgttaggctgaaaaattgtccagtgttggcagttatcccatcagtaagacattccttttactaccgaaaatacatagttctgtcgaaagagaccttttgactggtccccagtgccctgactgtgtttaaatccctcactagtgaaataggaggattactactgccatcattgttctaaaacaaacttccttttggaagataacagcagcggtaaatcagatgttgaagaaagtaccagcttaacttcactttgctttaaaagggtttcctctttaattgacaagtgtcatgtataatagggcatggcaactcacatagtaaaccttgtgtggggctgcctgctggggttggagttcttaatgaacatacaagtgaatacactgaggcaaaaaaattaaagctctccaactgtggggtattcattctgttcactgtggcca

SEQ ID NO: 54129 - DNA, 1043 bp, Homo sapiens
gtgtccttaccctttgggctgaaggaggcatcctagtaccagggttccacgggcactatccgtattcttagtttctatcatgatagattatgctgggaacttgttccttttagcccactatctgtcccatggaaaacagtactctgaatcagaccccatggagggtggaacattctgattagccagcaagggcagttaggcccgtagctgtggtgtctgctgccacagcagaatggataagcagttctcagccaccaccccccacaacataatccataaaactctttcaacctttttttttttttttgcatgtctagtgtttgcaaatggaaaatggctgaggaaaaacagagtgaaagtttatataaaatatttataccttaaagatcttttatcttgtgtcattcaagagagaagtgaaaaatgtattgggagtacattatcaagagtacattataaatttaaatctcagattgaataatatcagctgctaatgtgtggagctttggaaatgagtcacttttgaatctcaagaacttaactgtaccaggtcagttacacttaagaaggaagtgccttttgaaaaaagaaaaatcctataccggaataaagacttatactaatgggcattaaagatcaaatacttgacataatattcatgttagaatgtagctacataggaataagttgtaggatctgagacactttatggaatgtttctcaaaaacaatcaaataattttggtcttttctttgtgaagcaatataacctgtggttacgagttatgtgtcttagaaagacttagatttgaattctctgtctgctgcttgttagctgtgccattttggatcagttcttttctttgagactcactttattttaaagcaaagttaatatacctacctaattggttttttttgtaaaggattaaacatcatggtatttgtaaagcattcagcactttgcctagaattttatagttccagtaaatagtagctatttttatcattattgtcaccatgatattgtttttagacctaact

SEQ ID NO: 54130 - DNA, 1024 bp, Homo sapiens
agaaatgtcaaagtaaggaaggagttgtgtgtattttcagtcttgacttcatttactgtaagtgccgaagcaccaagtgggaggtggtttgggaagtatttctgatctaaagaggaaactccataaatcacccatggtaatgtgtctcattagcaacactccaagtagatgaccaacattccgaggagatgttgctcattttcatcctgcatcttggcctttgtgcttacctggccctagcttagattttaaaatttaaacatttttgtttctcactcttgaaaactttggtactcagattcttaaactcctctgttaaatagttttcagattagcctagtatagcgttcaaaactggaaaccactgccagaatcctctaatgtgggggaaaacatggctattatcattgaatgtgcctccaaaacctatcaaagttggcagatgtccatgtgtttggcttggaccaatttataaaacgttcacatgcttatgaaaattgttatctctgctattcagaatagttgagtataaaattgagcagaaaagcataataagagaagaagctctgctatgacttgcagtatttttcttttgatcactgaatactacaagaaggatcttttgtttgcgtgtttgtttcaaacttttccatgtatagaggtgtcttaggtgaagtgacaactaatgacatgtggaagtcactctctctggtgttctgtttcttctataactaccctcccttcctgtctaaagagagagggaatagctcctgaattaggtgaaacaaatagtttttaatgtatggtaaaaataagtcattcttcctctgttggcaaaattcattgtaggtgcctttcagtgtagttctgcaaatgttttttccattagttggagtagaaaagagatgaaggattatcagttgtcaggtatattttgcttctaccaaagatgatacataaatatgaaatatttgcagaacaagctgcaaaaccactaggtcctagaaataaaattctgatggtt

SEQ ID NO: 54131 - DNA, 1062 bp, Homo sapiens
ctctttaagctgacagaatagcagcgttaacacaccctaagctgcttttagtttttcccttttttcctcacattttcctgtgctttgtgtacagtgggggtttgtattttataagaagtctctgatctatgtagtatgccattcgctaacaaaaaccaaaataggattgtttctgtcccacttggttgcctgactaccccctcccttcctccccttttctcctcacccccaacctccaaggcgtgcagtttagccttgcaaggcaagggcccaaatgcctttcataaacttgagccaattccttttgtgttgtgggtttcaccgctctgattttaatatcgcaattaaagacagatttttattttctcaagaactttctcttgcaactggggaaatggaattgacgcagctgctacttttaactaagaaattatatcattaaataagagaaagccgccttgtagagtgatttgctttcctggggacgttgggtctcacgtggaccctaaggccccagaaaccgttcacagtgagagaacccagctacccctggctttctggctttctgtagtagcccctagccaggcatttaatccccacaaaaactgatacagttgttacctccatttcatggagtctaaaactgagacctagtgatgctaacttgcctaagattatctaactagttcataatggtgccaggatttttgtcattcggaccccagagtcctggctcttacggctatgcacacagctctctagtaggatcttggagcaaatgcggtgggccggagtgcagtttttaatccagcagtctttgatttcatgaggtaaaaggttacgtgatgaaaaatggaaaggaagggagaccaaaagaaaaatgtacttggtggtaagagagacactagggcaagctggaatctcgtgaaagattcagactttggatgaacagtcagaataattggattgtgtatgcactctcaaggtttggaggtactggatggcttattgggtaaaaagattagtgttttcccgtcttgaggtctgaaccaaacggaggtc

SEQ ID NO: 54132 - DNA, 1858 bp, Homo sapiens
tggattgctaataaaattttgcaattttacaacaagagcagtgttttttcctgattttttttttggcatgacaatttttatattttaactctccaaatgtatagtaaattttgggtcacataatgtatgaagtctaaataagtaattaaggattttaggactaaaagatgtaactctggtgtactgagatttaaggattatttccttaggccttttctcttagaaattttattagattatattgaggtttttttcagttactaatatttatttgttaagggaattaaattattttttggcatttctgtgtagagggttcctttaaactcttctcattttcaagtgaagatttgatttctttaagtgttacttttatgttcttgatataaagagtgtgatatatatatataataatggtttattggaaaatggagcagtttgttaatatttagaagaccttccagattataaatgactttaccttcttttctaggtttgttaaagttttgcactgtagggttttgtggaattgggagcctaattgatttcattcttatttcaatgcaggtaagtttctcaatctagaatgtaaactacttttacattcaaaattgagttctgtgatctcctgttctatttaaaatgtttagtatacgaggaagcagagaagaatggttgtttccatttttcttcatgtactagatctaaggaatcctggtcatgtttccaactagcatttctcaaactgtgctctaccagttagtagttctcaaagacataagaagttcattaaaaaatatcccgtgctcaaatatgatttgtaaatgtgagttcaattgagttaaagaagtttctttactgaataagttctcaaaatctttttaatatatgttgtctctaagagggattgtggttatttttcaaacccgtttcttttcctcatagtcactgtcaccttgtcaattaccataaaagcattgataggattctgttatacatatgggcattgtggaagcagagacaagattttcttttgcactggacaggcactccatactagtattgtgttgtttgcaaattacagaaactgaaatccagctagcttaagctaaaaagaaaaaaaaaagggcgttctttagaaaatctgagaatgtagaacagatatgtataaacaaatgatatacatgtttagggctctcctgataactcatcttgcttttctccatagccttattttctcctgctgcagtgggactgggggcgggcatagtttgtgaaatgctgtccttaaacatttaaaagtgccaccagatgttttctgttaaattatgtagaactgattgtggttaactcatgaggattcttagagaaagagatgaatttttcacaacaaatgttgacaaacagcatttcaacaagcatttatggagcacctaacgtctttagcaagtgtgtcagttgcatttagagcatcatctgttttgctctgctttctcatatagtatttccactcttcaattctgtctgcttgatgttatcattatgctttaaaagaaagtcacaatctaggagatttggataccatactgtgaggaggaggcagcatatggaccaataagataccagaattaaacaaggaaaatatttggttttaaagttggaattttcctgtctgtactcgtaaacatatgcctaaccaaatatcctgccttctctaactgtgggacaggcaagcaggcatgaagaggctaaggtacttgtgcacatatgcttagaaatgagcttctcactttcagtgaggatccaaggaatttaatatattattgggattctttgagttaagatatccagaattcaa

SEQ ID NO: 54133 - DNA, 1034 bp, Homo sapiens
ctcacttattttttgtgttcgtacagctgtccagccagtaaagtttggagacaaggaattgggtccacctaccatataacgcttgacaagtcatttaattctggtcctccagaatctggtcccatttgcaaatggtctgccttacagagatttggcgaggttgaaagaaaagaatgttcaagaatgtgtcttgtaatctgtaagctgttattctcctgctttttgttcctcccttatgtttaattccggtaaaattatggagttgtgatctttttattgggaagaactcaagtttgtgagtgctcttactcagatagttactttaagaaaaggcatagagaccatatgagctgaactgatgaagtctttcctaaaaacacggtggaggaagaaaaaacaaaaccaaacagggatctttctggaaaggcatagattaaaactttactacagtaagccactctcacacgtgggcatgggccactttatattgggttagttaggattgaaatgtgctgtaaatgcacaatacacacaagattttgaacagatttcatgtaaaaaggaatctaaaatatcttattaatttttattttttgagacacagtttcactctgttgcgaaggctggagccgcctcctgggttcaagtgattctcgtgcctcagtctcccaagtagctgggattacaggcgtgcgccaccacaccctgctaatttttgcatttttagtagagacggggtttcaccatgttgctcaggctggtctctaacttctgacctcgtgatccacccgcctcggcctcccaaagtgctggaattacaagtgtgagccactgatctgaatatgtttattcttaagagggtttagtttaccaaagcacttacactgctatgtgtatactgccttaatgcctttttttttttttttttttttttttttgagacgagtcttgctcttttgcccatgctggagtgcagtggcttgatctccgctcactccaacctctgcctcccaggttcaagccattctcctgcc

SEQ ID NO: 54134 - DNA, 1044 bp, Homo sapiens
tcatacagtatggtttgtgccttttttgggtcaggtttctttttttccacatatcatttttgagatttatccttgttgtgtgtatcagtaatttttcctttttatttctgaatattatataccatttgtttattcatctgttactagacacttgggtttttctagttttggggtttttgtaaataaaaatgctgtaaactttcatgtgcaggcgtttttgtgagcatatattttcatgaatactgagtaagtatttgtgagtggaagtgctgggtcatatagtaagtgtatttttaactttataagaaactaccaattttccgaagtggttgtgatattttacgtttctcttagcaatgtacaataatagttccaggcacttcacagcctcgttgaaacttagtgttgtctgtttttaaattttagttaccttagtgggtgtgtagtggcacctcattgtggttataattttgaatttcactgagtggagccttgataaagaatgttcttgaggttttccttaatttttctacaggattgtagccatatacaattgaaattcatcttttatattgttaaattttttctttaggtgtctttaagagtgattgaagagaataattcaaaatgcctgaaaatcctgctacaggtatactggatatattgttctataattaaattaattatttaaaaatggaatctcaaatgggacttaactattactctacttattcatcttgacccaagataaactgcaggtgctgcaggtacttgatcgcctgaaaatgaaattgcaggagaagggtgacacgtcgcagaatgagaagttatctatgttttatgagacactaaagagtcctctcttcaaccagatactcacacttcagcagtccatcaagcaactgaagggtcaagtaagttacccatcagagttttacattaatatattatattaatatattcaaaccatcaaagaaagatagaggagatagacaaagacaaattatctttaaggactcagttcagcaaagagactgtattggg

SEQ ID NO: 54135 - DNA, 1042 bp, Homo sapiens
acccaggaggctgaggcaggaggatcgcttgagcccagaagacggagactgaagtgagccgagatcacgccactgcactctaccctgggcaacagagcgagaccctgtctccaagaaaaaaaataaaataaaaatgtactttgcattgagagaatttaaggaaattcaatgtaaaaaagtaattcagaatttactatgggaaaaggcatttttctcaggagtttccatccagcttggaattcatctcataatgtgaatgaagtgtgaaaatacctctgattccctgaggttgcagaacactgcacacactctctcttacgttctactgaaataatcaggtgagaggatttccagaaataatttattactgaaatgctgagtttatgtggttcttaggggaagctgcttttatgctaagcaatttcagttctgcagacagagtatgttggctaaatgtacaccattgacttttttttttaacgctccttcattagggccggcaaattgaatatatagatatagaacggccttcaactggaggccttggattcagtgtggtggccctcagaagtcaaaatctcggaaaagttgatatcttcgtgaaggatgtccagccagggagtgtagcagacaggtgaggaagctgtttattttcattttgctaattgtttcctgataattctgaaaactattataaagagagtgaaaaactagtaataaaaacagtaacagtaacagctaacatttttgctttcgtttttgctatgcatttgtcaggccttttgcgaaaatcctataccccatggcagcagttccactatataggtatcatcattccattctgtagatgagaaagctgagattcagagaggttcagtggtcaacctatagtcacagagctgttaatgctggagccatgatgtgattccaagaccatctgactgcaaagctagtgcgctatttccctctcttacaactgaacatggtattttagctatggactgatcagtaagataggaatattgaagttctcattctgcat

SEQ ID NO: 54136 - DNA, 1058 bp, Homo sapiens
aagcccatatcatatagaataggcatgataaatcagaaataactttagttattcccataatcagaatgatatgtaaaatttcactgattattgcccagttacatataaatttatcccttttgatagacatacgtaagtaaaaatgaacttgccatgcaaatgcagcttcaaggcaagttccttggctcttcatttctgatcactattgcttcaccttatgcagcttgtggagccactgatgttcctatcatcatttcagctcctaagagtatttatttagaacagcagttgtcaaagtttggtctgtgggcctctggagggctctgagagccttgcaggtggtctgtgagatccaaacagcttttacaataataccacaatgttattatccctttcaccctgctaacatttgtactgatggtacaaaagcagctgcaggctaaaactgctggtgccttggtgcaaaacaaaggcagtggccacaaaccgttatagtaatgattgcattattttctgccatgtgcttgcaacaaaaaagaaaaaaaatgccgttttacttgaatttttttaagatgcagtaaaatgattaattttagtaaattttgatcatttagtgcatgtctttcgaatattgtcaaaatgggaagtaccacctagcattcttgctatgtactgaagtttgatggcatttagtacatgtcttttgaatattgtcaaaatgggaagtaccacctagcattcttgctatgtactgaagtttgatggttgtcttaaggaaagtcacctgcaagattaatctactttttttttttttttgagatggagtctcgctgtgttgcccaggctggagggcagtggcgtgatcttggctcactgcaagctccacctcccaggttcttgccattctcctgcctcagcctcccgagtagctgggattataggtgcctgccacaatgcccagctaattttttgtatttttagtagagacggggtttcaccgtgttagctatgatggtctcgatctcctgacctcgtgatccgcccgccttagcctccca

SEQ ID NO: 54137 - DNA, 1117 bp, Homo sapiens
gcagtgagctgagatcatgccattgcactccagcctgggcaacagagtgagattctgactcaaaacaaaacaaaacaaaaaactatctatctatctgtctatctatctagaatctcacttctgaacaccccaactgtgaaacacacccaagctattgtggattattgctaaggcctcccaacttgtatctttgcttctattgtttcctcttctgtagtttattttaagcacagaagcttgaattatgttgttaaagtcagtcaggtaatgtcactcctctgtttcaaaactctgctcgatgccttctcttcccaatcatgaaaagaagatgccctatactgtctgactccattaactctcccatctcttagactactcttctttttcctcattttcttgtagccgcactggcatctttctattcctcaaacatgtcactgaggatgttggttgtgaagttcccagttttatgctggaggcttctgttctgacctttccttcttgaggccctggcctttctgtcctcttccttgcacacgtgaccattaacacccaactctaggccattaggcatgagcttataccctcaacaaaggccttttttagaatactgattacttttctcattttgagccattcctttgtgttctacatgaaattcctttactcttgccatttcaaccagttattaacagtattccattttattcagcattttaggtggcttctttgtcagccattttgccagagctgaaagtctgatgaattgttattaaccagtgaagttacagcatttatttctcaaaataattttgtctttttcttgaaggatggaagactccagacaggggaccacatcttgaagattggtggcacaaacgtgcagggaatgaccagtgagcaagttgcacaagttctaaggaactgtgggaattcagtcaggatgctcgttgctagagatccagctggtgacatttcagtcaccccccctgcccctgcagccttacctgttgccctgcctactgtagccagcaagggccctggttctgtgagtatacatatcattctttcatcttaaaccaaagcctgggtgtgacacactgtaagataagaaatt

SEQ ID NO: 54138 - DNA, 1057 bp, Homo sapiens
cgagacggggtcttgctatgttgcccaagctggtctcaaacccctgaactcaaacaatccacccacctcagtctcccaaagtgctgggattacatgtgtgagccactgcacccggtccactttttttttttttggtggcaaaatatatataacatgaaatttaccgttttaaccttttttcctttttttttttttagagtcagagtctcaccctgttgcctgggctggagtgcagtggtgtggtcatagcttactgcagcgtcaaactcctgggctcaagcaatcttcccacctcaacctcccgagtagctaggaccatagctgtgcgccaccatgccctgctagttttagttgttttgcagagacagggtcttgctattttgcccatgctggtcttgaactcctggcctcaagcaattcttctacctcggcctcccaaagtactggaattacagtcattagccaccatgcctggcccattttaaccatttttaagtgtgaaatttggtggtattaagtataaatcactactagtatgtggtaggcactaaagaaatgttggctggatcacagtatagaaagtataggtgatcccagccatcagctgaattctgtatgatttagccaagactaggatcccatgggcctaccaccttgtaaaagaatgtgctataataaggtagtgtgaagattttttgaattcttaaatatagataatctggtgaaagagcttgggataaggaaggaagcacagatttggagtcagaaaagccacttttggtctgaattgccacaggttagcatgtgtcccttggcatgtcacttgactttgttgagaatcagttccttcatcaataaatgcccacttcactatgtgcttgtaaggatctaatgaaataccatccatgtaaattataaagcattatctcattttggggtattggcaatattatcactgtgaagaaggcattttaacaggctatatgggctgggataatggttggatgtggtaaaatagtggggccacacttgtgcaatgttctgtactctggaagtg

SEQ ID NO: 54139 - DNA, 1681 bp, Homo sapiens
agaatacttttttcttttaaacatatgagacacttgcataaaattattttaaaaattattttagtattttctatatatgcttgattgctgtatcagcagagcatgtaactgatgcaaaagtatatttcttttcaatagaagttatttttctaggatggtattaagagtgtgtgggatgtgaaagaatattgtggactgacgttaaattttgacagccaagtattctagacttattagctatactttaagcagtaaattaaacatttttttaacatccttaaatttctgtagtgatattcttataaaatgaaaatgcaaagggaaacagtcttaaagggctgtaaatgatacttagtgtgtttaaggggagctgagtagaggtaggtaagagagtatgacattggagtattgaaaggagaaaccacagtgctgcaaaaaatttggtagatcccttacccagtaagggcgtatgctgcatgcattttgtactttatccatcaatacatgcaaagatttagccttagattttaaaaattttaaggatttctaacatttttatttgcatattatttaatcataaataatatgatgaaagcgaggccccttgtttacagggaaaataaaatgatgtcctattttcattttggtagatggatataaataagagatttttgttttttcatttggggctggctcagttctgacttatccccttgtcttcctaggtcaatggcatgcagctttatggaaaatctcgccgagaagcagtctcctttcttaaagaagtgccacccccttttactttggtttgctgtcggaggttgtttgatgatgaagcttctgtagatgaaccaaggcgcactgaaacctctcttcctgagacagaggtactaaatgaatatagtgcatttcccataggcatgcccattcatcaaagatgccccgaagactgtgctgcaataagaagggaggggaaaccattccactctgctctttttttgcttgactaaggcaacaatgcatagcttttcaaattgttactcttcatttaacatcaaaaaattctttccttccctttccttgacatgttggcaacattgatgcacatggattttgattttagagaatctttgtttttagtaattgcctggattcattacttttggcttctagttcaacgcagtttgtcttatataagtttaaggtgtttgcgagtgttgcatatctaatgtactcccctttttaagagccttaaaattatgaaactcagccgggcgcggtggctcacacctgtaatcccagcactttgggaggccgaggtgggtggaacacctaaggtcgggagttggagaccagcctgaccatcatggagaaaccctgtctcaaagtagaaaaaattagccaggcatggtggcgcatgcctgtaatcccagcaacttgggaggctgaggcaggaaaatcacttgaagccgggaggcggaggttacggtgagctgagatcacgccattgcactccagcttgggcaacaagagcgaaactccatctcaaaaaaaaaaaaaaagaaactctatgataaatttcaaagtgagtctggaaattgccataaaacccttcagaagatcagagaatgaaataacactttatatgctcttggtactccttatttatttatttttttaa

SEQ ID NO: 54140 - DNA, 1041 bp, Homo sapiens
tttgttcattgcttgggctgtaaaagataatttttgagcttcagatagaagtttagagtattttgggggaatgtcaatcagatgaaaacaatagtacaatgctataattagtataaaaacagaaggttttttgaagcagccattcttctgcatagtagattcattgaccctctcatttaacttcctggaattccacatagcaatgactcttcttcctaaaaagacagggagtctagaatagagggactttcaggagtaaaatcaagaaaagtaacaaaggacctgtatactgggcagttgtgctaacctatttcttctaagatcagattttcattatttcaactcagtgatttttattcattttagacttaaatgatgtccaaagacttggattttttttttctcaccttattttctagtaaagcttttcttgaaaacttcctggagccagcagaagtggtttccctgttctgctccagcctatctctgtgttgatatttctttctttgtctctctctgtaattatgaagccaggtattgctacttacgtatcttataagcttctactttgtatgatgttttcatttacttaaattgcatatttttccttttatgcttctaatgggatgacagaactcattgaagtataagaggtcagtgttaatactttgaatgaaataaattcttcacattaataaaaaaaactgtatgaacagtctgaatttttaagcacttgaatttttataagatcttatcctggagtgtgtgtgccccagagcatgccccttttacaaagattaaaaagaaaaactacgcatgccaaagagaattctcagtttgagaagaagctgtgagattcttgatgtgtgcattcttttcagaattgaaagcatagtgttttgaagcatttatcttctttggtatttcaggttgaccacaatatggatgtcaatactgaagaagatgatgatggggaattagcactgtggtcccctgaagtcaagattgttgaactagtaaaagattgtaaaggtttgggat

SEQ ID NO: 54141 - DNA, 1025 bp, Homo sapiens
ccaaaattaactggaattgaatgaacaaatttaatgggaatttgaggcatgagccaccatgcccagcctaggttagccaaaattaactggaattgaatgaacagatttaatgggaatttgttaataatcgattttgataattgggatttaatttagaagatacctttcagatgtggtcttagatattcaggtacatttgcatttctattattgtaggaatctatatatatttgcattcttataatacatatttatatcataatggttgctctgatgctcttaactgacattatctgtaagttttatattttgaatagtgcacatattaagtcagagaaatgtttcagaactcaaaaaaattcagtaaaggatggaaagaaaaactagatagtccttaagaatttaatccctagttaaaaggaaaacccccttctgagctttacgcttaaaaacatctatagtcagttctaaatgtagaattttttgttcttcattgcattcctgtaggtatgtattgtaacttctattgtttcttgaaattttatttttaatttatagaattataggattttccttttcctcttatttacctctcaatcagcagcacacatactgacatttgtttctgtacaaattatgtaaaataattttctgccaacaaaggattagatattctttttgtctttgtgcttcttatagaacataactacttaatttcctaaaggccattttgattcagattaaagggctcatcttatttacttctacagctaaaccttggggaatggggaggggaacacattcaatcctaacttggatgcttttcttaagtcagtcttaagtgtacttacagatgtgtacagcacatttttcaccatttgtcagtggtacctagaactgttatctaccatgacatttagatgacaggtaaacacaactcaaatttggttttgggcaagttaattaatcggttataccatcccttgttgtaattaggtaataaattctaaagttcaagaatattt

SEQ ID NO: 54142 - DNA, 1096 bp, Homo sapiens
aagtaaggctttagtggatatttttgtgatactcttttgttaaaaggtgggaataaatcttgtaataggtaggtgataaattcctagaagtggaattactcatcagaagagcatactgtatcttttaaattttggtacatatttaccaaatagcttgcatttaagtttgtgagactcaaatatatttagaccacttaaaatggatcctttcttatgtagagttatttctttattccgataattctcatggaagatagtgtaagcaggtgtgtaattcatgaatttgctaatggttttctatgatgtggacagattaagtgatagcaatatataactatcaattttgtttcaactttatatatggcggtaattaatttattggcctttgtagctaagtgggcataaagtgtttatattcagactatgatattagtgccccaaactctatttctatttcttccacttaattttatttatttatttcttcttccacaaattttaatcttgttttacttttgtttattagagaatttagcttaaagtggtggggttggggggagggcattaggactttaatttttaccaagagatttgagaatttgagtaaatgctaatatcagtatatagttttcaatagcctgtgcaagcctactgtcttcatgttcatcttagctaatcagtttacagaatgtaggatttagcatttgataggtattgatataattttaacacattaatagtatatagagtggtaacactataaagtcaggtatgtaaccatattatttccagaatctaaaatataaaggataggcatgtactataagttattatacagtttcacattaatgctcaagggatcttataacatggccactgacatctaggttttttttttctcttgccttttttttttttgggagctctttgggtccacgtcacccatataagatattggtactaagcaaaatgcagtcaatctgctactaatggcagtatctgtagtcttgcagatatatcatatgccttactgttgaacaaaccacacagctgcatttaaaggtcactttttgcttaacggaacttaggggaactg

SEQ ID NO: 54143 - DNA, 1070 bp, Homo sapiens
gaaagaagttattcaacaggagaccagaagggttatgagaaaggaatagtcttcaagaagtgatttccatgggactcctgcttaaaccatttaaaatattggggtgcttaaaataggtttttaaagtactaagctttataggataaaagtatgtgcaagcttatgtactttttgttcctcttaagaatatattttgatcttttagcaggttcctttgtccacttctcttccattttgctttttattgctttctgtgctgtgcttactgtgcagctctgggactgtttagttctatgtctgatgtgtggaaaaatctattcttactgcctaatagtgtttaggaagtaataagacacaaggagccaggaaccgtatcagtttaatctatcttgagtggactgaatgtactttgtgggcacttattttgaacatgatggtgctgtggtaattggtatgattagtgtaatactttgctatattataaaatagttaaaaatggagttagatgttagataagatagcttgctcattattcattagaatcaattagttattactttgcattcactataaacacatttatttctctttcccaaaagtaaatgcttagcttattggtcaaatcagaagacagtcttttgaaatgattaattataccctattgttttaaaccagaactgttctcgtgattttaattcagctaatggttcctgacatggcttctgttgctctgaaaatggcaaaggaaaaagaagaggtgttttaagatatatcttatcaaaaaaggagacatgctgtcatatgtattttgttgtttttttttatagtaaataccctttttgagttttgtgaccaaaatgtacatcaatttcattgctgatgcagtgttttgaattaacttctgtctttcgttactttttatagtggttttgtgaatgtttggatagaaactagggacaaatttgagtcaagatactctgtcaaattaagttataggattttagagttgaaagaagggatcataactcatgtatccaactttttcattttatgtttgtgaggaaactgac

SEQ ID NO: 54144 - DNA, 1352 bp, Homo sapiens
atggggcatcttcagaggtagctagtttgtcccctccctgccccccaaatgacaaagaagctgcctttgggttctgtcgtccaggaaaaggggtggtagattggatttagtgtttagcataactagtggtctaaacctgaatacattttagtaagaaagcattcctgtcactagtttgaggtctaaagaaggcctcactttgtgtaaattagtgctcacaatgacttttctggcaataaggaaaatatattcacctttcaagggtagaagtctatttccatttccttctggtgaatcgtcctttagaatgttcctaaattatcaattcagtgggttgcattttgaaaacctcctcacctatttgggttaaaaataatatttttaaattttggtgttatctgaaactgcagagattgttcacaaacaacttggtgcaaccatttatttgcttttggtatattttgctgttgcagttttctctaaggaagtgtagaaattattaatatgaagtaatgttagctgctgggcagttcatgagaggaataagctattatgtagtctcccttctccccccaataaaaaagcctttcatcaaaaactgacatcctaaatgaaggaaataattgtacagcttatttattagtgtgtcaaacttaaaatgtaatggtttcatatttcaggatgaaaagtgtgttgtgattcatggttgccagtgacaaaatagacagctcttttatattaccacgtcgattgcctgctgatatgccactgtactttttggttctcttctgttctcttcctatgcaatagctccctctacttgaaaatactggtgtaattatagtttaacactactttattagtgagttccctgggctcttttttacttttaatcctcttcataaatatgtggtgttatattacatcagagcctgtaagaaaattttgaagagtctcttgactcgggggtagaaaggcagggttagttgcaaaaagcaagataagttacatttgaaggcattcttcaaggaattagctgtgtagcctttgttgatttaaatatggtatatttggttaaaattccatgcagtactttgaaaatgaaccctgatgtttgaaacacagaggcatagaaaactggatcagaaaacttcaaaagaatcatcagccacttcaaacagacatagccgggaacttggcaagttcttactttgctaattccaaagttttgtaattcccacagaaaacctagcagtttttctctactttctctggaaggttttaagagaggctagagtagtagaatctcaggttacaatatgttgccttgtggaacagcatgtgcataatga

SEQ ID NO: 54145 - DNA, 1121 bp, Homo sapiens
acacactaccacacctggctaatttttgtatattttgcggagatgggatttcgtcatgttgtccaggctggtcttgaatcctgggctcaagcaatcctcctgccttggcctcccaaagtgctgggattacaggcatgagccactgcacctggccttttaatttttttaattacaaaaactttttctagcaaggtcttgctatattgcctaggctaatctcaaactcttgagctcaagcagtcctcccacctcagcctcccaagaagctggaattatacagaggtgtacaaccatacttggcttagagtgagattttaatttatttttacctgtttagaagattatcaccagagtgccagacacatgaagtaagtggtcaaataagattcatcagtcaactcaagctgtcctaaggctgcatatttattttcagtgcatggactcatccttcttctttgctcgattcacaggaccctttagatcctacaagatcagtgattgtgatccgctccctggtagcagatggtgtagcagaaagaagtgggggactattacctggagaccgcctggtctcagtcaatgaatactgtttggacaacacctcacttgctgaagctgtggaaatattgaaagctgtgccaccaggcctagtacaccttggcatctgtaagcctttggtggtaagtgttgtattttgttaatataggaagtgataatagtgcaacagttaaaaacatggattttggagacacatatacctggccaagaatttctgttctactgtttactatgtgtgtgaccttgggcaggtttcttaatgtccttgacttacaatatcagaaaaaataatgtctacctcatagggttttgggatttaaaggttatattcattaagtgcatagcatattattacataaatactagctgctaatgttgctagttctactactaccactcttactactattttcatctttatgcttttagcacagacttctaagctctcagcacatttcttatgtgtaaattattattattattattttatagacagagtctctctctgtcatccaggctggagtgcagtggcacgatcttggctcactgcaacctccacttcc

SEQ ID NO: 54146 - DNA, 1019 bp, Homo sapiens
tctatgatgtctattatattttttagtgccgacattttaaaaatttcataaccatatgatgtgttcaaatacatcctctaaccacattaaaaaaaaaatacagggcagtattactgttttcagttttttttttttttttttttttttttgagatggtatcttgctctgttgtccaggctggagggcagtggtgtgatcataactcacttcagcgtcagtctccttggctcaagcaattctttgcctcagtctcccaagtagctggcaccacaggcgcatgccaccatgcctggctaatttttaaatttttttgtagagacgggggctcactatattgcccagcctggtctagaactcttgtactcaagagatcctcctgccttggcctcccaaagtgctgggattacaggcatgagccaccatgcccagccctactgtgttaatttaaaagcttcactacaatgatgtttagctgcaaggagaagacaatagaaaagaatagatttattccaggaatttacttcttggtagtaaagaataagacttaaaataggaaagatctttgatctcttagaaagaagaggacctcattatgcccggcacccagaggttctccagagataggtcatggtctgagcaaatctatatgccaggttttagccaggaacccacacagtttctgcacatttagtttcagtggtatgcactagctgttctgattagtgaaatataaattaatttttaaaatactgtattcattccttcatatttattttcaacacagatgaaaaataagatttgttattttttatattataaaagagtcatactcaaagtagagacatactccccatatctttagtttatagagaatgttttctgaacattcagatagttataatttcttttgagttatttaagcttgaaaatcctgaccttttaagtctttgctttcttaaataatagtttgcagtgtatgtatacttatgtactactttttatgggttaaatatttagtg

SEQ ID NO: 54147 - DNA, 1091 bp, Homo sapiens
gtttggcatgttttatttttcccagcgttcaagaaaatgtcttcattctgtgaaggtaatttgatcatagagtttagttctactttaattgtgtgtatgaaccaaatattgatgtgctgtatcatttggtatgtgaattgaatgaatatttatgcagatataattattcatcatgaagatatctctttttgaaaatgttaaaatgtgtgttgaccatctataaattatagatgaatacattttcagttagaaaatcttggtatgtcacgtgtcttttaaagaataaaatctgtaacttctacaattgaagaaaaagtttaaatcattgtagaattaatacaatggatagtttttacttttacatttattttagaaatgtctttcatttgaattttctgattaataacaaaattaagcttctacaatgtatagaagatacaaataactgactgtctcactagagaaagaatgcactcctttaggtaggtcagcagtcttaaaagcttgctcttaaattcctgtttttctgcattagtgtgtttataccacagagtcacttttatattataacataagcctaaaataatacattgtgtttgttttacagtcctcatgatatgaatgaagttgggtatggtctaaatatttccagactatctttttatgctttttgtcattgaagaaagagcattgtacaagaagcatttaacccttctctcaaattttgcatcttcagaggcaaggaactgctccaccgccaatgaaacttcctcctccttataaagctctgactgatgacagtgatgaaaatgaagaagaagatgcctttaccgaccgtgagtgccttttcactatttagggtagatgcagaacttattaaattatgttttaacgactgttgtaaattatcaaatatatggctgtgagttcttcaaaaatgtgcatgaatgtatgctaaaaaatcaaatctatacctttgaagcttttgtggcgtcatttcctaagcttttcccttggacactgagaaagggaatattgaaggaagctatgctgtacactatttttcctatattcccttctaatcttattgt

SEQ ID NO: 54148 - DNA, 1037 bp, Homo sapiens
tggtgtgctgcacccgttaacttgtcacttacattaggtatgtctcctaatgctatccctccccgctcccaccaccccacgacaggcccccgtgtgtgatgttccccaccctgtgtccaagtgttctcattgttcaattcccacctatgagtgagaacatgcaatgcccaaactgaaattctatacctattaaaaaataacttcctgcttttaaaaaaaagttttataagaactccttttcccccatccctagtacctggcaaccaccattacagtttctgtttctatgaatttgactactttagatgttttgtgtaagtggaatcatattgcattgtgactttttgtgactgccttatttcacatagcataattttctcaaagttcattcatgttgtagtatgtgacagggttttcttccttttgaaggctgcgtagtattccattgtctgtgtagaccactttgtgtttttttctattcatctgatggttgacctttgagttgcttccacctcttgactattgtgaatagtgctgctatgaacatgagtgtgcaaatatttcttcaagactttgctttcaattattttagagatatacccagaagtagaattactggatcatatgatatttctaatttttttaaggtatgtccatactcttccataggggttatataccattttacaatcctaccaacgatgcataaacgttccagttttttcaaatccttgtctacacttattatttgctggttttttggtagtagctacactagtgggagtgaggtgatacctcattgtgattttgatttgcatttttctcgttgatgaagcttcttttcacatgcttattggctatttgtataccatgtttggagaaatgtctgtttatgtcctttgcccgtttttaaatcagattatttgatttatatttggttgttttaggagttctttatatattctagatattatatacccttatcagataaataatttgcaaatatattctcccattctgtgggttgccattttact

SEQ ID NO: 54149 - DNA, 1056 bp, Homo sapiens
tccttttctcaccccattggttgctgtggcaacgactcccagcagcccttagagcaaatgccaggccatgcggggttccccgcagtggagccacatgtctgatactgcgcaacagtttgtgctgactcagccatgcacaggaggagtgctaccatttctctcttaagttttgaattaaaaactaaactggcattgcagtgtcttgattttttaaaaatgaaaaaccaagtcagtttcaaaaaccaaatcatttttccctctccccttgaaattctaggttcagcttttgttgtacttactaaagagaagcaattgtcacagagattacaggaaaccccagagattttggatggagggaggcagcctaggaggctgagaggaagggaaatctattatgcaatcaaaatagaccttttatttaatcccgaagcctgactgtggagacagagatagtgtccatgttagattagtcttgtgaaggctgccttaaatttggtctctgtgaacttttgttgactgtcatcatcaacatgtttttcctggaaagaaatgagtgcactgcatgagagattaatctgtagtttacgaacctagtggcccatgagaagcacctgagcaccttgttacaaagattcctaaaccttaccccagaaaacctggctcagaatctcagctagtgggtcccagtcatggttctgttttataagcaccaagggtgatattttaggtagtaagggggagaaagtattattttttcctcacccattgcaaggttcatggctgagacccttataacaaaaagattaacaagagaaaagcataacaaatttgtttatccaaaattttatacaacacaggagccttcagaaagaaagacccaaagacccagggaaaactgtgtttttatggacagtcctgcagaagtatgactggaggacaaaagggtatgatctagtggtatgaaattgggggaaactcaggaaagcctatttgttgtgattctttttttttttttttggagacggagtctcactctgtcgcccaggttggagtgca

SEQ ID NO: 54150 - DNA, 1038 bp, Homo sapiens
agtttgaattatggttacacctttgagggataaagaataaatatataatgttatatcaacaaagtgctgtatatgacatatatgtgcatccaaaaatacagtgaaatacccttagaagaatagaatgaagttactgagacaagccacatgagcagtttagaaattcaaaggagcaagcgattgctgttggagaagtgggtacagcgagagttagttaatatttaatactagctaggtagacttacataggaaagaactgagtccaaatggcatcagcaaattcatgatttactgagtacctcctgtatgtcatatgccataaaaggtcatacagttaagtaagaagttctccagcaactacaaagacatgcaaataagaaactatacatcaggcaaaacaaacatccatagagggaactcattgatgttgggttattttcaggctcggttccagtgggtagttttcacagttgagagggagcaatttggatggattcagatgcagagaaagcagaacaagaaaacaagtagtgatactgttgtcatagaccaggcaacatgaaaaggacatgaattaggatggaaactgtgggattaaaagaaaaaagaagaataaagcctttagattaaaccattagactcagcggtgttttaaattttttggttgatggctgaatgaattaatagcaaccgaggatgtagcacctggaagtttaagcatttgagatttaacatcacaaagccataaaacattaaatatttacttctgttagtgtgctttggctttgacgtttacattatctcataacaattctattaatattagacattatcccaattttaaaggttgagaaaccagggttttaagttgttttgtatcttatttatatcttatcagtgatagaatccatacctttgctttggtgtctgtgcctttgcttatattcatttccaagccaacatagttgtcttgtactacacattatcatggatttatttttaattggggtataatttatactcagtgcaatagatttt

SEQ ID NO: 54151 - DNA, 2096 bp, Homo sapiens
ggccaagaaagtcattttgaattgacttgataattggttttcagaaaaagtcttaatgttaacaatctctgcaattcaaaagggacaactatttctcaattttgcgtaagattctattcaagttagcttagatttggatgatttggtatgatacatatgttggtttcttaaagaataacatctattataattaatctcattatagagaacacagacaacaaagttaatagtatggcaaatcagacagcttcattcttagttatctgctctttggttaatttattgcattcaaatcactatgtaaagggaattttcatgataatttataaattttgaattctaattttctaatcttacccattttgctagtgaactttttattaatttattatggagtgcacccagcatagttttcttaactaagctcatattcttaccaagtttctcaagagaattctttagtaagtaatttttcatttttttgtatttcagattgacgtattttaagatttttttaacttctgaagtctagcaggcctgtaagaacaaaaatcattctgtaggaattaaaaacagaatccagtcttgacaacatatccacaatgtctgatgtatctactagtgtacaatcaaaatttgctagacttgcaaagaaaaaggaaaatatcacctatatgaaaagagagcagttaacagaaactgataaggacatagctccggtattagatttaaaatgcaaggacgtatcagcaattatgaataagtttaaggtcttaatggaaattcaagacctgatgtttgaggagatgagggaaactcttaaaaatgacctaaaagcagttttagggggaaaagctacaatacctgaggtaaagaattcagagaactccagtagtaggacagagtttcagcaaataatcaatttagcattacaaaaaacagggatggtagggaaaatagaaggagaaaactctaaaataggtgatgataatgaaaatttaacctttaaattagaagtaaatgagctgagtggtaaattagacaacactaacgaatacaatagtaatgatggtaagaaattaccccagggtgaatcacgaagttacgaagtcatgggaagtatggaagaaaccttatgcaatatagatgacagagatggaaatcgcaatgtccatttagaatttacagaaagagagagtaggaaggatggagaggatgaatttgtcaaagaaatgagagaggaaagaaaatttcagaaattgaagaataaagaggaggttttaaaagcctccagagaagaaaaagtgttgatggatgaaggagcagtacttaccctggtagccgacctttcatcagcaacactggatattagtaagcaatggagtaatgtcttcaacattctgagagaaaatgattttgaacctaaatttctgtgtgaagttaaattagcatttaaatgtgatggtgaaataaagacattttcagatctgcaaagccttagaaaatttgccagccaaaaatcttctgtgaaagaattactgaaagatgtactcccacaaaaggaagaaataaatcaaggaggaagaaaatatggaattcaagaaaaaagggtaagcatacaaatgtataaatgtataaagcttatgtataaatgtaatagtaggcatggttattttgaaggataaatcaattttttttttcttgagatggagtttcgctcttgtcggccaggtgggagtgcagtggcacgatctcggctcgctacaacctctgcctcccaggttcaagtgattctcctgccttggcctcccaagtagctgggattacaggcatgcaccaccacgcccagataattttgtattttcagtagagacggggtttctccatgttggtcaggctggtctcaaactcccgacctcaggtgatccacctcggctacccaaagtgctgggattacaggcgtgagccactgggcccagccggttaaatcaaattttaaaaaatgattccttaaaagtaaaagcatgatattaaaagtaatgatttaaagggcactttttttttctgtgaaggttttattatgggcagagggcaag

SEQ ID NO: 54152 - DNA, 2032 bp, Homo sapiens
ctcacatacaataagcagacaattgattaaaataggtaattactgaggatcaatcacatacacagcagtaagtgttcagggatctagaaggaagaaagtagacattatgacctcagaatttgtttcaagattacacaagaaatgacaaatatcttgagatgatcatagggagacttgacttgtttggggacctaggccttcaagaacaattaatatttaagcactttttcagatattttctgtcagaattgaagccatattaaaattagtgaaattgaaattttaattctttaaaagacaaatgatttaaacaaataactcttttttttcttctttgtttaactttcaggataaaaccctaatagactcaaagcatagagctggagaaataaccagtgatggcttgagcttcctatttcttaaagaagtaaaagttgctaagccagaggagatgaaaaacttagagactcaagaggaagagttttccgagctagaggagctggatgaagaggcctcagggatggaggatgatgaagatacctcagggctggaggaggaggaggaagagccctcagggctggaggaggaagaagaagaagaggcttcagggttggaggaggatgaggcctcagggctagaggaggaagaggaacagacttcagaacaggactcaacctttcagggtcatactttggtagatgcaaagcatgaagttgagataaccagtgatggcatggaaactactttcattgactctgtagaggattctgaatcagaggaggaagaagaaggaaagagctctgaaacaggaaaggtaaagactacctccctgactgagaaaaaagcctcacgtagacaaaaagaaattccctttagttatttggttggggactctgggaagaaaaagttggtgaaacaccaggtggtgcacaaaacccaggaggaagaggaaacagctgtgcccacaagtcaaggaactggcacaccctgtctgaccttatgtttggcctctccctcaaagtcactagagatgagtcatgatgagcataaaaagcattcacatacaaatttgagtatttcaacaggagtcaccaaacttaagaaaacagaagaaaagaaacacagaactctgcacacagaagaactaacatccaaagaagcagacttaacagaggaaacagaagaaaacttgagaagtagtgtgattaatagcatcagagagataaaagaggagattggaaatttgaaaagttcccattcaggtgtcttggaaattgaaaattcagtagatgatctgagtagcagaatggacatacttgaagaaagaatagacagtctagaagatcaaattgaagaattctctaaggatacaatgcaaatgaccaaacagataattagtaaagaaaggcaaagagatatagaggagagatctagaagttgcaacattcgtttgataggaattccagaaaaggagagttatgagaatagggcagaggacataattaaagaaataattgatgaaaactttgcagaactaaagaaaggttcaagtcttgagattgtcagtgcttgtcgagtacctagtaaaattgatgaaaagagactgactcctagacacatcttggtgaaattttggaattctagtgataaagagaaaataataagggcttctagagagagaagagaaattacctaccaaggaacaagaatcaggttgacagcagacttatcactggacacactggatgctagaagtaaatggagcaatgtcttcaaagttctgctggaaaaaggctttaatcctagaatcctatatccagccaaaatggcatttgattttaggggtaaaacaaaggtatttcttagtattgaagaatttagagattatgttttgcatatgcccaccttgagagaattactggggaataatataccttagcacgccagggtgactacaaacaatatgctttcctcccccagcatgcatccaaaaatcaacaagtaaaacgaaaatacacttctacccagaagg

SEQ ID NO: 54153 - DNA, 1045 bp, Homo sapiens
atgatttaagcagatgactttatgctttcttaacagccacaattcaaagggaacaaaaacctggagaggggaagagagtcatctccctgcccagggacagcacctcttactgggccacatttaaactacccaaagattgactcatcagcaatttaagctgctgagtccctcagtcacacccagacagcaggcactcatccagtgactctaggtcctgtgaatcttagcttcaccccaaagccatttctaagatcattagagggcactgaccttcttgacattcatatgggaacaggggtgggctactggaaaccagagcctccttttccaaacattatgtggtcaaacaaaggatctgtgttaatgagctccctgctgggttgtcctgggggagaaggaggcagcccttaatctggaacaggtttgtacatcaaaggcccctggccctctaaggagtagccactgctgatgcccgaagaggcctgagatgggaggcccgtgggacaggcaggcaggcatgagctttggaagtccctggttagctaggataatcaggcagtggatctgagagctctcctgggtatctctggaggtctgtcacaggtacgagagagctaagtggctgttttctgatggtggaagagttgtgggatctgttgcatttcagacaactcaagcatgattgttagaagcatggactttaaacgctcatgaggccaggtgcagtggcttctgcctgtaatcccaacactttgggaggccaagtcaggacgattgcttgagcccaggagtttgagaccagtcttggcaacaaagtgagaccccctgtattagtctgttttcacactgctgataaagacatacccgagactgggcaatttacaaaagaaagaggtttaattggacttacagttccacacggctgggaaagtctcaatcatggcggaaggcaaggaggagcaaatcacatcttacatggatagcagcaagcaaagagagagcttttgcaggaaaactcccccttataataaccatcagatctcat

SEQ ID NO: 54154 - DNA, 1080 bp, Homo sapiens
ctgcctcttgggttcaagtgagtctcctgcctcagtctcctgagtagctgggactacaggtgctcaccaccatcctcagctatttttttgtattttttagtagagacgaggtttcactatgttggccaggctgatcttgaacacctgaccttgtgatccacccgcctcagcctcccaaagtgctgggattataggcatgagctaccgtgcctggctggtgatgtgtcttttaaagtgatgggagcagccaggcaccacagcttatagctgtaatcccagcagtttgggaggctgagatgggaggatcccttgaggttaggagtttgagcccagcagtgcccttaagcctcacctgaggcctcttggtgctgagcctgccttcagatcaacacaggaagagtgcttgtcactgtggacacccagcttcaacgagtctcatattactgactctgttagtacttacggtgtccttcatggaagaataacctgaagaaagtttctggtatggattggattctttgatttttttttccagtcacccaggcagaaaatgtttggttcaaagtcagaaagacaggcctccccttcccagcatgccaggaaatgcaggtgggcctgtccaccaccccctaccacgaccccccacctaaatgctttggttattggccccagcccctgacaaaagcaggattaaatgggcaacacactcggctcatcttcagaagcattcagaagccaagtcacatcggcacacaccatggtcactccagatttttgaagctcaccctctcctagggcagttgcccagtttggatttttgagctgctgagatgtgaaagaggaggagagtgaaagtcttgtttatcaacttgaaaatgattatataaatatgtgtatatatgtttgttttatttagatataaaccctcagaagaatttcttaatgcatgccgggcactgagccagcatctgccagaaactgggaccaccacagaccagctcttggtactctaatttttcattgtcatgtaaagatttcccttctgtttaagacgttagctctgccagggtgactttggtc

SEQ ID NO: 54155 - DNA, 1045 bp, Homo sapiens
tccgtgcaggaggtaatgggaccaaaaagaaccttcagtttgttggggttaacggtgggtaagcatcgcttgtgaagctcagactgcctttcttgctacctctcctgctattgtcctttgcactctcttttcctagggggaggcatctggttttcattcctcttcaagggaattaatttcaatggccctttaaaactccatctcgggtttgcatgcgtttggcttcttgccagctgtggtggtctgttggaacctctgcttttaatatgtcttggctttggtcttccccagggccaggactccaggtggcttctgggagttttgggggtatacgggcccttagaggaagacatttaacctgaaccataaaactgaaactagtacaaattctgttaattcgtggaacttcaaatttcatccatttaatttttttctttctttaacttcctgcaagccaaacccaagtgtttggggatgaagaaaaacaactagactattggcttagaacatgaacaaaacctcatatattctatagaattgaatgtttgatttagaatattttctaaatcagtcattcaacaaacatttattaaatgccaacagtgtgctcggtcgtggagattaaaaagtcaaataaataaaggtctctgcctttagctcacagataacagaaataaagatgaaatgctgatgtgctgagataagttttgttaggtgaggaagcacaggatgctgtggaagcccaaaccctgaaggctgcccagagagctcagaatccctgctaatttgagtcacaccagaagggaagacattagacgccaacaaggggaaacatcagaaatgatgaactggggccagtcgctgtggctcatgcctgtaatcccagcgctttgggaggctcaggtggacagatcacctgaggccaggatttcaagatcagcctggccaacatggtgaaaccccatctctactaaaaatacaaaattagttgggtgtggggacatgcacctgcagtcccagctactcaggaggctgaggcaggaga

SEQ ID NO: 54156 - DNA, 1087 bp, Homo sapiens
aggctcacccacccaaggagccaccggcctcctcctcctccccgccagtgggtaaataccatcaatataggggcctgagacagggagccatttctccttcacatgataaggcagagggaacaaggttttcaattatattaacatgtttttaaaaagattttagcagctgggagcagtggctcaggcctgtaatcccagcactttgggaggcggaggtgggaagatctcctgagatcaggagttcaagaccagcctggtcaacatggcgaaaacccatctctactaaaaatacaaaaattagccgggcatggtggcaggagcctgtaatcccagctacttgggaggctgaggcaggagaatcacttgaacccaggaggcggaggttgcagtgagccgagatcataccactgcactccagcctgggtgacagagcaagactccatctcaaaaaaaaaaaaaaagaaaaaaagattttagtacttccaggaacccagtggaataaaaactgatgtgtgtgacagtggaggctcgggacctctactcttgcctttgctctaaggttgggtctgactatgggcccactgcctacagctgtatggatagcacagggcacaaagatgccagccagggagggcaaatgagagttgaaagccagcccacactccatttgccaagccttgcgctgcagcaccacatccacccagagggggctgttctcatttgcattgtgcaaaggcagtgtctggggccaagaatggccctgctgcgtggactccagacctcttcctgggcttttgcattcctgtgttcctctctggttcttgcatagtagaggttttctctggcctggttttggaggagcattatattgatatctggtatagttcactgaatattttctctgcgtgcatgtgtgtgtgtacgtgcatgtgtgtgtgtacaggggcaggagattaagtgctgctcacatatggaaatgggcccttcggctgagcagcacttcctgttgtaacagatcaaaccctcttcactgtcgggtaaagtggaaccacgttttgctttgcagggcagcatgcgagtctgcttc

SEQ ID NO: 54157 - DNA, 1096 bp, Homo sapiens
agagcatccagcatgcctgccacgctgctgcacagcagggcttctgaggagccaggcctgagcctggggccccctgcccctcctgccctccctccccttcagggtgaaggcagtgtctgtgatggcacctttgaacctgcagaaggattggcaggtttccacagctccagcccacgagcatcaactcggattccagagctggtccaggagggagctgagcctccagagggtgtggtgaaggttccaaatcacctccctctcccaggccctcctttctcattccagaatgtgcttgtagttctagaggacaaggaagatgaacacaatgccagagaagcagaggtgttgttcacccctggctcccctacgccaagcccgccacctctgccatcacccatccctgagaatgagctcctcctggaagaaatcgagctcaacatcagcgagattccacccccgccacctgtagaggtggacatgagaagcattggcatcagggtaactgaggaaagcctgggccttgccagggtggatccaggcagcatctccagcctgaaacagcaggtctcggccctggagggagagttgtctggaagaaccgaggaactggcacaggtcagaactgctctccagcagcaggaagaggaaatcaaagctagggagcaaagaattcgagagctggagttcactgtagcccaactggaaggacagtttcaccaagagaacgccaaagacactcagggccagacggacgtgatggtgaacactgaccctgtccatggactcttgaccagggagtcgtgtgataagggcattgaagtcaaccttctaggcagcatggagtctgaaagctgggggcaccgaggagaggagaatggcctcctatgggggccagatggtcataaacaagggaatcagagcccagcagaacgtgtgcttctgccccagctgtcactgccacagggacccgagcaggtccttacctcctctgtacatagcttcctctccactgaactcaggattgaagaagcaggcactgaacaggaaggaggccctcagggaggaaccaggggagcaggaggctttctgtggggca

SEQ ID NO: 54158 - DNA, 1054 bp, Homo sapiens
ggatgttactttgtttagtgctgtgtttccccaatacttattcaaacgctaatgagactcaccacttctgtatcctcctttctttcagaaccttcaacaagttttacagactcattggatgaagagtgcctgagacactgagggtcagcgctccaaagatggagaagacagatggtaggcaagctgctttgtagggcctggtttaagataagcacttgggctgggaaagaattgttgccacaaatcctggaaatagcctaggaaaggcctgcaggagatatccctcaaacaggcagtgctggtaggctcaagcatgtatttcagattttgtgtatctccagccctagcctaggaaagaggcacaatatggtaagcctccatttatacctaagtgattctacaagtcatttaatgtctttgatcctcaatcctcacatgtatcagttagctttgctgtgtaacaaacagcccaacaatttagtcacttaaagatgttaattatttctcaaaagattctgtgtgttagcagggccattattctggtttgggctggcatggatgatcttttctgggttcattcacatgtccatgggcttctgggtgacttggctgggagctggatggcttagaatggccacactcacatatctggggtatcagtaatgacttggccacgtgtctctcgtcatccaggaggttggctagggcttgttcacatggtgacagaagagttcaagcacaacacaaggacagactgactccaatgtgcagataatgttccagtctctgcatatgtcatattgctgttgacccactggccgacacaagtcataaggccatcatccagtgtcagcgtggtagaggagtaccccaagggtcagatattattgtggctatctttgcaaacagttgacaacaccttttctataaacaggtattaatactatttcatagggttggtaaagaactaaattacgtaatgcatggaaagttgttgagtaacaactacctagcataatgaatgtctgcatgttcccctcttcctgtccccagg

SEQ ID NO: 54159 - DNA, 1022 bp, Homo sapiens
aaggtcagggattacctgaccaagtcctttaacagctgcgaaacagacacagctgtgctgaaggcacgagctatcagctccggccctgcagccgaaacctggctttctgggaaggagacgagtcctccctgctgtgggctatgcagcaggaggatgcaagggaaggtaatgtgggcacagcgttcctcccgactgttttctcttcttcgtgaagctccagattcagctgctgcaatgcaggcgaaaatgacacacacttgcaaaaaacgtgggaatggagttaatgagattgtgttaatgtgtcatttattgagcaggactcatctctgtttgccaggtcggcaggaggtgagcccgctggagaactcagttggcagaatctttctcagtgcttctcacctcctctggtgtcccggcttcggccctctcaatgtttagaagcagcggtcagatgcctcctgcttcttggcacagggaatatttgcacttgaaaggctggggtcctgggatggggaaagaggaagctctcatcatcttggcatgatcagtccaaggtacaggtgatttttttttttttcttatggaaagagtgctttgtctttgcaagggatcatgcagggattggcagggttgttgtttggtgaactaccttgctaaatacttgactttgtaaggttgaattctccaagaattctcgtggcaatgaggctgagacttgagccaagctgtcttttcaaggaaatccaaggtgctatttattttggcatgcagcctgctctgggatgaaataccacatttttattattgcagaataaaaagaggtttgaagagaacaaaagtacagaaccaggtttgtttcaagactaagtaagggaaggtctctttatatttggatttgaggttagaaatgagcttgaaaatggcatcataaaaggcgtaagtgtggagaggagagggtgcggataaatgctgcaggagttgggcttacctggggaaacccatgttcctgggcactgagggtg

SEQ ID NO: 54160 - DNA, 1024 bp, Homo sapiens
ctgccaaactcaagtcttagttcctaagcgccctggagtgcaagcctttagggcaaagagggagtattttccaggagagggaggaggaccccctgaggcctgggcaaagtcctatctaccaaatagggccagaggaggatcagatgcagccagtgacccggctgaggcatggggagaaagcatcttgagttaaacacgattcccaaggacctgcttgggtaaatcaagcccaggttgcttagagcctctcaaaatgtgacacaggaaagctacactgggaatggaggcagagtccgttctaatactgccttttcaagcccagccttcccacttcactggaccataatgtgacctggggaaagtgagttttggggaatggctcggggatcagaccagactgattcaatcaacaaatgctctgtgccaggcactggtcaacgtagtgaggtacagaagtgaacaaaactggcaccttctggcctcatggagcttgcattccagtggccaacaccaacaggaattaaatcactcacataaatagagaattctccagtgctgagttctttgaaaggactagataccctgaaaacctgataggtccagtagtcggtcagtctgcagaatgacaggagagagtggaatgagccttctaggcagaagtagccgcgtgtgagagggcctaaggtgagtagcagagtgggttagaggaactgaaagcctctgttggctgagttactaccaggggcccaaatgggcagtcctttagttgtgcatcccattgactggtccagtcagtgccttcctttctgaactgtaataatgagcagttggaagtcccctggctagatcatagtgtggggagaaggagagagatagaccaatagcaccttgctggactcactgccccatgtgtgcaccttggtcagacagcccatgcctgctcgtggtgccaagagcagcgagcggttcattccctaatgtccattcagctcacagtgaaccaaagcctctgcccaacatttag

SEQ ID NO: 54161 - DNA, 1060 bp, Homo sapiens
cttgccgccgccgggacgcgagaaggcaggtgcgggctgggcgtaaataggccaactccgcggcgagggcgcccggcgcgggggtgtgggccgaggacgccgccgccagcctcccccgaccgggcagcctggtcgctgctcgtccttccagctttctttccgttcccgagagcggtgaaggatggggagaaagaaacgtttccacgcaggttgccctgtgtcggtaattgcgaaattttaccgcgcattttctttcacttacactttttcaagaagtgtttagaacgccgcgtgtcttaaaccttggcgaagatgtccttgtagatttttgttgaaaaatcggaatcgagtcgtgtcatcttataaagaatttaaaactattgggactgagtgttcacgctgtcaacagataatggtcgattcgtcgtgctttctgcgaaagttgatttagttacaggagaaatattttggatgtaacagccccccagttacaaggaaagccaggagcaagaaatagcaaggaagatactgcacctggcaaaatgttacattctcggtgtgagctttgctttgaggggctaggaggtttggttttttgattaagctgacgatccgctatttcacctgcctaatcattcttcccttctgtgtagtctggttactctgtcggtttgagatccagtttctgtcatccattaaattggctctcgagaaaaaccttttatcagaatcattaatgcttggcgatccctgagaacttagcgcaggttggtttatcattcagaagacagcgcttcctcagaagcattaggtagacaggagagtaagtgaagttggagacagaatggagagatggatcagctttccagtgcttcctgatttgggtctcagaaatggtttcagtgtgctgagttcagtatgaattcctagatcagtgtcagccatgtgaaatgcttattaaggatgaaatttgagtgagtcttgtgtagttcattttattactctgcattttaaatttgaaactcgttgctgaagttttgggctttaagtaattttatgg

SEQ ID NO: 54162 - DNA, 1050 bp, Homo sapiens
gctgggattacaggcgtgagctatcgcttccggcccttgaaataataagtttttactacttatactattttactgtaggtctactaaataggatattttgtaatgcgacccttaatccatagcaggctgattttaaaaattcagtagcttctgttttttgttctttaagaacagtgtggtatgcttcttcatttaagcaataaatattgagtgcttattggcaggcattaggttttcaaatgttaatttctaatttgtaccattcccttggtaaatttgttttcaaaattgatgattttgttgccaaaactgataaccaaaaactaatgaaactttctctgtgattaacagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaatgtatgtatcttacatttctgtactttaaaaattctacagtaaagcagcagtgaacttggttgacaactccagtctgacttgatagtctgtagcggcacaaaaaagtacgcttcagtgtacttcttagtcaaatctagcagtttatagtaggaacagcaaaactggtggttccccgtaggaatcacatcgataatgtttaactcatgttaacactgtgctcagccatttagactaacttggagaaatatttgttgactaaaattgtctttctgagtttaaatttgattatttgtagtgcaaaacatctgtgtaggggtaaaaggttttatatatatatatatatatatttgtttggttcagaagacttgacagttataagacattttaaactctagtcatgtaactagtcatacctgttggaggcatatgattgcaaattataaaaataaactttaagtaa

SEQ ID NO: 54163 - DNA, 1534 bp, Homo sapiens
ttaagggaattgttctgtggcttgttatgtgtaataatgtttttaaatgcttttaaaacttttattctgggcatatagcaatttttgagcctgtatttcttaaaatgtcatctgaacaagattcacatacttttcagattatacaacttttgggaaaagactaaatctacagaagtaatattttcaccttgtttctttaagataactacttatcgttctcccttctatatttcatagtgatcaagttgttcctgcagcacagtcttcacctataaactgtgagaagagagaaaacttgttaccatttgtgggactgaataatctcggcaatacttgctatcttaatagtatacttcaggtaaattgacaattttgctatatcataaagctttagtaggcaaagattgatgtagcatttaatgtttttgagttattggaggactttaatgtccatactgtctttgcctttgattgttaataaaccagaataggctaaaataataagttacatgttattaaacttcctttggggtaagagaaaatgatagactaaataaaggtgggatagcaaaattgagtagaccttaagtggaaggtcaaacctttaatttctttctctgattcctggtgctacagtgtgatatatgtcttatcccttggaagtaacgttggcattgtgttgtgtgtccgttggcgctgtgttgtgtgtccttgtaaccttaaagtcttagcaatatctgcccaggtgcagtgctttgtgctaatgagggaagacactgggctactactgatgaagtggagaacaaattttgacacaaaacttaatctcagaattttagggtaatacatgttaaaagtgctctatagaaagcatgatgttgttttaatgattttacgtgtattgtttgttcagtaaacacttaagacaatctcactttttataggtattatatttttgtcccggttttaaatctggagtaaagcacttatttaatattatttcaaggaagaaagaagctctaaaggatgaagccaatcaaaaagacaaggtaagaaaaataaagaacagaaaataatgtaaaaagcaaaagtaaattaatggaaatttacttgcctggaaatgaagaggactgggggggtggatgacaaagattatttctctgttagcgagctattgtcaggcaattatttttcattctttcaaggtggctaactagataattcccttttacaatgtttgctcctgtaatctgtgtatcaaacttttgttacttgtatactatatattactgtatactataatcacaatatgttatacccatgtacaacttatttacccattgtgttttcaaattgagttaaaatttaaatacagtgtatttaaagaaatctttaacttccataattaaaaaaccattgtaattcacataaatagtaattcataattcctcttaaaattacaaaaaagaccagacgtggtggctcatgcctgtaatcccagcagtttgggaggtcaaggtgggtggtggattgc

SEQ ID NO: 54164 - DNA, 3456 bp, Homo sapiens
atagtacctcatagggttattgtgaagataatgtatacataggagataaaaaacattttgactaaaacctggtgtatggtaagcattatctaagtattagttattaatatatttagaagaggatcaaagtattataatgaaaatagggtacaatttactcttacttttagttacagataagaaattccaaattagtgctgaataaatgtcttgacatttaaaaaatgaaataatttatgattttccttacatgaattaatttctatataggctttatgtactgtatcttcaaaactagaatagatgaaatggaaatttttatttatagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggttagtataattcttagactttgataggtagaagcattagcagctacagaattagaattttctcttcctagatacatgtacaatataatctctggctaaaattgtttcaagagaaggaaatttaacactgaatgtgaactatggtgttttaagtgctatgcttagattagtgtgtgtgtatatattgtatgcatatatatgtgtgtgtgtgtgtgtgtaatgtcattaaagtaattttaatttatagcttataaagtagggaagttcggccaggtatgttagctcgcacctgcaatcccagtactttgggaggcctaggcgggcagatcacctgcggtcaggagttcaagagcagcctggtcaacatggtgaaaccccgtctctactaaaaatgcaaaaattagccaggcatggtggcgcacgcctgtagtcccagctacttgagaggctgaggcaggagaatcgcctgaacccgggaggtggaggttgcagtgagccaatattatgccactgcactccagcctggggcgacagagcaagactccgtctcaaaaaaaaacaaataataataaagtagggaagttcagtatattttaatgtacatttaagagtacatttccctttatgcagtgtttgacataaactgatgaaggacattgcatttagtgaaattttaaaagtaaagactaagtacagtcatgtgttgcttaacaacagggatatgttctgagaaatgtgctgtttcattgtgtgaatttcacggtgtacttacacaactagatgctagagcgtactacacaactagcctatatggtatagaccagggtatctaatcttttggcttccttgggccacactggaagaagtgtcttgggccacaccacacagaatacactaatgatagctgatgagccaaaaaaaaaaaaatcaaaaaagtctcataatgttttaagaaagtttatgaatttgttacgggctacaggcaagctttgcatggcctattgctcctaggcaacaaacctgtatagcatataactactgaatactgtaggcaactgtagcacaatggtatttgtgtatctaagacgtatctaagcatagatatgtaaacataggtacagtaaaaataatcatagactactgtcacatgcggtccattgttaaataattgaaacgttggtaggtggtgcataactgtaagttacacgatacttgaactagatttttacctagttttgtccagatctacagatatcagggaaaatgtgtaatattgatatagtgaatagttttaccaaaaatgtcatccttattctgggtttattctatggggaggtgtctgtaggaagggagttacaatacaactgacttttttttattttttattttttttatttttttggagacagagttttgctcttgttgcccaggctagagtgcaatggcatgatcttggctcactgcaacctccacctcccgggttcaagcgatcctcctgcctcagcctcccgagtagctgtgattacaggcatgcaccaccacacccggctaattttgtatttttactggagacagggtttctccatgttggtcaggctggtcttgaactccgacctcaggtgatctgcccgcctcagcctcccaaagtcttgggattacaggcttaagccactgtgcccggcctacaactgacttcttttaaagacagtaatttcatagtcagttttatctttacagggaccttaaatttcattaatagggtacctctaataagctaataatgctaataagctgatctatgaaaatggaactgttattcatgatatactttatttaaatggaaaattggttatttggactataatgagaaactaatctgtatagacttacattttcctattttcattttaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaagtaagcaaaattggagtcttgtgtggaccatgatggaatatttataattctttaacaacacaaagtttaatagtagctggtgtaattagggaggggaaaaaagctagcttttagtgtctaatgtaacctttctgcttatctggcttcacttataaatggttagcatttgggaaattgtgacatcttgattttgatgtagagtgtgttagaatggaaaactgaaatgctttaataagtgtacttttgggaacctgagtctttcagagctactgagggttttttttaatttttttgagatggagtcttgctcggttgcccaggctggagtgcagtggcgtgatctcggctcactgc

SEQ ID NO: 54165 - DNA, 1347 bp, Homo sapiens
acactaaaagctagcttttttcccctccctaattacaccagctactattaaactttgtgttgttaaagaattataaatattccatcatggtccacacaagactccaattttgcttactttcagaactctcctctactttggaaagctcatcttcttgtactggcacactgatgtcttgaaaatcttctcttctttctgttaaactttcacattccaagcaacgcgtccttaataccagctgaccttgaaataatttctccactagctcaaaaccaatttgttcttcacctaaaatgaaaataggaaaatgtaagtctatacagattagtttctcattatagtccaaataaccaattttccatttaaataaagtatatcatgaataacagttccattttcatagatcagcttattagcattattagcttattagaggtaccctattaatgaaatttaaggtccctgtaaagataaaactgactatgaaattactgtctttaaaagaagtcagttgtaggccgggcacagtggcttaagcctgtaatcccaagactttgggaggctgaggcgggcagatcacctgaggtcggagttcaagaccagcctgaccaacatggagaaaccctgtctccagtaaaaatacaaaattagccgggtgtggtggtgcatgcctgtaatcacagctactcgggaggctgaggcaggaggatcgcttgaacccgggaggtggaggttgcagtgagccaagatcatgccattgcactctagcctgggcaacaagagcaaaactctgtctccaaaaaaataaaaaaaataaaaaataaaaaaaagtcagttgtattgtaactcccttcctacagacacctccccatagaataaacccagaataaggatgacatttttggtaaaactattcactatatcaatattacacattttccctgatatctgtagatctggacaaaactaggtaaaaatctagttcaagtatcgtgtaacttacagttatgcaccacctaccaacgtttcaattatttaacaatggaccgcatgtgacagtagtctatgattatttttactgtacctatgtttacatatctatgcttagatacgtcttagatacacaaataccattgtgctacagttgcctacagtattcagtagttatatgctatacaggtttgttgcctaggagcaataggccatgcaaagcttgcctgtagcccgtaacaaattcataaactttcttaaaacattatgagacttttttgatttttttttttttggctcatcagctatcattagtgtattctgtgtggtgtggcccaagacacttcttccagtgtg

SEQ ID NO: 54166 - DNA, 2218 bp, Homo sapiens
tgcacaaaattaggaaaataaaggaaaaaatacaattatttcttccacagaaatgcctgaatattagcagttatttatttttttgtttctgcatatattataaatattattcaaagttggggtcttgttttgattctgcttttctgatatatgaacactggatattaagggttcattcagatttttacttggtttcagattggggtataacattttgaatttaaaatagaactgcaggaaaccttttctttttttcctcccaaaggtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatgtatatgaatatttgaattttttacttgtatatttttataaatacagctgagttttcttaaagcgaataagtgtgtgtatatatatatgtatatatatgagagaataagcatgcataattacctttattactgaatactttctgacagtgcaggagtttttcaaagaggagaaattgtgcttagtccagccaagctgtcatacttaaaagaggtttataatgaaatctgttgcatctaattgtcctttaaagtagacatgatttaatggaatccaaaactggaaaagttaagatgatgctttgggcacacataaaaacttggttaaaatttcattttaaactagtatactgaagtggtaagtgatgaatgatttcatgacttgttaatggacattcttggtactaagtttttcctagaaatgattctaaatatgtaaatgctattggggtaacactttaat

SEQ ID NO: 54167 - DNA, 1092 bp, Homo sapiens
gtatggtagggttgtgggagaggggaataagtatatgctattaaagagtagtaaattctacacagattacttattattgtcaaccgcttttctgtttttttgttttctctctctctctctttctgacacaggctcctgctctgtcacccaggctggagtgcagtgtacaatcatagtttactacagcctccaactcctagctcaagcaattctcctgtctcagcctcccgagtagctggcactacaggcgcacaacctacacttggctaatttttaaatttttttcgtagagatggggtcttgctttgttttccaggctggtctcaaactcctggcctcaaatgattcttctgcctcagcctcccaaagtgctgagattgcaggtgtaagccactgtgcctagcctattttctcttttcaatggttccttaaggcccttatgtcatactgtggtattggacagtctcaatttgaagatctttacgcagaaagccttgaataccttttagtaaaatctttaaagcagagtcgcagtttattatgatgtctgaagagctttgggtcactaggtatttcagacagaaaaacctgggcaacttccaaaggcccctgcaaaataagaaaataagaagtgtgtttttttgttatctctaaaatcacagagacagaatttactcaaatgatttttcttagctctgagatggctgcatttaagcttaatgcatatatgcctatgcctatattaaaactccacagactatttcagtattttctaatttcattctacattcttatctagtggaattaacttcttatgagtttattcttcaaagaaacagaataggaactcaaggactgactactatgttcattaatgtattttgctttgtatttttcacattctttaatgtatcctggatgtaaaagttgtcaagctactacatctgccaatccgctgattatcagagttgattttgctaaaacaggttccctcagtattccaaaggtattccggacattgtgttaaagaagataatcttttgtaagctacatcatttggagacaaaaccttaaaatcgtgcatgtttctaa

SEQ ID NO: 54168 - DNA, 1044 bp, Homo sapiens
ttagatggccgtgcccatggggaacttcatgaacaattcaaaaggaagaccattctgactacgtctcatgcctttccttatattaaaacaagggtcaatgtcactcataaagaagaggtaagtccattaatgggcaaacagcattagtgaagcaaatacattcaagccatgtaacaacaactcagatgtaccagaagatatgtaccatcccttataccataacatattagaactttacccatttttgagtcctcaattttttacttcttttctaagaccctaattcacccccagctttttctttaaaaggttgattttttttttttcatttaggaatccaagtttggaattttattgttacatgaaagtttacaattgatcttttttttttctaatttcagttgattatacataaagttcattaaatagttttcagtcagtacactgatttaacagatgctcttttactcagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggttagtgctttttgctagcactgtgtgatttaagctgtaaatacgatttgggataatttcagatcagaaataattgttaagtcagatgaaaaggatctgccttctctactgcctgtatttttctacctatgcgatcttataaattctattaagaaggaattgattcacttaaaataatatttccttaaaaagcttgtacaaaagaatgtgatctttaaaacaaggactcattttcagagctatgtacatatttgcgaacctctactatgttagattctccctgatgttaccttccccagatctcctttacaataagttgtgaggattaaataagtgatatggaatcatttttttaatttgaaaaatatattgacacaagaaattattgttcttttgtcatatgcagattagaagccatccccattagt

SEQ ID NO: 54169 - DNA, 1546 bp, Homo sapiens
atccccagtgataacatagtcatgtgatacttttttttccattcaaagatcacaacatatttctttaaagaacaccactactctagtaaagtatatcttacattttctggaaaggctagagaagatctctactagatccctaaggaaatatagattaccctaacttttgagattgacagatgcaaattgactatatcttaactctcattattggactgaatggacatgaatgtgagccagtattttggtttttatatgttcagaaatactggccatagttctggctcagtggcttctgttggatttttattttcttcaatccacactaaagctgagtgacataaagtaacacatccaagcagttaaaagatagaacaggattagaaacagcaaattataatgagcagggcgatcaactctgaaagagggaaatgaaataaaaattcaagaatagagcatagtgaaaacaagtacttttgggtagtcaagtgggtaaatgtgacactctaaaggagaaagtaaaacaggtcaggcacagtggcccacacctgtaatcccagcactttgggaggccaaggtgggaggatcgctttagttcaggagtttaagaccagcatggtcaacatggcaaaacccatgtctctaccaaaaagaaacaaaaaaaattgctggggcatgtacctgtggtctcagctacttggaaggctgaggtgggaggattgcttgagccgggaaggtagagtttgcagtgcgctgagaccatgctactatgctccagcctgggcaacaaaacgagaccctgtctcaaaaaaaaaaaaaagaaatcagaacattgtaggtataaaacatccatgagcctttacctcagaaaggtaaagttagatatgaagaaagttaaggaaaacatagtaaatgggaagaatcttagtatctctaagaggagatactttctggtagttagtgactccctgatgactggtatagacccataactgagcacctgataatatatcccataccactgattttttttctgccccttatgctacttttgagaagaaaaagaaagatatgaaagcccagcatggtggctgacacctgtaatcccaacattatgggaggccaaggcgcgatcctcgcttgaggcctgaagtttgaaaccagtctgggcaacactgagatctcatctctacccaaaaaaaaaaaaaaaaaaaaaaaaaaaaaaaaaaaaattagctgggcatggtggtgtgtacctgtggtcctagctacttgggagactgaagcaggaagatcacttaggcccaagagtttgaggttacagtgaactatgatcaccactgcactctagcctgggtgacatagtaagaccctgtcttttaaaaagaaagaaaaatatggacagcaaatatttactatgtagatgatattagatgtggtttctttttttcggactgggacataaaatggtcagatatgtccttctgataagaaatggagtacaatatatcttggaagaatgtgttttgtcagtaagccaccaacc

SEQ ID NO: 54170 - DNA, 1679 bp, Homo sapiens
catttaaattatatttattctttttcccccttttcttattcaaatcctgcttagctccttcttgaagccatcctagatcttatgttatcatttttttatcttttaaaactttacttatacatacagggaggcctttatttatacatagggaggcctgtaacatccataactaaattgcaagtacatctctattttatttgtttatttttaaattgcagaccgtttctgtaacggaatccaaagagagcattcttggtggagtgctaaaagtgctactacacagcatggcctgtaaccaaagtgcagtttatctacaacactgttttgctacacagagagccttggtttcaaaggtaggttattttgtacctgcagtgttgtcagactttgttttttttattaacattgtctaagatcatttgacacattcattggttaatatatgtagtaatatattaatgaatatgtgtagttaaaatttaaataataacctaagacccttaattcttctttgcctctctactgctgcctgccttttagaatttttcatttattcgaatcacctttaaccagttctggtttgaaaaacagtaacttggatgtggagaagggcctgaaattaatagccaatcttaaatatggggcttctcttgttttctcttcacttggttctgtttttataaaaaactcaatttataaagaattcaatatataagcaattcaacccactgaaattattttatgatgaatggaaaagaaggtatgtgtttgttcaactgctttaaatgtttacttcttatatttgttttcccttagaaatatgtatattcttaaattttgaaggtagctatttcattttaatcatcctagaggatggaatgcagagatgttgatgaaaataacttacgtattattttgtaataaatatagaattcatatatgttgattactaagtgttttatgcacattctgatagaagcttcacaacaatcccttgtagatatattattaggcctattttgtggatgagaaaacttgtccaaggtcccactactagttagtaagtggaataatgagcattcgaacccagtttgactctgtgtctcacactattaaccattagctaatattgtcctaaccattcttttaatttctgggctatactaacaagtctccagttcaggttatattaacatatctcagaaacttttactgtaaaaattcagtggtggtttgttttgttgttttacagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaatgtaagtattttatcatgaaaattctctgtattcataatgaaatataacttctgctgatagttattaaatcagtttttgggagagcatggagttttttgtatatttttagtctaatcataggctatcttgatatttctcattctgtgtatatcttacaaaaatccaaatctccaattgtgtgcatatcatgtgtacgtatgtatgtatgtatgtatattaatacagacttagaatataaatgtacattgagcagttttaaattttaattgtccct

SEQ ID NO: 54171 - DNA, 1005 bp, Homo sapiens
tgcatgtatagctatagctacatatagataaactgggtttatgcagtatcctctgtataccacagcaatgtttcaggctttttatctataatcattgtgttgggtcctaacagttgccctctgggcagtattctgtagtaacaatgtgatagctgacatttatttagttttttctgtgttaaacattgtcctaagcactttacaaatattaactcatttgatccttctaagaaactcatgacattgaaactgtcagtatcctcatcttgtagatgagaacacttaggcacaaagatgttaaataactgcccataatgacgcagctagtatgtagaagagccaggattcaaatcagttagcaagatctttcagatgttttagtaaatatatctctcacctattccttccattccttttctactaccactactctgccaggttcatatttccacgctattacaatggccacctacttcataactcactctgtattcttcccaccatccattctgtacattgttgtgagaattttcctttaaaagtattttatggctgggcacggtggctcatgcctgtaatcccagcaatttgggaagctgaggtgggtggatcacttcaagtcaggagttcaagaccagcctagtcaacatggcaaaaccctgactctactctattttatttatttatttatttatttatttatttatttttgaggtggagtttcgctcttgttgcccaggctggagtgcagtggcgcaatctcagctcaccacaacctccgcctcccgggttcaagtgattctcctgcctcagcctcccaagtagctgggattacaggcatgcgccaccacgcccagctgattgtgtatttttagtagagacagggtttctccacgttggttaggctggtctcgaactcctgacctcaggtgatccacccacctcagcctcccaaagtgtggggattacaggcgtgagccactgcacccagccaaccctgactct

SEQ ID NO: 54172 - DNA, 1063 bp, Homo sapiens
tccattaggtaggggatttttctttccgaaaaagggaataatttatttttggtaaatgtgaaaagatctgatttgatgaaataacaattacagcattttaaaatttaccttgtttagcttcaaaatgtaactataagtagtcttagtttctttatattcaaatacactaataaggagttaatgtaaaaatattcagatttacttctaagtgaatttgtatagcatttccttttcttcaattcttattttacacattttttacatttttatacatttattttaaaatgagaaatgttttataggaatggaatgcatgcaaatatatgacaaaggtaagaaattgaacaaaatttattcaataccatgacttactgtttgttttaaagatgttagctaatctctgtggccttactgctttttcttctttgtcttcttctttttaaatagactgtttggattgcataagaaagtcatcaatatggtacacaatttactctccagtcacgactcagacccgcggtactctgaccctcagataaaggctcgagtggccatgttgtatctacctctgattggtattatcatggaaactgtacctcagctgtatgattttacaggtacctagtataattaaggcaaatattaaaggcaaagctcaatgtttaaaagtgttagaaaatatctcaaggatgaagatcttattttaggaaaataagaattgtgtgctgatcaaagtaaactataaatattaaactatattgccagaaaacctttgaccgtgtgagagaattccgtataagattgctttaagtagttcttatgatgaatttaaaaataatgattttatagcaattctgtacctacattttaggaaatgtttgtgtgaacatgcagtatacatctgaaaaaatacaagaaaacttgacagatgtttaccacctcagttttgacttgattcatatatataaaattgaaatgaatattcacttgaatatcaggaattgtgtttattgctaacaccaggttaataagttgaagtggtattacttcttcaaaactagaa

SEQ ID NO: 54173 - DNA, 1034 bp, Homo sapiens
gatgaagcataattgaacagagaaagaagtcaaactgcagtggaggcatgacaaagccctgcttaactctcttgtatccagaaaccccaaaggaaaccagatgaaaattgatgggtttttcagtgggtggcacttgacttcaacagctagtaggttctctgtagatgaaaaagtgttattgtagcagttaatatgtatgtcctcttttataaattgagatgaagagattttgtggttttagtatcagagaagcctatattttcctttgtccagtgaaatactcgttctactgtattattcctgaggcaaggaggctactttttttaagctcttaatttctaaagtgaaagttagttaatcttaatacttcttaattttgttttcaatatatttaattcctgaataggattctgtaggtgatatctcatatgcgtgatttaaaaaacaaaatttaaacttcagctagaaagactagaaaacatcaaagagtacccacaacttttcattttatctctgtaaaaaaatcttctggatcagcctatttttccacaaactcttcagtctggctagcatgcccttaatctaatggatgaggctggcctttttctttctttccctgtcctctgccaaagatgtagctacacaaagacagattaatcataaatatggttgctaacacccttaaggaaacatatttgtttatatctaattccttactgaacatctctttcagccaggaaatgctcatagaatttcttctgttatcttgttgcccactttctcagctagctatgtaattttcagattctttcagataacagagacatcactcttttttgaaaggctaagaagagttttatattcttattaggagaagatttcgccatagagaaatgtgaaatctattgttgcactaagaaaccccacatgagtcctgaatatggactgtatcttggagaatgctataatattttgaagtattaagatgttaaaaaaaaaactcagacaacaaaatgatggtaattttccagaga

SEQ ID NO: 54174 - DNA, 1047 bp, Homo sapiens
tatctttgggattgactatttttaggatttagtgaattcaaatttgatcatcaaattttagtaccaaaaaaatgtatcaactcttaattctgtttctgtaactgcttctgttttgtgttttaaatctccagggaaaggaagatgagttagaaaaattgtcactcttagtaagatatgttgatttgcttcccttatgcacagttttgttagtcctttttcatattaatatacactactttgcaaatgctttgtatgcatatccattataaggcagaaatcttctgctatttttttttaaaaagaccttacctgaaaacttgaaaattaatggctcatagcaaagtttaaattttaaaatgtatttcctaaattgtaccagcaaagttcatgcatgtatttgcgtatgtttaaaaatgtacttaagatacaaacaaaatattactgtactataagtttttagtctagtttctgtttgcaggtacaatttaggaggctatcttctacctgtccttttaaaattacattttactgcaagataacatgtaattttttcagctgttccacataccactgtcttacatacataaatagccgtttcgttaatgggtgtcttcagtgcatcattgaatggttcacgtgccttattttgcttattctcattatatcttcgtttgtatttgcattatgatttggtttatgttatcagcagatttgactttgataataactttggatttacttctggatagctttttcacgaggagctggctttgcagtgggttgtttgcagtggcagcgttcgggaatcagctttgcaacaagcctggttcttttttgaattaatggtgagcaaaaactgagcatgttctttaatattttttctcttagtgaacaattttatgctagctcatttgttaccttagaaatctttttctgttgcacatcttaacgcttttccatgtgcctctaagacaaaattacatgtgttacatctctaaataaacactgtggacactcaacacagtttaggtggaattaagagtgagg

SEQ ID NO: 54175 - DNA, 1074 bp, Homo sapiens
tctattatatgcttagggtttagatcgctccaattcctgggttaacactggtggtccaaaagctgccccatggggatccaaccccagtccaagtgcagaatcaacacaggtggtgtttatattagaggtttctttattggctgctgatgtttccctttagaacattactttttagtatatactatgatttcagtggcttgctttttttaatcattaaaaagtgtgtatttttgtttacttagcacattttccaactactatgcatgagtaccaccaattgcaccagtaatgttcttctttcctatttcctatctctgtcttctttcttccttacacaccctatcaatatttcagtgcctgctgcttatgcaattgatggcttttataacagtttcttctttaggggtagcacgtctttaatagcaatttttaaattttttacgtggaggaaaaaacccaacagttttctatttgcttttggtttaaagtgtaactattgtatcattttcatttaacatttactatcttgttattttcttcctaatcaccgaatagaaagactggcaataagttgaaattgaatgtgaacagtatatgatccccgtgctataagactcaataccagaagcaaaaatccattttaatttgtactgtgttgcaaagtatgaaatttgttataccttagctgaattaggttttgcttacttaagactagttgcttgatagctaatactgcatgatatctcaaaatatacttctcatctgtgttggctttggagggaaatcctgttcctaaataaaatttttaattccatttctaatattgtaaatgatttatatttgatttagtatatgacaaacctgaatagtagtttttgataataatgaaaaagtgaaagaaattattctaaactttttcttttctttaatataaagttactgatttcttttttggtctgagaccagttgagaagtatgtttttactttttatatatttttactagatatgtgcatgtatatagatcacacagataaaagtttcattctttgcaacactctgaatattatataat

SEQ ID NO: 54176 - DNA, 1002 bp, Homo sapiens
ttttatcaaatgccagtggaattttgcactgatacgtttctttctcatatatcatctttttttaatttctcaaacactgagagcttactgtgtgctaggcactatgctgaggacttgtggatatgaagtaaaatctttgtaatataacacaagtgttgatgtcacatcaaatacagtatgggccttgctcaaggatcttatctatatgtaagggaagaaatcaatagtgttactgggatttggcaaaaaaaacctcacacttacatacacgtgggcacacatttggttaatctgttccatgtttgttggaaattggtaaacataaagttattatattaaatataagtgatgagtttgcttaaatgtgggctgtttgatataactcttagctttataacacctgaattatggaatttacttgctttgccaaataactggccacaagttttctttaaatagttagctttgactagtgtaattacaactgttcagaacatcagtattgtgtatataaatataattcatagcacaaagagatttttttattctcatattagcgattatcatatattgtagttttaaaggaaattattaaacagtaagttaagtaaatttaagagtacagcaaagttcttattctttttgtggaaattcatgagagaaaagaggacagttataattttgcaaaaatcaaatgctcatgttttgttatttttgtaacatgagtagtgactgtaaaaattgaatatggtaggaagaactttacacttttatacaaaaaagacataattttgggcttggacataattttggagactaatgagaactttattttaacttctatgaaaaacataagccttttggtttgcttttattcgaaatattgtaatgggattctgagaaggcagatattttattttaaacaaatctgattgcataatcttactagtattttgatattgtctaatttactttgatagaaagcattttaagaaaaatatg

SEQ ID NO: 54177 - DNA, 1408 bp, Homo sapiens
ttgttagtgtcaccagcacccttcatgttgctaaatccagtggttaattttcagaactcggcttacttttacctaccagcagcttttcacacagttaaatttttttttcctctgtgatttattcatttatttggcttccagggtactacattctgttagtttccctcttggtttactgattataccttttcagtctttgtggattcttccttttctgatctctttatctggatgtgtttcaggcctctgtccttatttctcttctcttgtcttctctctacactctaccttggtcagcttatcaggttccatggctttaaataccacgtaaatgttatgctaatgattcccaaaattatatttccagtacagatctctctctggagttctaaacttaactgctttttctaaatagttttgttcagatttggatatatatgaaaggtagagacacttctttccatctccattgctaccatcttggtctgagcaaccatcatctctcccagaactaatgtactagttttaaagatggtttccctacttctaccctgtgctctgttcacaacatagcaaccagaatgttgctttaaagacttaagacatggctgggcgtggtggctcacgcccataatcccagcagtttgggaggctgaggcaggtggatcacctgaggttgggagttcgagaccagcctgaccaacatggagaaaccccgtctctactaaaaatagaaaaattagctgggtgtggtggtgcatgcctgtaatcctagctactcaggaggctgaggcaggagaatcacttgaacccaggaggcggaggttgtggtgagccaagatcgcgccattgcactccagcctgggcaacagagctagactctgtctcaaaaaaaaaaaaaaagacttaagacacacacaaaaattaagtcattatgtcattcctctgagcacaatcttctaatggcttattctctcagtcctttaagtctttactctgaaggccgccttctcagtgaggttgactctgattatcttatttaaatgtataaccagtggctgtgtcctcagccttctaatcctgttattctgttttttgtctttttttttttgtctgacatttactaccttttaatgtagcatatgaattaattattcttatgttgatttttttttagtgtttatctccctttaacagagtgtaagcttcattgtggcagggaatatttgttccaaggcacctgtaatgtctaacttattcaaggtgctcagtagatatttatccaatgaagaaatgttagtatgagttaacaccgcaggactagatcacttgtttaagaacagaattatgcttttgtttgccctcttactattgggattaattatgtatttaaaggtctgcagagatt

SEQ ID NO: 54178 - DNA, 1059 bp, Homo sapiens
tctcctgtttttcttgtagtacctcaacttagtttatctactcctttgcaatctctaatcttgatcctccaacctttttactgtgtctcacccccttaatgttctctcttcttccttagccagcttaatgtctgtgggcaatcattataattattcccatcaggctgggtatggtggctcatgcctgtaatcccagcacttcaggaggctgaggcgggcagatcacctgaggtcaggagttcaaaaccagcctggccaacatggtgaaacctcgcctctactaaaaatacaaaaattagccaggcacggcggcagatgcctgtaatcccagctactctggaggctgagataggtgaatcgcttgaacctgggaggcggaggttgcagggagccgagatctcaccattgcactccagcctgtgagacaagagtgaaactctatttcagaaaaaaaaaaaaaaaattactcccattataatcaaacctcagttcccttatctttcccaaaccttgaaaccatagttaaacccaattgactgcctgtgccatgtcagcatctgtgcagctaaacatgtcttgagaaataccatggtgattgatctcatttgaaataaacctcaagagagcccttaatgctattgggcaattatactgtatttctgtatctccatcactttcctgttctcccaggaaatgatttaattccttctttcattacctcaaacctcctaacacctctcccctcattccttttctcattttatctcccatttcattgagacaactgaaaccatcagaagaagactttgataaacttttaccatgctatctagctacctattaccatctactatctactgcctaatactcttctgtattaaaaatgaatagatgagctatttatttttctaaattaatttctttcactcaagctctcatctggtctcacctgctcaagatctacactccaccagtttttccatatctcttccacatcatcagtttctccctaaatactgaatcattcccattcacatataggcatgctattgtttttct

SEQ ID NO: 54179 - DNA, 1105 bp, Homo sapiens
agcaattcatgatctttgtggaattttctaaagtggcagagattttttttcagatcctttcctgactaattttctttaattatgtgctatttcatatacaactctaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaaggtaaactgaagacatgcatctgtaaatttggtttttgttttgtgaacaaacgagaaatatccagttgttgtaatgtattctgaattttgagatgtatgtaagttaggaattaggaaggaattgtacatttctgttctatcagtaaacactgttttatttttctgttaaatatgcttgctcttacaaactactccactaaaaattctaaaatttgtctggaatcactagttgcatataacttattgttgtcagtctgatactccatcatgtgaaaaatggctagattgatttcatatagaattaaaataaatctgtgactgatatgtagaagagagatgtcatcattgattcaagtcatgagatcctcttctccaaaaaatatccagaagagtgattaaacaattttccatttttgtaaactagaaagagtgatactcagagttatttataagggatactgcagagtaacctgagtactatggcagctgcgaaaagagaacgcttcccccaccccccacacacatttatttccatgtttaagaaaagaactcaggttttttattcctgttttcattattgattatattttattgtaatacaggtagtacgtagcattatttatatactgtatatttatatactgcataggtcttcagtagaataagtttgatttttggattttcagaaactttcctaaagaaaagaagctatagacagcatttccttaaggttcttttaaaatgtctcttaatttttgtaagatttacattaagactcatttagcataattctatttatttcttttaggtttgatagattataaactca

SEQ ID NO: 54180 - DNA, 1056 bp, Homo sapiens
cagaccagcctggtcaacatagcaagaccccatctcttaaaaaaaaaaaaaaaagaaaagaaaaagaaaaacatgagaactttcatgctttatacatttcttctgtgaggtagaaggcaagatttgctaaggaggaattaaggaggaccttagttttgagaaggattcttgtaacttggagtagctactgtaagaaaaaggaaaaggattaaccagaaacacaggtaggatcgcttaacttcgctcaggtttctgtctctggtctctttcccctctagttcagtatatatagattaatcttcctaaatgaccattttatctgattattctacttttgggaaaacttaattggcctcattatctcttcataatttcctgtcttggttaaataaattatagaatctaagatcctattgctcaaagtggctgttcagtttacccatttatgcagtgtgcaatttatcacaattctccaatttttgtaaaattattgttacatactgacttgagtgaccgagtaggtattgcttagcctgggatttaaaatgctgtagtcttacctcaacctgtttttctagccccctctttttttttttttccttctaatcattttacagattcactcattccaatcaagttgcttattcactattttcttattatactgttattattttcaataatctcttttattattgatatttttaatttttttaaacaaaagtaatatatgcccttatatgctatttagatttttggagtaatctttaaaatgaaaaattgcttcttaaggtattacacacgatgtattttcttttttcttatgtactttgtattgttttactaaataacatatccgttgagcattgttttcttttttgactaatcaaacccatataattttcatcttaaattagtaaaatgagttctcattttgttcagaaaagtatttttggctcagctaatgcaacgtgtaattaaaagtcaatatcaaatagtaatcatctttatacacttactgtgtagtcactatacttaaagtatgcaaagatgaca

SEQ ID NO: 54181 - DNA, 1085 bp, Homo sapiens
acactgataggcactgttcagggcatggttcctgactttaacatctcacagactagttaagaaaacaggcaaacaggtaaatcatgttgtattttacaggatgtataatctacctactctacattttcattcatctgctatcctccgcttaatgtagctcttctttccttcattttcttagtctctgttttctctttttattttctataattctggaaggaaaggtgttcttcattcccatcgtttttcaaggtttactccttatttttttaccaacagctttcacccaaatcctgcagggaagttgaacttgaaagaaatttcagctaaccagatataatttttatgtttgactagtgacacaaaggagaggagtattcaattatttgagtttttttaggggagatttataagtagaaataattcctgggttgagtatttaaagatgaataggagtctgacaggtaaatattattccaaggagattaaacagcatgaaacagcatgtacatagtacacagacataatgaactcagaatgaatttgggggaggaattttaagtaattagttataaattagaggattgattagaggtaatatggagagtgggagatgaagttgggtcttccacactttaggaaattgggactttttctgtagggaataaatagcctttgaagaatctggtcttaattagagaagtaacatgaccaagtttgactagaaaaagatggctatgctatgtagagatgacttaaaagtgggaaaacctacaggcagggagacaaattaggagtcttgcagaatttcatacaaaaaatgatgagttcctgttaaaacatgggtgacaatgggatggagaagagagaatggattgtgagatcacagagtgtacagttacagaaattatagaagaaggttttaaggaaaaaaaggttagcattgttctttgttatagattatataagtaaaataatagtaataacagtaattgcaaacacttgcatagcatttactgtgtaccaggaataatgctatgtgctttatttatatttgagagccaagattcaaactggttccagag

SEQ ID NO: 54182 - DNA, 1066 bp, Homo sapiens
tgagggaagtttttttttaatcttcatctttaaaaccaccacaaaagtaatgcaatgtttagccaaaggtgggcaattaaacctacttattgaatgaataactctcttagatatttaattttcaacaaaagtcttcacattacatgatttttaggacagaagtgaactaaaacactgaataccaagaaatatattgataaggaagatagtaatttctaaaaattatctcattttattgctaggtctttatttttgttctcagcattagtggaattaaaatgactatgccatctgacattgttggtaaactcaactttctcataattcagtggtgatttggtgggattggtaataagatgcctagtgtcttattttttttcactgaagtcatcaagttctcagatggctaacattagctatctttcttgtttattatcaaaagccttgttctacttaatattcctgtgttcaagtctatacctgttaatgtttttgaggcttatttgagatagaaggatatttgacctattaacatctaaggaagaaaacctgattggtgggacagacctcgctttaaagatagttggagcaatatggtttggttgcatttttgttgaatgtaattctgagagatactcactgaatatggaaggttgggatgctaaggttttatccctttttgttatgaatagcagccgtgcttttctataaaagtgccctcttgggattattctcaatgaatattgagaagaaagtgtcattggtttggtcaaacaagatatttgatgtattcttaagagtctggaagcgcttctaaactgaggcaaatgcagtttgtgggcgtttcctgattttactggttttttttgtttgttttagtggtcaattctagtccatatttaggatttaggtaactttttttatttcttcaacagtgagatggttgatataagacagtctatagagcaaaacttgatcttttttttttttttttttttttcggtctcactctgtcacctaggccagagtgcagtggcaggatcatagctcactgcagccttgaact

SEQ ID NO: 54183 - DNA, 1030 bp, Homo sapiens
taccaaagacaggctttatgaaattatttccttctatattatatcctactgtagtaggatactaacactttttgcaaaatttgtgcaatttctcacaaataacactgacagagtagaggtaatggtcacgtagtcttggtttctagtatattgtctcttggtataaatatctgtataattcttatagtaatttgaacagcattattgattataattaaagtaatttgcctaattataaactgcagaagcatttcaacgtgggaaaatgcattgaaagtagtaattttataaaggattttctgcctgccttttaatacttcctgtctgagtacacactgctaaaagcagaatctgatctttgcttgaacttgtgcctatttaaatagaaccctgatcaaatataaccagtaatgtaaaaactaaaaaattttatgccaaggaaaataaacttgtaagcaaatgtagggcctaatttaaggattcctagttcctaggaaccaatataaaaatttcttagctacagagaattttaggacatttaagagcctaaattgtttaaattccaagcaaagcaaagtcctttatcctacacgaggttgtgtaatcttatggagatatgtctttcaaataaaatacaaggtattttggctcttttttacatagtatctctaattttttcctttttaactacaatagtttgttttttaattaatgttgtataggaagatcctattgtatgttttatactgagaacatatctcagttagaaccactcacctatcaagtgctcaattgtctcattagaccgtctttttggacagtgtagatccagaggttaagtgagctttgaaggaataattttatctatcttactgttttgtgtgttcactattaacatgttaagttttatacatatatattttttagttgaacagccgtatctttggacatgtaaagattttttctttatttatttttgagacggagttttgctctttgttgcccaggctggagtgcagcgtcgtgatct

SEQ ID NO: 54184 - DNA, 1419 bp, Homo sapiens
atacagtatatattttaacaaataaggtatagtgatacctcatgttaaagtcaatgtgacttagtagtcatctccatttgtttaaagacagcgaacttattttaatacagtatttaattctgcttcattaggtttcataaataaatcatatcaaacatttactccaaattattttgtagcaaaatgaagcatcagtttaaaaatttgtattacagatttttacacatactctgtgctgacgatttttagttttgaaattaatactacaacatttaagaactgtacaattaccagtcctctgtatttagtcaagtttagagttttaacaagagtactagttttttaaactgggaaagttgtgatattagctcatatgatgccttttaaaataaaagtctctaaattttttatttagaaaagttatttaataagttcacctattgattataatctagattgtgaccatctaaaattgattcccacatcacaaaatttaaaacaaatagtattataagaattttgattgagaaatgtaaacggtattctttaaggttatgtgattgtatgtttaatcttaaatagacagtgactttaagataaaaaaaatctatttctcaagctttctcttaaggatttaataccagattattagaccacattaacttggaatgaggttaatgtttaaattattgccttttaaatttgcctcagttcattcaaagctttctgaatctgttggatggatcaacattttggttgattttatagagtataaccttccattttgagacttccaagataatcctcttctcctctctggcttagattttgctcttggtttgttatatttaccatttaggttgttttctccacactcatcatgccaccaccagcctcctaaaggagatagatatgcaatttaatgggtacagactcgtatgtagttactgttactgtatttccccgtaagtttatcttcctttcttataaatattacagtgttttagatgcatgtatcccagttttaaataatctgtataagtcccaattttaaataatctgtataaataatctatacactaccaaaaaatagaaaatctgaggaagattagaggtaaaatacctgattgaactagaatgaacactttcattatagttaagaggttttcgtctagagagaaaacgcttatttgggattcggatttttaaaagttgtcattgcagataatagctaataatgtgggaagatactttgaagatatgaaaataaagtattggtatcagaaaaagatacctgaataaccctctggacagttgaagtgtccttttgctttgtgatcccaagtagaaaacaccaaatctttgttttccgggattgcattggggacattgccagtaatcgcaactagatgtagcgta

SEQ ID NO: 54185 - DNA, 1054 bp, Homo sapiens
gtgtacttggtttcagtaaaattcatactggttcaaaataaactcttgatatagaaatttttcagtaattcactaaaatcaggtaaactgactatctttgatgcttttggagcttttagtactatttttcagaatttttattattatgatttgccatattctgtgtattttctcactaagtgccatttgaggtgtatggacagtaattctgtgtggtttcagatgaacaagctgccatttactagaatatttgtggaagaattgagatatctgcaccttaaaatacggcacaatctagccaatcagaaatgtgtggggagacattctagacaaatggaatacattaggaaggcatagaggagatgtttaaaagtagatcgttttgatgagagcagaaggtttgtgttgtgggaaaaaatggctgaagaggtaatttggggccaggtgatagagacttttgaaaacctggaaggattttggattttgttccaaaggcctatactcttctaattggagtatacattcttgtgagggcacaactatatgggacgtgcaagttcacaggataaacatgacacatcttctaggaacatcactttttaaatacttggggggaaataaatatttttatatgaagattttttttgagacagagtctcactctgttgcccaggctagaatgcagtgttaggatcatggttcgctgcaggcttgacttcccaggctccagcgattctcctgcctcagcctcccaagtagttgggattacaggcacctgccaccacacccagctaatttttgtattttttgtagaggtggagttttgccgtgttgcacaggctgatcttggactcctgggttcaagcagtactcccgccccggcctcccaaaatacttggattacaggtgtgagccactgcaggcatgaagatagatttataaagtataaaacacaattcatatgcaattttaaagtaaaattctaagatttaagctaagatcccaataagattctgaaagaaatttgtgcatatagtaagttattttatcctgt

SEQ ID NO: 54186 - DNA, 1031 bp, Homo sapiens
catttatttgcatagggttaactgaagaggggcctgatcttttcaaattctctacaggggtagatgaagatacacaaatatatggtagtttctaacaatcagaaaatgaatgacttgtttcttactgcaccatacaagtggggtttacatcaaattcttgctttatcaaggaagtacttaccctatcacagtattttagaaaaagtactagtgtaattgttaacattaagtaaaccaaataaagatctttctcaatggtgaaaaaaatcttttattggatatttgaaatcatctgaaagttaggtaatagattgtatgcaatgttacttgtgttccaaatttttacttgatcaccactgttgtatttgagttgtaatagatcaaggtacattaattgagcaaatgcttatgtgttttactgacatccagtttttaagaggtatgtccacagaacacatggtattcttggcaggattgttagagttagccgcatttccagtaatggccttagttgtaatcacctgttgaatgtttgtatctttgtttttctacttagtatttttgaaagactatatctagcaaacatggtgcgttactaagaatgtaagaatgaatacaatggttcagacctggtaactgtcagggtgagaaacaaaaggattttggtctgttaggaatatgcccatacatctcttaataaattttagtaaatctattttctctgatctaatctgaatatagttttaaacttttattatggaaaattataaaagtaaagggaacaaattaatacacctacacctaaaattaatacacctaaaagtaaagagaacagattaattttttttttaattttattttactttaagttccgggatacaagtgcagaatgtgcagatttgttacataggtatacgtgtgccatggtggtttgctgtacctatcaatctgttatctaggttttaagccccacgtgtattagctatttgtcctaatgctctccctcccttgcacccaaccccctgactgtc

SEQ ID NO: 54187 - DNA, 1142 bp, Homo sapiens
tgttttgccaaatagtttctttaacaaaatatgattataaagttgaccattcccttttaaaaataatctccaaattacataaagaaataataatttttgtgttacttgaaatggtacgactatatgtgtagcttatgaaaaattgggagatgggctctcgtaacctgtattttgtaaccatgtttcatttttaggaattacagtaagttctcacttaaaattgttaataggttcttggaaactaaggttttaagctaaatgacatgtgacgaaaccattttttttccagtcaatgttataacaaaacaatgctgaacaaaatgatattattcaagaacctgctgcacatggtccttaaagtccttctcttaaagtcacagtttccaagaacattatccagtgtcacagtagctatgacattaggtgaggacttactgtatttaaaattgaggaatgatttttccttcctttaacatgggtataataaaagtacctatatcttagaaatctatggggattaaatatgtgtaaagtgcatgtcacaaagtaatgcagtacatattaaatgctcaatagaagttgttattgtttttggctttattagattacatttactcatgcactatacaacttgagagagattggtttgaaaagcatgagggtactaggcatctggggtataattggataagagaattattttaaaagggagattatcagagtcaatattggcctgctttgtattattagaccatcaatgtccatgggaccttaaaaccaaatcattaaaagttgtttattctatttgatgctgttagaaaaacttggccttatggacagcttatatgtttaggaactgatagtttattttaaaaaaaaacaaaaaccttaagcatatctagaaacctagcataggtagaaataattttggaatgacgaaaagggatgtatgacaacctcagcagctgacagctaatatacaaatatcatcaataatttacagaaagttccataaatatttgctaactgaatggttatgctggatcatggtgatgataatcttttagctcatttggattctttttgccttctcaggaatgtttcaggataagacataatttgtgataatacataccagtggt

SEQ ID NO: 54188 - DNA, 1034 bp, Homo sapiens
atttctcccgcacctgaaaatccccattattgcctaactccggagctgcttcaagtgaagctttaccctgacagtagagttagacctaccagagaaatcttagagtttcccgcaagggatgtttatgttccaaacactacttacaggtaagagattttaatttggagaattctgatagaagatactgtatattctaaaatattaaagtataactagaataaactctccaaaaatcttaagtagttttgttacttaactctatctcttaccgcacaattttattaatagttttcacgtattaaggctttctgtgtgtcaggtataatgttaattaccttacatgctttatcttttttagtcttatttaatcctcattatttgaggtggattttacttttattttagaggtgagtaaaccaagggttagagaggttaaacattttgctgagcatcacaccttagtgtgatggtgatgggatttgattcctgggcctttaggttaaaacatttgaactcctaattactatgttttctcaaatgtttttagtagcagaatctagcattacacaagaatcaaatttatgtgcctgcattatgttctaataaatcaacaatatttgttgagtatatcctatctagagaatacttgacatgacgttgtcagatataacttttcagactgaacattacataactctgggggtgccatttgcatgtactccttatgaatgatataccctttatttgtgaatgccgagaccagaacttgacatgtctgttgggatattcagtagggcagctcaggtataagattctaaaacagaaatttggatttcatcctagacttccccatcctagtatatttttaccaccatttaccaagttcctgaggacaaaatttttggaattattatgatttctctcctttcctacccctcacatttattcagccaacaagttacataggctctacttccaaaatatatcctgatctgtacttcttactacttccaccttttaaaaattctagtctg

SEQ ID NO: 54189 - DNA, 1045 bp, Homo sapiens
ggctggtctcgaactcctgacctcatgatccaccctcctcggcttcccagctgggattacaggtgtgagccaccatgtccagcctgtatcctatttccaaattgttaatagtgtaacttttcttaaacattggttgtttatgaattttctttatgagaatgagtatgtggcctacatgtcttccccacacaagtatttctggcctaaactaccatattcataatatgtgaaatagaactttcaggccctaggagtgcattttgtgctaaaatgaggtcagtgttatttttagaggtgaatgtatggatccaagacattctctatcaaagatattttactctttgcaaacctgttcccttcacttttaaccatgagtcaaatctgtatttttccaatgccagtcatgattcttaatgataatgaaaattagcttagtagatgacacccaggttaaaaaagaaaagaaaacacgagtagaatagaaaaaatagtgcactgcatgtagtaaggttaaatattgctttagggagtcgttccccccctcccccttttgtatgagtgtacacatgtgtatatgtatatactagattttgatgtaaaatggattctgtgtcatgaatcaagatcagaaaattttgaaagtctttgttgtaagtgactaggtgactagaaccatataagaatggggagaaaatttgtattagcgtaacaaactggagtagtacatgttttggagtggattaagggaaaatgctagtaattccttcaaaattccattttctgagatgttattctgagtaagaagaggaaatcctggcttactgatatctcataacttgagagggcaagaattgagggtagacctcaattgaatggaccttgaatagacagatagcaatctacttgaagtccccttcactgttacatatcagtagtattcatgggcatctgctctgagaaactcacaggaaaaaaagccagtgataaatgtctcaaatggtattggtctttttattatggacagtagtaaaagagagtctagaga

SEQ ID NO: 54190 - DNA, 1046 bp, Homo sapiens
tctggttttggtatcagggtaatactggcctcatagaatgagttgtgaagtgttccttccatttttttggaagggtttttgaaggattggtattctttgaaagtttggaagaattcaccagtgaacctgtcatggcctggtcttttctttgtggtaagttttttcattactaactcgatctctttacttgttttaggtctattcacattttctttcatcttgagtcagttttaatataaatactttgaatctttctagaaatttgtccatttcatcaaagttatctagttggtatctaatctaagtgttggcctacagttgttcatagtattgctgtatattcctttattccttttactctgtaaagtctgtaaatgatatctcttctttcattcctgattttagtaatttgagtctttttttttttggttcatcattttagctaaagatttgtcgggtttatctttttgaacaaacagtttttggtttaattgatttttctgtatggtttttatagtttctattttccttatttccactctgcagttgcctcttgtagccttctgctggtttcggattttttttctcttcttttgtagtttgtagtttgttgaagtctgaggttatattactgatttgagatagttctttttaaaatagacattaatagctgtaaatcctcccccgagcactgctttagcaatgctttggtatgttgttcttgcattttcatacatcttaaatacttcctaatttctattattccttctttttccattagctattttttaaatgggctattatacttacatacatttgtgaattccccaaattttcttctgttattgatttatagtttaattcttctgttgttggagaacatttttatatgattttaatctctttgaatgtattgtatgttgttttatggcttagtatatagactgttttagagaatattttctaagtgcttgacaagaatgtatattctgctcttgcttagtgtactttagtgtagtgtaaatgtccattaggtctagtttgtt

SEQ ID NO: 54191 - DNA, 1050 bp, Homo sapiens
taactcatggttgttatatgttagggactatttcaaatgtgctcagctacttccatcttttatagagtaacaaaatttaacaaattataactagaatattttgtagttaccagttgctgactagaccatggttatacttcctaaaacaatacttggaatacataatacatgtttggtacttactctcttctccccagaataacataatcacaaatagaaatttcaaagacctgctctgtacgtacatttgtagaatgtgttgagtttgttcactggttaagatattgcactaatacttcatctctgtaaggtacagatttttttctcatctctgctgagaattgagacttctcatccttttcctttatgtagtatgaaatagcctttaactgatttctttcaagtataatcatataatgtataaagttctgttttgcagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggaggtaagagtgtttcatacaaaacatttctaaatgtttacttttttcttttttttttgagatggagtttcgctctatggcctaggctggagggcagtggcacgatcttggctcactgcaacctttgccaccggggttcaagcaattctcctgcctcagcctcctgagtagctgagattacagatgtgcgccaccacgcctggctaatttttgtatttttagtagagatggggtttcaccattttggccaaactggtctcgaactcctgacctcaagtgatctgcctgcctcggcctcccaaaatgctgggattatagatgtgagccaccatgcccggcctcttttttcttatataagcttgtttcatttgtagactctgcaatgtaatattgcataaaaaggattttcttttttctttttttttgcctttttctcatttaacaccat

SEQ ID NO: 54192 - DNA, 1047 bp, Homo sapiens
tttacatatttttttcatcttgatattctttaacacaatattggacatacacagtaggtgctacctaatttttcttgaactctttattagaattctccagtgaaacagaactaataggaattatatatatatcttagatctgttttgattattgtagtttataaatacattttcatatcaggaagtatgagactttcaactttcttcttttttccctaaatttgttttgattattcagggtctcttgaatttccctatgaattctaggatgggtttttctatttctgcaaaaaaaaaaaaaaaaaacattgagattttgataaggattgcattaagcttatagattgctttgggtagttttgacatcttaatgatatcaaatcttttcagtccatgaacacaggatttcttttcatttatttgtgcctaatttaacttctctcagcaatgttttatagtcttcagtgtatatagatcctttactttcttggttaagtttatttgtaagtatcttactctttttgatggtattataaatgaaatttttttttaaatttcctttttcgattcctcattgctagtatatagattttgtatcctgtaactttgttgaattcatttattagttctaacagttttttgtgtggcatctttaaagttttctacataaaagatcatagcatttgcgagataattttacttcttcctttccaattcagatgctttacgtatttttcttgtttagttctcaggcttgggcttccattactatgcctaataggtgaggctaatgtgggcattcttgtcttgttcatgatgttagaggaaaagctttcagtctttaaccattgagtatgatgttaactgtgggcttttcatatatggcctttattatggtagtttctttgcattactactttgttgagcgtttctgccatgaaagagtactgaattttgtctaatgtttgttctacagcaattgagatgtcatatatttttttctgtcattctgttaatgtgttatattgattttcgtatattgaacca

SEQ ID NO: 54193 - DNA, 1049 bp, Homo sapiens
aaatccttgtaaatgtccctttattaaagtctcaccctaatgtaaatatgttgtgtattttctacaaggtcctcgattctcttttaataccatgcaatgtggagcagggttattacaatgtcagcactattgacttttttgtctagatggttctttgttgtcagggactgtcctgtacagcgtaggatgttcagtcatatctctgacttctaactgctaagtgacagtaatactcctgtagtttcgataaccaaaaatgtatgtaggtattgccaaatgttcccttgggggcaaaattgtccttcattgagaacctctactctagagttttagttaacctcacattatatattatttcattcaacaaatatttactagatgtttactgtatgtaagtcattgttcttagaaatgagttagacatctcaattaagtatacaattttgccgtattcatataatgggaattactatgccagcattaaaaaagatggtaagaataatatttataacgtgaaaatttgtccacaaaatgttaagttaaaaaagcagactacaaattatgtatactgtgacactgtttaaaaaaatttgtttggcaagtgcatttatgcataaagtctagatggattaggcattaaactgttaattatgattctttggatgctcctgttttcctctgaatattcatgtgttttctaagatttttgcattgaatatattatttataatctgaaaaagaaaacattaggcttttatttttaaaacttatttaaaaatgaacatatctacatatataagtgaccatgttagaaagtgattagtgcctcagaatggacataatatgtcattaggcttttaggtagtttgagtttatttgtagctggataaattaattaggattaactagagaagataaggttgatttagactctgaacgatatgcatagaagagtgtatttcaagaagaagttttaatataggcaaaggcacaggtgtagaaaactgccaagtattgtgataatttagttttggaatcaatttctctcc

SEQ ID NO: 54194 - DNA, 1038 bp, Homo sapiens
ggaaactcatactctactccttagctgggttaaaggaacattgaatataaattttctttaacctaaattgctagaatagattcttattacataaagaaataatgcagaaaacacttggcttattacataatgatgcccaaaaagtgaaaaaattcctaagtttgatagttgatatttatttaactttttttctttaatagatatcataaattgggaacaggatttaatcccaatacattagataaacagaaagaaaggcaaaaaggtttgccaaaacaagtttttgaatctgatgaagctccagatggcaacagctaccaggatgatcaagtaatacttttattcttaaataactataagaagttatttaaaaatagttgtcaatttattaattaatatatttatatttaatgttttgcatgacaggatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggtatagatgtttgcatataaagaagcaaatgattattaaaattgatcttttgggattatgattgatatatagtattacaaaatgtagaggataaagcaactgaaacagctgtaatttttataaatgaatacattttatactagtgaatttactattcttaatgagtaagttataatcaaatgacttctgtctgtggataaataggtcattcttctctatgttctattgtgaagactaaaagtgttagattagtaaagtaagttctgaaaaagataaagagttggaatatgataagcatattcattttggtgttgcttttcaatttgtaggaagaaccaatagaacggcttagtgttcctgatatacccaaagaacattttggtcaaagacttcttgtaa

SEQ ID NO: 54195 - DNA, 1035 bp, Homo sapiens
acaaaagaaatttattctctcacagtgctagaggccaaaagtctgaaatcagtatcactggactaaaataaggttttggcagggctgtgctttcttcagatttctcctggagtatcagttctttgtctcttccaaattctgatggctttggcattccttgacttgtgatcacatcatctctatcttcaaggccaggatattcaaatctctctctttttcatctttatacaaattttttctctctgtgtatagcctaatctccctctgtctcctcatgaggatatatgtgattgcatttagaaaccacctggataatccagcataatactcccgttttaagatccttaattacatctgcaaagactgttttattttttatttttttccatataaggtgacatgtacagggcccatgtgttaggatgtggagaatttttggagggacattttttagcctaccccagtctgattatatgtttttactaggataatcaacaaaaacaagaaataaagtaagagcactgtttagaaacgtagcaacttacttttttttttaatatccaaagatataaaaaagcaaaaataatccttccagtgagtactttgtaaactataaagtagaataaaactgttaattcttactagtgtttttatgtgagagttctgggcaaagtatcagcaaggacattaaagagagtatgacccaaaacatcaaggagtacaagaagggtaacactttgtgttttctttagtgcatctggttgaatatctgtgaaaattttagaaagaactagattaaaagcttttatttaaaaaaatgttatttgccttaagttttaaaattattacattcacctcttgttttctacccatctcttatcccaactttttacaaaggtgccccttaccgaagcagtagatccagtggatttggaagattacctcattactcatcctttggctgtggattctgggcctttacgggatttgattgaatttcctccagatgatattgaagttgtttatagtcctcgg

SEQ ID NO: 54196 - DNA, 1372 bp, Homo sapiens
cacaacaatgttgctttacatcaatgccattgctttgtatggccaactttttcatttttaccacaatctggtggatgcacaatgccatctcattgtaagttttaattttcattttattactaatgaggttgagctctgttttgtatgtttattgatgatttgaatttcttcttatgtaaattgcttatttaaatattttgctgttatccccctcctccattgttttttccctttgggttttttaggaattgattttgtgtgagtactttacatacagtctgtgtattagttgtttattgattatatgtgtagcaaataccttttcccaccctgtggcttgtttttcatagttttaatggaatcttatgaaagctgtatgttctcagttttaatgcagtttaacttaccagtcttttttaatggttattggtttatgggtcgtaagaaatattttattaccctgagatattaagatattcatccatattatcatgaatttgtagttaccccctttttatttaggtttatattccaccttgtcttgatatgtgtatggtgtgaaattttaatttttttctaaatggattgtcctttccccattaatctgccctgccgcctctattgtagattaaaaaaattaattttaatatttgtgggtacatagtatgcatatgtatttatggggtacataagatattttgatacaggcatcaatgtgtaagaatcacatcagggtaaatggggtatctatcatgtcaagcatttatcttgtgtaacaatccaattcttttagttatttttaaaatgtacattgaaattatctgttgtagatgatatatccttatttgtgggtctttttctgggatctctgttttgttccattggtctggttatacagtattttttttacaaattataaataatcttaggtataatcagtcttggcatttggtagagtaactccttccacctttaaaaaaaaatcttgactgctcttagccctttgaatttccacgtaaattttagaatctaccaaagacaaaacaaaactccctgaacccaaaactcatagaatttgattgggattgcattgaatctatatgttaattcaggggagaaatgacatccttataatattgagtttccaatccatgatccatagtgtatttctccatttatttaggtcttctttatgttgtacaatgaaattttataatttgctctgtcaggttcttgcatatcttttgttagatttattcctgggtatataacaattttgtatccagctataccttgctaaactcttgtttattctgaatgtacttgtgaattcctttatattttctgtgtagacaaccatatgatctggaaa

SEQ ID NO: 54197 - DNA, 1027 bp, Homo sapiens
aataaaaattaaatgacagaggactctaatatttgtagaatttctttgtggagtatacttatgtatgagacagtagacatttttgttttaataaaatcatatttgtgtgaattatgatgtcccaagaaaagaagcattcatattaaattacctttttttgttttggggcagttgtagttctgtggctctgagtctttttagtttgctgacatttctttaaaaattttgggccggatgcagtggctcaggcctgtaatcccagcagtttgggaggccgaggcaggaggatcgcttgaggccaggagttcaagaccagcctgggcaacatagcgagtcccccccaccccatctctgcaaaaaaattagccaggtgtggtgttgcacctgtcgtcctagctgctttcgaggcagaggcttttttttttctttctttccagcgttctagcactttttttttcctgaaggggcaaaatagcaagtgtttaagagcatgggctctactctcagaccccgacatgggttcaaatcctgattggtattttctagcttgggactttggccaagttgttgggccaaatttccgtttcctcgtctggcaaatgagaataataataggacccagctcatagtgttgttgtgaacattaagtggcataatttgtgtaatgtgcgtaggatagtacagggcctatactacctgtcatcaaacacttgtagtaattagtttctcccagggagttatgatgacaggaaattttttttttttgtaaaataattaggtcttacttctgatgatgatgtcattaaaaaatgttattactggccgggcgcggtggctcacgcctgtaatcccagcactttgggaggccgaggcgggtggatcatgaggtcaggagatcgagaccatcctggctaacaaggtgaaaccccgtctctactaaaaaaaaaaaatacaaaaaattagccgggcgcggtggcgggcgcctgtagtcccagctactcgggaggctgaggcaggagaatggcgt

SEQ ID NO: 54198 - DNA, 1072 bp, Homo sapiens
cccacatctaagggcttttgaggttggaggtgtagaataaattcttacatatgatgactatattcatatatgagaaccttcagcggtcaactcagcatcactgcttattgagtttatatttcttgtgatttctttggcttaccttttcgttttgtattggttatttacccacatggggctcactgctaccctatagttacagaagaatacctcgtcttacatctttttatatccgaattacttaggagttttcttatgttttcctgctcggaccatatgtccccggtgggtttttggcaatgattttgtgtcagttgatggcagaaagagacaagggaatgatcttcttgcttgcttgtgacttgtaattagattatgagccattgagaatacccagagggagtggaaaggctttgaaaggtaaagtctatgtattttctgagtttcaaattgataaagcttcttctttgaacaggaagagtttctatttagtccaataatctgaggctatattgaattaccagttcattcgctataaaatttttagaaccacatgtcaaaaagtggcccatctaaagaattgtataatttagcaaaaagtcattaaaagccatttaattaatgctctttttctttaaaataggattcaagtatttggaaaaatgtatttatggtgattggttatgaagtatttctagatgttttgatggttctggtgaacagcatcgtattctgttcactaatgttttataaaaaggcagaaattttctggctttctggggaaccacgtaactcaaatgagtttgcagctcgttttctattccaattattgcactaaagaggttcttatactaagattatcattcttttttaagctatcaagtatgatctatacatgtcagtaaaatataaatattaatactggtacaatgttaaattgggattattcctaattaatgcacaaaatgctgaaatggtttcagccatgcttaagatttggggcgaaatatatttcagaataaatttactcatataattttttattgaaaaaaatgatacggtagccattact

SEQ ID NO: 54199 - DNA, 1077 bp, Homo sapiens
tggctagccagttatcctagtggtatttttaacttactaagacatttctggtgatgccagagatgagatagctggctgtccattgcggggtggaggataaatttgggtaaaaatatttctgaaaatcgcttttatataaaatttaatacatattcattatgtttttctcagtttacaattctgatgtaattgataaacagagtgcttccatgacttctgataatgcagatgacaaagctgttattattctagttcctgttagacttggtggagaaagaaccaacaccgactacttagaatttgtgaaggtatgaaataagtgctgaacttttttagggcaatactagctaatatgaaaaatatagaaggtttgcaatttttttctgttaaatgagtagtgatgattttgtagttgtacgttgtacgttgtaaagtttgacattagagattttaaattttggtattataagaccaatgtgagttgaagagcacagtgttctataacaaaatgaaaagccttttaatctttgtagctaatcagggagacacagatgcagcaataatcataacctgtaatatagttacagtttcattattcttatttgtaattttaagtatatatctttattcataaaactagcattaaactacatcacattaattattgaaaaaactctctattactgctatgttatctcataatatgtttcctgtgacaccatgatgtcaataagagatgagattatttctatagctagaaataatgaagatatgaagatagtatttggaggaattccaactttgtttttttcatcttaaccagttaaaaatcggttctttcttggagcacattgtttggtttcttgcttcaaaagaacctgtgtagttatggtatcttgttttgggcaccaagacattcacatatgataaaataccttggaaatagtttctgattaaggcagaagtttttagtttattttcatagtttcaataaaattcttcattttttagtagtctctttttgcagcaatagttggaattcttctttaaatggagtgttatgggatatagtaatgt

SEQ ID NO: 54200 - DNA, 1188 bp, Homo sapiens
ccacttgcctcttgactaaatctgtattaattttttttggcagggtattttaagcctggaatattgtgtgggtattattggtggcaaacctaaacagtcatattactttgctggatttcaaggttagtgatttagtaaaatatatttcttcattgttttcttttaaaagtcagaaagttaatatgagatcatctggaaacaggatgattaacagagcaaaacgagtaccttatacattcatcagtcctactatagccactcatttgtcatttggtccacaacataattagattctgtaaaatatatgtttaatttctgttactgcataaacaaggcataatttattggttgcgctaaacttcagaaaacatcactgccacattctggcagttgctgtttacatatttactttttaccagttttagtggtgcaagtagatgataaaatgacaagcaatatgttcttcctgtcaagataaagaagtgcaatacatttttcatatgcaaactgtagaatataattgtgtgtttgtgaaagcaattttatcaccaaaaattaaatgacagtctcatcactttataaaaattctgcttatacaagcatatttgattatgcaaaagttaatctatcctgtgcaaacctatgtttcagtcaatgaatatcagtctggcaagctgttactcccagatttttttcagctgttctacatagaaattggattgtaagcagtgtaataataaggtgttttttgaattacttgtcttctgttttgtccttgtagatgacagtttgatttacatggatcctcattactgccaatcttttgtagatgtcagcataaaggatttccctcttgaggtactgtggataaaaagctgatactgttttcttaccatatgaagtaaactaattatttagagatgtgctaggtagctatgcttttacggtattataactactggttaataatcaatattttactgatctatagaaccataattaacacagtggtcaaaggttaagtactttgttgctgaattttaatttatgatatactttcttcttcatttatctttgtctctaacttgttagaaaccctggccatactaaaataaatgatcaagtctccaagtaattttgtatagagacagctaaacagtactgaagaatttaaaatgtaaggcctgt

SEQ ID NO: 54201 - DNA, 1071 bp, Homo sapiens
tgatagctctttatttgtaccagtagttaggctatcattttatggtatgtaagaccaatactcgtcatttttgggaatttttttttttttttttgagactaggtttcactcttgttgcccaggctggagtgcaatggcgcgatctcggctcactgcaacccctgcctcccagattcaagcaattatcttgcctcagcctcctgagtagctgggattacaagcatgtgccaccatgcctggctaattttgtaattttagtagagacggggtttctccatgttggtcaggctggtctcgaactcctgacctcagaattcttcactggaacttatatataatagtaacttattactgctttatttccagttaattttattcaggaaagtggacatagtaagttgaaattttatttttacaatgtaaaaatggaatgataaaaaataaaacgtttcatataagctagatttagtttacttgacctgccatatgaaagaggaaatttagcaggaatgtggcaggaaaatgaatgaggaaaggaacaaatgagatatgtgggaaccattccatattcttcatttctcacagttgttctcttttcattctcctttttcaacatggaaggccaggtgaacataacaaaatatatatttttcatttttcctcctattactggaaattagtatatgcatttgtatattttagtttgacagttctttgtctctacaaagtatcatgtatatgctaaagtatacaaatacaggtgatattgtgatatttattgatgttgatgaacattttccattaaaaagtcccatttccctgtttccattcatgtattttctatctggatgaaaataaatatgtttaaaacagtaaagcagtttactcctggaatagaaacaaaccagattattattaccaaattaaaaaaaaaagcaaaattaaaaaatgtgtgctgatattttctaattaaagacacttatggcttttacattggaaaaatacttagaaattattattcttgagcatcagaataatatgcattaaggcaaagagaaattatgttgaaat

SEQ ID NO: 54202 - DNA, 1009 bp, Homo sapiens
ttatatatattatatattgcaatgtaataatataaataaagtacacaataaatgtaatgcacttcaatcatcctgaatccatccccacccccccagtccgtggagaaattgtcttccatgaaatcagtcccttgttcctgaaaggttggggactgctggttattcaggttgcagcttggtcttttctgacaacacatcttaaagaaaccttccagtccttccttagcacatgagccggttttatttttattgtggttctcatctctgaatggtgtacaaacaccattggttatctgttcaatactcatccctctttcttttttgctaaagaatcctgattttgtttgcagtgacagtacccaccaaatactcgcttttctagcctcctatttctttagaaatagtttggtgtaagtgaaatataagtgggtgtgtgctggaagtttctgggaaggcttttgctctcctgctgtaatgggatgtagatgcagtgctgtcctcttacatctacctgccccttccttgaatttaaactaaacacttggggtttcaacagtcctatttgattcagagagaaaggccaagagaattgtagaagctgttcatctgacatcaattaatcaaagtagcaatgtcaggctggtgaaaacagttcgtattatttgacattgttgttattgttttctattatttctttctttgtcacttgcaacaaaatcattcctaattaatgtaaatgttgttgccattgatagtaggaggaagaaatggaaattttatgatcaatttaagttgatgttgcagtcatgcctccactgactactgttggaggtggtagtggttacaccagaacaaaactacctatgcttagatcctgactgtgtcagttactagttgtgtgaccttatacgagtcacctaacccctcaatatttcagttctcccatctgcaaaaacatggatgataagcctagcagagaaattgttgagacagatagtaggtaatatta

SEQ ID NO: 54203 - DNA, 2021 bp, Homo sapiens
tcctcacaaaattctaggtattgcttttttttgtatgtaatgtaactttagaagataatatgtaaaatgtggattattactatgtgtgagaaggtcatttttcatgttgactagattattgtagaaatagtttatttaaaatattttttaaaagggaatctttgaaaagaccaaagttattttttaaaaataacttcatattattgcttttgatcttcttaacagttctctgaggtagaaaaattggatttcttttgctctgtttttgtacacttgatcttagccaaaaagccgagcagtgattaccctgttttatagatgttattcaggtagagtgatgtgtccaaggtcacatcaaggttagttacaaaacagagattagaatggaccttctgactcagtttactgcctagattaccaaacagtcttctacaatattttatcatagtcagtgataccattttgtttcattgtctattactacctaaagaagataaattacaacctaactctctagtatttcttcagactaatgtgaccagaaaacttactttggggaagtgggaggtgagagtgagcatatactttgatgatttaatcccaatgaaggagcatgcatttacctataaataaacaatacaatgctaatcattttttgtcttttagccagaacaggcaaaggagtagcactgggtgaatgtaaatgaaagaagctaacaggagaggttcagggctaaaacagtagatttgtcgtgtggtcttagtgtgcactattgcatccaataaggaattcttctatactttctgttacagatgctgaaattttcttctaaggagaaatatcccttatttacttttgtaaatggtcattccagagactatgattttacatctactacaaccaatgaagaagaccttttttcagaggatgaaaagaaacaattaaaaagatttagcacggaagagtttgtcttgctttaaagattagcacatttgtgcttgataagaagaattccattgaaaggggaaaaatgaagagaaacaagtatatctgaaatgtttattttcacaaatatcttaattttatatgttctttaaaaaagaacatttgaaaatataacagttaaagatatttttctaaaagagaaatgatttaatgaatcttgctttctaataaataaattgagtgattctggttgcattcctatttccctaagatctactagtgataattctaccttaactgtaagccttttagtcttcaaagtcttccacctgagcccattgttctcatggaggttttgtgatattaaccctcccccaaagactgggatcaccaaatagtttcaaaattctcagtttgtactgaagaccagaagatcagagaaggaaactttaatgctgtctagcctcctgctattaatgcaatcaaagaatacttttgcatatgtcttgataattaaatagtatttgttaactgtgatatgcatacacttatataagcagaattatgagttaaagtaatacttagcaatatgattttataatggctcctcattatgcttgctgttgaaccttttatgaggagtgaatataaagtattggttttccctcacaaatttaaagattatgttattaatactattataactgcatcaatcaagtcagataaaggcaactataaaatagtagtagtgtttgtttcctatctcaagggcgaaattttatgggaactcaatttattatgcagtttttaagtttaaaataccaagaaagatgtcactagattctcttctatgtgatttttgttttttatataaagcagtgtagtggtgtttagaagctgaggccacctgtaaggcaaatctgccttaagtgtattatgtgttacttaaaggcaaatttgtgatctaaaagtacaagagtgatttttgagctaggattataaaatacataataaagatgtgagaagataaaatgcttttgttttggttttaatgttgggattattttaatccttt

SEQ ID NO: 54204 - DNA, 1034 bp, Homo sapiens
aggtaagtatctgaactaataagaaacaacacaaagactgagagccagggtccagggtcctgctttctaaacagaagtgggtttggggcaggggccatccccacggggcacagttgaggtgcatgtggctggttttggttgtactggctagggagcactgctagtaggtagtaaggggtgatgctaaacattctgcaggtgactgagggctgtgatggccaggctgaaacgtataattaggtggatgcctagaagagaaacaggaagaagaatgctatgaagggggaaaaaaagggtgtagacatcagaagagcagggttttggttttaacactttaaaatatgaaaatttaaaattggaatgtgattcctcaagccctattcttagattctgttttacctagatataattctatacattctatgcatatacttagtgaatttatgcatatactcagtgaatttagatggggcagagagagtaggtcatttaatgctggggttcttaacctgatgaacccatgaatagaatttaggggttcatgagcttgggttggaaaaacatttacatctttatttttaccaacatctacctgaaatatagtatttcctttcaataagaatacagacaacaaaatatagcagtgttagcagtagctagaacattactactaatagaaattatagatattttttatattacagctaatatagataccttgaagtatttacactgctttgaaattttggtaggttttgctactaggatttttaaatgtgttgatagagaagcaaatacattactatagttacaaatttttaaaaatgtataattggccgggcgcggtggctcgtgcctgtaatcctagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcat

SEQ ID NO: 54205 - DNA, 1100 bp, Homo sapiens
taacgtctgaattcacatttctatctgttcctagtcatcatttatcatagacgatgacattgaggcaagccttggatatgacctggaatgaagggagaattgaataatacaagttgtgtggctcactatttggaagaagtcttgtgctttgaaaaaaatgtattctgtgtccacaagacagactttttctgtaaacctgactggtccatgttaaggaatgcatttgtacccctggtgtcagtcactgtgatctaaccatttgagctaattagactagtcacatgttgttaaatattcatccagaaaatctccacaaaaatggaattttaaagtcaatcaatgcccttttttctgtcttggaagattagatcaaggagcatgaacagaaatagagctccagcaaaatcataggttaaaaggaatattctagggtcttctttgccacagagtcagcttcccataaaaggtctctctcctgttttcccatattccaaggcaaaatgtgctctagatctatacttccggggttcaaataccacgtctgccactctcttgctgtgtgaccttgtgcaagttatttaatctgcctgtgcttcaatttttatttctggggaattatagtaatacctatcatataggtattgttaggggtcttgaacgagtcaatattgttggtgtcaacctactactcttgtgtccatgttgttatatgcaatgatcaattcatagttttctttttatttgcctcattagcactattcaagacagttatcattcttctttcttgaaacactcttctcttggcttgcaggatgccctgctgtcctggtttttctcctctttcaatgttccttctcaatttctcctcatctctccaatctgtcaatgttggagtgccctagagcttagtccttagtcttttctcttttgttttatactccttgttgatgtcctccaggttcatgactttaaatatcatctatatggctgctacttccaaactgataactccaccttggatctctccccttaactaactgcttgacatctccagttggccatctggtaggcatctcagatttaacacaatcaaagctaaa

SEQ ID NO: 54206 - DNA, 1053 bp, Homo sapiens
tcaagcatatctcctgcctcagcctctcaagtagcggggactacaggtgtgtgccaccacacccagtttacatttccatatggtataataaatgctataatggaaccatgtacaaaggtacagaggtagcataggagggaatgattaactctgagagatgggtaggttggggaggaagtgaaaaggtttcataaaaggttatgcccaagcaaacctattataaatggaaacatataaataggagtttttccagtacataacgtgggttctggagagggtgaaggcatttcagacagagggaacagaatatgcaaaggcacaaagttgcataatagcatactgtgtatagaaaattacagataatttggtattattgaagcacaaagtgtgtgtgtgtgtgtgtgtaaggggttggtggtatgtatgggaagtcactgaacatgaggctgcagggctttccatgcagcattaagagctgttactattttatgtagtggggagctatttaagaaaaggagcatgggtctgtaatattagcactttctgaaaactactctgcctgctctatagaggatgtattgatgaagataagagtggagggatgggagtctacttgggaggctattgaaagagtccttgggtaagatgatgatgatggtagaaccctctacctttgaacaagctctattagaaaattttactttataccaagtcaaaactggcattctctcatttgttctgttatatcccatagaccatacaaatgtgattctttttcaagaagtcttactcaggaattagaaatgacttttgtgtctccccaagtttcctcatttcttgctgtcctttgtgagacatagttccggaccccttaccaccatggtcctgatccttggacatgcatggaatatcagtgttactcttaggatacagccccaacaatctattataacactgtgcacatggtctggccacaaaaatccaatgatcctaatatgtcttttcatcattgcaacctgaggtgtttagttttttttttagcagccaaatcat

SEQ ID NO: 54207 - DNA, 1106 bp, Homo sapiens
actcaagtgatccacctgcctcggccccccaaagtgctgggattacaggcgtgagcaactgtgcccagccaggtaacattacctttaattctgtgtttgtgtctctataatgaaagttgcatttagatttttttaagtaataaaatcctattttcagaggtatataactccattacaaagatccccattggcccccatagtctttgcctatgggcacaaaccaacaaacctcagtctaaccactgggtgaaatgagaatggaaaaggaaaacagttgcttctagttattgctacctttttttaaggcatcttgaaccaaacagtagcccgagggggtgaataacctgaatataaaatagtactattgagttttgtgtgtggaattattgatttcttgatattttgagtttggaaacttccttcctttcactcttctgttagagcaaaattcaagcctctgctcccagttctgtcttcacttacctttatttccttttctcatttgaacgcacttgttgtctgggattggaaattccttggacaacagcctggggtgacatcagaagtgaaagaaagagccaaggtctcttccgtgtgaggataaagacctggcttctcaccgaggataaattttggattgagtatgatactaaggctgaagaatattattccaactttcctaatgactccctctgtccttccaggactgggattcccagatgccacatctttttttggaaaaggactttgctttcctcaggtgtgaagaatctgggccttccctcctgcatttagagaaaggctttgctgaggcacccaaatcacctgaagctccaagcaggaacttcacaaccaggaagttcccagagaacttcactgggttcctgagtcagcctgggcagttctgaaacaagcttacataggacctcaagggacatcttgcagtagagaaccatgaggtttgatttcattttcccctgggcttggcctatgctcttccttctggactcccgtctccacaaactccatctttttctgactgactcgtactgcttctcacaactcttctcaagcttcgtcttttcttggaagcccttcttgcttcc

SEQ ID NO: 54208 - DNA, 1026 bp, Homo sapiens
cttagagtatgcttactaagattagtgtgtttgatcctctcaacaaccctatgaagaaggtagcattactgtcaaccctattttccagctaagaaaactaaggcacagagaagatcacacagctaataactagtagaactggctttgtacccaggcagtctgtctacaaagctcatatgcttagccaacatgtgggaggatatcaaggtcttgtgggacatgaagcttatataattctaggagctctctttgagaaaaaagaatacaacactacaaacacaaaactaggtacagggccttggaaggggcccatgaaagagttacattttataagattcacagtaaatctgcctttagcttcatggtaaacccatctgtgcctctatgcaataccctaagcatgagctctgttgttataataaagactgccctaacccaaatacctagaaggtggttgagtgaagacagcatgaaaataagcattatcattttccaaatgtgcaactgtagataggactttctggtgctccacgccaagtcagtgagcattcataaagcaccagctatatgctgagcattatgctaatatgctaacctgcagaaaatacaaaagcctataatcccagcaccttggcaggccgaggccggtggatcacctgacgtcaggagctcgagaccagcccgactaatatggtgaaacctcatctccactaaaaatagaagaaaaaaaaaaaaattagccaagcgtgctggcgtgcacctgtagttccggctactcaggaggctgagacaggagaatcgcttgaacccaggaggcagaggttgcagtgagccaagatcgcaccactgcactccagcctgggtgacagagcgagactccatttcaaaaaaaaaaaaaaatgtatacatatctgtagatatactctcaatgagctagtttatgtgtccagcactatataaatgcaaaatgagactgatacaacagtagctgcccttgagaaattgaaataacaaataagcacttaa

SEQ ID NO: 54209 - DNA, 1207 bp, Homo sapiens
cattactgttctgttgctcctaaaacacctctttttttaaaaagcaataactaaaagcattttttaaaagtcaaaatcacaataaactgttaggctcagatcacgtctatagtaatgtaagttatttcccttctcttaagacgtttacctttttccccccatttagcctgttttttttacagttcaatacatatttttccaagctccacttgccaaacaaaagagtttagcctcagtgttactcctctgacaaatatccttatggtcttgcacatgtgagagccattgataaacaaattaaaattctgtcccagctcagagctcagctggcccattttatcttgcagtatgggtttgtaaaggtctgggtgtctgtcatcctcccctaaccttgtctttgtcaaagggatacaaaagcctgcccgctcggggcccttacgatactgattagtgtgagtgacaaagtggtgctgcaagtccactcagcctttcataataaatctatcaaagagtaatagaattccatcaatcctgcatcatccccgagggtcgctgggctgggatggaaagtgtgttccgttgggattgtacaactgttattattcaattacactcttttcttcctagttaaagaccatgatatcattatcacttaatgaatacatataattggatctggactctatgtttggctgatgaataccactcactattcattcagtctcagctcatcttctgaccatttattatagacttttggctgaaaaccatgatgacaaagggaatttgaaattagctgcgattttattcaatgctcagttagacacaaagacaaaataaaattttgatggctaaatgagttgagaatgaattaataagttttgcctaactcaacagtctgtgatttactcatacttaatacacacacaacatccacaatctctgtcacacacatatatacacacagagttagcaacaaaactgtttaaaatgttcaataacttctaaaaatgagttttatttttgaaaatcctgaagtgttttaatgtaatgaagggaagatttactattttaatctcattaaaaaaatgtattagctgtgaaagtgtcaacacacatacacttacactcacacacacatgaaaatcttcagttcaaccctagccaccaaagacaattttatgattaaataatatttaaatttgac

SEQ ID NO: 54210 - DNA, 1031 bp, Homo sapiens
gctaggaaaggtaggggaaaggagacgattgggagaaacttgttaaaagatacaaaattatacctagatgagaggaaaaagttatagtgttctataccactgtaggatgactatggctgacaataatatatattttcaaatagctaaaagagacgatattgaatgttcccaacacaaagaaatgataaacatttgagaatatggatatgctaattacccttatctgatcactctacattgtatgtatcaaaacatcactatataccccataaatatgtacaatcatcatgtgtcagttaaaaaaaatcaaaagagatcatgtaagctataaaggaccccatagttgagtagactcaacactcaagctggtatttttgaacacctactgtatgctaggcactaggctaagtatcgtgcttaaaaagagaggttagtaagtccctctgtgacagtcaccacagaaatccctagaagtttatgctttttccacttcatccctatcccacttctctgtttgtgatcattaattatgattacttatatgctgtcttgtactttgaaatataggaatactgggaactacacagcgcagaaagaagtggccacagcaggataaagtagaacttagactctgaacaagagatttggcaaaagtctaaacatagaggaaagctgtgcgatggggtatctgagactattcccaggctaaatgactgagggcaaaaacggttgagggcaaaaatggttgaggaggggtgccactggatgtctggggtcaaaaataagtattgtggccgggtgcggtggctcacgcctgtaatcccagcactttgggaggccaaggtgggtggatcacctgaggtcaggagttcaagaccagcctcaacacggagaaaccccgtctctactaaaaatacaaaattagctgggcatggtggtgcatgcctgtaatcccagttactcgggaggctgaggcaggagaattgcttgaacctgggaggcggaggttgcggtgagccgatatcgcacca

SEQ ID NO: 54211 - DNA, 1074 bp, Homo sapiens
gatgcaatggcgagggtgccataaacaaagacaagccctaccaacagccagacagctggtaacaaaggctgggctgtaaaaaggtctttctggctgcccttttacacagaagtaggaaaatcacacatttcttctgggtgtgagagtgatctggctacaacatctgtcaccccattgattgccaggctggcttcattagttctggctggctaggctggggtctccttcatcctaaccttcccatgtacatcttttcttcagctgcatgctgtcaagaataatatagttcttagcagggaataaccccacttgactcaagaaccccctaaataatctcttagttctgacatattgttcaccctaaagaattatctctaatgtcaatggcacccagagtggctgaagcctcacaggaaaagaggttctatctctggaattaaggattcaacaaggggggtccaaagactttcaggcgttcgttgaagattaaaaagtccaaaatattaagaggaacatggtccaaaccactgctatgaggacgtagtgggatgtcacaaacgtttgtccttccttttcgtgtttgttgaggaggcagtgcagctttgtgggctttaaaatcattactgtctgccccagggcctcttgtcttcatatttttgtgacttagttaccatctatgcactgctgattccctgtccagaactcattctagtactcctgaccctcctatcaatctgcctacaagactcttctactttagtattccatagacgaaaaatatttatttgacatctactatgtaccaagtagcgtcccaatctgaacttataatcttcattctccacaaaagaaaactggatgaaatcttgagcctacaccaaggttttctttttatttatttatttatttatttatttatttatttatttatttttattatactctaagttttagggtacatgtgcacattgtgcaggttagttacatatgtatacatgtgccatgctggtgcgctgcacccactaacgtgtcatctagcattaggtatatctcccaatgctatccctccccctt

SEQ ID NO: 54212 - DNA, 1034 bp, Homo sapiens
agagtgctgtcttgacaatatctgccgtctcctttctcattaaaaccaaaccccaaacctactatcaaacaaaacggtgatacaaaaatcacatcctacatattttgtgtcctgcccctctcctcagcattcatttttagtttggcaatcttttataactttggtgaacaaaagcaaaaactcaagaaagaagaaaagactttattttgtgttttaccctgtttcactggcatagactttgatccctttctataaataaaaatctatttcaaaatcagactttaaatcttgatgtatttactgtaaattttacaagttggaacctcctactatcttgatttatatgattttaaaatggagttcttaccatttcccttgggaagaatttttggtttgaatagttcttactggcaggttgcttcctttatgtttagcccaaattttcattttcaaagaccattttagataagcaccatgatagctctaagccaatggatctgtgtgccacataatagagtgtgacaatccactcagttgtgaaagacactgaagataaagcaataaagcagcatttgtgttatcacattggctttacaaatctacttaagcactgacccaacagtgttattcattattgggaattatggatgtttataattgtccaaaaatacattgggctaagttataccatatattatagatttaaatttaaattcaagatcccgggctgagagagatgcagatttgtaacactccttggaggtttgggggtccgtgaaccaatgaatacattatattgtcacattaaagaactctttttatccataaagatgtaacttttttttatgatccatataaacaaaattattcttatatgtatgattatatacatatatatggttgaaacatctgtatgtatgtatatatatgagaataattccagctggcatctgaaattgacagtaaaaataacaatgattatattcttctgaactgtgtataaattactggtgtaagctccttaagggcaggct

SEQ ID NO: 54213 - DNA, 1069 bp, Homo sapiens
aagataaatcatgcctttgtctacggttgtggttttatatttacctgtaggtgaatgtgttctaaatagaattgactgtgtcattatctacatatgtgttgtttttcttttctcagaaatattcccttgtgagagtaaatctttactatatctttagatgtattgagtcccatttaatagggagatccaccttttgatgtatattcccaactaaaggactagggaataaggaacttaaaataccacgtttccttcacattccttcccactacccctcccctcgaattctctatccttctacttggtttactgggttcattgttgtaggtactgtactcagctgaatcttgatatctttttttttccccttaggatacttctacatagacataatcaagttttgactatttggaaaccaagcatcattaaaattctctcaaactcctaattgcgaagaatcgataacatttcaagaagtgataacatttctctgaacaagaaaagaagtgattgaccacgttttaaaagtactctggcactggtgctgtgttttcttcccctccctaaatttgaagaactatggagaaatggtacttgatgacagtagtggttttaataggactaacagtacgatggacagtgtctcttaattcttattcaggtaatacatttttactggttaaaaaaaaaacgaaattttcctttgaataggtgtttgtttggggaaaagtttaccattttctgaccagtacagagaagaatttcaggcctttttgatatggttgagaaaatacatttaaatgtccagttctaatagaaagaatatggataacagctaaatagaagcatgcgctttgtgatgtgagaaagcaaaaatgtgttctaacaggtaagatgacaaattgagaaatgattctgtattaaacattgaagaggaaaatgagctagcacttcaagggaggggtggagtctgtttagggtagagaagcatattactggattaaagggaagcgatcagtgaacaagaataaaattgggaatgagagagggggaattgatggagtgtggt

SEQ ID NO: 54214 - DNA, 1408 bp, Homo sapiens
tattaaagggacaacacgctattttcttcatcttgaacatcctcatctcttgcatgctggtgccacatatgtattgccttgcattttgtaggcctgtctttgaaatttgatagtcctgaaagttaattcatatacttagttaggtgggctatgatgctgaactagaacgttgatgataaaactctgaatgtctatatgtcctctgtacataaactatggaagcaccatcataggctaaaaacatttcttccctgttccctcatccactgtttctctcactaaagatcactatgattgtaactatagataaaaataaaagagagctttggcagtagctgatggctgaatttgcagatctgaaaaggggaccaaagggagaagcctacaatgataggacttgttttcaactctggaaatttcgcatgtgtccttttgattcacctttgaataccgtgcatctagtatagggcatggcacattgtagaccctcaataaaaatctgtggaaggaatgagtatttaggtgttcactttttctttttttttttgagatggagtctcactctgtcgcccaggctggagtgcagtggcgtgatctcagctcactgcaacctctgctgcctgggttcaagcgattctcctgcctcagcctcccaagtatctgggattgcaggtgcctgtcaccatgcccggctaatttttgtagtttttagtagagacagggtttcaccatcttggccaggctggttttgaactcctaacctcgtgatccacccaccttgacctcccaaagtgctgggattacaggcttgagccaccatgtgcggcctaggtgttcgttttcgtatggtctcatttccatagctttctctttgtattatgaaggaggaggtcagctctacccttcattgttatatgatacagtatatattgaaccgtctgtttctgaaaactcagagaacttcatagacatttttgttaattattattgctctctatcataattgagcagtggtgattaaccttaattttgtatacaaatctacctgaagtataaaatagcagtagcttagtggtaaagagtgtaggtgctagagtcagactgtctgagttcagatcccagctctactatttattagctgtgtgacctttggcaaatcatttaactttctcaaccacagttttattacttatagaatgaaaatagtagactacatatttcactgggttattgtgaggactgaataaaatgatacatgtaaagcacttaggccagtccctagcatgtaacgaactctcaataaatgttagctctggttatagcatcatagaaattcatgcctgtgtcatttttattgaacatatcctgataactgttgatgacattatttattgacttactagatggt

SEQ ID NO: 54215 - DNA, 2407 bp, Homo sapiens
gaggagggtggatcacttgaggtcaggagttcaagaccagcctggccaacatggtgaaaccccgtctctactaaaaatacaaaaattagctgggcctggtggtgggtgcctgtaatccaagctactcaggaggctgaggcaggagaatcgcttaaaaaaaaaaaaaacccaggaggcggaagttgcagtgagccgagattgcgccactgcactccagtctaggtgacggagcaagattccgtctcaaaaagaaataagcttatgaacaatggttatttatgggttatatagtttggcttgcactgttgtattcttatgattgagaaaataaatggaatagaagaagaagctgcctagttgtaaaggacatgattaagaaattattttaacttaacttttagttctcgagtcatgatagttgtatatatttccttcacattctggctaaccagaggagcctatcaatttgtggacattagacctacttttcttcctaaaattcagagagccttgcacgtaacgaggctctcgttacatgttggttgaattggttacaaacaatcctattctttttgttgcatattttttgttgtatgagtgttagtcattgatgaagtctactaatagtaggatgacagtaaatcccagtttgcctaggagagtcctggtttgtgtctattgacatggcttaattattaatagcttaataattagtaaattacattattaagcttagataagtgaggtgcaatgttaaattataagtctacttcttgaatattgattaacggaatggtgctttcttctttttttctttttcaggtattttaacagcagtgataacaatttacagtattggggattggattacccacctcttacagcttatcatagtctcctatgtgcatatgtgtaagtttttctttcttaatgtaactctaaatttttatgcccttggcagatttagtaagaagcagtgtgatggggctttcttgactagaggagagattgcttgtagctgctattgtattttttttttttttttttttttttgagatgaagtctcactccatcgcccaggctggagtgcagtggtacaatctcggcttactgcaacctccaccttccaggctcaagtgattctcttgcctcagcctcctgagtagctgggagtacaggtgcccgccaccatgcctggctaatgtttgtatttttagtagagacggggtttcaccatgttggccaagctggtctcaaactcctgaccttaagtgatctgcccacctcagcctcccaaagtgctgggattacaggcatgagccacctcacccagccactgctattgtattgtgtattacaaatgggttttaagaaataactattggctgggagtggtggctcacgcctgtaatcccagcactgtgggaggccgaggcgggcggatcacgaggtcaggagatttagaccatcctggctaacatggtgaaaccccatctctactaaaaatacaaaaattagtcaggcgtggtggcacatgcctgtagtcccagctacttgggaggctgaggcaggagaatcgcttgaacccaggaggtggaggttgcagtgagccgagatcacgccactgcattccatcctgggcaacagagtgagactccatctcaaaaaaaaaaaaaaaaaaaaaaaaaagaactatcaaagtttgaacatttctataatttttttggaggacatctagcaagaaatgtgaaaaacctagttttgttttgaagtagagatgttatccatatgtgtagactactaagaaatatatctaatatgtgttgtgtataagaaagttttttttctggaacagctcaaagtaaatgaaaaatatagatccagatggttaccaactaatctgtcaagttagaaactagaataattgtagtgtttcatttgtgattgaagatcaaaatgggaattcctcctccttttaaagaaattgaatagttatagaagataaggaacttctgttttggtaaagacccagttctactctgtagtggtattccatcttagatttgaagtatgtcagcaaaaatttgaggaacctcttcacaatatctcgtgaactcatcttgtttaatttctacttacagccctgtgtcacttcacgatggggatacattctgagaaatgtgtggttaggtgatttcatcattatgcaaacatcatagagggtactttagtaggcaaaatggtatagcctactatatctaggcgtatagcatagcctattgttcctaggctacaaacctgtacagcatgtcactgtactgaatactgtaggcagttgtaacacaatggtatttgtatatttaaacatatcaacacatagctagcgtaaaaatatggtagtacaatc

SEQ ID NO: 54216 - DNA, 1021 bp, Homo sapiens
ctgtgcctagctctaaggacacattttttaaccattatgtacttttctcatttgcaaaatgtggataatagaaaccctgactttgtaagcttagtttgataattaaatgaattaatatttgtaaagcacttaagacagttcctgggagacactaagcattatataggcatttgttgctattattaccatttttataatttatttttgtggttctgaaattttacagtgatttgtttagacataggtgtttttcacaattgttttggatatccaaaccgtatatgggtccatacgttttgaagactcatgttcttctgttctgctaaattctgttatattatttctttgatgattttctcacttttttctttcttgagcctattagtcagatgtttgatcttttgcatccctttctcttttgttttatgggttgggttatcttgagtttatccccaacacttctatcgaatttcatttgtattgttaggtatatttttaatttctaattagaatttactactttttgtttttttggtaaagttcactactgttccctgagtgattttaattctttcatggtcatttagtttccctttcatttcgattctttttctgtcataggttttctataaatgtttattttatcctagtgtatctatttttatttaagaataaggcaagaacacctgcatatgacttctatatatcattggtccactctaggataagtggggagcaagctggccaccacgcattgagatgcttaaatgtcagaatgtggaggggtttgcattatagtgctaacctctacactggatagtttagttcatttcttcagaaaaatatgccctcttttgttgccttggggtaaatgtttggctgccagataatctttgcatgggagtggggtaagatttgacttctacctctagggattttcagttaatctcttgttttcttctgcacatactactcaaagactgtaacctacttggtgtttccaaagttctctagggtcttg

SEQ ID NO: 54217 - DNA, 1430 bp, Homo sapiens
agtttctaattaagtacatatattactttatactattaatatatataatagaggaagtgtagcgatctcagtaaatttttttttaacttgctgttggaacattgttttattctctagattttggtatgttataataatattgtgaagtaatctaacagaaacaaagctatgttttaaatctttagagctcttttaaaccaaaacaaatcagttgctgcttagcagtagatttaatgtatttgatgctgttatacataatttcatgtttgtttatcacttcagtactttgaatttctattgggaaatagctttcattgtatatgttattttaaaatcacataagagatatgctatgagcttgcatttcctagagcatatctcttgtgtgatttgctttttaaaagctctatctttttaaaagattattgagataatttccttgacacaggaacatatataattctgtgagtcttggctttgctttgtggggtgttcttggaatatcttgtgactgcgacctcctagggtcactggcattttgcttagctataaattataaacagatggaactttaccacgccttgccatttttttgctttttacttggcaagtgttttaaaaaaggcctcaaaggaaaggggtgagtgacttttaaacactagaatccaaaaatttacttcagataatttttttggcatacttacttgcagtaagatgatctttcactttgccttttggtgatttcttataaatattttggctgtagggtatgtgggaagagagagattaagtcatgttctgtattttatttttaattttcctaactagagaaatatttcaattcatgtatatttactggtagtgtggattgggtagttagaactttgctgtaggattttatcactttagagcttactacattatatacttattagaaatacatccccatttgatatttttcttcatgaatgcactctcttattcctataggaatggcatctaacataaatgttaattacgatggtgataacagtccttttgttgaagtgcacgtcttagctgttgtgaattttttacctctgatttgagcacactcccatcttaagcctatattggtaacatagatttggcattactatacatgtgcatgtattatgttcagtgagactcaggttgattttgcagaattactgacctttccctatcttactgcctacctttgtttttgttttaggtttgtgttgctagttaagctagcttgtattgttgtggcttccttcgttctctgctggctgccattctttacagaaagggaacaaaccctgcaggttctaagaagactcttcccggttgatcgtggattatttgaggcatgtttaaacactttcctctcctttctgttactgtaccttacctgtgacctttagggg

SEQ ID NO: 54218 - DNA, 1798 bp, Homo sapiens
ttgcttcaggaagatctcataatttcttatgagatatataaccttcatccatagtaatttttaatgagaatctttcatttcatttcatttaatgctagtttaatcactcttgttaaacttttattatgtgaataatttgatcatttagatttggtaattaaattaaaccatttttctgaaacaaaaaggccttttaataaagttagacagaaacaacatatttatagataatttgctagcatttcttttaaaaataattttaaaagcatattttcctaagttttgaatatataaatttctatagaatatctttcagtagacttataggaagatggaaccagcattttgaaagcgactaagatgggagtttggtgttgtgaaggaacagaaatgtgtgactgtatgtcaacaggatgatggtagtgatgatctaaataatcactattgttataaccaccacttagcaggtgccagacacttccatgtaattttatttgatctttacagtagctttgtggtagctattgtctccactttacagattagaaaactgaggtcaaagattcctataactagtatgtagcagaactgtgacttgaacttggaaaattgttttcctaacctcttctttatataaactctaacacttacataaagaaaagtttaactctctatgtaagctgcctaattatttgccttaccttccatttcagaaatggcatttatcatgataattataaaaatgagtatcagacatgtttgatggtgttgccagtctcttccattcacttcttgccttcaaaatctgaaaagcattttctttgatccagcagaggaaagtgggatgatatagttgtcagtgatagttacttttttgatgttaagtctgcacagctgtaagtcaagcagctgtgtagagaacggatttcaccaccaggagagctgtagttacaaacttaattttgaaagtgatcctagcacaactgctaatgtctttagactttgatttattagcaattagctcttgtcattgctagtagctagcaggttactctgttactctaagtaaattcagttgtgtgataaaaatgggtcaaatgtaatatgtattctataaattgtagaaaaaacatttcttagaaaaatttccaaagatgaaggactttagtattcagggatagtgcactgctctttgaaaactattaagtatttgggaatgtctggattatggtgggccaatgcttttgatcaactgccctgcacaaaaatgaaaaatgcttgagacagtgtatgcgtatatgtttattcctggaggatttaatctatttagttataattgtgactaaaagtttcacatctcaaaaagtttattagagattatgggctgtacttcatgggttttaatatttctttcaattataccagaatgtaaagctaacaaatctcttttaaggataaagtagccaatatttggtgcagcttcaatgtctttctgaagattaaggatattttgccacgtcacatccaattaataatgaggtaagagaaacaaagtttgtatgtagtattttataagttactctttaaaagcattatggtattatttcatttatttggcatcattagggaatgaggtgtttttcttttcttttttttttttttgagacagagtctggctctgtcacccaggttggagtgcagtggcttgagctcggctcactgcagtctctgtctcctgggttcaagtgattctcctgcctcagcctctggagtagctgggattacaggcgcccgccac

SEQ ID NO: 54219 - DNA, 2018 bp, Homo sapiens
ggcttttatttgattaagttaggcgcctcaggacaagatcccttttgattaatttaaaatcagctgagtaggggtttcacatctgcaaaattctttcacagcagattagtgttcaaataactgggagatgagatgggtgtggcctctctgtcttccaaatcttatgagaatttcccttgtagcccaccctaacaaaggcatacaggaagggaattctagggacattagttcagcctagccaagttgatgagtcaaaatctacaactgggaaaaatcagttattgtattaggttatatacttgttttcagggctttcaggggctatttcccatagtactaaatggttccaggccactttgcttgttgagtctgtctgctttttctagttctttttcctcccacccattagccatcattaggagaagctctagtagcttcctgctccctttccaccttgttctttatgatttaccatgggcttgaaaatcagataatcaatgtttgtgaaatgagggctagagagactcttttgtgagtaaagtttatgaatgtttgtgttacagatatagcattatctcttatacttcattatgttttcttattttgagtgtttgataattgaccttcaactatgtatctttgtatattttctatacatgatattaaatactaaaataacagaagcaatatttagttttatcatgtttggtctatattatgtaatcgtgtataaaagtatatatatatatcaatgtgtagattttgtttaaatgttatttcatctttaaatttaataaataaaaatatagtttgaaataaacttaagttgataaataatatgatccttatatttaaaaaatatttccttatttaagctagatttatacctctacaaagaagacaaatatttgatttgtattaattttttagcttttgttctacgtttttgagcctgcttcctgcatgcataaaattaatacttcagccctcttccaaaggattcaaatttacactggtaagtttttcattactttagatacttaattcttgccacaactgatcttttaaaaattattttcatggtctgcacaggatttattgggttgggaaacaagacattcatttatttggcagacatttattggatgtttcccatacttagcttctgtgttagacactaagctaagcaatcaatactctttcagttaattcaactatttaatttgtttcgtattagttaatgagggactacaaagtagaaaacagtggcaatgaacttaagtagcttaaatagttatgctataaaacagatggtattaagttctatcaggtacaaatgaagtcctatgatggtgtgggaaagggagatattatctcggggggagattttagaatgctgtttagggcaagtgggatttgagcccaaatttgaaagtggggcaaggttagaacagcaggttatatagcagaagagaagttcaaaacagaaggaagaagttgaaggtccagaggtgggaaaggacacaggatattctgggaatagctattaaacaatataacttgtgtgagttttgtgtgtatgtgttgagagtaggagaggatatagtgaaagataagggtaaaaattgaccaaattattgaagaccttgaaaatcttggttgaaaaggtttggagtttgatttgtgtgcaagagaaactaaaaaatatttttgagaaggagagggggcagatctctgttttaggaggatgacttgtgtcagtttgaagatggactaggtgcattttctacagtttagggtttttctgagtagctttacaaagtcttcttggttgtgtttctatggcatttaaaattttgttcctgtgtgccatggtctataaaatgacatttaaaaaataaccttttaaactatcaagaacatttagtttctgaaaacagtaagtcctactggacttatgtgaggcaacatttagaaattagggttccaagtctgggactgccatgtaagtacgttgg

SEQ ID NO: 54220 - DNA, 1421 bp, Homo sapiens
ataattttttttaaactctaaatagcacattattaatttataaaacattaatatattttattgaagtgcatgttttaaaacaccaaaatagatttgttttgccggttttagattctgaccttcttgtctttcatggttttaaatttaagttgtctgagattccaggggaggatgaatgtatgattgttgtgtctgaggtatttactagttctgtttattaataactgagttatgatgaacttagatggttaaataaagctttataatcattgttttttgaaaaaatatgtcaattttttaatttgattaaaatatgcatactagtgttgtttgtattttacttctaaatagagctttaataaactttcaactttcatttgaaatgatttttatttagattctataattaacttgatatgctatttcacaagttgttatatctcatttcccccccttttttcttaaaggttagctgtgcgctatcattctttttattttctttccaagtacatgaaaaatccattctcttggtgtcactgtaagtagaaacatttgaaatatgtgtttatttgtttataatataactttataatttacatacaaatatacatttgaatgcaaaacaaaactacacaaatgttatatctttgcataaaatgatttcatagtcaggtttttttccagaatttttgattttctttataaagtgtattttaaactgaaaaattttggtagaatgttattgacataatagtaatttcttcctgttccttcacttatattttctacatgctaataaaaaatatatccttcaaagaggttttcatcagattggagcctgtttgtcatctttgctttttcatttcattcatttccacatctattcggtagccttcttctttccatttacttccatggggtcttttgtatgttgccttctttctctttttttgccacaagcttagtttaggccctattggcaatctgtaaccagactactttgttttagaagcattaaatttttttcctgatgttcatagaaagcagtggatgacagctgggagtatgatatcctaatattaaaatagtattcacatagaaccctttggaatactgaaatcctcctctaggtcaatcccaacccactactgctctacccctcaccctatgttcactaggatcctgtggaagatacatgtacagaatgaccaatgacaaatggcaggcagtattgcttttattaggtggagctttggactaaaaccttcgtgcagagctgggctggcctgtgtggaaggcttcttggctctaaataaaacagtctcatatcattgtagactgggaagactgcttaatgccatcctctgaggcccaaacctgagttagagcttaccactattgtatgaggctaggctgaccct

SEQ ID NO: 54221 - DNA, 1412 bp, Homo sapiens
atgttggccaggatggtcttgaactcctgacctcgtgatccgcctgtctcagcctcccaaagtgctgcgattacaggtgtgagccactgcgcccggcctagtaatttcttttagtagttttcagtttataatcccagggtttaaatctcatatattagttgacataggaaaaagtcatccttctgggaaagggggagaatgcccaaatctttatagagcactttttaaaataaagagattcaaaataatgataacaattattcaacaaccaccatcattaggaaagtttattgtattttaaaaaagtaaacactagatgatacctgcaaagagttctttcaactatttaagaatacagggtattattattatttccatttccacttaagaaaatagattaatcatttgctcaaggtcacacagtaaataaagggcaaacatggggaccaggactcagggcttcacactagcaatgctccttctttgagcattgccacaattgaatcccaaaggtactggagcaggagttgtggtaaggaggttacagggcttagagctatgaccctaaacaactttttttttttttttttttttttggagatggagtctcgccctgtcatctcactctgttgcccaggctggagtgcagtggtgtgatctcagctcactgcaacctcctcctcccgggttcaagcagttctcctgcttcagcctcccaagtagctgggattacaggcacgcaccaccaagcccagctaattttttttgtatttttagtagcgatggggtttcaccatgttggccaggctggtctcgaactcctgacctcaagtgatctaccagccttggcctaccaaagtactgggattacaggcctgagccactgtgcctggcccctaaacaattctttgataaagccagtggttctgtttattggcattgtgcttcctgttcctatactatttccctttttatgtagctcttcctactaatttcttcctccttttaattttattattatcaatttgttttcctttatcctcttgtctctcttgtcctctccagtggcatgatgatgttgtctgccatatctttagttttaacttagcggagtaatatgtaacatgaaagaacataaaagagatgtttgaaaacaatactgggaattcatatttaccaagtactacgaaatatgtgacaaagccttctcagatttgtttatctgatccttttcttaagctacttgtttgtatgatagagaaaaaaagttccattaacggcatactggaagcagcagttttccaattattatgaggagttgacacctctgtgcctgtgtctaggctaatttagtctggactgttaacaaaatgaatcagtagtccatatgaagaccttcctggctgttttta

SEQ ID NO: 54222 - DNA, 2046 bp, Homo sapiens
tttaaccctgactagcattaatatttgtcccagatacctttgttcagtgccttggtggtaggaagtataagaagacaggggtcctcaggttttggctacacatgggaatcacttggagagctttaaaaagtactgaggcctgatttaattggtctggggtgtgatgtgggcattgagattttaaaaactcctcatatgattctaataggaagtcaaagttgagatacaccagaataaattagaccctcaaccctcacctttaattctgctcatttaatagctacaagtcaatgtttccagcacatttaaatttcaccttttatactactcagtaatcctttttttccttgcagtttcttatctcagtcatcactatggtgcttctgacgttgatgactgtcacactggatcctcctcagaaactaccggacttgttttctgtattggtgtgttttgtatcttgcttgaacttcctgttcttcttggtatactttaacattattattatgtgggattccaaaagtggaagaaatcagaagaaaatcagctagctgtattcctaaacaaattgtttcctaaacaaatgtgaaaatgtgaacagtgctgaaaggttttgtgaactttttgctatgtataaatgaaattaccattttgagaaccatggaaccacaggaaaggaaatggtgaaaagtcattgttgtctacacaaaataaatgtatatggagaccaaagaccaatggaggcttgtctaagtactgcttggccaaaacatgtggttttattattcacagctattcaagtggggaaaaaagagaaacatgtccttaatcccattgtttactcaggaaatgcactttttaaatgtctttaaaaaactgagaaatatttcttgatatttgctttgtctaaacctacttccttcatcagaccatatagtgagcttcatgggagaattgagccccttctttttaatggaaatcactaattttggtattcaaacttacattttagaatgcaagtagtgtgtatttcactgtttagaagtcatatcttagggaattaaatttgtgataatctttttaattactgagaaggcaatttaaactgcttgaagtttgaatatgccttattacacatgcaaatttgattgttttaacaaggcaaataaaccataatcttatttatttccaagaatgcatattttaatacaattaaaaatgaattttcctgaatttaaatgtaagctttaacttaactttaagtggtttgagtgaagtcttctaaattacacataatcactggttctaaacttccagaaccattctgtttaattaaacattatattatatatatattattattgacatggttcagggttaccactgccagagcattgattcatgttaacttcatcctattaatactgtatcaccctgtattagcagaagccaatatttattatagtattcaactggtaaaaataatacatgatatccatgttgcagtttctcatataaagatatgttttctttagcctctgtaataaagataatcattttcccatcaacattttttaaggaatatatttcttctttcataagatagccattaaactatattaagtggtggtatattttaatatagtgcaaatcaaaccacatacaaaaaaaaactggttctagacacggacagtcacaggctgatataagaaggtatgtgtttctaagtctggtaaaggaagtgggtttagacaaagcaaaaatctagaaaggtttctttctcaaagcaaatgtgcataaagactcaaagggcaggtcaacgcagaatagcagccttgaatcactgccgaatcagcaagaacattgctgtccatggtcaccatctgtaatcactgtgcccaaatgtcagcatcttggctggctggtgtagctttatttttaaaaatattttttgtaatagtacacttgtgtttaacatagaatgttgacttagataaatgatgaggaagttataaataattggagtagcataactttattatttgg

SEQ ID NO: 54223 - DNA, 1036 bp, Homo sapiens
aaaagcaaaatatcaaaaatatccagtgatgaattatcacagaagtaggcaaggtccaaagcatttctcttagctaaactcagggctatagggatgttttcatataaatacatataggttatgcaaaaatattaaagatagattcctcactttcttcattaatatacctgtcaaaaaataagcccttcaaagttatgttcaagtacgttttagatggaggaggtatttctgagaaatgcagttttctcagctgccaaaaaacttaggtttgcttcttaaaatgaagagaatagggtgtatgttcatgtatcatatatgaggcatacagaagtcattttcccttgaggacttagtgggggcgaaaaatccccaatgtagcattctgtccaaatgataaaccacaacaaattgagtgaaacatttacaaaagtcagggcagccaaaggaacctctctgttcaacagagagaaagagatggataggatataactaaataatggttaaagtaacgcaatggtttcaagtctcaattggtctctcttctgttatgttcattggaagatcagggcaagtatatcccctgcaactccccctcccctcatataaacattagttgtgtgtgtggatctttctgctttgtccttcatgtggcctccaagggtgataaagtgagagtcatctgatctacaatgaaaagaactgggaaatgattctcagcagacccagctgttctaaaaggcaaaagcttagtatatcaagaggtcaaacatacagtaactggtttaatagcattaagcacatacctatataacttgaattatatatgaaaccaatctacttcttaactctgtattacctgactaacatagattactttataaaatgttttggcttataacctaaggttagttttcaatgctataataatccttttttagtatatttttggtaacatcctattataagcactgtatcagaataaatttcttaaacagtatgaagaacataattaatgaaggtaatttatataatttat

SEQ ID NO: 54224 - DNA, 2009 bp, Homo sapiens
gccaacatagtgaaaccccgtctctactaaaaatacaaaaattagctgggtgtggtggcacacacctgtagtcccagctactcaggagactgaggcaggagaatcacttgaacacgggaggcagaggttgcagtcagccgagaccatgccactccactccagcctgggggagagtgagactccgtctcaaaagaaaaaagcaaatgagaggttgccagcagcatctaactaaactaggtaccaaactagattgttattaggtgttaaaatcacttcttaagtcatgtatgacgtgcatgttaactaattcttgataatataattatcttttatatctcacaggcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaataaagcatgtataaaagtggcacctttggtagaactctgtgtttttctgaaattcagattaaatgtaatgatgagtggaattaagtaccagttttcccatttaaagccccagctgcttattaatttatagattctgtagaaatttttttaaagatttatctagtctattgtgtagcctctatctcaggagtgagtttttattttcctatgcttatagagaaaaaaacattttcaaggttttaaaattttacaccatttataaaatattagagtgtattttttcagtacaaatgtttaaaatatgaagttttttttgaactaaactacaaagagtactgaatttaaagaaaagacctttattaaggggcaatatgtgatccattccaaattattttgaaatattaaatttcagttattctgtggtgttttctgtcatcatcatgtttttgttgtcactcccaaaataaaggggaggagggaatcacagagtatgttatcttgatagtgaaacctctgcttttcttgaccatttctgtaaggaaaactgctactcctttggtacttgccctaagttttaacaaaattagtagaaaatattaccatgtcatttgaatatatcatgaaaaatgaaaactacatgaaaatctgaaacaaaatataacaagttaaggttgaaaattttccactgcgtgcaatggcacaagcctttaatcccagctactactctggaggctgaaacaggaggattgcttgagcccaggagtttaagaccagactgggcaacacagcaagacacctatctcagaaaaaaagaaaataattcactttccacttagagaaattttagattcacctttttaaaatgaaaggtttttaaaaactgttactataaattatataaattaccttcattaattatgttcttcatactgtttaagaaatttattctgatacagtgcttataataggatgttaccaaaaatatactaaaaaaggattattatagcattgaaaactaaccttaggttataagccaaaacattttataaagtaatctatgttagtcaggtaatacagagttaagaagtagattggtttcatatataattcaagttatataggtatgtgcttaatgctattaaaccagttactgtatgtttgacctcttgatatactaagcttttgccttttagaacagctgggtctgctgagaatcatttcccagttcttttcattgtagatcagatgactctcactttatcacccttggaggccacatgaaggacaaagcagaaagatccacacacacaactaatgtttatatgaggggagggggagttgcaggggatatactt

SEQ ID NO: 54225 - DNA, 1046 bp, Homo sapiens
ccccaagtcagggcacagatctatttatttcataatatagctgaactatatagttttggtagtagtccagattaaaagatgtggaaactgagtgccatttaaaatactttagggacaaagagaagagtttttcaaagaagcctcattgtttggcatctcctccatctgtcctctgtttgcttttagtagctgttttccctcgacatgctgctcctccagctccaaatatttgcgtgtttcagtcttttctgccccacaaatatttttgttgtaaattatttcttcctactcctaatcaaagcttttgtttcctcagtgaactgatctcaactagatattaacaggaaagcattcttttttgtttaacttatttaatgttttttaacataggaaatatatgtacacaggaaaaagttcaaattatacaaaaggatatacagtgaaagcaagtagcaagtaaaaatttaaaaattacagataatcttgtatttgacagcaggtgcctgctaaaccaaattaatttctggtgcagttatataaaatgtaaataggcagcaaaggaggaaatgttgttggacaaaagtgataccagataatcaagcctgttgtttttctccctgaatcaggtccacttaaacttaatagtgtctttccttctttcttcttgtaaacccatcaatttatttagagcttagacttttaaaacaatagctcccatggcagtgggcttcaaggagcaagggaagagcaagaatcattgttatgagtcacataggaatttgcctatgtttacttaatttattaatttctctccatatttgtttctaaagatctctgttatttaagtatatcactccatgaattggtgttataattagtgagtttaagtaagagctgagacattttacaacatataaaaataataggccgggtgcccattattatctactaaaaatacaaaaattagctgggcatggtggcaggcgcctgtggtcccagctacacaggaggctgaggcaggagaatcacttgaacctgggatgggg

SEQ ID NO: 54226 - DNA, 1040 bp, Homo sapiens
tttgctcctcttaaaaacctgatgaagactgtcatctgactttcgtattttgagagaatagatgtgtgctcttcctttgttcagtgattcttctcttgtgtatatctttgttcttttggctattatcacatatttgaacaattatatatatacatatgtatatatctaaaattagaaattaactgccaaaggcttattcttgtttaatatataatacgtccatatacaactatagtattcgtcttttacttccacatataaaacttttaatatcttgatcttttcatatatgttataaattttcttctatgtataaaatcttgattctcctccctgtatttgaaagacatggtgacatttgtgttttagtgactcacattgacaaacacatttttaaattattttccaatagaatggcgatcagtccacgaagcgatgcaactttctccagtcagaaatcaacaccttcagagagtcctcgaacaaagaaatttccactaactgaagaggaaatattttatatgaattgtagagctgcctacttaactgtcttcaaaagcagcttggaaaacattatttctaaagatcaactttacttaggtaaatttttaaaatttttaaatctttcacctttttgttgaaagttaataaataggtccgaaagactgaaattagaattaccttgttgaatcatcccagtttcttagtgaagcttgagcaatggaactacagtaagctattatgtcatatcatatagttacatattctaggaactacaaaataaaactttcaatgtttatacaaactagatgggtaattgaaagcttctatcaattactacttgcttaagatacttttaattctcattttggtgctttaagatttatcataataaaattaaaacgcttttggcctcttaagtcactagcctgaatttgacccatactgaggaaagtgtaaaggatgtgtaaaaatgggtggaatgtctgaaaaagtgaagtactgagagataagtgaacttttaaaagagaattgagttg

SEQ ID NO: 54227 - DNA, 1047 bp, Homo sapiens
ttgatatgaaaaaatgcttttaaatgtttttatatgttgcccatggggttgttctgatcttttctaatagtatatttactcagaggccaaatatgtgaagccaatacataaatgtggctatttattttatgaggactacaaaatacatctgctacacaaaacagaaataatgctatttaagggcttactacagtatcatatttaatctttatataggctcaatgacacacaaacatttccctgatagaatgttatataaaagtcttttttgtaggcttccttacagacaagaataggcaagaaacaaataaaattggctgaagttaatgttttgactaaactcttcttcagaactgactacaaagttaagttcaagataaagcattgtctaaaacagtagctgtttccactttgttttgggtaaaattactctcttatgagattgcatgtgtaaaaaaattagtatatagcaaaattataatagagtttgcatgagtttctatttacctctttataggcttctgtttatctgtaatatgttgtatttacaaaggattttttatttgtatttatactttcacaattattttcttatagatgagttttgtgcccatgaaaaaactttccatttgtcatccacagtggcagtgcaaggttatgtgtggagataaggaaggatcatgggataatatatattaggaagcagcaagatctggtttttcactcctgagtctacatctagccaatttcaaaggttatgcttttcaaaggatggatttggtaaacatttcatttttgtttgtttgtttgtttgttttgagacggagtcttgctctgtcgccaggctggagtgcagtggtgcgatcttgctcactgcaacctccgcctcccgggttcaagtgattctcctgcctcagcctctcaagtagctgggactacaggcgtgtgccaccatgcccagctaatttttgtatttttcgtaaagacagggtttcatcatgttggccaggatggtctcgatctcttgacctcatgatccgcctgcct

SEQ ID NO: 54228 - DNA, 1033 bp, Homo sapiens
atcctcatagaacccttcttcagccaggcgcggtggttcacgcctgtaatcccagcactttgggaggctgaggcgggcggatcacgaggtcaggagatcaagaccatcctggctaaaatttttagtagagaaaccccatctctactaaaaatacaaaaaaaaaaaaaaattagccaggtgtggtggcgggcgcctatagtcccagctactcgggaggctgaggcaggagaatggcgtgaacccaggaggcggtgcttgcagtgagccgagatcacgccactgcactccagcctgggtgacagagtgagactccgtctcaaaaaaaaaaaaaaaacccttcttcagcgtagttgccttagtgacaagaaataactagctatttttataattttaggtctactttatcagatatatttgaagtaattgatttagatggaaatggtcttcttagccttgaagaatataatttttttgaattgagaacaagtggtgagaaatgtgatgaagatgcttgggctgtctgcagaggtaagcacttttcttttccttaacagatgtataaaaatatatatatagcaccttttcatctctaagaaatgagaagtcaaacttctgcatgaaatattattatagcatttaggacagtttgaaagtagtattgtttgtagatcataaaaacttaaacatttatttttcttaaaccgatagttggtataatactcaagttaaaagaaagtgtgaattacttaatcataattttagttttgattctctactcttcggggtttagaagacaaaaaacttgtccttgcgcttgataccactgggcctgaagtggtcaagaaccacaaactgtgaccaggagagggcagcaaaaagccaaaaagctagagttttactcacaaattaaggtttccaggaagttgcttatattatacatgttaaacattcttcagtgcttttcgtatttgagttgaatttaaaaagtccatttatggaaatattgaagccaaaaatgccaagatggacaaag

SEQ ID NO: 54229 - DNA, 1027 bp, Homo sapiens
tctcagtgcacctagaccctaaaacaatgcctgatacaaagttgataataaatatatttgtttatatattgtcaatgaaggagtaaaaagatgttttagacatattagttggaaggtagtattaaaatgaatggaagttgaaaaaactagagataacaacaaaagaaatagacactattgctatcataagtcaaggatgaaataatgtgaccctagtgtccataataccctgggaatgaagattaaaaggtaagtaagtttaagtcacatttaaaagaaaaagtttatataaatggtgacagattggaaagaaaatcaatgagaaaaagtaacaaagttgaaagaagtagccaatttgtatgaatttgtagtgcactatatgatgttaaaacagaatttcagggtttattctgaggcttatatttgtctgtaattattaaagaaaggaatagcagcttatgaaatctttttttaatagtcagatgagaaagtgattattcacatcagcaatgagctaagtaaaaactgcataaacaacagaggactcaacatatttgcagtagaagtgggacccaaatctacaatggtaatgtattattttctaattaaagccttttgttttatgtctttgaaaaaaatttgctattaatgctatgagtaaaatgtaaatataaaatggagtggaaaattattttaagtatgatatttgtatcagtatcattctatactcagagacaggagactttggttctaatccagttctgtcactgtttggttgagtgactatgggaagttcatttatttctatgttccagtctctctaaatgtaaaattaagataatatcactaggccgggcacggtggctcacgcctgtaatcccagcactttgggaggccgaggtgggtggatcacctgaggtcaggagttcaagaccagcctagccaacatggtgaaaccccatctctacaaaaatacaaaaattagccggacatggtggcagacgcctgtaattccagctactcggga

SEQ ID NO: 54230 - DNA, 1106 bp, Homo sapiens
taggtaggttaaataatttacaaaaactataatggcagcactaagagtccaatatagatctgccaatcccaagaacttgaacagctcctgagaatgaagaatgaacagcccttgatcttgaagatctgttttccaggctccaaaatctaaactgggctctatctacatctgccttcctgggccaaacatttataagcatcagtgagagaagattgcctggatttgtttactttgtggtcctgaattttcagacaagcgcaaattcccatgaaagaagaacagacaatagctgtatcccagtagatcatttccctgttaccacctgtgctgaatttgcatttcattcattcattcatttattcagtcagtcattcaacagatcctgttgaataccatgttcagagaaatgtgtggactaaaaggatgatgcagacccaagagttgtccttaaggagcttacagcagagtgggaattttaggtgcccagatggaaatttgtccatttgggagtagtgtggggtgggaaggaaagaattagttaagactaaaaaaaaaagttcttaaaacttcatcaccctttagccattgccctattgctcttctctcagccaacctttgtaaaagctttctgcattcactatttctcattctcacctccggtttactcgccatttcactgcttctgccccctccactactccagtagaattgctcttgccaaagttactagggacttgccagttgctaaattcatggaatacactctggtctaatcttatttggcctttctgctgcatttggcagtgctgattttgtactcttgtaaagttcttcctcccttggccttgcttactctcctgattctactcacactttttggaagttccttcatgggctgcacattgactatcccctaggtttctttcttctttctttctttcttttttcttcttcttttttttttttttttttttttgagacggagtcttactctgtcgcctaggctggagtgcagtggcgcaatcagctcactgcaacctctgcctcccaggttcaagcaattcgcctgccttagcctcctgagtagctgggatgacaggcatgca

SEQ ID NO: 54231 - DNA, 1016 bp, Homo sapiens
ttcatcactctgcctgcagttatcctgggaagcaattataagctttcagcctcaaccatgcagactaactggctctacttccttcactattgcagtttctagttctgttcgtaattgttgcacaagactttgtgctattgcaactacttggaatgccagttccaggcagagtgccctctgttgtagacaccttgtgctttgggaagttgtctgtgattaggggagtaattttctatttgaggttggtctcaggaagggaaaccactcctgactcctgcctgaaaactcgcctccttgctcagaaacactaattacaggggtcgtttgatgctctcacttaaatattttagtcactcacacatttattgactatctgtatgtgcccaaccccattccaggtactgaggttaaaaatgagtgagatgcagtctctccataccacagagcaaaggaggaagcttgtttgtgtatatggagcatggcccatgcagggttacttaatgctagaaaccaaacactctgaggcaaagaaaaggtgtagggggttggggggcagggtagaggaatagtctacccagactgcctgtcactcagaccagccactctgctgcaaaaggagttggcttatcttttttttttttttttttttttaagcacttagcagtttcctagggctgctatctgctgtaacaaactgtgtggcttaaaacaatggatatttattctcttgcacttctggcagcttagaagtctgaaatcgaggtgacagcaggaccatgctccctctgaaggctctaggggagactctttccttgcctcttcctagcttctggtggtggctagcaatccctggtgcagtgtaacttcaatctctacctctgtcttcacgtggcattcttccctatgtatctcttctgtctctgtctccaaatttccctctcctaaatcctgtcattgaatttagggccaccctaatccagtatgctctcattgtaacttgattacatctgcaaaga

SEQ ID NO: 54232 - DNA, 1022 bp, Homo sapiens
ctgataaaattttccaaatcagcaagacaattgaagaatatgcagtttgccctgacctgaaagtagaccttggtgttctgggaaagcagcagtttgacttggaaaataagttcaaacccttcacaggcatgtttactttcctcctctttctgcccactcctatttccaagttgagcgattttcctttcaacgttttagtagagggtcttcagctttggaaagatttccgtgagtgctctgtaagctttgcaagtgttagttaattaacaagtctggaattaggtttgggagaccagagacctgggctccctgggccctgccagggatcagctgcatgacatcgagtaagtcatttccagcactctaggcctcagttttcatgccttgactagaagacctgcaggattacattcatagttaacttttattgacctcttgctacatgccaaggtctttacacgtgttaatccattttattctcacagtagatctgtcagggcagcactgtcagcattcactattatagatgaggaaacaaaggctgagagagattaagtaacaggctcaaggtcacagtcagtgaatggcaaaacgaagatttcaactcaggtttgaatgattcgcaagactacactttccattttagttttcctcattcagtaaaatcaatcagactattttggggggaccaaattgcaactccctacataggcagctgtggctaacattttgttgttgaattattgtaataattgacagaataaatatttataaaagtattcagattaataaaatgaggatgagatgattggcaatgaacttgcattttgactttgccctaacatgttttctttcttctggattgcaactttatggaatgcattttattagtcatttagttcctggctaaaggatggattgcatttttttgtttgaacctactcagggagagctgacaattgcatcctaacaaagataaagtgacactttggtcatctcgaagacattcttgaggttcagaa

SEQ ID NO: 54233 - DNA, 1111 bp, Homo sapiens
tttgatggagatggggtgggtataagtgcatttaagtgaactctggtgcaggccaggcctgatcctgcagatggggaaaaaagtgggctgcttctgccagacccagggaataactgttaaggatccctcattctgacccgaggtcagaactaaattattagaagcccctcttgaacaggaataggagtcattgaaatgaaacccacacatttaatttcagacatccatacttgctaacaatggcacgatgattaggttctgattatgatagaatgactggtatttcctgagctgggtgagttctagatgcctgtcttaaggtgggtttctgctctcaaccagcagctggctacttatttaatctctggacaagattttggtcttataatacacccattcattcattcacatgagctgaatattgaagctgtaatttcattgcctatatgaagatgatattgagagaattaacattttaatcattctctaccattaaaatgtttagaaataagctgttttatttacaagggtgactatgtaccagacaaggaagagatgtgtcttaggtttatatccctggtatctcactgatggtaggcactgtatacatttacttagttgaaaatatatttttgttgttgctagtgttaccattagctagaatccactgtttcctgaaaaatgatttttcccttatcaaaatgttgggaaattaaaggggttccagcagacattattctgtagtacatctttgtgatgagtgcattctgggagtgttttttggccaccctcccagttactgtggtacacagactgtggtacacagtttacccagtagacctaccaaactatgtaaacagccaatatttcttctctcattgcattttcccctcccctgggaaaaagatgattggttccagagtctgaaaaaagtctaggaggttaaagttagctggcctctggagggagaacagaggactcagctcaaaaggaggttgtgcttggactttaattgaaaacagttttaactttttggcatggaggtgccttcggcccaatggtactgtataaactcattgaaaataaaacccagtgttaaaaatgcagtatg

SEQ ID NO: 54234 - DNA, 1035 bp, Homo sapiens
tagtcaaaatctcagcagcctcaggcaggtctcaggctgggagcaggcccagcattcaccccagagaagcccagggagcttggaggagaagtgcctgagtcacgtgctcctttcaagagagttctccagagataacattgcttttcattttacctcctcaggatgtggtgactaaatgttagatagcatctttcaaaagcctttgaaacatcttagagctttattctgtagaaatgccaagatgggtgttttctgcttattcagaagctcataacccttccctgaaatcctccaaacccttcctttcatccctggcctgttccatccccagtgactgacaggcctgtattttttttgccagcttcttctgaagttagatagttttgcgggagggccaaacaaatgatgaagaaagtgctgactgataggccttggtgtgatctgcagtcagcccgtgggcctcaacttcgtgacttcttccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcaggtagaaacagaccggtgtgtaagtgagagagagacctcagagcttcatctctgacatctcaagggaaaaattaaaaagttcctgttggctatttttcttttgctgctgtgtttttctagggtagctgttcttacctggttttctgctgtcccacgtgactctcacatgcactcgttgggacagtggtttatgcccttgttctgtgcactgtccagtaccctcattctgggattcttaacctggactccagagggatttttgcactctctggaatgatatgcaagatgatgtgtccattgtacatgcagaaaggagccccagaatctaagaaagagggagaactgtgggaacttagatgtcaactcctc

SEQ ID NO: 54235 - DNA, 1073 bp, Homo sapiens
ggcccaattctgaaatttcactttttctctccctcttgacattcagctattctctcagagaagcagtttcctgttcagcgatgtgccccaggcctacacagtggccaggcttccagtggctgggctctgcctcatagggagtgaaagcagaggccaagctcactgtggttctggggagtgtcatctccttggcccttcaaggccaggcttgaggacagggtccctctgcctcctctgccatgctgctttcttcaacgtttcttgttgactcattagaagctggccttgcttataagaattctccagaaaacatattaccatgagtaagaggtgccccccttgtgtttctgcgttctgaacccccccagcagagggggttggatatgagtataacagccttcatgcaggactcactgcatggcctgtgggctttggcgggggcaccccatggccttctggccttcccacttgccccttctgatccattctccacaccaccagctaagtactctttcaaatgttgaagtgcagaggcctttgtgtagcctccaggtccgtgtgactcacctgcctgtcacttcccgctcctctccccctactcacagccttacattccaagcttcagtcttggggaaccatggcacctccctcctgcccccaggccttggaagctgctcttctttccacctgaatcacctttaccctccatcccaccctccactacattctccacctttcccctccattccaccatccgccatattctcccaactcctacttgttcctcaggtctcaatttaaacatcgtttcctccaagaagtgctttctgagcctccagtgtctggtttgggagctttttctggtgttcctatcacctctatttcccccttcgaggcgcttatcccattctatgttcataacctgtttactttccatttcttctactgccctgggaactcctacatggcagagactgcctttttcaccagtgtttacccaggatctaggcctgtgtctggcacatagcaaaagccccattaaatattttcagaatgagtgaatgaaatctact

SEQ ID NO: 54236 - DNA, 1038 bp, Homo sapiens
tagggcaaagatggaaaaaagagaaaaaagctctcaacaaggggattgagtgaaacaagcatggctggcccagagagaagggaatttggagggacccaggaaggggagcaggtgacacaggcttgtcaaggggttctggagtgaacaactttggtctgaatgggaaactgtacttggtttccagccagaatgagcttggcgctcccaagctctgaggtttgggtaactagtctagttgggattagcaatataacaggttggaatgtaatggcagctttatgtgtccagctgtgctagctgaattctacagcaaggttcagtgcctgcatttgacctgtttccaaggggttggaatccccagatgtgtcataatgtgttaaaatcagttttgtgctttaaactgctgagagtgttgtatttcaggtacctcatcataaaagaaggttacagaagttagggctgcacctgtaaggacagaggtaacatagaagaaatctatattattgcttttggtggtggtggcagctgaattaactaagctccaaagcaatggacaagccatcttccgagagattggacatatggcatctcctgatccttaaaattgtagattattttagccctacctcttcagcaaagcaaaatcctcatgtagagggactgtgtgtgatttaaggcaaaatgtctttccctttcccccagccgggggtgatgtggtgggaagtatgttggatttggactcaggagggggattacctaaacagcaactgtagtgcatagtgggtttcggtgtcatctagacctggacttgaagccagactctgccatttcccagctggatagctggcatgccttagttagcaagtttgtaaagtcatcactttacaaagtagataatgatacctacttttcagagtttttgtgaagataagcatcttcaaagtactagtgataaaggaatagtatttgcagagctcttgtcgtctggtaccatctctcatcattttattagtgcttatcagcccacaggccttcaga

SEQ ID NO: 54237 - DNA, 1101 bp, Homo sapiens
gtctggttcctaggtgccgggctacctgcctttaatttcgcttctctttccttttctgagtataaaacaatataaaacaatatgagagggtctgtctctcttctctcaccatactctttagtaatgagctcaaatctgttattattgtcttatttgttgttttataaatccctttccattttgtgaatgtttgatcttttctctggggtcaagacttctggtagaactcacgtttactttctcctcttggactcaagattcctaaggtagcccagccagtggctcaggaaatcagcttaagcggagatatgtttcatgtatttatttaaaaagatacaaaacatttctcccatcatttttctattttgttagccaggagaagaaaacctttaaatttattttttctggtctgtccattgttgatttctcatctaccccctccctatgcaaagctcaacttctttaggaacctgaagcttaccttataactgcacccaagcccagggctttaggaacctacctggcctttctcaaaatcttatagattctgtggtttggctgctgggagccagagggaggtggcttgctactgtgtttgctatcattttgtaaaccttccgttgccatttaaataggtatttgtctgtacttttagaatagaagtgtcttgaaggcaataagactgtgagcttttctggtgaaaacactgagagcccaagtccactagtcccaactttattagagatgcctgaaaatcctccctggctggctagggggagccgaaccaaggtgggatgggcaaagggtgtggtcaaattgtctccttcagttttggaaatatttaatttccaatatagattcagtatacatggtaggctgttttgcttctctgatgcctgggataatctgcctgatatttagtgaggggtcagctttgccctatagcaccctttctcttctgtatcttgagcataggcccccagttagacttttggaaagtttctgaaagtgtcacttgctctgaaattagtatcaggtttggctggtggtttgatggtgaacatctaccccatttcaaatatttctgaaaattttacacag

SEQ ID NO: 54238 - DNA, 1049 bp, Homo sapiens
atttctcagctttctcacagttaagtgaagccatgtgactaaatactagccaattaaatgaaattggaggtaatttttgtcgcttgtaggcttgacccataaaaaactccccaggcagaatcggtatgatccttcttcggtggcttgacaaccttagaagtcatgtgttgaaagtgtcacaacgtggaaagagcctgagactctcccttaatcactgtgtggtggaagccacacttgtttaggttttatgtgaaccaaaaacaagtgtccattgttaaggctgagattttgaggttttttttttttgtttttttttttgttacagctgctaatgttaccttaactaacatgaggttgtaaatcagtgtgtggtgagatcaatttagtgggttaggaccagcatttttagatagaataaaataggaaacctggtttgtgtctgaccacttcatgcagacctggggctccatccagtaaattaaaccccttcccaaataatttatggcacacatagggtgcctctagcactgtagagaatctagaagaatgaagggtggcctttacccttggggagtttaccttttaggggcagtaaaataggcactttatacagccagtgagtacagagttggcaattatatatgcagaatccctagaagggtgggtctttcgggaggaagtgtgatatgatgtgagccttgaaggaaggattgagagggtgcgggattgaaggatgggagatgggaagaggagttggacatttcactgctggaaaagggctggagttccacagcagcctgcagctgctctgggggtctccatggactcgctgagactatcctgagttcttaaaccaggccttcactgtggaatgaagctgatctccaggggatgggagagtgaagaaaagaaagacagcgttgaatgaagcctgttgtgtttttagcatatgaagggtggaggaggagagagaaggaagcagtttcactgggagcctgaagacttgtctttcttcccaaagggtgtcccagggagttaaaaatgttgtg

SEQ ID NO: 54239 - DNA, 1028 bp, Homo sapiens
tacatctattatgtgtcaataaaaaaagttaaccaaatgatcgatgaacacctactatgtgccaggcacagtgctgggtgctggcaatgcagtggtgaatgagacagggacctgggtgcttgctctagggaatgcccttaggagaagctcagggtatgtttttttatttggaatgcttgctgattcccctcccaggacctccagaaagaagtggtggttgcttcagcggtcacttggtgatgactggcaggtatatacctgtgtagctggcacatctggtgcctgtgatcagagccgagccatccagtctgagctttgtttttcccagtgcagcagtggtttcctgcagtaagctccatcttggttgtgctgccctccccgctggggttgggataacagcctcctggggactgtggctaatctcaggagaagcagagaccccagggaaagactcctgtctccgttgtgtgcacctaggattagatagaactgccgctaatgcagttaggtaaaggcaagggccctggttgctggggaaccaggaagcacagggtgagcttcccatctgctctcagtgaaggacgtcctcactgtcaccgcttcctagggccaaaggggcctctgacaaagctaatgtgaccaaagtcaaaatatgggctccgagagtcagccaaacccattcaactaactgtgatcttaggcaaacctcaaagcttcggtttccccatctgtaaaaattggggtactaatcatatctacctcattaccttttggtgagggcaaaaatcagacaatgctgacggtcactggcatgtcctgagtgtgcatggtgagtcgtccatcaacaagagctcagatgaccatgttccaggtgaggaacccgaggcccaccctggccttgatcagaaataaccaccctgaattcctcagtgcctgagtctggcatcgaaactggcttccccggcctccagcactaggccacgaaggaaccagcttctttctctcactggtggtggcctgctgtgccc

SEQ ID NO: 54240 - DNA, 1137 bp, Homo sapiens
ctttttgtttctgggtggtggactataattttgtattaaggaaagaatgcctgcccttatatatccaggactggattttttttttctttttcttttcttttcttttctttttcttttttttttttttttgagtactcatgaaaggaaaccataagaatgtttgggtctaataatatacttgcttgtgtatgaagataaaaccaataataacattaataccacccttcagtggtgaaatgctttaacctttcaaaacaactccttttatgaacttactctatcagttggcaaggtgatttcagggctatctcctgtggtgatgatggatctgtgggagcttttctaattgtgtgggtgaatttgagagaccccatcccagtggttcttgttcaggggtgagtatggaatcatgtggggaaccgccatgaattacacatacccaggtcctgcccaggacctactgacacagtcctggggtgggggacctgcccacttggaaaacttcctgggacttcctcagctggaccctctggggattggggaaatgcattgcagtcacctgcctggggtagtaggggctgccacatctgtgactaggacccaaggagagtgatgatgacccttcttggaatcatgcagaacacacagtgacagtcccttttggaagctggccacaggctgcactttattcattattttaacagcaaccaaacatttgctgtgtgcccactggtggccgctagacagtcttcccaccctttagctcatgtagtcatttaaaccagttccatcactagagaaatgtgttactagccccttgaaggagagtgggccttcaactggattcaggagttgtggtctgaggagagtgattgatatggtttggctctgtgtccccacccaaatctcatgtagtagctcccataactcccacgtgttgtgggagagacccagtgggagataattgaatcataggagcaggtctttcccatgctgttctcatgacagtgagtaagtctcatgaaacgtgatggttttaaaaatgggagtttccctgcacaagctctttctctctttgcctgctgccatccatgtaagatgtgacttgctcctctttgccttctgccataattgtga

SEQ ID NO: 54241 - DNA, 1031 bp, Homo sapiens
gcagggaaatttaaactgggtgaaactgaactggtttccaattgcttgtgttctccatttccagccaagttccaggttttcctagagtacagccaggagcatctgcacctagagaacacagaataaaattgtggaaaccaaacttgtaaatgtttttctcattagcttcaggctcccagccaccaataaactgtaggctttaaaaaatcctgtattattttgcaagttaagagaatgtgcatattccccttatttatatgttcaggattttcttaaaatgttacacatcaagcatttatctgctaagccaccccaaaaggtaacagcattctagtttttgtacaaaagagaaaaaaaattccacttaataaacttgcagtaacttgagcctgttggtggtcttggaggaaacccaaatccaggtttggttgatactgtgtaatgtgaatgcaattagtagcggtttttctaaagtagaaagagatgtagaaaaataatgcatagcaaatttaggtcagagctgggaagcttataaatccttatttttgttttcattactttaagtaatagggcttttgtctttattatgtaatttccctagcaataatatgttttaaaacatttttctgttaatttcatacatttgatcagaaagccacagttcataaacccctgtgatgtggcagctgtcactgtttatatatagaggatgacttcttgttcatccctgggaggccaacacaaaaattactgatgggggcaactttcactacctgttttttcatttagtagaaggtttgcaaagcagttttcagttgatcaacatcctcctgataggctaaggagtgaactgacctttacatgcatggtttatttcagagcatgttatttgattccagcatatttaaacctaagcaactagattgtaaggtctgtaaaaacagaatttgtctttctggttttttactctattcccctggcacatagtaggtgttcaggaaatattagctactattctcctctccaagatg

SEQ ID NO: 54242 - DNA, 1035 bp, Homo sapiens
ctgattccaatgaatttttttttattcactgaggctttatgtcatataaaaatatgtgacgtattactgctctgctgcccatctatttaaggcattcttcagtagacttgtcagggcttatctaaatcttagcaccacttacgtgtggctgattgcttggcaggaggaggttcctgcattttcttcctcctgtgtattagtgaattgaaatcaagggaaaaactgcttggctttctgcttccttccatggtaggtagacttttctacatattttccaacagttctttttgacagccaagtctggaaacagggcaggatggaggttttacaaataggtgacagttgtttgtctcatgaatttcttctatttcctttccctagtggagttaactgcctccttcctacaacaatccgaacgtacttccatcacagagtatctagcagtgtgagcaatagccatttctctcttttacctcttctggattctaaacccatcataggtagagatagaacatgtctgtgcttagatagtatctggcacatacagattgctcacttaatggtgaatgaatgaataaagaagaaaaagtgatgaaagaagaaaaactacagtcgtctcttggtatctgtggcacattcgttccaggaccctgatggatgccaaaatccttggatgctcaagtctctgatataaaatggcatagtgtttgcatctaacctacatacattctcctgtatactttaaattatctctaggttacttataatacctaatataatataaatgctatgtaaatagttgttacactgtattttaaaatttgtattatttattattattatttatttacttatttttccaaatatttttgatctgtggttgattgaatccatgggtgtggaacctggggatatggagggctgactatatatactaatgaacactactttggattatatgaaaatacccatttatgaaatggacagttcaaatgtttcctctttgactgttcttaacctgacctcccaacttga

SEQ ID NO: 54243 - DNA, 1044 bp, Homo sapiens
tcgtggcgtggggaatcatgaggttttccaatctggaaatatctttttggatatttctttccccagtgctgggtagttgccacacatgtatgcactgatcagcactctgctgaatacttgagggggattctctgtggctctttctgcagctctcttttctctgatacttggccttgcaaactctagttgccttggtctccctggactgttagctcaattcactcaactcaggcagttcactgagctctgcctgagttctccctttcctccagacaccttgagctggaaattctctcaggcagtaagctggaggactcgtaggattcgtttcatttgccttccttcttccagggatcactgccctttactgactgttataccagtcttgacaattatcctgttactccaacttggccagaaatggaagtgatacattttattctttctgtctgaaataatcctccatccccaatgtttaaaaactgccatccttgactccatgtgactgtgttaggagccctttctctggtctctcatcatacctgtgcttacagtaatttagtgcggcactcctctccctgcgttgttcttgcatttttttttaccctctcttttctcgttagattttgtttccttgaggacagggaatgtctttaatctcgggatttctaacacctaacatagactcaggtgtgtaacagttgctcaataagtacttgttgaatgaatgaattaataaataaataggattcaattttcaaagtatctgttgttgaacaactttcagaagtttttttttttttttacagaaatgagattagatatgcatcttcatatatgcaattgaaatctctcttaaatttctagataatcagttgttgttgatggcttggacatggtttttacctatttattttttgtagcctctccttagaaggtgttaataaaagccacctagttgatgcttgaaacaacatgtggaggtaaagggaccaagaatagaatagccatattctataaacaaacaaaatgaagactaacttt

SEQ ID NO: 54244 - DNA, 1095 bp, Homo sapiens
gtaggatataagtaggataagatgtaatttgtcaggttgctatgaggaataaatgaagtaataaatgttagttgcctatcacagtttcaggcacatgggaaccctctccccattcccccaaacttaattgaaaagatagccatcagcctctgaagttgaattgtgctgagtggttactaacattaaagacatatggagttattgtatctgtatctttcacttatcagcttttccttgaaggtttaatgtgtgttcctttgcttttaggccccatgtttattttcctgaaatggtgtcttcttgacttaaagtacaatctttgcttttttattcttttttcactgctcttgcctggtgatcctgttgtttaaagacatctccatccttccctatcctttccctttcaaatctatggcccagactgggggtggctttaactaacaacagcactttgcattagttaagtagagtggaatttctcattctacctctcagctattgatgaaacctttccctgatgcacaaattaagactgggtgtattttgcatattttcctagaatgacacagtgattctgtggctaaaccaagattagaccctaccactttaaaaaatctgactttttgcttaaagtgtaaactgtgttgcttctaaaactactagttgaatttaactttcaagtgtactttgtatttaaatctgatgatagtgttgtttttccttttgtcttgtttagatgagggtattttcttcacttccctgacccctagtgcctcagtgacctaggcagcaagttttttgatgctgtccagaatgctaattaagatatttattctctttggccctattgtttatgatacttgtaattatgtctattagatggtaatctctgttatctcccactatactaagtgtactactcggcacataaagaaatgtgtgagtatgtgaatgtatactcacatgtttgaataaatgtgaataaatcaatatatttatatagttactgatttaaatgtgttccgtcttgggatgtgagatgggataattgaataagaaattagcctgtgtgtgttaaggtagtcaaagttttta

SEQ ID NO: 54245 - DNA, 1049 bp, Homo sapiens
tgcttatccctactggagactgatgggtttacaccaacatggaagctggttggaatggaaaccatccagaaaatgattagggagcttgaagctctctgaaactgggcataatgtgtattaagtcattatagttttaatgaaacttgtcttagctggggtctcttaaccacttgttttctagttgtaaatattgagtccctaatttacactaatgagatgctgttgagatttaacgccaatcttatactgcatttgtcaaagtgtaagagctaacctgaaatgtagctttgcaaaatattctattaaataaacttggtggagaagtagcaacaaacaaactgcatgctttcagcagaaactgtcaacatacacatctctgaagaaattcatattttatgccagggtggtctacagtagttcccattagtaaacggttaaatatcacccttccctggtaaatctgaatacttttgtgtctgttgtgaaatgctgtacacatcctcttttgatgatctgcctgggaattctccactgtgagaattgtctcttaaaaatgggaagcagcaaggcatagtagaaagaatataggcactggtgacacatatatttaggcctgagcccagctcccagttggtggccaggtaagttctttaacctccttttgcttattttttttttctccctgcaacatggggttggtagtacttatagggcagtgctatccaaacacttagtagaggtgataatgtaagtagtgaacgtagctcctgacatatagttggtgttccctaaaggatagattgaaagatatacacaccaccaagttgaattcctctcagatttgtccaaggccacccagcctttcttggccttttcttccatcattggttagtgtgtgttcttgaaggcagtctgattttatccttggcttaaaaagtggggaaatatttaggaagcctagcctaatgcaagagaactcatctatcttactgtaggatcaaatacaaatggtttttggattgtccattatttatctctcacttctcttc

SEQ ID NO: 54246 - DNA, 1060 bp, Homo sapiens
aatcagcaaaaaatttattttgtccttgacattttatgccaaaaatcagcccagagaatgtgttttatagcctgggctgaattcccctaaaggtagagttttcctatgagcagtgttcattgaattggctttttttttttttttttgcactagataactatattaatttattagataatctttttattgtttcagcaagatagaggaaacttacacagagacagcagagcataatgggtaagcatctgggttcttttggaagacgagatattggtttccattggccttgctacttcctgtctttctgaccttgagtaaattactcttccagagcctgtttctttgttcaattggggatcataatagtgccgccgtcatcatgctgtcatgattaatgcacctaaagcatttagcacagctgtcagcacttattgagtattgactaattattagcgatgcacagtgatctataacttaaagcttcgtctcagaatatgccttcttatgatctgatagtaataggaatcagcagaaaataaggtggttcaactatccgggaaaactaccaaatatccgcttagcagaggcaaaataaatgtagcttaaatgcagctgaaaatgctgaaagctgcttttgtttctcatgttatagaaatgcagttatttttattaaaagtgatgggaaatccatctgtaatctcctgtctttcttttatctgtttgtaaaaatagctcagtaaacccataaatgccaagaccctgttcagtgtgagaaacattgttgggcaggatgggaaagttcaaagaaatatcagatgcaatccctgctttggtggaatatttggtgtaacttggaaaattaaatggaaaaaaaattaaacaacaaaacagcacccagctgccaaataagtgaggaaggaaagacctcaggctgaagcactggtgatgggaggagggatttatttgagctggtttttcaaaggatgggtaaggaaagaatagcaggaaggcgtctcataggtatggtttaatggtaagagcaaagtcagtgtagtggcaa

SEQ ID NO: 54247 - DNA, 1046 bp, Homo sapiens
tatactagcttcttacctggtcttctgcttgtactcccacttgacagagcatctagagtgattttattaaaatataaaccagatcattcattcgcttttgtaaaactcttcagcggtttccaattgcactttgaatcaatctgtaccccttaccctgcaaactgccacctgctgtggtccctgcccacttacccacctccactggatgcccctcgatacccagctcactgtgcctcggtcatgacggccttctttttcttccttggatgcaccaaaaccagggggcctgaggacctttgcatgtgctgtttgtcccctttgcctggaatgctattctccaagatctttgcatagctggaaattttgtagctctaaacacggggttcttccatttcataagactataaagctagcaacctctggtatctggttaacagttcactttgtgcaggttattccagatgcagatagcatgggtttaggttttcatttagagaaccacctgacctctccgtagaaactcaccacattctctcccccagtgactttctaacacattacagtgttttaattttcttcatgtactcagcactacttgaagttttctcatgtatttgttgacagtttatctccacccactagaaggtaactctggccagggttacagcactagttctaaccagtgtctgctgtataagaggcactcagcaaatattgattgattgaatgaatacattttttattatatattaaaaataagtagaaatgaatttttaaaaataagagggaagtctttcaatgtctatattcaagccgaggtttgggatccagtggccatggacaggcctgatgggaaggggtgggtggaagaatcactcgtcttcagagcattgcggtatggtgagagaccatctcatacagcctactgcctcccgatactttcattcactcgttcagttatttgaaaagagctcactgtgtgctgctctatgtgctgaactctgggctcatagcaactaaccatgaaagacctggctctgccttta

SEQ ID NO: 54248 - DNA, 1042 bp, Homo sapiens
gtgctgctggatttgttttgccagtattttattgaggatttttgcatcaatgttcatcaaggatattggtctaaaattctctttttttgttgtgtctctgcctggctttggtatcagaatgatgctggcctcataaaatgagttagagaggattccctctttttcttaaaaaaaaaaaaaaaatagagtagcctctctgaactagcagcagtcctggggggatgttgatatcctcattttagacgaggaacctgtggctcatggaaataaggtgaattgttcatattcacaccactagtaattggtgggttaggcccatgtatccatgactcaaagccccatcccttttcagacaactagaggtgtacccactccattgcaatcatgaggaatttaagtttcaggacattccatcttgcttcttttgtttcctcaacgactaggcctgttctggatttttaggagttaaaatttggttgatgctcttttcaatcctaacaaaatatctcactatccatagtcctttgcgatccactgacaagtgagaaaccaaaatgtaaggggttccctttttttttttttttttgccagccagcctaatgatttggcatgctggcaactgcgtggttttgaaccgtgaggctgctctgagtacctgcatccttgtcctcatggaagtcaccaaaaccgtttgtcaaatggccaattccatcttatacagggagtcggggaaatgctcatgaaattgatcttgaagcacttggcaatcgcaagctccataagaatcctgggtaggagtaattaacttattttggaggacggatttacttaggaaagctccaactgcaatgagggtgggcccttttcttgttgctcctggcatgtgctcttctccaagtaacatttgcagcagtctgggtggtttgtctgcttagagccatccagaaaagttggtgggaaaagccaagaggccattggcactcagagactggggttggcaccagtcacagtgagaagcattacttttattagcaacttagtc

SEQ ID NO: 54249 - DNA, 1092 bp, Homo sapiens
cttaaataaatacttttggagaacacattctacattctattttaatgaaaaaatttccaggcatatcaaaaacaatgttattcacaaaaaacaatgtaagttaaacgaaatacaaatgggcttctacagtatatttcaaagtatgtgctttggatttggattctgattttacagttcgccagctgtgttacctcgaatagggaacattatacctctctgaaacatgcaaaattagggatgaaaacacctaccatggaggggtgttacaaagattagaaagaatgtccttggaggatctagtacttaatgttggctccatttctccttctctttcctgcacgttttgagttaatgcattcagctttctttcctaaacctgtcaccacagacaagcctgctacaaggatccctgaagtttagagagattgacttccccaagtactttctcagttaccaaggataattcattcaacgggtttctacactcattttcttgtgaaggaagaaacatgagtgggaagggaggaagttaggagttggacctgagtatcctgtatacaggagtgtctgaaagtgcactgttgtgatccatccatcttttaggaagagttggatgatgattttctggctctgtagtgactcatgagccacacagggaaggcaggtttttattcattcagtcatttgagcaacagctacatgccagaccgagaagtgttaagagtgtcagaccactctaaagaaccaggggtcctcaagtaaaaaggctaattccatggtttgggcagggaaggtacaaattaagcctggagcactttgttgtaccagaaagtatacaaacatgatcagtgatgtcaagaagacagagagaaaccagcttgaaggtcttctgctggccaaatctgggacactttgagtgatggaatagataaggacagcaatggattataaggcattgaataaaatatgaagccacaagtctattcggtgacaggtaggtaagtacgtagatagatagatagacagatagatagacagacagatagatagatagatagatagatagatagatagatagatagataatgtgaa

SEQ ID NO: 54250 - DNA, 1051 bp, Homo sapiens
tgaaatagggtcatttctgacctttctgacactacatctagtggatcttatttaggggatttgattcagcccaagccaggattcatcagagctgtttgctcggtgacctttcacgatgagcatttgatgtgcttgcagggttcaggaccgagtatctggaatgtttgtaattgcctgtgcataaggatggcagcttcctttgtgcacgtggggaacaggtttctgctaggagattgttgtttagcattaattaagccccgccatatgttaagcattgggtattttataaagaccctatgtcctggagtggtacatcaggacacattcaaaacctctgcagtctggctcaatctacctttctagccttagttatctttattcccctttatgcatttccagccaaatttcgatttcttcttatacatcctgtgcttttctgcctctctgctctcaccttttcacctggattgccttctcttctttgccaatactcattctcccccttttgcaaggcaacaaattacttctccctcaagaccaagcataaaatttacattatccagtcttgtctaatccctccagctggaagtggcctttccctctttgaaactcccatagctctctttcttctctgttcttctcttcacattttctatatgatgttatggtgatttatatacttatctcacccttaagcttagaagttccttgtaggagggtttctatcttacttttttttttttttggtctccatcacaaaatctagcacaaactcttatttgtaggaaattctcaataaatgtgtgtggaatgatgagtcacatcttacctggtgagaagccatagccatacatatttgtgtgcaaatacattcagcaaacttactgagtttctactttagttcaggcatgattcaaggttctgagattacagtggtaaagggagctcaaaagtcattgtcataaatggtcttttatgattagctctctattgtctactgacatagtttggttgtgtccccacccaaatctcatcttgaattgtagttccc

SEQ ID NO: 54251 - DNA, 1018 bp, Homo sapiens
ctcagttagcctagtaactagttaatgattggacagaaatttccttaaaccagtaagtctcctaccctttgccaagaggtttaaggaaacctctgtccagtcattaactgatcactaggttaactgaggaggtccaaattcatcctgcctcctctagtgactgctggggtgctagttttcacggttaccacagaacttgagagaggaaaatgagaacggcaaattaaaatgccataaaattccattcttaacaagcgttagttttttttttcctatatatccactccctcacctatcttatgacatatgagaaatcctaacatgggacttggtgtataattagcattgaatgaatttaagttttctttctttctttcttttcttttatcttctgtggtctcctgcagaatcagtctataaaaagggcatggtaaaaaaaaatctatctcatagcattgttgaaaagattaaatgacataataagatgatgcatatatagtagctagcactgtacctgatgcatattaggagcttgataatattactaacagtatcatcatcaatgctatctgagcaaagaggctgttccttctttccagccagagttcttctgttggataatatttccagctgtgaaccccaaccagagaccttgaagcctttatttccttttctctcattggcctttggctgaagtctcctttctgcagagaacaaagtgaccagcttttgatgaactattttcctcttttatccatttccaagtgttagccatagtgaagaagtgtagctgggtgctagcccaactcaagaagtgataatgtaatatccaacccaagataaactcaaggataactttcaacacggctactcaagcagttcaggggggaggcatcttgtagagaggagaccaggaagtcacttggcagctgggccagcacacagagggccattgctccagtaaagcagctaacctccatctcttcatcaaaccatcctagactcagcactctgcaga

SEQ ID NO: 54252 - DNA, 1034 bp, Homo sapiens
tctccctgcctgctcttctctctctccctctttctcttccacaaacactgcccccagtaaatctcttgcactttgaattccatcttggtatctgctttccagaggaccagaaccaacacaagtgatggttacatatccaaaagaaattattgtggaaggaaaatagtacagttcttgaaagcaatcaggattgagggataactgaatctcaagagtctccctaatagcataattagagggaggagtggaggacaaggtttgaatcttatgttacagtcataattgggaaagagtacagttagtcttgtaattgggaagagaattcaggatggtggggggaagttattgaaaaagtagaaggaaactctgggaagtgtaggatcatagaacatgaaatagagagagagcgttttaggaacaggtgataatcagcgcagatgtcatcaaagaaaatctgagtagggactgaggtcttgtatttagagactgacagtgtggctggctggccatcaagtgattatttcagggaaagaatgagaataggtgccaagtttacaggaatgaagaagaaacatagtgggaaatagctagaggtaatgacagtagacctcacattgaaaatgtttgtccatgaatgagaggagggaaattgagctaattagagtaataatttccaagattgagtgtgtgtgttttaggaacacctaaccatttccagaagagggctttaaaggtgctagagagagagagaaaaaaaaaaaaaaaacaaccattgtagaattaaaatgctgaaagcagtgggaagagaaaagctactgaggccagagggaggggttagattttaaacagaagagagaaacctcttttctggaacgtggcaacaagaagatggcagaaatgacagagatataaggggtgagagtgaagaacctcacgcttagaatgtgttcctggtacaaaagtaacaagaccaacctctaagaataagagaatgagatggggaaaatgtgtaaagagagtggagatgatcagga

SEQ ID NO: 54253 - DNA, 1036 bp, Homo sapiens
atgtgtttcaccttcagaatgctattttattttctcagctaatgattattattttagcaagatttgacaataatagtaaaataatcgaaccagtatttttttttttgagacatggtctcactctgtgtctcaggctggagtgtagtggcataatcatggctcactgcagactcaacttcccaggctcagatgatcctcccacctcagcctccccagtagctgggactacaggcacatgccacaatgcccagctaatttttcgtatttttggtagagtcagggatttgccatgttgcccaagctggccttgaactcctgggctcaagtgatacacccacctcagcctcccaaattgctggctttataagggtgagccaccgcgccaggcctcaaagcagtacattaagaactgttcgtgtaaataagctctgttgagggacattaactggggaataaagtggctggaaaggacacattgaactcctttttcatcttctctgaaaatgttaataataactgagacacatctctgtgtctatatctatacttttcataagtgaggaaagaatatgtgaaaatttggccaaaacttaaagtttttgaatgcaggaaaaggtttgttattcacagtggaacaggggaaatgtaagaagatgatacggtttggttgtttccctacccaaatctcatcctgaattgtagctcccgtaattctcacgtgttgtggcagagacctggtgggagataattgaatcgtcggggcagtttcccccatactgttctcgtcataatgaataagtctcatgaaatctgatggttttatgaggttctcattcccttttgcctgccaccatgtaagacacttggttctcattccctcttgcctgcctccatgtaagatgtgcctttcatcttccaccatgattatgagacctccctagccacttggaactgtgagtccattaaacctctttttctttataaattacccagtcttgggtgtgtctttattagcagcatgagaacagattaatac

SEQ ID NO: 54254 - DNA, 1027 bp, Homo sapiens
ttaccaaaatgcattgcaattttcccaaacctgagtcttcaaataacaaacatgaacttataggtactgtgaactagaagaattggttatatccagatttctgggagataaattaaaacatatttttgtggcataaataagctgattcagaagttacatttcttaactttaggtagaggagaatatttgtatccttttgttgctatgcaactgtttaatgatgaagcttcaaaccacaattttgtatatcatatgacaatcaattgttttccaagaatatttattattttaagtacacaatttcagtgaatcttgagtttttctaggagtcccttaaagggaaattagcattccatgagccagtaaaatacctactctggtaaaacattattatggttaaaaagtaaattcaagttagttttttataaagaactataacatttattttaaacattttataataactgaaaacattaaagtgagcaaatgaaatttcaaaaccacttgtaataatgtattttataatcgcactgtgatactatataacacagtctcttttgtattaaaatagtatttttttcacaagctgaaaaatatcttttcctttgttgacaatgttttgtaagatgactttattttcagatctttttctccttttttgcacaaaactatgcttatggtttgtgtcacagaagtgaaaatatatctttgcatttttatatctggtctgtttttcttgtttcctttgtttttaacttgatatagattttcttcaaatatataatggcaattttcagatatctcaccttaccatatctttccttattttcactgcatgcatttaatcactgtattacttaatgtttgatttgttattatgggcatttcaaataggcaagcattgaattgtaatgacaaaaaggctattttatattaaggatatatgcatttgtatttcacacaccagagatgatattaaacactgattattttatgctgctgtttattaaaaatgtttactataaaa

SEQ ID NO: 54255 - DNA, 2663 bp, Homo sapiens
ctccccctttgtgtccccatcccagagcagccagccccgtctggctcggacgattttccgaagtccccaccccacccccttgaccgcgtcctcgcgtcctcgcgtcctccctaccgaggcgcaccaatgggcgccgggagggaaggcgccgcagagtacgcagctgccccggggacacctaggtcccggcggagagcggccctccgagtgggctccgcgctcctttcccctcccgggagcatggggggaggggctggcctggtagattctgggtagactcccgactctaatcctgctgggggactctttttgttgctttccgcatatcctgctgtagtttgcgtgctgtctgctgtatgatttttgtttcgtgtgtgcctttttgggtcgaagaaaaagggagcaaagtgaataaggttcccatttctccagattgtttatcatgtccgtcctcctcgggagaggaaggagggctgacagaaaaactgcccgcagctagtaaggaatcctgatgatgttactcacgaccaacagtagtaaaaattgctgaacaccaaccacctggagattctgccccgctgttattttaatccacttggccataaaggcccactagattaggagaggttgagatgacattcccagcttgaaacctttgctataacattcttagataaaataacaccattctcttacacattctaacaatcatggggatgaatgtggtcttcgaaagattgaagtttccaagaatgcgttcttggaataggtttctgatttccatcctactgtgaccactccttccacctcccaccgggagaggtgtttaagtcacttttgggatttaggtttcttacttctttcttcttcgtcgcgtcgtcctcctcgtcttctccttctcttctttcttccttcttcttcctcctcctcctccttctcgttcttctcctcctctttcttttctttttccttcttccttcctcttctttccacttccccacaccaatctcctcccaagaggttacaattttcttgaggaaagttccacagaccttctctactgtggggaaagaccaccggaattttttaaagggtgacatgaggactgaggagtggatggattttgaaaggtaattttgcatttatttgcagacacccagccctgaagtgcaatggagttgggttttcttgatttgcataataatagataagcttttaagatgcatcattcaactatgccgatctttcaggttcagattcagttgcaattttttccatatgcattttctgatttctgattattgctgagttcttaggagtgaagtgacttttagaaaagatagaaaactaggattaaaaaaacagtggtgaatatttccattcagagcacaattgtatttttgcattgaggcacctcttttaataaaggaaacttaatatattggagttgtggactctgcttgtaggatttgtaggcacttgccaccttcactccatccctagggctggacaagaaatcttaggattcccccctatcccgcccccccacgccttttccttgtaagctaaggacttgctttttctaagatgctgacagccattttactgtttctcacccagtccttgacaaaaggtgaaattggatcccaacacattgtcattcaggtagggatcctaagcaaatgtagttttaaaaggctgccctgttgaaaaagacacttcgaaaaaaagctctgatcggtggggggtttgtgcccaaatggtcctttatctcctcccaactggcctctttctaacacctttgcaacctcattgtggaaacggacctcctgtggacagggttttgtctggcaaaatgtgaagtggcttctctccttttttgaaaggagacacacatactgtatttaaattctgcttcttgagctgtacattgatctgccacttgcttctaactgggaaaattgcagaaagtgtctctttttaatttagttagactggtcggaaaaaaaaaagtcgaatgcaggttagatttttggccttagaacaaagattttgagccccacattctcatctgtaaacctttgggatttgttcagtgggtctgaaattatgtgggtttagttacctaaagtgtaggttatatagccctccctgcagcatgatggattttatagaggtggagctaatctgtttttcagaggtaagcctcacataggctttaaggtgtgacttcctacgaagatggtcagggtgggggtggagagggggatagttgtgtctctttggaaaagaatgtcttcccttgcttaagggattgactcctttcatttgaccttggcattttgagcatagtacaggcctttcaggacaccatctcactttatgagaaacattctataggcctctttatatgtaaaaagccaatgttcagacttttatattgcttctgctgctgaaattctcgaaagacgattttaaagtttgagaaattataaagtagccctcaaaccaggcctgttgttttgcagcatttcaagtggcagcacttactgcttataaggagttgcaagggggtaattttacaaaaacaaaaacctaggcttcttttagcactatagtttcccatgacgtagttttcgcacttgctgatagagaagacagtt

SEQ ID NO: 54256 - DNA, 1049 bp, Homo sapiens
ggtttagaatgatttgaatgtgtaattacgcaatatagaatattttcgaaggaaaaatcacctgtatatgcaaataatgtgatttgattctacgccttgtgtaccatataagccttagtggaaaaactgctgtgttgctttcttttgaaaatggatatttagaatagaagaaaactgtccattgacggatgactctgagttgaacttgtcaggaatgagcccaagaaaaagcatgttgaatgacttctgataaactgtctctgttgtgcttagcacttcctggacttccttctcactaatgcctatctttgctggccttattccttgtgcttattatgtttttcctgccaatagtacttgagtctggaagggcttgggggagggagaggagatggttttacacttagtaacatgttgctgctatttctggttgctgcttgaggagttccttccttgagcttaagtggatgagcaggcaggaaccttgcagaactctggaattttggtattagatggagtgggatttattttagatatgcttggaccttggagtaagaatttattgaaagtcaaaatatgaagggacaacagggacaagaattttgactcagccagttagttattaactgtgtaacttctgtcatgttattaaatcactctgaactttagtgtctttgtatttcatgtagctaatgggagtaaatatattttaaaggataaccaagtgtctagctcagggcctaaggtaggagcagtcaataaacagaaatgtaaatatgagagcagttcatttagtgccagggcacagaaccgggaaggtggtaaacatgtagctcctaagcctgaatgaaactgaaatctaatttgtagacctgcagatttcaatatggtcaatcctctgcccccaggtttttaagatatggttcacggacctttggatgtggtgcaaagccatgcttggggctttctgaagaaaatgctagacctggctagtcatagttatttctttagttttaaactacaaagatttaaaaacatatacaaaagta

SEQ ID NO: 54257 - DNA, 1102 bp, Homo sapiens
aacacactatgtgggccaaaccaaacatgtctgcaggctggatagggccaaaggccaccaatttgcagtgtctgggttagaattattcagcgggttacaaaaagaaaatgcagtgcttgtgtgcaggttatggggaagccaatttctttgtgatacaaaggagaactttctgatagaagagttctagaatggattgctttgagatatgagcttgtcatcataatgacttcaacacagatgaatgtttacttggtgccaggcactatgttaggtttgagatacctacccatcagttaatttctgatgtaatgaatgttatgagaggaggttcaggatgcttggagaaagtgtcagggatgttaacctatttaagggcacagagggattctggcaggcctccctaagaaagtggaatgaattaggagttggttagtgaaagagtggacctcccagaaggctcctttttgaggaaaagcatagcacctttgatgagtggaaagatggcattatggttttggagtttagagaactagtgggaagaaagggcataaatagaggtgggagaaataggcagaggtcaagctgggggctgtttcttggatccttcatgtcagtaaagacttgttctgcgggcagcagaacactcaactcacactggcaagaaaggaagctaccaccctatgcggttgaagtgtctggggtagatctttgggcaggactggattggggctcaaagcatgtggccagtatgctgtttttctccctttgcttgcctacttcttaaataggttctcccctctatttcaatatggctggcagtagcttatcagtgtttgagttgggaactagctgctgcttgtgcccaagttccttgtatttggaggtggtgtgctctgaggagaagaaacaaaaatctggagaaagcttagaacctagaaaactcagccaaagtgacttcagactcagacacttcagcagtcaccagttgccaaggcctgctacatttctggattctgcctccccaagtccagttggagcctgcaaggtggactccctgcttctgctccaaagacaggctggctgcccagtgtggtccctcctg

SEQ ID NO: 54258 - DNA, 1052 bp, Homo sapiens
ttcttagacttactagaatgttgttagattttttttttaagtgcaaaggtaagtggtcaataactatcattgcgaaccagtaccatccaaacaatttttatttttttatttttttttttactgaaaaggtaagttatttaaaaatactttagaggaggaatgactttgttttgtgtttgtttatgtaaaagccacagaagaaaattccacctgtaattttcaggtaaagttctattttgaaattggattttatgacctacatctctctccctagtcattaaggggatatgaagttgtttctttctctctctctccctttttttttttttgggtgaaaattgcagtaggattactactttggaggaatcattcatttaatttgatgatggaacaaactaaatgtcatttaaatgtttctttaccttgccctctttttttctgagttcaaaggtagctttctctacttcagatttgcacagtcaaatgatttcagagttaattacagtttgaaaagttccaacacctaaacaccagagtggggaatgtaaaaagtagcttatggtccatatttctctggatatagtatgctttattgtaattgtagagtggaagccaggggagtaaattcttatcttgtacatgataatgtcttggttctcttccaaccataacagttattataaagatgcagtcaaagcccaagacggcagcatttttttttcttgcttccccttggattttcattttattttatttttgcatggagtatttttaaagatattcaaggccctggtggaaggacggtgaaaattggcaaaccagtgaaaatgaatctgaatttttaattaggctttgagttgtttcttcaaagtgtggacacatcattagggatgtaagtcttgttgcattagcagagactgacattttacttcaaacgcagagagtgcagctgtcctgtgcagataaaagtcgccaagtatggaatagcaaggtggattggtagataattagctgtcccacattactgcagtgtggaagaagcctgccagtca

SEQ ID NO: 54259 - DNA, 1546 bp, Homo sapiens
tggctctctctaaagcctatatttctcatgacagcccaaagacaggatgtgctgaaatgggttggtttccataactttgcttggtggtgcctgaacaagagttgcccttggccactgcaggagacagccagtgctttttgccgctttttctgctccctttctaggggactgttagtcacagagttgttgctgctgttgttgctgccctgagtggttttgggggaaaacctggagaacatagattgggtttgtttgtttgttttctgttgcagtcttggctatttgatccagaattggcttcactgaaccatttatgaaaaggggaaatttgccacttctgtagtcttcaggggggttagcctgtgtgctaattatgaaccaaacacatttgttaggagtgttttaaacttgagatagtataatttcagatgaccataaaagaggcaaatacattatttgcacatattcagataacaaatgtaggcaagagttacaagcagtaaaacatcctggagattacttattagagcatgagctcttgcaggaaagaacacagacttactcatctgcgtagtcctggtatggttacccctgtctgtgtcacatcatgaggactcaaaaaatgtctagaccacagacattgcccagcagcccttaaatggtagactttgtaactttttagtagttactgttacaaatttagcttttactactgtgtttaatgtgtccatttcattactttagaattaccaggaaatgtctagggtctttatctgctactaaagattaagaatgtttcaggtgagtagaagtatctgctacagtatcaagcacattaggactctaagtagactctaagtattagttggttctaatgtttaatatattcacctagagaaagttgggctacatttaggaatgtaaaacatacaaaaatgattgtgtacttgcaaactatatacttgaagctgctttatcctagaggttagacttcattagttaattcatttcacaaatctttattgaacacagactatgtgccaggtattatgcttggatttgagtttatgttgtcacaaagagacttggttcctactcttatgaaatatgcagcctgctaggggaaatagacattaaacaaataatcttataaatatacattgtaaattttgagtaatgttttgaaggaaacatggggcctttagaaagagtaccaagggcaggctgggctgggtgtggtggctcactttggtaatcccagcactttgggaggccgaggtggcaggaccccttgaggccaggagttcaagaccagtgtaggcaacatggtgagaccctgtctctaccaaaaaaaaaaaaaaaaaaaaaagtgccaaggagatcttttagaaatgcaagtcagatgtcatacctctgcttaaaactccctaaaggttctcatctgactcagtaaaatcctgaattactggtggccttcacagctgtatgtgatctggcccctgccacctttgtgaccttatcttttaccttcccccccccccttgca

SEQ ID NO: 54260 - DNA, 1096 bp, Homo sapiens
acacacacacgtattcagatgtgttttttatcttccggatgtggactaagttctgctactacaaattgattttctttcgagtgacattgttctcaaaggaaatttgcttttattatttaaataataatgacatccaggattagaaataataaagtgtaatccagggtgtatagaaatcttcaagagagctgtgagttttgcagttcttgttttcagctaaaaacaaagcattatttaggatttttgggtcaatgtggcctgtgtagaatcttgggtttagttagtcaatctgcaagaaactgtagattgaacttctgttatgcacaagcacagctttgggagctgggagcacactgatggatagaacagagtccctgcctttaaggagcttacattcttataagagggagataaatatttaaacatgtaaatgctaagtacatgtaatgttggaccctgaccagttctgtgaaggacataaagtaggttaacatggagttcaaagaaggcttcttgggggtgctgatatttgagtggaggcatgaatgatgattggtagcagcctaggaggacctggagtaaggaataaagcatacagagacctgtggagggaaggagatcagtgtgtgtgaagggctgaaagaaggcactgaagaaaggtgggaataaaggaagatgagcgaggataggatcactgtggagaacaagtttggattttgttctggctgaaatgggaagccactggagggttttaggcacaagagcaagggagttggcttttgcttagaaggatccctctggctggttccatttttttctcttactctcttggctctgtcaccccctggctgtcagtttatcctcaggctggttttgcctgtagtaaaatgagtacattcagtagaagagggcacctttctccccccaggctttgaaggatgccttgggctcactctgattggaccttagtggaatacaagagaatgggattacattagtttatgccaatcaggacctactcctagagcccaaagctcctagagctgggttgattctactcacattttatgacctacacaatccagtgatttggata

SEQ ID NO: 54261 - DNA, 2021 bp, Homo sapiens
aggatagaaaagtcaaccaaatacagccctgctttcctggagtgaacattctactgggggattagttagtaagcaagctgggaacagcaggggatgagggtcagctctgggaaatcatgggagattgttcataagcaatggtggagatttttgcttgatggatgcccatgggtcatgttccctggaggattgtgtttcagggattaactctttttaagctagtctgtcccaagctgtatttcttatttatggcatttttagacagcccacgagtggcctgtaaacaattactatgcttcattcttcctctgtgtgttttctataaaccttcaacttggttttttatttccgtcttataactgagctgccagttgccctgagactttttccattttccaatctcccaggaatgcttacctttgtgggctttgtggatgtgattttgaagaaggagtgagtcctccaaactaaaagccatttttaagtagtgcagagaccttccccaaaggaggcgagagatatggatgattccaggaatccccagtttacaaagagtctggatttcaaagctcgtttcagagtctgttgtctggaacaacattcacatagaggggttataaaagcagaccccgctctcaggccaactcacaaaagcctgtttaggagaaatgggattttaatccaagctcttttgctatccttctgaacctcaggtttcttactgtaaaaatcagggctgtttccaccgtcgttgtagagttaaatgagatgaggtttgtaagaatatctagcacaatgcctgatgccagaggtctcaggaagtgtttgctttttcttcatgtgaggatacataatgctaagtcttcagaattttatactctactcctcacttctagatttgagcagccaggaagagtcctgggtgtgtggggatgatagatgaggaggatgaatctcctgttattaaggatgaggaaaaggggaagtgttataatattattagttcctatttattgagcatttactatgcactgcataccatgctaagcacaagttaagtactggctattattacctaacttatacataccccagtggaccaagctggatgacagaatgtccattcctaattgccttagccaaagggagttgtacaaagttacctaattcccttggccagaggtacaaatagctccatctcagcccctgcccactttcaatgtcgcccctgtccaccgatcaggaataactatttggggatatttttgtctgtcactaagcattttcagcaaaaaggaagatatttttcaaattcccaaagggcagaagcagccctctctctggtactgcaggtctgactgggcatggtttcctcttgaaatgtctccttgtgatgttataacttaaaagatggagggctgtttgatccaagcctaggatttgttggctacagggttttcgttaatagaaaacattcatgcacctctaggggggagaaattaaagcacatacttcttcctgtttgaccttcgaacccttgccatttacatcaaacactcactgggagagaaagctaatttaataaactgtgatagcttcttctctaacaagcctcactttaaacttggcattttctcctcaagctgatgagtttctgtcttctcagaagatgtgtgtacccttcagacatctgaggggagagaatgtactttgtgggtggtgcaatgccttgctaatgtcatgttctcccttcagtgagtttcaaaaatagcttgccttttaagaacaattacaaaggagtcgtgcaaaggcagagtgacttggcttcagcaagcctcaatttcttgatctgtaaaatagggattttaccctacctcaaaggttgtagtgaagaccaaaagcaagaatttatataaaagtactttgtatcatgctttttcagttataaccttttattctcagggaagtcagcaaatgctggtgggaacatagatgcagagcaacattttctctctccaaac

SEQ ID NO: 54262 - DNA, 1068 bp, Homo sapiens
tcacacattttattggaaaattacttgttacattttgtgcttcctatttctaaagatttgggagactgtggaaagtgcatattaccacatagggaactattatgcctctcttcttacaacttagaggaaggaatatttttgcaagagttatggcccatagctggacaatataacaatgcaagtggaggaaaggaattgtgcagataccaaacggctcaacccaggggttgtggcagcctcattggacagttttgtctataccttcttttccccagggaattaccaagaagagtggaggccccctgccactaattttaaatcctccctcctccctgccacacacaccttttctcctccctgcagtggatttacacacattttgtggggctgatttagcgagctcgtggttctcataatctccttatagaagtgtatgcacattaaggggacctatttaatagacacggctgcctctgtgaaagaatgctttgtggaagggagcctttgtgtatttctccatctcagcagttcctggggcgcttcccaagtctctctgtcaccgaatggcagagctgggaaggacctgctccagaataatgggagggagcggtgggacaagggagggaggaggcggccagcgttggaatgtggagaccagggtattggcacttcagagctgagcatcttaacattttctcttcttacccccagctggggactttgcatttgcaatgagggccccacttctctgagccctagtgaaagtggatcactttaagcccacaacaatggtggcttcttatcctcttagttaatgctttagataacttttcttttagaccaggtaggggcttgtaaagtgggactgtggctctggccttgcctggtaagacacatgaaattttctcatcttttctaactatcttccctcccctgttttctcttaatttgaaagaaatctctgcattggtaaatgtggacaaatcaagctgtgttagtgacatatctccagcagttgtcacggacgagatttatttatataggatagcaattctcgagctccccaac

SEQ ID NO: 54263 - DNA, 1110 bp, Homo sapiens
atcccaaagctttgggatggttctaacgacaaagaatttacatttctctttctttagtctgatttggaagctccaatctagaatttaaccatgtagtagctgcttttatttgctacctgttacctaccagtgaaaccacaaggctagtggaattctttattgcttaaattgacaggatatggttgcttaaattgctaggaaaggggggaaaatctcctaagaaccacgttttattggtaagtagaacttaaaatagtgctcactttttttagtgttttttatgtgccaggcattatgctaagggttagagttctatttctaatgcagatagctactagtttcagaaagagaaatgacttatctaagatgtgaaagccacgaagtggtagatgtggggttgaaacccatgtcagcttctgcttgagcacttaggattattacattaattgattcagcatttagtgagccccataatatttgctgttggcataaatcttgtttctttgtgtagtggtctctttgtgtggggggctctggagaatatgggcatgggttatgagaggaactggtattagttacagttcggtcaacaggaaatactttacagatccagtggttgaaaacacatttgtttagatcattcctctgttccaagtaagcatgtattggaaaccaacctcccctcccctgcttagggagaatggaatgtatgaatatatatagaattaatttgaaaactggaaatgaatgaaaatgcaaagtattattgtcatcattattagaggaagaaaaagagaaaaggaaagaaaacctgaggatagaatgctaaattccagccttaggtaagtttattacagtatacagtgtctatgctatattctggaattcttttctcatgtattaggaaaagctctcctatataatcttaatttatttctttttgaccttctctgttgaaataaatggctaccatctcttcttatgtacttgaaaaactaagttctcccttatcttccaagtgtgaatgaccacacaaaagggtatgtccccaatgtacttggtctgtctgcctggattgaagttggcagataaactttgccctcagttctt

SEQ ID NO: 54264 - DNA, 1068 bp, Homo sapiens
tttcttcaaaaaaatgccgaggaattagcccattggctactgattattagctttgcagtaaaaaaagagtgagaaagagacatagtctgtaattttatagtgcctccaacactaaaatgaaggcagagcttttttctttctgccaaggatgctacagggctttgatttgcagtggtcatcctttgattatccagtcactcggctaacattttttcagtccctactctgtgcttccatcgtgccttgggaggctttagggtagataaagaaaaggacacaggccttgcatctgcttattgtgcttgtgggctgggggaaataaagacagtccttcctagttttgaaatttcactttcaattaattatagccagcaatggttggcaaggaaagtagggaaagatggaagagccccttaaccagaaagaattaggagatttcaaggcctgttgaaattaatgtgatggttatgagaactgcagctatttggagtcatatagttcaggaaaaaaaataccccagagagagccaggaatcagcaggcattaaaccctggcttgttctcctggtaaatgagtcagcctctggcgggaatataatcaaaataacaacaggacacatcagcatatcaaaaaggggcagagggagtttatcaggggccaagagtgagcacagactagatcccaagccctttgacaggcatttgggcattcctcctttctccagaaaacctttccagagtcttccaacagtggggcaatatacccttaaacaaaactgtggcacgctgggtgtggtggctcatgcctgtaatcccagcactttgggaggccaaggtgggcagaacacctgaggtcaggagttcaagaccagcctggccaacatggtgaaaccctgtctctactgaaaataccaaaaattagctgggcgtggtggtgcgtgcctgtaatcccagctactcaggaggttgagtcaggagaattgcttgaacccaggaggcggaggttgcagtgagctgagatcgtgccactgtactccagtctgggtgacagagcaagactctgttccta

SEQ ID NO: 54265 - DNA, 1023 bp, Homo sapiens
acttgggaggctgaggcaggagaattgcttgaatccatgaggcagaggtcgcagtgagccaggattgcaccattgcactccagctgggtgacagagtgagattctgtctcaaaaaaaaaaaaaaggagagacagagagaaaattaacctattttaacctattgctatgcagatagtaacagtttattataattattatataattaagctacttcttgcaaatgtgaagattctctattccctcctcctgcattttaatacagaagaaattaagaggaaagtgcaatgaacttactaccattatattttctaggaaataagtgaaaagaaaaatagttatagccagaataataaagtggttttgatacactgactatttcttgcctctcttggagttcacaacctctccctctaccagctctatctttattttatgtatcatttctctcgggataaaaccaacttcactcatcatgaccagaggccttccagtcagattggcagctgtattcttggatttattttagtctaggttcccctctttgaactgatttatgcctttttgtgttgatgccttcagcagttaatttcatagtttaactactttttctataagaaaatactatctgaacagtttctagaaattacatcttcttctggcaaaaactgcttctggtgaaattacttctacttctggtgtttttgtgcacaaaaatacccaaccatagtaagtgtaatacaaacaccttgaaatactacctatcagtacctttctctctgcaaggtgtagaaggatggctattccactttcttccaaggctgatgaaaaagaaatggaagtgacttccacttgaaaatcatcagctccatctcactttgaataaaacacagttgatcttttaggggcttacgtgtagatttgagcctggcctagatgcctctttgctggcacctattaaataaacagagtaattaaatgataggtaaaaggtctagaactcaggtgtcattactgaaaagtgtt

SEQ ID NO: 54266 - DNA, 1053 bp, Homo sapiens
tccctctctctgtgtgtgtatgtgtatgtgcatgcatctatgtgtgtgtgtgtgcatgtgtgttgttttcagataataggtacagcataaaatctttttagattataatttttgtttctattgcacattctcttatggtgggggaatttcaggttaaaaaggaaaataccaactctgtctaattaatgtcaaaatttaggtgaagtaggtgaggagaggttgaaaatttgtggtaagtagaagagtatgaataaagttaactgcaattaaaaccacttaacctgtagttacatttcccaaacccaagtggcagccttaaaactgaccactgaattatggaaactgaacggaaaaaggctttgtttcattgcatcgaagtatttttcttttcccattttgggtgcattgatctccctgtattccctggggttgctggaaaaacttggtcaaaaaggataattactttttttatttagttgcatgctcttcaaaaggcaacagcaagtattcattaatttccatctgatagagccgaacttttttttgtggttaaacaattgaaacaggaaatgacccaagatacagtttccatgacaccctgtcacttggatccagttttccagaagatgaaagaccaaagccggcttttgatagtgagtaactaattggactggctgatagtgggagttttttaatgtgaaaaataaaggagaaaaaactggaacagctgtgttttggtacagttgtctaatccccagataaaacactccaaggacattgaaattgaataatgcctttagttaaggggaaaaatctaaaatctgtcaaagcactggtttactttagagaaaatacagaatatatttacatggaaaacccaaaacaaaacaaaacaaaactccaaaaatttacagagccaagatactaagtcatgccttttaggaatcatctttgttcatacaaagtatgatttcatatttttaagatgaattcttacatgtgaataaagagagtacttgctagactactttttcggtcaacattttcaaatgc

SEQ ID NO: 54267 - DNA, 1027 bp, Homo sapiens
cctgggcaatgttctcaactacctaaccactaagtttctgcctcttgttgtgtttctagtgtctttctaataactctttcttttttctgattaagttcatttctgtcttttattttgttgttctggtggtcattattcagttttgcacaatttttaaattgccaaaaccagaaattgccagagagattgggtcactgggacaaagattcagatacatgcagacaatgccaagtgctcctgtaaatctcttgcaagattgtggtatgatttaaataagatgttgcatattggagtgctgtgggtccttgaaagttcaatgcatgtataattgttattcctggaggttgtaatgaggggaatatctatgggattaatatggctgtgggtacattggaatttagagtgtcaaaggccactggatttggtaatggttctggtccttgtagtggagaatccattttccttttgctgatatctatgtggcaggtaaaacgccttttagatcatagatattttggactgtgcttatttttagtgtacctaagatctctacaggtataggacattaaagcagatggagtacggtatgtagtaggtttgcaaatgaaggagactaatcgtacttctgctgtagagcaggcactgtactttaatctgtttttttccttatttgatgttacttcctcttattttatagatgaggaaatcctcacgagaggaagtcttagtaccttgtcaagtatcaattaactgttataagggtgattgaacattcacatccagggcttttatatttcaaatccctggttctttccattatagcatgctaggatcatgagaaaataaagaagtggaagaaagaccagagaaaggagtaggaattgcctaggaaaataaacaaccatcaggttccagagagaggttattagaaatctagagttcagacaaagaatcataaaattgcaagattagaatggaccttagagaagtagagctcaccaccctctccagctcatctctctctcca

SEQ ID NO: 54268 - DNA, 1027 bp, Homo sapiens
tggaggcctcattgagaaaatgataattgagcaagaactcaaggggagacaaaggagtatgccatgtggattctctgggcagagcttggcccagtgggatgaagagcaaggaggctgatggggcaggaagacagtaagagcatcactagggctttaaaggccattgtaagggtaaggggaacctgtggggaatcttgagctgaggaatgacgtgattgactttagattaaaattgtgatcattatcaccatgagcttctcctcaggaggagggacctggacagtgtagcacctttacccgattactcttctttctcctattagcttaaccttttacacttgaaaagtatattccaccaccccagggtagctgccctgcctactctatgtcattgattgaacttggcagtcctgtggctgtaatggttgtattccttgggaaacaaaggaaatgattagatcttaagagggaaagaaagtagaatcctgtggtagcacagcttgtgatcctctttgaacatgacttgatctcttccaggcttcccttactgaaccaggaaacctttgtagaggatcctgggaggtgttggtttggtttagtgttttctaaatgtttgtatctccttacggtgagagggatccattatggagcagggggaagagcttaagtgtagtaatttgtcagctcatgacctgtgcttaacttctttcctctaagataatagcagcggacatactctcagcacacatggggatggaaaacatttctgtgctacttctccagtgaaaatcaatgacttttttttttttcactttaagttccgggatacatgtgcagaatgtacaggttcattacataggtatacatgtgccatggtggtttgctgcacctatcaacccatcatctagattttaagccctggctttcaacattcaagatggtcttccattatctcatttatgtcctattattctcaatcaagttaattggaaatctgtttttttagtgcatgtacaggaatatggca

SEQ ID NO: 54269 - DNA, 1027 bp, Homo sapiens
attaccacctgttgtaagctgatctaagccagttcggttatacacaactcctaggtgcttttttctggtgaattttgatagctgccagattatttgaggtgagaggttttgctactatcccacaaccttgccacctacttatagctagtgcaagtctgagacattctgctgcacatacagacgttgattaacagccgtatatcagccagtaggcacaaaatatttctgcaacattactctctatgcttgataaagtcccagctgtcttcttttagttgttctgctcaccactttgcatgaaagctgtacttgtagacattacaacattccagaggagagttctgttatctttaatagtcagcatcaagcaactggaagtcctccaactgtgccggactcatgtccacttaggggacaagcctatcaaggctacactcttattcatacaagggtagaggtatttctagaatattttggccaattctcataatttgaatatatgtttaagtttaccagggatggcccatttctcacatttatattgctagcaaagaagccattcgtctcacacacccacacaaatccacctctgacattcactttgctaattggcaaagggcctggtgttaatgaacatggatggtggaaatatttgcagtgtgtctttctggagtatgggcttcatgcttagaacacgacctgcctacccctagagtgcattcctgaatataatgccaaccacatttgagttgtagtttaaactaattaactcacatgcaatatctcattacctatactgaattattgttaagttaattaggcatcctaacattgcctttggaaccccactgtggaaaccactgttactaatgtcacgctgtaggagtagactttgaaatgatttgtaaggattcttttgcttaaaaagcactgattaacttccacatactcggaaccatgtcttgtcactgggtgggaaaacatattagttaccatttactgagcacgtagcatgtgtgcagtcctt

SEQ ID NO: 54270 - DNA, 1018 bp, Homo sapiens
tgatcatgccactgcactccatccacctgggtgataagaaaacaaaaacagaatgaggtgggagttgagtcagtaaatatctaaacaggtatttttgttccccccatacctccaactatcatagaacaactatcattaatagaatgttattatagtcttaaaggattaactatagtaaaatagaataatagtagactatcatagaacaactatcattaatagaatgttattatagtcttaaaggattaactatagtaaaatagaataatagtagataactatcataatggtgtgtgaagtacatttataatatttttagtgcgctctatatgaattcatcttctcgtttatgagataaatgagttatgtaaagcacttagtgcctgacagatagtaagcactatataagcattagctattatcattatttatagcaacattaaaacaaaataaggaagtttgttgacctgggtcatgtgtacctgggcgtacagtttgatttgcacaaggtcgtctattgtgtcactgatgcatttttttttaattcccaaagtaagcctcttcctttgccatggttttcagtaactaagcatttccctttgttatacaaactggaatagccctggtttctcgcaagtcactgtgccattcaagacatagtttttatagtgagcatcaaacataagcctctgaatttattttctcctcagaaagctcttgaggtggtgtagagtctagttgtaactttggatgtatgtgcttttgtgagtttgacaactctgaaaaatgtttgtctttctctgttatatattcaattttaagatttgtgggggaagaaaggaaaaatatatattttagatatatattatttacaggcaagccctgttactattttgatcaacttctaggtgttacgtaagttttctctattaaactctattaaagatgatctttgcataggggattacagataaatttaggagtaagacaggctttgtattcagacttgaccatgtac

SEQ ID NO: 54271 - DNA, 1045 bp, Homo sapiens
tttttatttttttgctcctctagcagatacataacttagattctcattttttagtttgttatatgttaatctcttgtgattactcagtaacggtacagtttggtaaagtcataagtctgcagagacattttaaatagaggcaatgtatggaggagtaggtaccatctaggcagggaccagtggaagaatgtgtgtgcttgtgtgctgtagtttggcctaatgtcttggcacagctgtcatatttcctggcatgtaagaactggatcttctcttaagtccacacatatttggcaagccctattatgttactctcctgacggggtacttgagtaacgaaggtgatagataatattgggtaggtactgactgaacagggacatgagagaatatggaaagaatcccttttaaagatctttattgcattagatgttagtgtccgtaaacaattacagcattcagggagcgcaggatttaaatgagaaacacaacttggtcagattatactagtcggataaaatggcatggactccagaaatctataattaaatgtatttttgaaaatgaaaaatatagtgtaacacctggtttattttgctacagaggtgcctgggtattgcttacataagtgtgattgactttggctgatacttgggtttctctctgtaaaattactgcattttaattaaattttttttctactagattctatttgttgtaaacaaattattcacatacacactcatgtagaaaatgacttatttagaaaatctcatgttcattttcttttcattgcagcggatattcaactcctttgtttacactgagaaaatctcaaatggagaaagtgaagtacagcaggtaagaggcaatgagtacttgacactccctgtctttgtcttgcttttagatgtggcttcgtcactctttccaagcaatctccacttgaggtttcctgttctttctctctgtataatttcacgtgcatctcatgcataatggtgacaaccttacacttcagattcttagaggcggttaaaaacttata

SEQ ID NO: 54272 - DNA, 1024 bp, Homo sapiens
tcatggttgaattaggtgataggattgggattttagccaaagtggtctaactctaaaacccatgttcttaaccatgttctaaaaacatatgctgtgttgtttttcatactttttctgctgcaaattcatctgtacgttttcaatttttaaaatgaaggtggtttattttctcttgagagtcttacatcagctgatataagataaataatatgtctaaacaatgtaagtactatgatgaaaacttagctgctaaatgaggaaaagcaagtttaaatgctcagttgtcaggggtaaaacaatggtggagggtgccttctgtgctgttagcgacgagcttttagctctcataaatcacaaggatataactggagccttaggaggaagcgcgttatattactaatggatcatcctgcaggaacataaacaagacataaaaataagtgaagtccttgatgactcttttgtctttcttcccaattcatcattattccattattaacataaccttaagacagttggttataatttgtatcctcatggaatttctgttgggctattggggttttgttttgttttgttttgttttaaagtaagtacctcctaaataagaacttttagctaattgagtgagtgaaaaactgcagctgttggaccagtttgtgggatgaaagcgtaacattgttacgctttctccctttctgtcacacgggagaagctgataacaacttggcattcttagtgtagaactgtggttggtaagcttctgttagtatggtttccctggaggatatagcaacccttagatacctctcagaactcccggatctctcttcccatatgaagcctggacaatagtcaggatgcttggagtactgttcagctaggaaaaaacgagatgggcacagagagaggaagccacctgatagctccccatctccccaccccccatttgggatttggagccatcttgtttctattttaaggaaaacatacatgtaacctctgttctgtattcttatatata

SEQ ID NO: 54273 - DNA, 1046 bp, Homo sapiens
gcaaggtttattctttagtggtaaggctagagttgaaggaaataaggatcaactattaaattcttaccatggcacaaaggtttttgaatgtcaaatgttaaacttttctaggttcaataggaattttgctatgaatcttcagtcccctaggatatatttcctgtctgtgcctgtcagcttcattgttacgtattttaaataaagctttccctaacattcaaaactccttccggcccttccttttaggaagcagacataaataaagtacccactatgcctttgcatttttgttttcttttacctttttctaactatgtgcccaccccacccccaatcttctgaagtataaagctaaggtaaaaagagcttttaaaaaagggctctggggaagtatgcaaatgacagaaatgtctatgggaaaattaagggaaaagaaattcagcaagaaagaaattcattgatgttgtgatgaaacgttgtcactggagataatgacaaattagaatccgttcccatggggaccgcacgctacctactgatcatttgacccgtggctggatgttggctagcctaagaattgacccaaaagatgacaagatggttttagtcctgttgtctcatccgtattcaggaaccccttaggggatgaaggggaaaggataaagaaggataaaagatgaaagctgagctgtggaaagaaaaatgtttttaattacactgaggaggattgtgggtccacctgtagctttctgttgagaatgtctttgttttcttctgtctgcagggatcatggcaggatacagacccagaatctgtctggctttttggaagggtctacattggcccttcggtcctcttcagtttattggatacattcaggattaacctctctgtgggctgtctttactctgaggttctgttatgcttgctgagcagcctgggtttggttggcgtgctaacagagattccttttagagggaagaaaaaaaaaaaaagacgcgatagtggagcacaagatgaggtttccatagtgtgtcaccatcaca

SEQ ID NO: 54274 - DNA, 1034 bp, Homo sapiens
tccatgagaccttaactgtacccctagaaaaatacacaccaagtaagcagattagtaggagagaatgttcctccttcagaggtgggacctctgcactgaatgctgaagatgcagtattctctcctgaccaggagtagttgacagagccaagaactgcttggggtggatattggaaaaccaaagcagttctgaaggtaaagctgaacaatcagagaatgtacagataagcaatacaatgaacctccttcaacaaattttaaagatacctgacaacagagagatcttttgcaacaggaagtggcctgtgaggactcccttcaattatactgtgtctacttggctttgaatggagcccactttccagtgaaatgtgtgaaggaattttgggagtgaaccctgagctgatacttttctagactttggttgaacacaagcactttgtaaaattacaggaactcctcagttttttaatgaagatttaaaaatggaaagagttagtagtatgttgttgcagtgaacaagggtacaaattctcagctagccacctttgttccaacccctcagaaagtgctttatctgcatattctaacagctggggtgcctgctgaacacattttcagttcacgccttccttttgtttttttggagatagagtctcactctgtcacccaggctggagtgtgatggcaccgtctcggctcacttcagcctccatctaccaggctcaagcgcttctcacgcctcagtctcccaagaagctgggactacaggggcgtgccaccacgcccggctaatttttgtatttttagtagagatggggtttcaccattttggccaggctggtctcaagcttctgacctcaggtgatccacccaccttggcctcccaaagtgctggaattacaggcttgagccacacttgagcgactgcacccagctgacactttcctatattccaatccttccaaaaatgtctctattttgaatcttaacaacttcatgttggagttaggtgaggaaaggaagatctcctag

SEQ ID NO: 54275 - DNA, 1086 bp, Homo sapiens
ggaatggtttatggaagaaacatttcagctgggtatttaagcaggaagaggatttgaatatatggagatatggaggaagagctttccaggagaggaagctcaatatgaagaaaccccaagcgtagaaatgaccaggagcactgaagagggacttgcatatggagcaaatgatggaagaggcagctaagaagttggatcaatattagatcataaggatcctcaaatgctagactggagaatttaaactttgttcagtagggtttaggctccataagtgaagtaaagaacaatgtctatctttctcttgcttctgtatctatggtctaatacatagtagacactcaataaatattggttgcttgaatgagggaattaatttatgagttcttgagaaagggagtaaaatgatgagacctgaactttaagggaattccacttcttaatcatgtaacaactagaagtaactagaacctgatttcatttatgtaagcaaagagcaagaggaggcctggacttggatgttggctcctacttcttgagttttggaagagggaggaatcataggtggccaaagttgattttgggtaactgagagtgatggtaccaggtgctaaggcatatttgttctttatgtactctctcatctttcttagttactttagttcagggaccctgtcagatacaactgtattcaataccttgcttaaataggtcctcgataaatatttgccaaaggagttagtttgtggtagcaaaactgactttgtttttagtgtttgagtctcagtcactatgatgctgtcagaattaacaagctacttaccttctgggcagaaattgaacaatattattaaatacttttttgcctattcatgatagtcattgttttaatctgaacagtgttattacaagctctgatgtgaaacatgtttgatattgatttagttatctcagttatcagttatgcttaacagttttgttatatgcatgatgaatttaaaaaatatacattcccaaatgctgacatacatgtatatcattttcgactcaacttgtctgtaccatcttcaaggcagttaatgtata

SEQ ID NO: 54276 - DNA, 1036 bp, Homo sapiens
gggaggctgaagtaagagaatcgcttgaactcgggaggcagaggttgcagtgagctgagatcgtgccattgcactccagcctgggcagcaagagcaaaactttgtctaaaaaaaaaaaaaaaagaaagaaaggttatggcaggacttactggagagccaggtttggaatttaggttttctgattccaaatgctgttttcttttaatggtactctgaccagtagtaaaattagaatggctcatctgccaagtgaaatgctaaactatgtgttccttcttagaattctacttgaggtaactagatgaccctccaaagttgctaaattggctgacctgcagcaatttgtgccatttccctgtgtgtgcttgtgtgtgtgcattaggtagatgtctttatctttaggagtcttgatgagtacccttatagcagaaagcgcctgcatttggatctgctgagaatctagcttcctgcgtttttcgtgtgaccttcattgaaggaagaatgggaaacctgcctcactgcttacgctattgaatttcaccagctgccttttatggattttaaatagagatggttttgtgatttttctttctttttaaaatctgatctctgtagaaaactgcctagcagactataccagctttaagaaatagaacctgtcttagctgaaaagcaacctttttgtgcatttttattgtgaaaaataccaaagcaatttcaaagaaggcccagatttaaaaatctatctataatctctttctggggacttgacttatctggtacgatgatgtagatatctgtctttacactctagctttattaacttgttaacattgggatagtattccttttgtagaatcagccataagtattctgcatcttatatttttctgtttctttaacagaacagggagatgtatggacaggactcttccctcctcggtgcatgtgtgctggtagatggaaccagttaatctccaaggtcatctgctaactcttagttgttagtgcctctcttttgtgtctgtgtcatacc

SEQ ID NO: 54277 - DNA, 1078 bp, Homo sapiens
gtgctatagtgttggaatgattataatgaaccagaatgatcttttgtggtgagactaaatgtatcatgcactatatgagttctgatttatttttaaaacattcttgctcccattggctccccttttaatagtttctgtagcctgtttattgttacagatgttacttttaaatgaggtcattgagctttcctttacttccaaaggcaatgtttgcctttttattaaggggttggcagggctgtctggagaacagtgctaatgtgagatcaaggttaaagcttcagaccccaggagactaggtggagaaaaagcctcttccatgtttacacacactcatgtcagccagatgtctcacaaagggcaagtttcctggcagagaggcgagaagacaggcattgtggtcacagactgccttgactctcatggccccttcttgcccactgtgaaacctcaggcatgtcaaaaacaagctccctgagcctgtttcctcagctgtcacttggagataataatttttattcctaggacttttgtgaggataaaacgtgttatagccccttggtatgcatgagggacctggggagggcaagggatgtaatagctaaaagtctaaggctttggaaatgctttaagtcctatgtgtagtatattttgcatatctttgttagaggaccgctgaccaaatctagcttgccagtgatttttgtaaataaacttgtattggcacacagcccattcattcatttacaaatgtctatgtctgccctctcaaagacagatttgggtcattatgacaaagaccttatggtctgcaaagccagaaatatttactatctggcccattacagaagttggtcgatcactgtaccagactgaaggaaagtttctatacagagatctggtcatttaaagcagtgagggataggggatgagtgggaattctaaagtgttcctgcagaaagtcaaatactgaatgttgtcacttataagtgggagctaaataatgtgtgcatttggacagaaagagtggaatgatagacactggggacttggaaaggtgagagggtgggaggcggag

SEQ ID NO: 54278 - DNA, 1042 bp, Homo sapiens
accatcacccccacaatatcctgcaaatctttgcagctcccatttcataatgtaattcctgatgctacatatggtataaaaacataataccgtaattagtccacccacttttatttgaggccgagggatttagtgagaaacacagagtcagaagagctatgttcaagacatgatcttaccacctactagctgtggatattcatttgtgtaggaactatttacactcactgtgcatgcatttttctaggctatacgggggacaaggccaaccaagttcttcattgcatggaccttaaaatgtaactgggggtggggagggagaagagaagaattaactggtattaaacaaatgatatttcagatggtgatagatgctatgaagaaaataaaatgtgtcagtgttataaagggccatttaatttctttgagcttcagtttcttcaatgcaatctgaagataagaacacatatcatgtattattttgtgcaacttaaatatcctgtgtgaaagctctttgtctacagtagaggtgaagatccatcatcattgttagagtcatatctcagcccttatagtcatataaacagatccttatttgatcacatgggtgtttaaagcttaatgtattttctggtcaaatacacctcatgcattccttcctttttaccttagctcggaatcttccccccactgaatttctttttgttccatttccatctgtataagtctgcttgtatatcaattattacaatagggcttgttttgtgctcgtctttgtatatcttgccaaatgtaaagcagtgaccagcacatagtaagtgtgtaataaatagctgagtcagaatggagcagaacaaaagatcctaagagctcagaaaagaggaaattctgattgcgggagagggtaagaaagacttcatggaggtcgtgggacaggattgcacacaacaaggtggttggcacttgggctgagggaatggcagacgcaggtcagtggtagggatgctgtgtagatgaagggaggcagtatagcatgatgtaa

SEQ ID NO: 54279 - DNA, 1056 bp, Homo sapiens
aggtacactgggcaataccaagcagaggttgtgcatattttatatgaggattttaactactagaagttttaagctgtgcagaaagcattgggttaaagaacactaacatcctgcttttttctgaaaaaaaaaaaaaaaaaaaaaagagagaaaagcaggatgttagtgatgctgaaaaagccaacctctgaaagggtttgctcctgaaaaacttctcttgtctgctttgatctttaaaggcataaattacccatccctgttctacagacacaccttgttgtcttaagtattattttcaatgcaccaatatggtttctccttccatgtggatttctccatccttgtgccatccctgggagaacacagagaccaacatgcccatgcactgtagtgttcacagctgtgttaagttgaggccctttacctaaaccaagactgaccccagagagcttcttctccctccagacccatctacgtctctacagtccggccgcagtcaaagcacatagtagtgattctggaccacggggcttcagtcacagacactcagcttcagattgccaaggacgctgctcaggtcatcctcagcgccatcgatgaacatgacaaggtgaccatgacccttgtgacccctatggcatcaggttctccttgaatgccttttttaaagtactttattgttttgtgatatacagatcctccttgacttacaatggggttacatcctgataaatccatcataagttgaaaatgcatttaatacacctgagctacatcacagcttgggctagcctaccttaaacagtcggaacacctaggttagccctcagttatggaaaatcatctaacacaaagcctattttataacataataaagtgttggctatctcgtagaatttattgaatacagtacactgcagaatactatatcagcggttctcctttatgattgcatggctgactgggagctgcggctcgctgccattgtccagcaccatgagaaagtatcaggagcctgggaaaagatccaaaattgaaagtacagcttcactgcct

SEQ ID NO: 54280 - DNA, 1067 bp, Homo sapiens
aatctctgggacacctcagagagaggtgtgggtacagctaatgataatctattgcctgtggacattttctgcttcatcattttgactttgccaactccagaggttttgctcactaacctagtggcttaaaacacacacacctcactctcttaccctcacccctcacctccaggttgaaaaacaggatagttcattcttgctatgacttttctctgcataaaatagtttgtgtgtgtgtttaatgttatgtatgaacataatactaccacttcatgttggaacaaaaaccaaactctaggggtttccccactttaccaatccttatggatccttttcaaatttgatagatggatggctccagggatttattttgaaactctcagaatctgttctgtaggccttcttactccttggcctcttctgttacataaataaataaatctttagacggtaggataacaagtttggtggttttttttttttttctttcctgcagatttctgtgttaactgtggcagataccgtccggacttgctcactagaccagtgctataagaccttcttgtctccagccaccagtgagacaaaaaggaaaatgtccacctttgttagcagcgtgaagtcttcagacagtcctacccagcacgcagtgggattccaaaaggcatttcagctgattcgaagtacaaacaataacacaaagttccaagcaagtgagtgcgttctctcagaggacttagaggcatagtagataaagatggcaataggaatatattgtaaattgatcacacaatgatgtttagagagattttatttatttatttatgtatgtatttatttatttatttatttaccttgagacagagtcttgctctgtccaagctggaatgcagtggtgtgatcatggctcactccagccttgacttcctgggctccagcaatctttctacttcagcctcccaagtagttgggaccacaggcttatgccaccacgcccagctaatttttatatttttggtaaagaaagggtttcactggctgagacctgtctgatctcaaactcttga

SEQ ID NO: 54281 - DNA, 1043 bp, Homo sapiens
aaaatgttggcaaaataaaaggctaagttgaggaccagctttgttgcatttgccaaaaaatagcctggcaaagtagcgtccattccaagttgacagcacaatcttatacattgttttttcttcaaataaaaaacagattggatcttttccaactgtgatacattattttggcagatggtaacctgtagaggaatgggtctttgtgctcattggttgaaaattaatgactgagtgatttgagacaagttagtctctggaaagaattagagttggggagcaaggatggagagtaagggatgtttttaatgcagagctgacataatgcttttacgcaattgaaaatctcacattatcctttcaaaactgatgagcttctttggtattcgaaatcaggaggtggccattgactcaacagcttcttccttgcctttaattaagtgcttaattttatcttttgcctgaaatatttaattctgtttgccaacacagcctccctctgggcagccagattatcgcagtccctgtgaactcatccctgtcttggcacataaacaagctgagagaaactggaaaggaagcctacaatgttagctatgcctggaagatggtgagtgagaggaagttgtgtttgcttgaagagctacagggtacagtgctcttcttcatgttggaattctcagccagggggtggcacttgggtctgataatttgtctcgtaatgtgactaatcagtttttaaagtgattgggaaagaagacattccacaggtgttgtataattatttttccttttttgtttataaaactgataattgttcatgatgaattcatcaaaccatataaaaggatgtaaagtagaaagtaaactatgcccagcctggacaacataacaaaatcccatctctataaaaaaatgtaaaaattagccagacgtggtgacacatgcttgtattcccagctactcaggaggctgaggtgggaggattgcttaagcctgagaggttgaagctgcagtgagccatgctagcaccaaaactatctact

SEQ ID NO: 54282 - DNA, 1018 bp, Homo sapiens
ccagccaaatgttgactcctttgtagggtatggtatctgtctgaatctgtcagcttctcccatcatataagatttcatatgcaaacaagtaaacacttacttagaacacatccctcagtgttctcattaacagaccatgtgtgaagcacactcctactgatgtctaaatagagtgacttgtcatgcctcccatatattctaatgggttgagaaaaagtaaacaaagactgtttcttttgaggggaagcagtcaccttggtctttgattacaatgaaatgggccagaactgggctgttaaagatgttgttatagtgcagggaatcaaaacccaggtgtgccttagtcattaggtgacccaactgactcctctcacctggcagcttatcatcaagagccatttgcttttctgtctagacatattctttttgttcaagagggcaagggtaggggcagatgtttatgcttgtgtatgtacgtttacatgtttttgttgggattcaaatgggtggaagaattttgatttggtttgtttacaaatatttatcgtgttggtccaagtgaatcacaatggaaatatgatggactttcaagttacaaaaacccaggttcaggccgggcacagtggctcatgcctgtaatcccagcacattgggaggccaaggcaggcggatcatgaggtcagaagttcaagaccagactgaccaacatggtgaaaccccgtctgtactaaaaatacaaaaattagctgggcatggaggcgcatgcctgtaatcccagctactcaggaggctgaggcaagagaatcgcttgaacccgggaggcgaaggttgcagtgagccgagatcgtaccactgcactccagcctgggcgacagagcaagactgcatctcaaaaaaaaaaaaaaagaaaaagaaaaaaagaaaaacccaggttcagccaaatgcagtggcacatgcctataatcccaactactctggaggctgaggcacaagactcacttgaacccgggaggcggag

SEQ ID NO: 54283 - DNA, 1855 bp, Homo sapiens
gcctgcaagatgctcttcaccagtgtgtcaacagcaggtgcagtcagaggctggaaagtgggtaagcagaatctagtaaagaattgaggttttccagctaatatttattattcctactcttcgtgttttaaaaaggtatgtcagtttttcagatctgaaactgatttccataagcctttacccaccagattaaatgttgtctcgttcccacttattacccgtatttagcgtgtgtaccatatgttagtagcctcatctgtgaatgggagtttttcttgaaataaaagacttgtgaggggccatggcatgaagcagcagggcaagggaggaggaacccctgaggtccagaagcagaacccagtggtcaaggctctaggtgtgatattttgaagctcatttattttcctttcttaggaaacacatctgcttcatgatagttttgagaactaaaaactacatgttccccgctctctccccactcctcaggtgggattaggagtttgggactagacattatggaaatagtggctgtggtagactaagtaaaggggagttggtttttagcttattgtagctgtagcttgccattttattaaacagtgtttagagggatagcttactctgctttgcgtgtgtattttagcaaaggaattgtggcatcaaactgattaatttgggatgttatacagtagccccaagtcaattaagtttgggaaatgctgacactgcatatattctcttgagacagtcacaatgcatgtaatacactaaaggctctgagaaattggcagtgaggaaacctgtggtgactggccaagtatttccaaacttattggacttttttttttatttttttaaatgaccccacacttgggggatgttaagccagagtctaacaaacattggggtcatttctgtttggtcttgtaagatgattttgaatagccccatgatgtgtggatgtcattatttaattcacagagagcagttttatttctctcctttccaagttgttaagaggcataaaacagttatttccctggcagtctattgctattctcattttataaggaaaggaaactaaagctcaagaaattcacagcactagtaagtaatggagatcctgagaactgtctgatgcccacacttaagtgctgtcccctgccccacactgctttatagaagactaagtattgtttttctggcagggactgttttggggtgctggattgtgaatggtgcatggtggacagtgatggaaagactcacctggacaaaccctactgtgccccccagaaagaatgcttcggggggattgtgggagccaaaagtccctacgttgatgacatgggagcaataggtatgtttgttagatgccccaacaatttgattcttgaatatacaatttcctgcctatatgctaggacatcttaaaataatcctcttcccaacttccctgattcctttgctggtagtctttagttacaaaaccaaggcagataattaccttcagaactggctaaatattctatgcagagagagtgagtggccatctgtgctgccaaattttacaagcctggaattcattcccataaagcttgttctgataaatataaggactggtttctgcatggccaaactctggagtctgtttggatatgcacgccagctgtcagaagcacagggccgtgtacggagtgaccactgtatgtctagtgcctgctaaaaccttcactcacaacttttgcaaggtagaagtcttatagctacaaatcagtatttggggccttggagtcaacagaagccagagctacccagtgcatctgggacagcttaggatgaagcacaaggacac

SEQ ID NO: 54284 - DNA, 1030 bp, Homo sapiens
gatgaggtgatcacattaaacatgattaaaagcgcccctgtgggtcctgtggctggagggatcatgggatgcatcatggtcttggtcctggcggtgtatgcctaccgccaccagattcatcgccggagccatcagcatatgtctcctcttgctgcccaaggtgagctcaaaatgaaccccacaggggaggcagcagccaggctagaaggacagtggcgggttgtgtaagcctctaaggaactgtcagaacagtgctatactttcagcttctgtggagtcattttggaagttcccaaagcctgctttcttcttcagtgcctaaaccctacaagctctattttgatccccggaaaaatccctggatcctctccttaccagcattagcccccagtggcctgcctctgcaataagccagtcaggggagctgggatgctgagtgggaaattttgtttgttagatgtgctgcccttgcaattccaaaaagacaggcaaatcaaagataccccagatcactaatggcaagaatataatctgttcgattgcagctgccattatgtagtgtgaataaacacacatttgaataatcacatctcttaaaacaggataagtcggccaatcgcggtggctcatgcctgtaatcccagcactttgggaggccgaggtgggtggatcatttgaggtcaggagttcaagaccagcctggccaacatggtgaaaccccgcctctactaaaaatacaaaaactagccggtgcggtggcacctacccgtggtctgagctacttgggaggctgaggcaggagaatcgcttgaacccaggagatggaagctacagtgagccaagatcgcgccattgcattccattctgggcgaaagagtgagactccatctgaaaaaaaaaaaagtcatcgaagccaagtacaaaatgattcacctataatcatggcctcaataccacgtgcagtatctatactctgtttaagtgcagtatctgtactctgtttgcagggaacaaaactgtttaatggcca

SEQ ID NO: 54285 - DNA, 1637 bp, Homo sapiens
atttgggataagggttcttgtttattttttttttctcctctgtactttctcagctgtctgaagtggttatgtatttattgtgtcattgttttttaagggaaaaaaagagttatcactaaatctctttaaaaataaattactttagcatctgctgacagtctgccagtgtttgcacctatgtattgcaaagacaggaatacctcccagtgccctagaaattgtaggtgaaatcttctgtctgcgtcttgaagctctcagctgtgtgtttgttttgttctttttctaggttacagcaccatgagcccacaggaggacagtgaaaatcctccatgcaacaatgaccccttgtcagccggggtcgatgtgggaaaccatgatgaggacttagacctggataccccccctcagactgctgccctactaagtcacaagttccaccactaccggtcacaccaccctacacttcatcatagccaccacttacaggcggccgtcacggtacacactgtcgatgcagaatgctaacaatctcctcacctccacgccaagatgagatctgggagctacagaatgttctggaaagaaaaagaaccggcttaaaacccacagcaagagacctcccttgtgtttgtgctttgtgcagagttgtttgagtcatttcctgcctgtcgacatggttaaaaacgagagaaacaacaacacagtcacatttgtgaagatgtgaggctggttctgaaatggaggggaaataagcctgatgaacagacctgccataacactaatggaaggtaacagaaggcgaacctccaaacacagagacggaacctgcaagtgaagctgagccagaggaatgttccaaagagccagaagcattcagctctccttaactggaagagagaaaaatctgctcacccagagactggaatgtggcacatgcagatacaaatgtgtgcattgaagatttcgctttgtttcttagcggtacctggataccacagttgctgtatggaactcatgttatgctctaaacgatgcatctcagaatttctaagtaaaggattatttttctactatttattgaactttcaaacattctcaaactttggggaaaaggaaaggaaacacaggagaagttttcagcagttgccccgagctgttttgtgtgtaatgaagtggttctttgattaaggagctctatttcttatttaactgatatcccactgccccactccacaaaataggaaaatgaagaaatctttctctctgacttgtttacatcatttcacggaaacacatctttgtttgtaatgcagtattctttctctgtgtttgacagagatggggaggggcagaggaatttaagaggttttaaaagaaatgttatgtttcttatgacttgtttccactcctcgtacaatgctattcttaggtttctacgaaacctaatgttagaaccgcatcctttcagctaagggagggttggatttattttccttgttttagagactacaaatttttaaatatcccattttgactgagaatattgacatataagggaagaagttttctaaattgtgaaagtctggttcttaattaaagaattttttttttaatatcacggttaaaagctgctgcca

SEQ ID NO: 54286 - DNA, 1038 bp, Homo sapiens
cggcgaggggggcgcgggcctgggcagcgcggcggggctggggccggggccggggctgcgcgggcagggcccctcagccgaagcgcacgagggcgccccggacccgatgcccgccgcgctgcaccctgaggaggtcgccgcgcgactgcagcggatgcagcgggagctgagcaaccgcaggaaaatcctggtgaaaaacctgccccaggacagcaactgccaggtactgggacggtgataggggcgacgcgtcccgaggggcggcggggcggcgctccgtgtccaggctgggatcgggggcgcctcagagcggtcctggggagtgggtcggcgccgagtggtgagagcggcccctcggtttgactgagttcttggggtttctagcctgcagacgccctgccagggaggggggcagattgggaaactgaggctctgagtggcgaagcggcttctccaaggtcacgggaatcaggggctgctgcctccaagttcggcccggtctttccttcccctacggccgtagaggagtaggaggtgaaggagagtggaggtgagttgtggagcacacattttgcgggggggagcgggggtagagggggccgaagcttcgggagcaccttggcaggggcgagggctccaacgtatagtccccggtgctcgggagtgccatagggggcaggggcacgagagagctgggagtgagtttcgctgttgttgcagaagcacttgcccaagtttctatgaaacaactctgtcttctcagtttgctaaggccccagaatagagttattgctgcgctccttggagccttgcagccgcctcctgctacgccaagtacagtactggagggtttgttctcagtgacttggatgaggtttaaagatagctactctgtgtatttaatccagattaactgttgcttttaagattagaaactctgcatctatttaactttttttttcccctgatttcaaaagctgcatgctcattgtaggagagctaggaaagacagagaagcacaaaggggacacagaaatt

SEQ ID NO: 54287 - DNA, 1048 bp, Homo sapiens
gaagcggactacccacctaccttgttctaaaatgctatatttccattgagacgtctgacccccggcacactctcaggattgatttgttaataaattttgcaatgtaccactctgttagcttttttggcagggaactctctccattcacttataattattcaatcagtcaactgtttatggcttaagagtctgttgaaagctgtaaaccctccaagaaagtgctaatattcataagcacacaaaatttgcatattatttcaagggggtatggatctcttatagcttatccctgatttcattaggggattgtagaccctaggttgaaaagtgctgttgcaggtcaacaaaattttagtcatgtctttgggactttacctgagtagggaccatttgggcagatccaaagctgttgcttcagtagagttttcatcagaaacttctgtaggccacgtttatgcatgagggtttgggtagtgatcctttatctgggcaagaatataaatcaggctcaataattttctttttaaacaaatcaaccatgcgacttcatgtttgatgcaaaagcttattgctctctagtcactcagcagcccacaactgacattttaggttctgtgcctggcccagagtggatgctcaacaaagtaaatttttaaagaggttttcaagaagttacaatgtaatatttcctccttaacatttattaaaagtcaaacattgatacaaagaatgtttttctttaaaacaaatcaagaatattatccattctgtttaatgtcttcacaataagtatcctgatttcttagtaagaaaataagtttctcttttgttagattttaggggtgcaactcattgtgagcccctaaacttgtcttctaggtatttggagcttaattttatgtttatttactactgttatctttaggtttgtaaacttatttcccacttccctatgttaaggcattttctttgtgtgtttgagacttactgtttaacttttatttccatatgaatgccaaaaatagcattagattcattgaaatttgtt

SEQ ID NO: 54288 - DNA, 1017 bp, Homo sapiens
tgctccataggcagaacagtggcatgggccactggttgcccatttttatggttatttctttattatcttgattatgtgctaaacaagaggtggattattcatgaattttccaggaaaatggtgggcaattcccagaactgagggttcctgccctttttagaccatatagggtaactttcacacgttgccgtggcatttgtaaactgtcatggtactggtgggagtgtagcaatgaggacggccagagatcactcttgtcaccatcttggttttggtaggttttagccggcttctttattgcaccttgttttattagcaagggctttataacctgtatcttgtgctgacctcctgtctcatcctatgacttagaatgcctaaattactgggaatgcagctcagcaggtctcagccttattttacctaacttctattcaagatggaggcactctggttcaaacatctctgacaccccccacctgctcccttttgtaagttttccattctaaaaacatcccttttgaaatgtactctggtatttagactcttagacgcgattatgagtattgttaccatttattctttttatgtctgtgtacagttttgcagtttcttttgattttattatgtaaatatttttgtgtacatatattgtcttctcaattggattttatgtaagcttttcaaggacaaggattgtatcttgtcccctactcctaccctctgccaaaatccctgaaataccaaaaaaacactgaataaataacatgggttcaatgagtattgtgcttattaaaggtggatgtgttttgttgcactaaattctagagaaaattaagcctaggtttggagttttacaattatggcagaaggcttttgaattttaaagcaaattccagggttgaatctcagggaaaggtacctatcacttttgaccaatgacaaggtcactatatcattgaactttcagtggatttgttaatagtttaaagaaatattcatttacccttttcgaag

SEQ ID NO: 54289 - DNA, 1063 bp, Homo sapiens
cttacactagaagttagatatctttgatagggcgtatcagaagaattacctttctcccagtatcacatgggctacagtgaaacccgttttcttttttttttttaaggtttaaatttttaattgtgataaaaacataaaattactattaaatatttaagtgtatagtttagtaatgttcagtatatttacattattttgcaacagatctctagattttcattttacaaaagtaaaatctgataattaataaactgcacttttccccctcttctcctcagctcctgaagagaacatcatttgactttctgtttttataactgggactaacttttatatctcacattggtgtaatcataccatgtctgtctctttttgaatgtcttattttactcaacgtaatgtttgcaggctttgtctttattgtaagatgagtgacacccactttcatttcctgttctaatattttcctgtgctgctcagtgaagttttttgctgatttcataggtctcagttggttctcactgtgaatggtgttagcaccattgggaagccctttgaataaaagaatgtaataaatttcctatctggcttctgacagtgaagatggtatagaaagacagaaacccaggctgttgctttgctgcatgccaagacatgaaagaatagataactacatggcaagaagaattggggaaggtgggtgagaagagcaggagcatcccagatcccagagtgagcagtctgcttccctcccccagtctttggaaaatctcacttgtagaatggactgatgacttctaagaggaggaaagctgctaaaaagagttctttatacctgaagtaaggtctgatggtgttagtggctggggtccaacattcagaaagatcacctaccagcgaaggggccctaatgaagaaggcagctggagagaataaccaagaggctggagactgggaggaagggtttttggggcagaggctccacctaagaggtgagcaagctgtttggtgcagcagcccttctctagggctgaacccctcgtcaccatcaactcagctttga

SEQ ID NO: 54290 - DNA, 1354 bp, Homo sapiens
caggtttatcaacttatgaggaaatgctgggaattccaaccatccaatcggacaagctttcagaaccttattgaaggatttgaagcacttttaaaataagaagcatgaataacatttaaattccacagattatcaagtccttctcctgcaacaaatgcccaagtcattttttaaaaatttctaatgaaagaagtttgtgttctgtccaaaaagtcactgaactcatacttcagtacatatacatgtataaggcacactgtagtgcttaatatgtgtaaggacttcctctttaaatttggtaccagtaacttagtgacacataatgacaaccaaaatatttgaaagcacttaagcactcctccttgtggaaagaatataccaccatttcatctggctagttcaccatcacaactgcattaccaaaaggggatttttgaaaacgaggagttgaccaaaataatatctgaagatgattgcttttccctgctgccagctgatctgaaatgttttgctggcacattaatcatagataaagaaagattgatggacttagccctcaaatttcagtatctatacagtactagaccatgcattcttaaaatattagataccaggtagtatatattgtttctgtacaaaaatgactgtattctctcaccagtaggacttaaactttgtttctccagtggcttagctcctgttcctttgggtgatcactagcacccatttttgagaaagctggttctacatggggggatagctgtggaatagataatttgctgcatgttaattctcaagaactaagcctgtgccagtgctttcctaagcagtatacctttaatcagaactcattcccagaacctggatgctattacacatgcttttaagaaacgtcaatgtatatccttttataactctaccactttggggcaagctattccagcactggttttgaatgctgtatgcaaccagtctgaataccacatacgctgcactgttcttagagggtttccatacttaccaccgatctacaagggttgatccctgtttttaccatcaatcatcaccctgtggtgcaacacttgaaagacccggctagaggcactatggacttcaggatccactagacagttttcagtttgcttggaggtagctgggtaatcaaaaatgtttagtcattgattcaatgtgaacgattacggtctttatgaccaagagtctgaaaatctttttgttatgctgtttagtattcgtttgatattgttacttttcacctgttgagcccaaattcaggattggttcagtggcagcaatgaagttgccatttaaatttgttcatagcctacatcaccaa

SEQ ID NO: 54291 - DNA, 1034 bp, Homo sapiens
taacaatggtgtacctacctcacaggcataagcactcactgagataacagtcagagtgctctgtaaaccacaggcaaatgactgttttcaaaaattatcgggctgggcgcggtggctcacgcttgtaatcccagcactttgggaggccgaggcgggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccgggaggcggagcttgcagtgagccgagattgcgccactgcagtccagcctgggccacagagcgagactccgtctcaaaaaaaaaaaaaaaaaaaaaaaaattatcatcagctgtcaatttcactaccatgagtagatgctggcttgcaaataagatacaattattagtaaatattacttgccactttgatttagacaactagaaaatgaaataccctggctagtattggatcagaacaggaagtgggtggaggtagagtaggaatcagtttcataaggcataagtgcaagtgacgtggagagacagtgctggaaccagcccctggatggaggggcctgggtggcctcctcaggagccctgcagctgctgagggatttgacatatgacttggaagccttgagagtgtgtgggaaccaccagctagcatgtcagacgcccaggtaaggccacggagtgcctgttttgcactggcctttatgaccctagacagtcaccaaatctttaaaccggaccccagccttgcataacataccgtcttctgtgcagattcctttgtacttcacaatgttctcatgatagaggttccttaagatctcgatttcctttttcagatcagctatgtggttacctccactctcaggcttcagagatttaacagccacctgctcccctgtattgtccccttcggggtcatacctgcagagctcaaccttcccaaagtggccct

SEQ ID NO: 54292 - DNA, 1119 bp, Homo sapiens
ggaccagggttggaaatagaatgcgggaaggagcagcttggctaaacttgacctttttactctgcaggaggataaagacctggtccatggaaatgtgtgtactaaaaacctcctcctggcccgtgagggcatcgacagtgagtgtggcccattcatcaagctcagtgaccccggcatccccattacggtgctgtctaggcaaggtgtgtctcccctctcttccctctggccccaccccgagtcaggggcaagtcagcagagagaagggctgggctggggttggtctccttttagagagtcattttttttttgtattttagtagagacggggtttcaccatgttggccaggatggtcttgatctcctgccttctcttaagtccttgaacgagcccccgttcgtcctcctgccctgggtgatggcccccaccctgggatgttttgctgatcctaaggccagggcttcagaagcctggcttcacacgaccctcctggggagcttggaggcagggacccatctgctggctgtgacccagactgatgtatcagaagtgctggtggtggcttggagggctgcacgcctgcaggccccccgcacagggcctatgtggccatgggccatgtttgggcacactgcttgaagtagttccttcattggctcactgttctggctgcagtgacagtaattgaatccctaggagatcccagaaactgctccatcagtgtgtctgttgtcttccagaatgcattgaacgaatcccatggattgctcctgagtgtgttgaggactccaagaacctgagtgtggctgctgacaagtggagctttggaaccacgctctgggaaatctgctacaatggcgagatccccttgaaagacaagacgctgattgaggtgagcaggtgtttcccggggcgtgaggcaagtgagggctttcaggtgctcgtgggcttcccaggagttgtcggaagcctggcactgtgggaagagatgggcatgggtttgaatctcttcacgggcctactgggtgtgtgacctcacaaatgtaactgaacttccgtgagcctcagtttcatcatctataaaatggggataatcagtaactacttgtagggttgtt

SEQ ID NO: 54293 - DNA, 1023 bp, Homo sapiens
tttgcttttctttcccagtttctattcacctgcatctccttatgatggtcatcttcagtgctaactccatctaacgtcctctgggaatagatctccctttcccatttggcaacatgtggattcatggacttagatttgtttctaaactattttctcctaacctgtacatgaaaaggagatgtacttttctactgtcttttagctacaagcgatatattccagaaacattgaataagtccatcagacagaggaaccttctcaccaggatgcggataaataatgttttcaaggatttcctaaaggaatttaacaacaagaccatttgtgacagcagcgtgtccacgcatgacctgaaggtgaaatacttggctaccttggaaactttgacaaaacattacggtgctgaaatatttgagacttccatgttactgatttcatcagaaaatgagatgaattggtttcattcgaatgacggtggaaacgttctctactacgaagtgatggtgactgggaatcttggaatccagtggaggcataaaccaaatgtaagtggctgttggcagtcgatcaaagagaacattcccgtgtcacatagcgtatgctgtttatccttctggagtcatctgtctgcatgtccatcactcccataggctgagtttatttaggagaccatgtatcattcatattttatttcatccctgtagcacaaggtctaaataagtatttattgagttatgtagagaaatataacaacatgtataatacgtagtagtataataataatagcagatagttcctgagtgtttaccatgtgccaagtacttttctaagtattttataagtattaactcatttatttctaaaaataaaaaaacctttgagggaagtattgctattatctccattttacggatgaatacaaagaggcacagagaagttaagaaatttgcccaaggtcataactaataagcatttgtgccaagaattgaacttaggcctctggctccgtgaaattgactaatt

SEQ ID NO: 54294 - DNA, 1020 bp, Homo sapiens
tttccctagagctacaccagaatggagggagagccccatcaactctgtacacccagctcctagacaaggccatctaagcatgtttgtggaattcatgcatgatcagacctcagcccagtgtcaccttcccttgctctggcgcagtccaggcctagtacacagtgtttgtcagcgtcacttctatggcgaagggacttcgtatgtctgtactgttccccagtgcctggcatagtgctcagtcaatgttttgttaaatgaatgagcgggggagaacatctcctgagccccttcacacccaactctgtttaaaagagctctgatgctagagaaactgccaatctgattcgtctcgttgctgtgctgcgtttctaggcggcccctccctgtgtagtagccttcttgtcaagatcaaaaacgggtgggctctcatggtttctcccccttgctcctagggacagtatgatttggtgaaatgcctggctcctattcgagaccccaagaccgagcaggatggacatgatattgagaacgagtgtctagggatggctgtcctggccatctcacactatgccatgatgaagaagatgcagttgccagaactgcccaaggacatcaggtaaagcttcccactggctgaagaattgattgtgaggatggtggtgtttctacatgttcttacacatttcagcttaattactgccagggtttggctgacctttgctctctatgaaacccagatcttccttagaatgtttactacatacacgtagcctaattataattgtgtcttgattttggatgttggctgctaatctcagaaatttgtgcttgggtgaaatttctgagctgaggatgccaataaaattagtggcccccaggccttctccgtcccctccttgcccatggtggacactgtcgtctatcactgcattttttccttttgttttggacccatcttaaaaatccttctcagtacagttctgtaagcagctactaccatcccaagcctgaactctgaac

SEQ ID NO: 54295 - DNA, 1029 bp, Homo sapiens
taagatacaccatcagttgaatagcagcaatctgggaagtaggaaacactgccacgtaagctgtatatcttgattgcgtgatgaaactaagttgcaggaatgttaaaatgtcaatcaaattggtcttggattcgaggtagaatgggcttagcagtgtggctgatggtaagcgtgcagggagctgtggtcagcatggagttccagtcagcaggtgtttccctattctggaagcatagtgagaagtcagaggagctgtctttgtgatcttcgggaagtcactttagctccctgagtcatagaggaggtgctgatgggacacttctcacgcagcgctagtaagaaggaaagagatggtgaggggctacaaggggcagggttgtctgcctgcttctcagggcacttcagcctccggcactgaccactgttggtgagccaggacgccctgcccacatctgggtcccctttgccacaattggcattcattttcctgccttccaggttctatttcaccaattggcatggaaccaacgacaatgagcagtcagtgtggcgtcattctccaaagaagcagaaaaatggctacgagaaaaaaaagattccagatgcaacccctctccttgatgccagctcactggagtatctgtttgctcaggtaggaagtttgggcccaggagaagctggagtttgtgggatgggagaggcattgtagagctcagaccccctgctgcagctgaacttggtggtgctagagtgctttaaggcctgttctgggtaagttcttgccacacctggacttgccccaagtgaggagaaaaaaggcagcatttcagctttccaagaggctggttatccagcttgtgggctttggggcttcctttctttcctattcctttccttttccccacctcctaccattttatttttcatccgtattaatagccttatgtgcagaggtcagagggaagctctgcttgttagaagatgtaattcaacagggctgaagaaggcacttctcagcagccgtagtaa

SEQ ID NO: 54296 - DNA, 1060 bp, Homo sapiens
tggcagtcattctccccccaacctgcctatgtttcaggttcataaaattttaatcatgggcgtagaagtgagtgacttcataatctccctggtctttcccatcattctcttattgacggaggcaactggtggagtggagaggcaggggagcactgttgggccagctttgtgaagccatatatcttcttgctagttggttactaaataaaaaatatttgtgataatcatacagagtacttaagaagtatatttattattaatggtaatagattttaatcactgacaaaaatcactttggttattatttattctaatatgcattttgcatactactgccaggaatttgtttgcatgtctgatgtataatcacgagcgtgttagaattgtttaagtgctttctgtaggaaacagatggaagatttccccaactcccagagtgtttccgattagcaaagtgcacatcaggcaggatctgtgaacctctcagataggggtttttttgaagctggatttgataaggctctgtgacggatacctgtaatgagaaatatcatcagagttttatttttaaatgatctaaatttggtttgccaggagctacagtgcatatttctggggagtcatagttcttgatgattatgatcaaaacagcctgaccgaacctggtcggaagtctgtttgccctaagaggatatgagtgacccagattctttgtggatgagagagttccttatctttgcatatattgggtttagaaacagatggccaaatgtatccgccttgattttctgatgtgtttttttacttttcctcaggtatctctcctctttgtcacaacctctttgccctgtatgacgagaacaccaagctctggtatgctccaaatcgcaccatcaccgttgatgacaagatgtccctccggctccactaccggatgaggtatgggaagtactgacctggtacctgcctggctccctctgcactgagggacagtggtcagcctggagccctgagtcacttaccaagaagtattgtagtcatttttgtaatttgtaacttt

SEQ ID NO: 54297 - DNA, 1064 bp, Homo sapiens
ggcttcctgttcacatgttgctaggactttcctctcacactgtggcagtggtgccagggcagagcattagtagtgggcaggaacacagggaaggctggggccatgcagtgattttttaaatgacagtcctttcagtctacagaaggaagagtgttggagtaagatcagtctcctgggtggttgttagactatgaaaagtactaaaaaaccagagaagacagtggtgttgctgatggggacagtttagagcagttcttccccactgtggaacgagcagggtccttagaatcagtagtcacgtgtttgactcctggcactctcgctgattagcgtaaaacctctcatgctttttatgagaattaagtgcgagtgcctaactccaggctcaagatattgaaatgcttagtagatattgttttttttttccttgactggaactgtatatttcatcaagctgtaatcagtttaacaaattatggtcaaaatatgagtgcttactgcatgctaaactctgttgggcattttacatgcattgactgacttaactcttaatagcccagtgagataaatgctatttttatctccccacttacaccaagaacattgaaggttagggatattaactaacttgcctaagattacaatagctagtcggtggagacgccagaattcaaacccaggttgcaatgactccagcccgtgctcttaactgctttgctgtgtcatctgagctttatgaaatggggttttgatttgtatctaggcttttgctcagaatccctatttagactttgctcttcgaagcagattcatagcccactttagtcctgtgccataaagactattttatattgcgtcaatacctttttgtacacttacacatctatagcctcttgcaaaaagggcattgtaggtacttgatgaagagtttttgaaagttgtttgtttttaaaaagagacaacatcttgccatattgcccaggctggactcaaactcctggggcttaagcagttctcctgcctcaacttctcactgaaagatatttttaatccttgtaccaacc

SEQ ID NO: 54298 - DNA, 1019 bp, Homo sapiens
agatacttctattattctgaggaaacaaactcaacagaggttaagaaactggcctaaggtctcagacagtgggtgttagagctgggatctggacccaggttagggtgactccaagagcaggcttttaactgcttctataaggaactttggagggcatccaatactttttcattatgcagggtttgagctcagagaggttaagaggcttgctcaacaccaggcaggtcctagtggatctgggctggaacatgggcctctttctgactggtgggaagaagctctcgcacaagctctgttcctcttgcaccctcccctcctttccttgctgtctgcctttttcctgcaagattcttcctgtctgcatactctttcctgcacaattgtgcttgtgattttccttcttcctggcctttatttttattttttttaaagaacagctgtacctttcctctctctttttcagtcttctccatttctgaaaactgagagcagattcctctctccttaatcccctctcagcccaaagcatggcccttgtgtcctctgtttttgactcccatggttctcagtgtctgtctctcagcatgccctcacagcctcttccctggggttcccgtgtatatgttagtcttgccagctgtcagtagattgtaagatttttggcatgctcagatgtatttgtgttacttctttggattcccctgaagtcccacaccttgcccaaggcagagtggtaaatggaaaggggagtgaggctacagctgagaaatgtgtttgagacctatctcacctctcactggccagttgactgtgggaacgccttagccgagtcttcccatctgaaggggctgtgaaactcgaatgtggtttagatgtgaaagccctttttaagccataaagtgctatataaatgcaaggttttattgtgatggcacaagtgcttcagaagtatttttgggataaatgattaaaaagcacatattgtgcctgggtgagttggttcatgcctgtaaccttaa

SEQ ID NO: 54299 - DNA, 1055 bp, Homo sapiens
ctgcttgaaggtaaaattgcaaaaatggctcattctcccctacttttatgaacactgttttagtctaatcttattatattgaaatcttagattttatcccatgcttgtgtttatccaattttatagggtgtgtgtgtgtgtatatatgtgtgtggggaatgtgaatatatgtgaatgaatgccttttctagagaatctggtatattaagtcatctacccaagaagaaaagtcttctgagattgatgctgtcagataaatctatagaatttgagaaatgaaagagagcatagagaacatctgatccggacttttccaaatgtatattccattaaaaaagaagtgccttggtctgatgatttttttgggagttggagactcactgcatttattaactatgaaaggcttaagagctcttgctgttaaaaatattatttaactatgtttaaccagtgtttctccaattttttcactatggaccctcattttccttctctctctttttagaaggatatgtacatagaacagttactatcattgcacagaagtacaagattccagaaaacataatttgggaatgctaatttaattcttaccttcaaattgaatgcgatacttcatttctgttggtttgtgttcccatatgtagtatgagcaggttgaatgaattaatcaattactgtgtcactcctgactgtgacattttctggttctgattcgttaaatcaatatttaaaaattatatctgtttctatattaaagaaccttgtcttttttgttccttactagaaccatagtgtctaatacagtgcctgacacatagtagtgtctcagtaaatgttactgaacaaatatatacctgttagattcagagcactgaactagctatgtcttgaggctgcagagagaatgatcttgtttttgctctcaaggaacttgtagtcaagtcattaactttcctaagagcatggaatgtgccatggagaggtcccaaattagagcttgattgtgataatctataggacaaagatagattggacattatttctgaccctgt

SEQ ID NO: 54300 - DNA, 1039 bp, Homo sapiens
tggaattaaattttatgagagttttgaatttaagcctgtcatgaatctgtgttgttgttgtctaggatccttgcctatatttagatcatttgaaatgaaataacagaaaattgtgaaatcaggaacaaagtcctgttagaaatgtaaaataatcaaaatatgaacctagctatgcttggatttaaaactgaaaggtagatattttctcctgacatttgaaaatgttttcaacttttattgctcttactggaaaggagaaagaacttagctaggtgcatatcatggatacttgactgggtccaggtcattacttagatgatttaatggaagggcattgggttaggagtcagtagacctgcgtggagtctcagctcagatacttctctttgcaaaacctgagttagttacttcagtcatctttttggcatgtatttacatatctgtaaaacggagacaatgttattggcctctatccggcatgatattgttgggggtgtaatgaggacatgtatgtgataggaatgtaaagctgtgatgaacacagagagtgaccatatgtctctgtttgcctggggcagccccagtttacacctgttgttgggtataattattgatagcacactctttaactctcaggtatcccagtttggctgataaattatatggtcaccctgtattcataacacccatctattgtttactattaatctttcgaagtaggaaggttttctggcctcattcctgtggccccaaatccctcaccaaataagtatttcttagatgctttctggtagttttcttcaattttatgtgaatttcatctctccaactacattggtcagtagataataattgtttttttttttcactcctgaataattttcttgtttatcatggtattagcattttaaacattctaattgcccattttggttggtgcatcttaagaaagtaaatttgaagtgcaggcagaggacagaggaaccccagcgggaaatggctttgtggaagtacactaaaaatgaagagtacagtttgt

SEQ ID NO: 54301 - DNA, 1002 bp, Homo sapiens
cctggcccccagcactcagcatgtgtgcagatgccgtctttctgcgtgcccagaggttcccatgcttcacctgacatctctagttacaggaccctttgtcttatcctttccagaaactaaacctctagatatgtgtttccttataataaaatagtcactagccacatggtagccacttaaatttaaattaacatttaataaaattaagaaatcggtttctcagttacagtagccatcttttaaatgcctggtagccacatgtgactggctgccgtactggacacagcacagatacaaaacgtttccattattgtggaccattttactggacagtgctggtctagacttttgctggggcagaggagtggccaacgggattctttttctcaaacacctttctctggccctctttcttcaccccagttactggtgcttccttccagttcctgtgactttggagacttctgtggtatacgttaatttggttatcagcttttgccattgtcagcttgggattcagtatttgtggattatcgaagtcaattttttttttacatatccaactactttccagtttccaaagttgtagttttctcctcttcttttccccttacatatttgtgaatttggtcttaaacagaaaagccatgctgtatttattatactactttatatattttaaaaatatgtactatattttagtggagtttcagaagggagtgaaattgggtatttctgttcaatctgccattttagctgggaatcctgcctcatttaccttcacaatcctataaggtatatatgtggttattctcattttatagtgaagagaggcaggtaaaataattgactcaaggtcacatagctagtaagtgggatttgaagttggatcagacttaaaaaatcagagagctttttttattaaatagtgttgtgccttatcttgtattgaggaaagacccacccatcacacgttccccaagttgcaatactatagttata

SEQ ID NO: 54302 - DNA, 1039 bp, Homo sapiens
tagcaagcacttgtttagttcctgctatgtccagacactgtgctgagtgccttcacatacattaactcttctaatgctgaccaaaatactacggagcatgtgttacgatcattgttttacagatgaagaaattgaggcacagatgggataaataacttacccaggatttcccagctggcacgtggtagagctgggattcaaacacacgtgttctggttccagactgtgcttatatctgctatgctgtagtgccagtgaaggctgggtcatgccagacctcagtttcgtcatcagtaaaatggaactaatatgtggattaaacaaaatgtgtatagaatggcagccacatcaagtcataagcattcatcaggtggactgtatatctagtggtggtggtggttgtggtcagcattgtaggaaaatacaggggtgcattaggaagtaaccctctagggaagggccgtgtatactgataatcgttaatgtaaggaggacaggggtaagggccctgaggaaagtgtgtgcatgaacagtgctgcgatggctctgaagtgggtcagtttgttccacctgggcagtgtggagccacttgggggtggggggaggggatcctgctgttgagtctggaaaaatgggcaggagtcacatatactggagcaggtaggaggagcatttcctctgcaccatcaggtgagcaaagatctagtgtgtactcagagttggaaagtggggtctggagacaatagcactggccgtaggagagaggcaggaactggagtgaagataggttagagccagcactcactggggcttgatgccattgcgaagctttcagtttatgcatcagggaatgtgtggtcctggggtccacagcttggtttaaagatctaatttgggtatcttctcagctttctgtgactctggctgagcagcagagaggaattttgttttggcttttatttgatatgctatctgtcatctacctaaaggagcctgcccacctcctgggttcatacagaggagaggtaccactatagtg

SEQ ID NO: 54303 - DNA, 1048 bp, Homo sapiens
ttgtaattttagtagagacagggtttcgccatgttggccaggctggtctcaatctcctgaactcgtgatccccccacctcggccccccaacgttctgggattacaggcgtgagcaaccacacctggcccagatttcttatttataaagtgccatgatgtctacctcacagtgttggtatgagcgttaaatgagatgtaaagaacctgatcagaggatccagttatatggtaagtagtctaaagtgtaggtattattattgttaaagatattgtgggcactttgttgattgaatatccccccccctccttttttagagccaaaatccatttaaaaaatacatttaggtttcttgcagttttttgctgttatgaacaacacttccattaataggattaatagctgtatagctagatctctgtgtgtgtacattatgtattcttaggatacatttctgagagtcacatgggttcctattttttggctctttttattcccttaccagagtgcctcccgatagtttgtaattttgtaacaatttaccattaaagaacagagttttgataggcagagatgggagagtaggagagagggagtagcctgtacacaaaaggattgcctcctttaccccaaaggttgaggcctctgaatgctggtctgagctcctagggatgatgcccctggagcgtagtaattgcctaggatacaaccactcagccttgtgccaccatggtaggacacccaccatgctgggtgtcctactgccatggttggggagggctgaatgttttcaccctgttgctgggggaggtggggacttggatgagtgacacccggcgtggacagctaccacctgcccatggtagatgaaaccttactttcgatgggaatggccctcccttcttatgggagttgtagtctgcatggagtgcggttgaacaaggatgagcaggtaatccaggtgtacttagaatttgcttcctctgaatattagaacgtgaagaggactttgagggaatccagcatggtggttttgactctttgaaaatc

SEQ ID NO: 54304 - DNA, 1074 bp, Homo sapiens
ctggccggatggctagcactgaacttgtgtggatgtttgttcaaactaatcagcctacgattggtttgttcctaagaatgataaaactttgttctagttttttaaattgtaataataattctgtaagcatttaagaagaatgctttctttaatgttgacttttttttttttttgagacagagtcttgctctgtctcccgggctggagtgcagtggcatgatctcggctcactgcaacctctgcctccgggttgaagtgattctgctgcctcagcctccagagtagctgggactacaggcgcccgccaccacgccaggctaatttttgtatctttagtagagacggggtttcaccatgttggccaggatggtctcgatctcctgaccttgtgatccgcccgccttggcccgccaaagtgctgggattgcaggtgtaagccactgcgcccggcctaatgttgacattttttactcctacacgaagctgttatgtttttacttattcttttctagtctttatcgataatgtataaatatgtactgtattatgtaattttaattgctggatacatatacctgtcttcttaaacttttttattctattttaatagagtctttgtaataatcatttttgaatgtagtatttagttgtgttaatttattttatttttcttaagtaatctatgatagaataagctatttctgtttttacagaatattgtagggaacctttaaaaacacacaattagcatttttctgctgctaattgctttattaggatgaatgcatagatttactgtgtcaaaggttataaccaattttatgacctttagtatgtaattctggaaaattaaacagaaacttaagtcacaaatggccttaaacattggcaggaagctgctgatttcctgactgttgtacaggcaacccactggcaagtaacatgtcaaatacggaccattataattccttatcataaaggcagatacagttttcttcaaaggacatgaaaataatttatttgcttttgatgccttttctcactgggaaatgatattctgtaagtgcacaatgt

SEQ ID NO: 54305 - DNA, 1018 bp, Homo sapiens
atgttgaaatgactgggtttcagggaccggaaactaattcctgtgagtattctttcctctgaggtgcaccagccttcttggcagtttaaggcgacaggaaagcataaaacattaagctcatttccgtgatacctccacttctgagggtttatgatccatgattctttgtagttggcagtgggcacacattcttccttggtgctctgcggataaactgcccagtcccgaggcaagacctgctttagaagcaaaaggataatttcttttaagtctactctggccagaagatagagctggcgtttgttgggatatttttaatctgcagtaactgaatttatttaacagtactattcacactagcattttatacattcttttattcatttagcaaatacttgttgagctcttgcagtgaatctcagagagtgaatagacagacaacaaaacaggtacaaatctgtcctcgtgtggaatttacagtctagtggaagaccctgagggcatgttcagttttacagttgcagactatatgcatgtaaaagagtaaatctttgtgattgtagaatgtttcctagaacccttcatggcactcctttgaagtttgaggactaggaagtagcttccccttgttatctttctttttttaatgttacagattaattcattctttgtatgcacagacatctctttggtacctattaagtgcctggcagaaggataagacatagtttatatggaaataaacttggtatacatggctgtaacacattgtgggtgatgctgtagtagcagtcagaattaagagctccaggaccctgaagagagctaattcctgcgtggagcccttgtcaaatgcttttttgaagaggcttcatttgagttgggccttcaggagtgagtaggagttcctttgttttagggtgggaaggaagtctaggcagagatacagtgtgagcaaggacataaaagtgggcatgtacgtggtgtcagtggcagacttggaagtggccactagatt

SEQ ID NO: 54306 - DNA, 1055 bp, Homo sapiens
ttcggccccaggaaggaggctgagggtcttagcttttttccttccttgcggtctcagcgagggaaagtttctgggatttggagctgggtgttgggcgtccgcgaactcgggaaacgccccctcccctcttaggttctgttaggaaccaggcctcaggtagccagcgagaagtgggaaaggagaccctgggcgagaggaccagggaaggggaacagtgggagagaactacccggggaattgcgaatcccactggaaagggactgattaaccgaaactggggctggtctctggctccctcactccaactccatccgcgcatcgtcggcgaccgggagcatcggaggactaatagacactcctccaaagtcactccccagggtccctgggatgtgggctccttggatgtgtgtttaccacggaacttctagataaaagatgcgatgtttgccaggtgtttgtgcacacgttttttggagggtttgcactccatgatttcctgtgtgttcctggggaaggggaccccgtccttcctgccactcttcttactacgtggctgtgagctgccttctgcccctggttgagtacatcgctatacatgtcattgacacttttccccccaagtcatagggtttttctctcactggcaggaatttacagtggtataaaattgtcattacttctttcagggagtaaaacatgggtagttaagtgatgagaataatgcagagagagatgtaaatcagggcgtgtttggttttggctatttttttattttttgaagaaaagatttgagttaaatatgggtataggcacagtagattttgtttaagatgagcaattcgtattgattgaatctttgttcttccctttccaaaaccccattatgtgttgtttcttgattttgcttttggtgactctgatgttttccaagaccaggggattattttcattgaaggatcaatgtgttcttttgtactttgtggtgaagattaatggagaccaccagggttccagacatttctggtacaatatgctttgtaatgtggagaaaatgt

SEQ ID NO: 54307 - DNA, 2079 bp, Homo sapiens
ctaataactacaaatatgtcaggattatttatttgtctccatacttacccaaccttcagtgtttcagggtaagtattcagttttccaaagctgacagaattgtggtcaagaaatattagttgataatcttatcctttttcgtggaacagctatctaaaattttactctaaaataatcacagtatctttgttcacgtagcagatgtttataattcgggtaaaaatgtgcaactatttccaagaaccttaggttatgggatccaactgtgattttttttttttctttaatcttcgttgccctctcgtgtttcaactctgtattacagttggctaagacctagatgatgacctccttaatttttagatatttttgcattttaggcaatgttgtttttaatttgtgtgtaggtggattgtttcattggatgttgcttttctgaagataaggtcattttcatagtacgtaaagttaatagttgagttagattcactgtacttttattttctgacttctgctgatctaaagaattgattcatctacctgacttatttgaagtacagtgctaatatctaatatgcatataatgagtctttgaaattgagcaaatgcctaatgaaaacataattatttttcaaatatctgtcaagttccactcatattgaaataacttgaaaccttatgacatggaaaaaacccaagtgaatcatggttttaataagttgatattctgatgcctgaattccaatttcagaatcttttgtactttttattaaaaggaagaatcatccctaaaatgacttcagagtacgtctcaaaggtacagataatttaaaagcaagtgatgtgtatatgttattattactttttaaaaaggtattctgaaggttgtcagtatcaccataggtatagaattgacataaactatagtgaaaaatatcaatgttactaatttgagtacattcttagcactcagagcaagaggaatgaaagtcatttttgctaatgtgcatttttcttcttaattataaagccccactagcttctgcttcatgatctcagttactgagaaaactaaaacaaaaagtaaatgtttttagaaatccttttgtttgtgtaaactgaatatccagttgatggagttggacagctagggtagggtagagaaaacaaagcactgtgttcactcatttgacatggttctggacatgggttcgccataacttagcaatatatgatctctggcaaatcacctaagttttttttttttttttctgcctataaaatggggtaataatatctaatctatttccagaatccttttttgatgaattaatgaataattcattgccagccccatagcgtcttgtgaaaaccaaatgagaaaacatatagagcagttttgaatgtttggcagatatgaagtattattgtcatgtttggttatgagcactttgaagacaggaatcatgtcttagttatctttatttcctgaacatctagaagagggctttagaacgtagtagttcctcggtatatatatgaaaaatcaatgattgaggtcagggaggcacagtcagtgaatccatgcatggaagagataagctgtgaaatatgctggaagcttactgcatatttgatgtattagagtgaaaacctaatcatgcagttgttcatcctcattaatatggataagtcatgtgttcatctttcattctaatttaattcaactgggccttttaatatttcagcctcaccacttgctgggctctgatccttctttttcttctgcctcctcacgtctccaaccagaaggtgatcttttagtccttcacttcatggggagccttcagagagagtaatgcagccaccagaaaggatgccgttgaccgacacagtgactgacaggctgccctggctcagttatcacagtgctgatgctgtctattctaaaggtacagtactgtgataactgaaggatggcagccatcttaccttccatcagaggagcctcaccgtacccaggaagaaagaaggtgaaagaggaatgtgaaacaggtggctgggacccagaaaccctct

SEQ ID NO: 54308 - DNA, 2069 bp, Homo sapiens
gttccatgtgatgattggggaccccaagtattacattattactgttatattagggagattagtgtaaaagtccagggttctagaacggctagcaggggtgtcatgggaaaattgggatacccacatacccggctattgctgcttttgtaaaaggatcctgaacatagcaaaaggtaccggaaaacaatgtgtggcaaagtaacaattgtgacacctggtggcattttagtgattctactcatctgtcactcacttccatttattttttctttgcttcatctactttctgtccccctccccaccaaatcacggctccactcgtggcatttgggcccacaaggctgctgactcctttcctccaaaaaaagtacaatgctaacgtgaatagaggtagtgctgtctttgggttttgttttgtctaatgagattcagaaattgcactggaaggaacttaggagctattcggtgctatccctttattttatagatgacaaactgccaaacacctcacctaagaccatatagacagagactggaattaaacatactcttgttgataactgtttagaggctccctgagaaatggagaggttcatcaattaatcaatcaatcaagtatctgttgagctagcattttgtggaaatgaccactaagtgttgtgaagggacatgagtaaaacagtttctgacttttttagaaagagtcctgttgacttgaggaaataagatataaacagcaccaaattaaattgcagtatacaacacagcacttaatgagtgcagtgccactgtggcatgtgttactagttagtagaaatgtgttcattttacagatgtaggaatagaagcttcgagaagggtggaacctgcagggaagtggagtgtaattgtgttcctggaacagcccaaggctgtagaattggaggtcattgcaagtctttggtattggctcctttagctgtccattaagggaatttgaaaatctgagacccagcattttcaaatggcagtgctgtagtaataaggcaatcatagattaattggagaccatcagggtttttagagatgtttagccaggggtggatcattccgaagttagctggcatataaaactgacttgtgagcaaaccataaaatctaaaatccggggggtgagagtggtgaaatgtgatgtagagcaaaatcagaaagtaaattaactgtggagtatacagttggactaaaaatatttgtgctgagtacatgtttgaaggggagaggcccatataatgtaatatatgggccagtcatgtatttataaatttttagtctcctggagcctttttggactaaactcttggtcaacatgaggaagaaagctcagtcttctctttgttaccgtgtccatagggtttttttttcgtccacatggaccttataaagttacatagcatgagattaattagggccagtgctcaaagtcagtaaaatgatgacacctcttctctaatcactctcagttaatgcttctctttgagaattggggctaactttgtatagggcggtggtccttgacattttcttgcctttctgcctatttctttttccataaaagagaaaaaaattctgtaacctgccacctcatcaatctttggcacaaattagtttttaaaaactcagtatagcaaagttttgcaataaaatgcaagtatacattctgtgtacttgtgacaaagcagtattggacatttgagcaacttttgctgacagtttataacatctcagtgtggtcaaatttggccattttatatagtatcactgaattagatgataattttcaaattggaaaacaaatcacactagttaaaagaccagtggatttaaatacactaaactatagtttaaaagtattttcaaatattctgcttggccaacaacttacggtgccttcagttatttaatatataatcagatattcaaaggtttaaaacaatattttcatcttagtttataaatatgagggatgtagcatgttttttgtgcttttatttgtactccacattgattgatcgcttgagaaaaggtctttg

SEQ ID NO: 54309 - DNA, 1730 bp, Homo sapiens
caagggtctcctgtcctgaatattccaacagcgtttccctctaaaagcctcctagctttataatccctttattctgcttaccagtcgaccctcccctcctctttgccccttgttctgtgatagatatttggggagaggggtggagaaagaggttgtcaccctctgttccttacagtgaggcatttttctttttctcagtcttttcatttattagatgtttagcatgtaaaatatgtaaatctgtttgcaggcttatttgaacttgttttcttgctggctaaggaatagctgatattctataaagggaaggaggggggaaaagatcaaaagtaacactctgagttttccccatttgagcatccccagagttgccagagaagaccctcctataaaaaccaacagtctcccttccatgacatcaccacctaagcccttccaactttagcttcagaacaggaagaaggctcaaaatagaactaccttaggaatccagctccttgaaaagatcaacttttaaatcagctgcaggaggaacacaatgaactttgacatggggagtgagaagggagagaagactgtatagtgttcataattggttcctttgagggagggttgggggatacttaccgtgtatttcagaaaagctttcctctagagttgggtacctagaccactgaatgataaataggatggttcaagattcatttattgaattattcataagtttttgtacgtcaacaataacaagcacgtttcagaatatgaattaaagaggggcctctctgcagaatctgctctagatagagaaggttgtttcaggaagctaggagggcacttgaagacagagaacctgaggatgcagtgacagctgctgtgagtatgtaagttgagaggctcataaacaataattgtgataaacaataattgtaacttttgtaggtgactgataccctggacaaagaagtaaggatgtcaggattttccacctctaccttggaaattaacttcttgtctttgaatctcactcagtgtctccattcagtccctgaattgagatatgctttcctctctgagctaaaatactcagtcttttggaagggctacctaataaacgataatcactgaagtgttgacaacttaaagattggaagtggagcagaaaatacttggtataatttgagcacttggtgggtgctgtaagatgactttctggttgatggggtaacatcttttactctggttcgggtttaaaagaatccaggtgacagagacaggatacctgccctaatatggtagccactagccacgtggctattaaccacctgaaatatggctagggtgaggaagagctcaattttaaattttatttaattttagactttgataacttgatttagttattggaaagcttatttatatttggaaacatacttgagcttacgcatctacttttgaaactaagtgttttgaaatccaaacgcaaattaagtattttgatgaaaatttagaattgggatatgtaagtgcaaagtaatcttcagatttcaaagaatgcaaaaaaagtagaatagcccattaattttatgttgattccatgttcagatgataatattttagatatattgggttaaatgaatatgctattaattccacctgtttattagtgtggctactagagaattaaaaattacatgtgtagcttgcattatatacttcattggacagctcag

SEQ ID NO: 54310 - DNA, 1046 bp, Homo sapiens
agtctgtgtaatgcactctgatattttctattttatttcattttttaaaaaattggtcgacccatcaaattaattttataactcatgaatggattgttacttgcattttcccagacactgatatgcactgtctaatgagattccctatattaaccaactgattgggacaattgttaaatgtaattgttaaatgtttacctcatttggtgctagatccataggaatcaccctgcccactaaaggagtgaggccacctcactgaggtaagtcacagttgttctcactgataagatcagaaagcacagtactgcagccagactttcaaagctacctgaggttaatatacataattcctggctgggccatttttaaaaagggatagctgcaaaattaccacaactacatttatcttagaatagagggatattgtttgggggcaactctttcttagactgtttaaatcattcctggttaggttaaagagacttttaggtttctgaggtttcacgtcaatttcagaggtaagcaaacataaaataaaagctctctcactgctatgattttgttttactctccttttccctaaatggtgagcagattagtctaatattcagatttcactctaatagcctgctttgacaatctgggaaacactagattccaaagaaaataaggaaatatatatacatatatgtatatataattatggtccaaacggagtggaaagaatacaacacatgtaaggaattcttttgttacaggtactcagtctagtcctcttctgcccatttccttcccctaacacgtcttccctaacttacagctgcctcattctttttttccttctgatagagttttgctggttttgttgatcttggaaagatcagtttcagctcagtggtgcacaaaagctggattggagagaatttaagagagaataataggagaagaggaattagagacagctagtatagacaactggctacaagggttacagagaaataagaaggtaaccaataagggaagtgctgtcaagaggagatttt

SEQ ID NO: 54311 - DNA, 1014 bp, Homo sapiens
tcactgcaacctctgcctcctgggttcaagcgattcttgtgcctcagcctcccgagtagctgggactacaggctcctgccaccatgacctgctaaattttttttttgcatttttagtggagacggggtttcaccatgttcgccaggctggtcttgaactcctgacctcaggtgatccacctgcctaggcctcccaaagtgctgggattacaggtgtgagccactgcacccggcccaaactagattttttttaaaaaagcatgagtagataatagaggcttttggattactctgtgtattttaccccctccacttgatgtttaagctctcaggttggcctttaagacatagtacaaaaggtcttgtttgtacagcttcatgtagttgaatttaaatggctgatgttatattttaacagtctcacctctaagttctgagagtttttgtactagttaaacaacagatccaggagcaagcatcccttacttagccagacagataatactgaaataatgcagagtcattcttgtttatcatctaacttccaagaagctagaaatcaactattttctgatcttcagcaccttctgtctgggcagcagtaacctgtaaccctggcattttataattcttgtgacttggtcataaccaacatttgcagggggcgaagcaactgccaggccctggactgactaatgaatgcaaattatctctaattcccacacagatctccagagcagtttttgttatatcatttgctttacaaataaataaatggcctcagaaaggttgagtaactaacttggtcaggtacagtggctcacgcctgtaacccagcactttgggaggccaaggcggatggatcacttgagcccaggagttagagaccagcctgggcaacatggcaagaccctgtctctacaaaaaataaacagagttagccagagtggtggcgcatgcctgtaatcccagctacttgggagactgaggtgggaggattgcctgagtccaggag

SEQ ID NO: 54312 - DNA, 1032 bp, Homo sapiens
atggtggcatgcacctgtgttcccagctacttaggaggctgaggtgttttcttcatagttacccatagcaagtgtcagagagtgatttaaaactgtatttttggtatgaaggaaaagaaagtcaagctttgaacaaataccaattgaaaggtggatactggatgtctgaaatgagtcacttaagtgccaaaatgccttaaatttaagagtttcttccatgatttctgcctctaaaggactttgacatctatttttttaaccaaggttttttattttttaaagcttattttcttactggaagagattcagcagagtgatattagggataacttatagaatgaagtctttcttcactgtattttttcccccaaagtagttatttctacttcagtgccaaaatattcttacaagtggggagataaagaacttgcagcttgaagaattataaagctctacagttcatctttgaccaggccccttgagatgcgtgtatgtgtgtgcgcaggtgcgcacacacgtgtgcactgccattattagtgatgttttggcgaagggatgataccagggtgagcaaggcttctcctagttctgtcccatacatgcagtctgatacttcagggtagagtggtcttacaagggaattgagctcatttacaggaatcttactctcagcattttctgtagaacaatgaaaagaacattgagtaattatctctttctggtgacttagccaggcatcttgggaatttgctgttttgtgaacattcgttcagctctgtcttgtatatctagtttgccttcactttatagacagtcacaacaaaaagaggatacagatgtgtgggtgtgtgggtgctagaaacaataacaattttgtatctcccacccagcctaagaaacagagtgttatcagtaccccatagctcctttttccatctctctcctccagcactatcctgcatcttgtaatgattctcttgctttaccatatacttttgtatatgcatgtagccatcaacattatattgtata

SEQ ID NO: 54313 - DNA, 1038 bp, Homo sapiens
gggcctcagtcttctgacagggtgttttattgtagtttgctgttgtcatgaggtcttcattcagatgcggatatattaaggtcattttgctttgtctgaggatctttctgggttttcatggtagagattgagatatgtgggacaagtttgatcttgtatcaggttagaggacatgttgcttgccctgcttcagagaagagccaaagctggcaggaatagctgcaaaagtatgctgcacttagatctttcaattagtaaattagagtaagatgcctctggaagtcttccacagagttattttaaacttggggtcgtactgcttgtgttgaattaactcaaggttctctctcaaggggcacatgaaggtcttcctccactgcttctgcttagttcaggccttcatcttgtgcttggattattatcgcagcctcctttgcttccaccatgccacatccaaatgtcacatttccaagggcctgcgacccatgtaggcacgtaaggccccgtgcgtagtttagtgctctgctgttgtcatcttgaaattcttcattttccaacaagaggaacaccttcaatttgtactagtccctacgatttcagtagctggtcttggctctaggaatagcatttctaaaactatctatttaaaattcctcaaagttcacgctccatatcctgcccatctagcaccatctcttagtggtgggcttttctttgactgtcagtgcttgaagaagttcttccaggtataccaaagggccccacatctctgcaacatttgctgttgctgtttccttcttctcatttcccctacccaacctggttcacttctattcatgttttgaaatgctgaagaaataaggttgggctgtgaaaccgaatatgaccatctttttttttttttttttgagatggagtcttgctctgtcacctaggctggcgtgatcttggctcactgtaacctccgcctcttgggctcaagctcttctgcctcagcctccccagtagctgggattacagataggcacatgccaccac

SEQ ID NO: 54314 - DNA, 1048 bp, Homo sapiens
gagagcatggacccgggtgctgccagactgcctgacttgaatccccgctctgccactttctggcagcctgtgtgaccctgggcctctggttgctcatgaaacacaaattagcaaagaggggcaaagtgagcaaatatatgtaaagtgcttaaaagagtgcttgccttatataagtgctgtatgagtgtttgtcattattttgtgactagtgtacaggtcctgaagttttttgggtgggggtgactatttgaagtgttcacttcaaaaatagctctaaaagtatttagccaggcagaataaaagtcagtttcagttatggaatgttttctctatcttttcagtgcttgcttttgccatgacttcctctcagggttgaataactgaagttctttgacatcataggcctgttttagtgaagtacgtcatcctcccaagtgatttggttagtatttttctccttgaaaacccatctggtcactttttcagttgcgatttttctttaaagctctggaataaatccatttggcaaggtgtggagtgcgagggatgcctggttcctatgttcagctttagactccttatgttacacaggcacatgctctgcggaggacgtgcctgttgagcgtgctaaaggtgattgaatgtggaaaggtcgaaaaaggcattctgatgacagatgactcatcatcttggtccatatggctgtagagaggcatcctgcaaatggtgggtggaaatgagtagagtggatccaagccaagggaaccccaagtggggatgtggggaggggagggagggtgagtgttctgtggtttggtcagctttgctcttgctaaaaaaaaagttcagcactaccttcccttcactgtgctttccagttgggtaagaaatattcttgttttgttttgttttgttagagatggagtctctctctgtcacccaggctggagtgcagtggcatatcttggttcactgcaacctctgcctcctgggttcaagcgattctccttcctcagcctcctgagtagctgggattacaggtgcacac

SEQ ID NO: 54315 - DNA, 1033 bp, Homo sapiens
gttcttgccagaataaatgccattatctgtatgtttcagggagttccccaatttgatcatttttgtgtgtgtgtggtgtgtgtgtgagagagagagatactgcagtaaaacatttctaaaggatgaaagctcttgtatggcatagatatgaattccttcctctggtaataattaggttattcccagaagcacagtgtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgagatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttctgcttatagctagcgaattcatttgtttgtatagctttttatacttgataatataaagtttcacaaatactttcattgatgcgtctctgcaaccactacattaccaacaatgttgtctccaatttgcagaaaagcaagatcttgaaccaagaattattatccccagtcctgttttct

SEQ ID NO: 54316 - DNA, 1046 bp, Homo sapiens
atggaatgtagtagattgtattaaatttaatgacatccgtccagtcccctcctttttttttttttttttttttggagacagggtcttgctttgtcacccaggctggagtgcagtgatgcaatcatggctcactgtgcaccctcaacctcctgggttcatgtgatcctcctgcctcagcctcgttagtagctgagactacaggtgcatgccacaatgggctaatttttttttttctgatttttttttttgtagagacagggtctcactaagttgcccaggctggtctcaaactcctgggctcaagcagtccttccaccttggcctcccaaagtgcttggattacaggagtgagccactgtgcctggccactttcccttcttttgggaggattttacaacttggccccattggcttcatgcttggacatatggtttgctttgaccagtgaaatgtgggcagaaatgacgtgtgccacttctgagcagaagttttaggagctagggcatggtcaccattcttttcctttgcagtgagactggcgacctcacagagctctttcaacctggatcctaaagtgaagacgtggaccagagatgtagccaatccatcatagatgagtagtgtgcattaaaaataaacctttgctttataagccactgagatttggatagagtttattttcacagcataacttagcccaagctgactgataaaaccgggcctaagactaatatatcttgttatccagttataactttaattcttttattatgcatttttactctctcgggatgcaaagatgaatcagacccagtttttgcccgagacttcttcacaatgtactggaggagatggccatattattagattgctctatacatgactgttggagttgatcactgcgctataaaggaaacaacagaagtagtaactctcttggctggccaagtagagcccatggaagagctaatatttgagctgagtgttgcatgcaaaagggaacccaagcagatgaaatggtaggcacaagaaagtctgagcatgca

SEQ ID NO: 54317 - DNA, 1120 bp, Homo sapiens
tttttcctgatgccctccctcccctgccctcaccaccacgggccccattgtgtgttggttccctccctgtgtccttgtgttctcattgttcagctcccacttataagtgagaacaactggtgtttggttttctgttcctgcattagttttataatttttaaaaccagatctttagtgcctatacaaccatctccgcttctgcgttcctgacctagcgtttactcacagcttcccagggctcattgccatcccacacctctcttttcttagataggatcttggctgctcactacattcctctactatctatcttccccttcccccataagccctggggataaagccattataatatctaatgttacatgatacttgacatcttatagaatagttcaactacaggattttgtttagatcttgacaatactcctggaaggagagagggcagatgttatgtatttcccccattttatatataagggaaggtgaaacaagcggcactaagtgatatgctggaggtcatgtgactggtgagtgtcagactcaggcctgcctacctatacaacatgctttctgccacatctccctccacacatgaaaaaacatgtttcaatagctatactcatggaagagggaagtaaaacgaataaatattatgcaataaatctatatctcaattttatttgattttttaaagttaacctgaatttcttatgatgatgttaacatcactttgggcatctagaatcatacactttgacatcacacaggctatgatttaaatctgccactaataaatggcacattaataaactgtgtgatatcagacagcatccttagtctttcaaaaatggagttatatattatctgaaaaatgaggatgacaattcctatgtcatgtaactgtgatgattaaatgcatttctggtacatagaggttcacaaagggctggttatttttaaattaatattaggtttactattgtatgtattaatattaataaaacaaaacctaatatggttgaaaatctagactattcttagaaaatagtctagaaaacctagaaaagtctagaaattattagcaaaccataatattaatatggctgaaaatctggac

SEQ ID NO: 54318 - DNA, 1058 bp, Homo sapiens
tgggaagacacaggttggaactagagtcagtttccatcagtagatagtattttgcagaacaatttacttggagaagaaagaggacagaatttctgtcacgtcgatcagtggtttattctctcactgccattgtctagccatatgtccctaaaaataagccacattgaatggatgtaatgatccctacccagcctattcctaaggatattagagagatcaaatgagaccataaaaatgaaagggctgtgtaaatacaaggtttgttagccaggctctgggaagtaaccaacactttgtcagagtgggaaaacctcactgacccacaatctttgggtctgtggctctggcccttctcctaccacctgttctgcatacaggtgcatgattgtagagagctgtgcttctccaaggttggtctccagaccagcagcatgagagcagcagcatcagcatcactcaggaccttgttagaaatgcaaattctaggcccccatctcagagctaccagatcacaaactgaggggtgggaggatggggagggataggaggctggaacctggaaatgtgttttaataaactctgcagtaattctgacacatgctaaaggttgagaaccactgacttagtaggatgagcaagggttttacagccagcaaatgtgggtttaaatctcaactctcctacttgccaacttgtgacatgtaaattactagaccgtcttgggtttccaacctctcaccactaaaaggaagaccgagtgtggtgtagcaggtgaagccactctccttccttcccatttcctttacaggactgtgtgagaaataaatgacatgacgattctggactctgctgtgtttagctgtgtgtctcctttggcaagtctccttgcctctctgcctcatttttctcatctgacaaaacaaatggcaagagttaatgtgtgcattgcttttgtcacactatgtgccagccactgtcttaaagagtatgtgattttattttattcttacaataaacctgttttacagctttcattttacacataagaaaaactgaag

SEQ ID NO: 54319 - DNA, 1078 bp, Homo sapiens
aacctctgcctcccaggttcaagcgattctcctgcctcagcctcccgagtagctgggattacaggcccatgccaccacgcccggttaatttttgtatttttagtagagatggggtttcaccatcttggccaggctggtctcgaactcctgacctcaggtgatccacccgcctcggcctcccaaagtgctggagttacaggtatgagccaccgtgcctggccggtatttagaatttttgttttactttgtactgggaagagccttgggttgggagtcaagattggtaggctctggcttgttcagttataactcatttgtgacctaggacaggactctatttctttgggtctcagtttctttatcgctaaaatggagagctattagactagattcctgtttttcagattgtgagtggtgagaaagcaacttagtgagtcttaggcaacattttagatcgatgaaatagaacagaaactgtcagaaatcattgcacatagcagaggtaactactgtttcctgaaacttctgttatagatatttatctttatgcatgtgggtataagccgtattctgacatcacatcggtttttttttttcctgtgagtttcagtcaaagaagtttgaggaacactgaaataaatcatagctcagtaatggttttcaaggagtctgtgaaatgcagctttatatgcatatatatacagacagagagagagagaaagagagagtcaatagttttcctcagatttttaaaggattctaagactccaaataggttatgaattactgtatttctaaggtcccccaggccttttccaagcctagttctttgagagcaaagtatccctttagggctgctgggagatgggtatgtgttgacagagaccagataagtgtatggtgtgaggtggtgtgtgtgtgtgtgtgtgtgtgtgtaggtgtgaccatagcaaccagaccgtgagagccattcctgggtcccaaattaccagttggtgtcctgaatatgagacataaaaacactaaaaattagagtctctgtgttgaaaaggaccacaacaaaactattaaaatatta

SEQ ID NO: 54320 - DNA, 1051 bp, Homo sapiens
acttgtgttttagacaccagtacaacacacctgaatcataaaatctatatacaagtgcaagtagctacctacttaattatgttttctaatatagtcgtctgagcatttgcatattgaaatacatgttgctttattgtaaataacttatttcacttctcttttacattacagttgaaacgtatatgtatatatatatacatatgcatagtttaattttgtgttaggttatttcatctttaaatttcattttgagatactaaacaagaaaatacaaaatatttttatatgttactcagagtttaaaaatgacttgatttttacccctgaatgttttaaaataatttgaaccaacattaaaacttttggagactataggttcaataaggtatttatggcttctttaataaagattagagcagtctgcaacaatgagattgagctgagtataaattaccctctttaaagggcagatatactgggttataagggttataaatctctaaaagtgatgttactggtcgttgattatttttatgctattgttactgccacttacatttttattttttgttttactattattatttttgagatggagtcttgctctgtcactcaggcaggagttcagtggtgcgatcttggctcgctgcaacgtccaccttccaggtttaagcaattctcctgcctcagcctccctagtagctggaattacaggtgcacaccaccacacccagctaatttttgtatttttagtagagtcagggtttcaccatgttggccaggctggtcaccaactcctgacctcaagtgatccgccacctttggcctcccaaagtgctgggattacaggtgtgagccacttggcctggcaaaatttttttaaaacattttatttatattctctcagcaggacaatcttcctagcataactgttgagggcccctccagtctcaggttttgaccttgttttttatttttttttattaacttaaaaaacattattattttttcatttttatttttgacttgacgataactgtatatatttatg

SEQ ID NO: 54321 - DNA, 1581 bp, Homo sapiens
aaaagccaagacattgacatttgcacaatccatagaacttaaggtttcaccagtcacacatgcactagtttatgtgtgtgtgtttatgtttgtagctctatgctatgtactatgtgaatacatgtaaccttaactaatgaccacggtgatcaagatgctcaaatatcaccacacactctcttgcattacccctttatggccacctccatttcccggtccttaacccttggaaatttagtctgttctccatctttataattatgttatttcatgattttttccagaaatgaaaccatgaaggtatccccaagattgccttttttttactcagcataatttccctgagttgcatccaagtcgttggatgtacaacatgcaccaacagtccattcctttttactgctgagtagtattccctaaaatggatatagcataatttgttaaaatatttatccattgaaagacatttgggtggtttccaattcttagctactaggaatagagctgctgtgaacatctgtgtacaagttcctgtgtgaaagtaagtcttcatttctttgggataaatgcccaatagtgcgattgctggattgtatggtaagtccattttcaattttgaaagcactgccaaactattttccagaggggatataccattttaaattccaaccattattgtatgagtgatccagtttctccatatccttgccagcaattggtatagtcactatttttctttttagcatttgtggtgggtgtgtagtgatacattgactttttgccccttctcctaccaaacaaatatgttaagttttgaactcagcttcccaactctcagtggcctggtctgtgatttccataggcctctatacttctgacctcctcctacctccatgaccttgacctgacttctctttcttctctccccagcctgggtcccggggtcccctttttacctcagaatcgctttatctcaatcctgccatcttcccaatgcctggagaaagtcacaaaagtgctctccactgctgccaggcctctgatgttacagctcctgggcagtcctttcctttacctcagtgatgtcaccctcccacttctgacaggctctgctccatacagtgaggtcttctctcagagaggaccttaccacctctcaacaagagtgagactgttcagtctgaagcccctcagcatctcctttctccatctctgcctttctgtttcttgcagaagccaactcctcatgtgtgcttatgttcccagagagcctccagctccccagggtagggatttatcagaggagtctattttcagacttcccttcgtctgttctccttttcctcagagtgtccttaatggaacacccacacctctcctctagtactgagtctgttgaatcaggatctctggaggtttgcagggcggagagtctctgtttttatcagtctcctcaaggcctccagtggggagtcagattcagagacggctgcctcagggaccctctgggcccctcttcttcacactacccctcagtagtgttttccccaaattttggagaaccaaattattttgttctgg

SEQ ID NO: 54322 - DNA, 1050 bp, Homo sapiens
atacacagtagattttgaacacttaggtggaaaaatatataaaatatcttattgattacatgttgaaatggcaatatattgtacccattgagttaaataaagtgttattaaaattaattcacttgtttattttttaaattcacttgtaaaaatttattttggctgctggaaattaaaatattacacatatggctcacattatatttctgctggacaatgttttgcttaaaaaatgttctctgtacaatatagagtacagcataaatgttagttatagccagaaaaaaagtataggaggtttagttgaatatgtaaggattctaagtggtagcatgatgcttattatttttgctacatttataatgtaagcttttatttaggcatctgaagtttttctttttatgtgttatagagaagtagggatggaagtgctaatccaattatgtgaggaaatcataataacttcagtgtattgagctacagtgatgcaggcattgtgttaagtactgtattaggcaggattcctttgattacaagtgacagagatgcaatctgaattaactaaattgaaaaagggggatcttgtaattgtatgaagcatgggagtgcatctgggtctcctgaatttctagaatataaacactgtttttcctatatacctatcttcctctctcaaatttacttctccctcctcagcagcattgttctctcagatcacttgtctccatatgtcagaaagaatggctccttcaacctctgtgtgtcatctttgctctagggaaggatagactcagacttgctctttctggttttaaatggaaaagtcctgtgaaaaagccatggttgacctagcttggttataggtacctatccctgggctatggcagctctaacccaaccacagaagagaatttcccagaaaaagggaccattcttcttggttgataaaagaataaatgtacactatagctactctagctaatttaatatgtacagccaatcagtagggtagtacctcaatgaacaaatgagaaactgagactcagaaaa

SEQ ID NO: 54323 - DNA, 1285 bp, Homo sapiens
cacccaggctggagtgcagtggcatgatctcggctcactgcaacctctgcctcccaggttcaagtgattctcttgcctcagcctcctgagtagctggagctacaggcacgtggcaccatgcccagctaattttttgtttgtttgtttgtttgttttttagtagagacggggtttcaccatgttggccaggctggtctcgaactcccgacctcaggtgatctgcctgcctcagcctcccaaagtgcaatttccataagttgcccaaaccattttccactgaccacacttagtaaggcaggtcagatctaaggaatgacctaaatgtccttcagctttcactttgatcagtggaattgcctctttaggctgcctcagtggccaaagcatgatcagaaagatggaggtttgaatcctaactgattgttgtgtaaccctgggccagttacttaacctctccaagtctgcctcaaaataagaataaaatctttagatttaaggtaggtaaggcacctggcaaatgataaataatcaatggcagttattttgttactattagagcatcaaggaaacacaggtttcatgatattgggttatcttaaagaaaaaaaaaaagccctacctgggaaatttgtcctattttctggaagacccagaaccccatcaaacaccaagaacagatatccccactcctaagaaacattataggaatagttcagattttcttctgttaaatgtcatccatcagctcacccgattttttccagcagacctcctcttctatcttgtgtgttgctttatatgtcgctcttgacagctgctactatttatgcatgcatttctatagcaaaaccttgattaactgggacacagcaaactgtagcacttaaatgactatggttttcccctatggacatcatttggaggagagagggaagtgacaactaaagttttgagaactgaagagaatcatgtaattccacatcttcgattttactgctgagagaaggagaatggatcaaggccaccctgctgattaagagcagagtcaggagaggattctcggtctattttgctttcttctggactgtggcctaaagatgtgtcttttggcatctctcttgggggtatttctccttaaggttttgccactacactgcaggtctcaaactcaaatgcctgcaagggctaactggtaataggaatgagtggaggaggctgagtattctacattgggaagtagtagtgaactatggtcctcagactggagcctatataccctctgtaa

SEQ ID NO: 54324 - DNA, 1074 bp, Homo sapiens
gcaaactccagagatagatattgaaaaatacaaaggcatatgtctcatctataatttctttcagcaatatgtctgcaagttgagcaaaaataactgaaagtgctctttttgaaaataataattttcacttttcaaaaatgatcctgtatttatttatttattttttgagacagggtctcagtctgtcactgaggctggttctaaattctattaatccaatgattatagtccagcatttgtcagggcacatgatgaacactaggtatttactgtccctgtgtgtctgtaatgaattaaaagaaaaagtacagagaaagattatttaagatgttatgggaaaagatttactagacttcacagaattattactttagtcaagtaactaaaataattcaatctgacagatttggaaaattgaaagtataaaaatttgttttaaaatttttattgcagtttttcctgccaccattcagattgtttgatcttgttataaatgagcattaactctgatttgcaattcaggtcacaccatacctcatcaaagaatgcagttgggaaagcaactggccaggaagtttaggtttccccagaaggactggaaggatttagaaaacatttctttggacttcttctggttgatgctcttcctacaagaatctgtgtttgggtgatccttgtacaggaaaatgtctcttagtccaatttattttatgtagaactgtgtagagctagagcttcccggaaactttctgagacccaaatcatctggactgaagtctcttagatgctattgtttgattttgtgtccttaggtgattgatataaggacagcaagagaaaaccatgtaagatgagaagaaagcaaagctggctttgtgtatgggctcaagtacattttacatgcacgtacttttttcctgttttggtgaggaaactctgtcaaatgactcttgacgggcgcctcacttagtccctccaagttttagtagagaaaatgataatttttaaccaagacttacttgatcttgacctaagatgatgagaatgagcaatccttctgaaatcttattattt

SEQ ID NO: 54325 - DNA, 1027 bp, Homo sapiens
atgcctggctaattttttttttttttttctttgtagagatggggttttttgccatgttgcccaggctggtctcaaactcctgggctcaagcgatctgaccacctcggcctccctcccaaagtgctcggattacagacatgaaccaccatgcttggcctgttcccatttataaaagtggaatcataagagctgttcttaccacagagctttagttgaggctgaaaacaatataaaaatacatttgcagtttttctttactttgtatcttgccctttcaatttatcatatgaagaaacttattctcagaggtggtaggagacctatcaaaggtagaatagataatgacagccagacttaggtcttctgactcaaaggtttgagtttttccccattgaactaaacttttgggtagacacaatatcaactgattgttgaaatggaaacatttttatctactttgatttcccccctgtttttagataaaagaggggtacatgttcagaggaatgtaatggctttctaagtcaacagcctctcaagtggtagataccagagcagtctcctagccagatgtgacttccagagctctctgccttccctggctcactttctcttcattcaaattattctctagaaaaggttgtcatttaaaggtcatcctgtcatatctcaaaggcactgcactatcccaatgccgaaaaccccctatttctcttgtgtgcaccccacttttcagggaaagtagaaccacaaaagtagaactttcaatattgagctgctaaagtgttccaatattgggcttaatttaccaagttcataatgacaaactgaaaaagagtagtccaattaaaatctggaaacagatattaatactttttaaagaataagtataatgataggtaaggatttctcttttgattctcactttttaggctttgttctatatatttaaatatatagaaattcacatatataaataaacaaaatattgtatatattaaaaaaaaagaataaggataatgaacaa

SEQ ID NO: 54326 - DNA, 1529 bp, Homo sapiens
gaataagatacgtcaatttaagtttcaaatttcaaatgcttggagactgccagatttcatagatttggaaggggaatccctggaaccaaatctcggaaagttggccaggtagccaatggtggacactttctgtgatggagctttagctactggggcagtgtctttgaactgttctcatcagtgcagagttctttttatttgggcaaaatcagcctttctgttctctagatacaaattatgtctaatccttctttcacatggtagcccttagacaacagatttttgagaacaggtactaattctctcttagtcttaattttcctcttttctaggccaatcaaacctaagttccacatgcttttttctctatataaaatgatttccatataattatcctaagctttgagaataatgttttttttttttattattttgcacaacaggggttttcaccaatttttattataaaaggttaaaaaagaattaaagattacagaaaggaataaaatgagaaaagttaagtattctctcccctccctgatcatttaggtccttgcctcagagataacttctactaaaagtttctggaaggactttcaacgtacaacatgagtgtgtgtaaatatatatgctttacacatatatgtatatgtatgtgtataccattagaattataataaaatacaaattcaaagtttaaccatgttcatatatgtacattgttcaataatgcttaatgacaaaaatagctacaatttaattattataattcagggattatgctaaacactgcatatggtgtcacatttaaccctcataagaatcctataaggtaaatgatagtaacggtcatcttatagttgaataaactaaggcacagagaggttaagttgcgtgaggttacacaggctctacttattctatattgagtaaaatgccatagagaaatgcccatacgattgcaaatgaagaatttagtggtgaatttttttatttgcttctttctctgaggcaaggaaaaataggagtgattgagagaaccaaaatgagttcagttgttttttaatcccatgaaagtacaaatatgttttctttacttaaatataaagaatttaaaaacactggaaatgaaaacagcaaaaacagcattgaataaagctgattaagacttgatacggcactgagagaacaatacaattgatgaagcattatatatttttggaaaaatatattgcaaatgaaaatggatccccactgctcttaggataaaatccaaggtattcttaacaggacatcagaagccctttgtggcacctgtgaaagctggcccaacaaaacttgttgtcgctccactggtagatcccctccccagcctgcacctccatctttatgtttttgcatacactgttctctcaactcaggccaacttatcccatagacccctggacacccacttttccaggttatctcctattcattcttcagggtttagctcagatattccttaatcgcaggctgcatgcaatggt

SEQ ID NO: 54327 - DNA, 1085 bp, Homo sapiens
gtaaaacataacttgaagtatattttattaaaatatgtataggaatatttttaatattttattcaatataataaatataaatattgtatttatacagtattcccactcatgatcctgaacaacttattattcctgaataagttgttcaggatcgtgtagccagattagtggcagaaatagattcaaatccaaaactgtctgttacaaagttcaccttttttgctctgtctgcaagaaggaactgcatctctagggatctgttttaatttcctgattcttccaagacttagaacatcctctagggacctgtatccaagtctagttcttgactgaaccctctagttaggtagctctggactttggaaggcagccattctattgctggacaagaaacattgctgggatgtttattgatgttcagtggaaatctgcccttcactctctcagttctgtatctaggtggcttgtagttctttcccttggtgcaacatacattcttttgaatttataggtccctcatgctgtacctaaaagggatttttctgggtttacctctttattttacagatgaagaaacttgagtccaaagagagaagccctgtttaacttactgcccttgagttacttgaaacctaatcttgcctttctggcttacctttctctttctagctctttcagtctttcctcatgagatgggttttctttactttttattaccctagtcattctccttatggacactctccagctggcctgtgtgcctcctatttttgaagctgacctcaatattccaaattcgggttgattgcatggagttcaacagaggatgtttaattctgcaaacaatgatgagatgccactatgtaccaggaacatgttgcaatcctctaccatattctgcctttctttttctttgtgcacattgtctacaatatttatgaggctagaggtttggttgcatatgtcacaaaggccatcataacagtggcttaagcagatgaaagtctatttcttttttttttgttttgttttgttttttgagacggagtctttctctgttgcccaggctggagtacagtggccca

SEQ ID NO: 54328 - DNA, 1070 bp, Homo sapiens
actctccctacctcattacctccccaaagctccacctcctaataccatcacattggggttaggatttcagcatatgaattctggggcatacaaacattcagtccacaacagatttatttctacattgaatgaagttgaatctggtgaaggttctttattttatacgaatctaggaacatactttgcatgagatacatatatgccatatcccaacaagcagcatttacctaacctgtgagctcgttacttccagtcctaaaccaagagacttcaactattaattcaacaagtccaaaattactttgaagattatattatttttcaccaaatatatacaaatcaaattgggcttctcagattagaatcaattttattctaaggataagtctttccttgctgcctttgatttaaaaagctgaaacaaattttggttttcaagtgaataatttttaaatgaaaagcacccacagttaagaggatttctcctctctctgtctcttaattgcaaattctgccattttcaatggagaatggctgatttgatcatgttcataatgattttatgcattttctttgacaggatggacgggcggcatcatcaattctggttggtgctatgttcattttctgtaatctctactctactcctggcccagccattcgattgctatatgcaaagcgaccaggaattggactttcaccatcccataggaggtaaagtaagctagatgcaggctaggcacagatgtagtctaattggtatcatgtactgttttaaatctgccttacaaatcctttcataagtttcttttactttatctctgtattagtccattttaatattgctatgaagaactacttgagactgggtaatttataaagaaaaagagtttcaatggattcacagttccacatggctggggaagcctcacaatcatggtggaaggggaaggaggagcaaaggcacatcttacatggtggcggggaagagagcgtgtgcagggaaactgccctttatgaaaccatcagatctcatgagacttattcactatcatgagaacagcatggga

SEQ ID NO: 54329 - DNA, 1121 bp, Homo sapiens
cacaaaagataccctgtacctatagcagtcacttcctattccctctcctccatctcctggtaaccactgatctacattctgcctctatggatttgtctatttgggacattttatttaatggaatcatacaatatgtggccttttgaggcttccttctctcacttagaatgtttttgaagcttattgtgttatagcatgtgtcagtacttcattatcttatatggccaaatattattccattgtaatgtcacaatgtattaatcttagttgataatctcagttaataatcatcagttggtgaacatttgggatattgccattttttgctattaggaataatgtggcaagtaattgtgttttgattcatcacatattggctaagtgagtgctttgtgccagccattgctgaggtttttaggattgacaagagtaagactatgtctctgcctttaagggactcaatttcacaagggaaatccatgcaagtacaaatatgcatgataccatattagagggaggatgaggtgttataatgggagcagtttgttttagccagcagtggcctagaaaggctacagagagaatatgaacttttaagacatgccctaaaggatgagttcattgggttggaacagggcatcctgggtagaaggaatgcaatgagtcgaagtatgcctgtgtgcaagaacatagtatttagcggatgagaaaatggtttgccaaggcagagttcaagtagaggagaggctggaaatgaagctgagcctattctaactggggaggtcatttaatatccatagtaaacacaaattcagatattgaaacagttgaaggtgcatgtctccccaaaatctaatcttttgatcagattcccttttcgctgattgattgtaatgtgcttctctcatgtatttttaggtgaccaacacacagatattccagcttcagtttcacactggattcataccactggacacaacagttttaaagttcaccaagtaagtactggttgggccaaaagtctatttgaatcaaattagctgtgaagtgctgaggctcaatggcaccaggctgtagcataccctggaatcctgtgctgctgaactactgagtgtcactca

SEQ ID NO: 54330 - DNA, 1080 bp, Homo sapiens
catagtgtggtctaggtgaacgcagttgtgggggtggctagagccgggatggagttgctggggccaggataggagtagatgttcaagggctcaggacagtggctgtgggcctattgcactattttaataatggattttgccgtgccagtcacatcagccctgctttccagaatgcttttacatgcagtagcattcaaatttgttgagcaggcattattctcctcttttctctagattaggaaactgaagctcagaaaagtaaagtaacttatctggttatgactgagtcttttttagaaatgagacttagatttaacctaagagtcaacctaagatgacttctgtgccaaacatcataccagttccattgtttttcactgaatttatcttttttaaatccctatttaggcctgagttagatgcatgtgatgtaccagaaaaatatcctcagctatttcaggtgacactggatgtagaactacagccccatgacaaagtaatagacttaactccaccatgggaacattactgcacaaaagatgtcaatcccagcatcctcttctcttctcaccaggaacatcaagatacgctggccttaggaggtatgagtcacctgatggttttgtttttcaggatgaagcctctctgttatttatttcctgtgtctcattgatgctacatggtctttttgtcttgcaggacaggctccaatagatatccctccagacaaccccaggcattacggacaaagtggtttctttgcctctctctgttggcaaggtatttacaagtgtttctttaagtcacatggtttgatgattatgtatttcttctgtaaagatgttggccctagaagcagactacattaaagcagcacttagaggtcattcaatccaggcacacggactcccacctgtaagcccagcactttggaaggccaggataggaaggccaggagttcaagaccagctcaggcaatatagtgagaccctatctcaacaaaaaattttaaaaaattaggtgggagtggtggcaaatgcctgtagtcctagctatgtcagaggctaaggcaggaagact

SEQ ID NO: 54331 - DNA, 1052 bp, Homo sapiens
atagagatagcaaatggttttcaactcaaaaactgattttggttgatttgaatcgactgtatggactgttatgttttggttctattttgttttaacaagcatttagatagccaggcactgttctaagcattttaaatgttaactaattcattttcaaaacaagtccataaggtgagtaatattcctaacaccatccccattttatggatgaggaagttgaggagtagagataataagtaacttgcctagattacatcactaataagtggcagagctggaatgcaaacccagggagttggggtccaaagtctttgttcctagccaccatgctcggctgcctctccaaacaaattgagaaagattaagaggctacaaccagacttggagagaaagagcaaagtgattgactaaaatatcaacagaatatgggcagagaagtggtagcatgcatgaatttcaagtaccaaaccgagatcccagtgccaacactgatatgagttagttataatctggagggataatgagtatcctcatctaaagagaaggtacagtggaaatggaattggatttggcttcatgatccagcctccagttttaaccttgccacatatatgattctggacaggttcattttcttcatctgtagaatggatgcaacagtctcttaccctactcacagggtaagcaagcatgagggttaaggactgaatgcatattaaaaacaccttgaagactccagatgctgtgagataatgatacagcattatgtttaagaatgaaaactgtaatgattttcaaaaattatattgcagaagggaaacaaaaagcagctgattttgaagacctactctctggtcaaggtttcaatgctcacaaagacaaaaaggggcctcggacaatagctgagatgagaaaggaggaaatggccaaggaaatggatcctgagaaattaaaggtgagtgaggcccctgacgcagcttgattatcctatatgacaaagtcatgtgataaagtcatgtgtatggagctatcgccatgagagtaacctattg

SEQ ID NO: 54332 - DNA, 1032 bp, Homo sapiens
ctcagcattctacctggggaaatggaaaacagaggccaccacccatgaaggcataacacccatcacattgtctgagaataggattaatgagcaaaagttatgataatagagttatatgatggtttaatggtttctagatttttcttggaaagatataatttgagcagtggctttatgcagactccaagaacaaaaccaccaggtatttttttttaagtaaaaatttactaaggcctttagcataatactgtaaatgtcttttggtcaagagaactaacaaatataaaggaacttgaaatgtggggagtgataatagtccagtgattaaactacagtccagtgattaccaccaactttctgactaagctaaaaatgaatgaaaatggtggctaaagaaaatagggactctgaagatgtcgaaatctttattcctggttaggaaggtgggccgctacccttctttccctttagaaaactgtgattaattaaataaaaagtcttactactataacaactctaaacctggtttaaatgaaacatctaattttgctgtaaggcttaatgctcttcttttgtttagccaagaaaacattcttagttggaaacaggtggtaaagtagtttggcctgttcacaacttatcaggaccaatatctagtgtggactcagtgttctctaggtttgtgagcagttgtggtaagagaatggaaggcaacactgaataggagttaagggaatggcacgatcacagtgagagagctgcactcacctgcagacccagtcagatggcttgtcagtatctgctctgaggaaccaggtcccacctccccacaaggcaaatctagacccattaaattattacagtgggcttttttgttttaaaagtggttggggatccacaggaacgacattcatacagggacatttgtgaaagcaaagcaagaatgaatgctttcccgatctcagactggctggattcagatcagtgtgttggctggttctcattttaaggggtaagcagtttgctattctg

SEQ ID NO: 54333 - DNA, 1039 bp, Homo sapiens
catatatattaaatatatccacaaagcagatgggcaaaaagattttcatgctaatcttcaaaggttcatgctcaatattgtgaaaagcttttaaaagttgttttgaaaagacaatcattttttgtttttgttttaactttcttgtggcaagctataccggaaaagcggcatgtcaaaaatactttaggttctacatagatctctttctctcttttgttttgtttgtttgtttgttaaagttcattatttattttaccttttactgacaatgtgaaactcgaagaaaatgttctctttttaaatatacagtcataaactgttcaaggtaaccataacaaactaggtgttatttattaacgtattataaaataatgtttgatccagtatgtgcttgtcttatttaaaattggaatgtgagacatgttgctgtgacctgtttttctttctcattcacatttgtagatattgtgtgaactacagtatataatgataacaattaaaaggatattctgtggatgtcacgtattttgaaatgatagaactacattagctttgtatcatgtttggataattcatcaatgttcacagtttaaaacatcattaaacattatgtaattacaatgagaaagaatcttacttaaatttggagattttcccccacatctcttttccggatacattataattctggacccctatttatctcaaaactcttaatatatgcagaccaacaggtctttgcattccttttaaataactggttgtgacaaagcttgttgttgatcagattcactgtttcatcatatttattgtaatatattttttgttttgtaaatatgttacaacaaaatgtgattggtctaaaatatttgtaatgtatattaaaaggttcaaaaatatttgtataaatctaagttatttgggtacttgtaggaatacaatgaggagcttgaatgccaccttctgacatgatttacttttaaggaaagttatgaggagagaatacaaaaagcatgcaccaaaatgtaatctgacagga

SEQ ID NO: 54334 - DNA, 1082 bp, Homo sapiens
ggagaaatgagaggagctagaaaaataaactgacagctagaaaaatactccactgaatcaacaaatagacatttcttgaaacagtaacatgctcaatgtgcaattttgaaaaagtaaactgagcaaggatcatgaaacatgatggtggtgagaatttatacttctcaggtagccaggggaagctaggtttccacagattcctttgtctttcagtccttttgaaaacggagaaaaagcaagagaagagggacggcaccatcaggtagagtggatctcagctagaatgaggggaagtggcccagaatccaacctcctccaaagagctgtgtgacaggcaagtcctatcctttctgcacctctttccttaaatgtaagttgaagcatttggaccagactgtttcaatgatcttctagattgcttttgccaaaacagaactctccattcctgtaagataagtacacaatggctctcagagatctaaaaactggccttggttacctgcaaactttgaggccccaaggcacaaaaataatagctttttttttttatttttttttttaaggttcatgaaagcttcggacacaaaagcttatatggtcttcgtctctataaataaaccagggagtaaagaaaaaccccgctagtttcagtaaagcgttgctattaagcaaagcaaacctatgcaaatatcaagttcttaatgaggagtgtttcctaaggggcctgtcctctggtaccccgcctctcctctgccacagtcatgtgaaggcagacaggcacacactcgcacactagcacgcacttgggagctcagggaacataacactggttagtgagtcggtgtccctctcccatcgattgcaacttttcccctccttccctctcctgcctctccccactttctacatctccgttctcaggaaggctcagggaggatcccccgctgcgtgcactgcgttctgagaggccggggagagactctgggcccgcggtcggggcggagccaaggtcccaacccacattgaacgggcttgaggattacttggagggctcaggatctaggaggagggcccagggcact

SEQ ID NO: 54335 - DNA, 1018 bp, Homo sapiens
ttgcaaggcttcctgtattttggtaggaaaacattccatttctaatctgtcgaatagagtagcatgacttgtttttatattggcttttatatcatccttgaaatttgcacccaaagatatccccagttaacatctgctataaacatgtagatagtatatatacgagtacgcctctgttcactatgaatttatccgagtatgtgagctgttagcagcagacattttatcgttatttctggctgacttttatacttaatatcagtttagtaaacatggtttacttggagagtgtcgactgtgttatatatccatttgaagccaatgccgaaaacagatgaaaagtagtgtctcagtactacacatgatcagaaactaccaaatcatgatcacgtttatgtgtgaatgtgttagaaaattgtgatgtagtgaaaaaaaaggaagtctgaaatggaaacggactaagggaaggaagcattttacagattgttcaacttttattgaggaactactgtatgccagagacttaggatacaaagataaatgagaagttattggtgggtgacagagctggaaataattatattactatgtcagtgtttatgttgggctcagatgcggtgggagaacagatggtgggttggattttgtcctccaaaaagatgtgttcaagctctaattccctggtacctgtgaatgtgatcttatttggaagtagtatctttgcagatataatcaaattaaaatgataactggtttaaggtgggccctaatccaatgactggtgtccttataagaagaggggaatttagacatagagacatacagggagaataccatgggaagacggagacagaaattggagtgatgcagctacaaagtcaggagcaccaaagattgttggcaaccatgctggcaaccactgagtgttaggaagaggcaaggaagggtgcttccctacagccttcagagggagtgtggtggcgctgctgacaccttgatttcagaagtccagcctcca

SEQ ID NO: 54336 - DNA, 1033 bp, Homo sapiens
ttcttgttggcggtcaaggcagagaagtccagactggaggtggaagtacaggcctagttctttaggacctactctgggctggagcatcagttgcggccgggcccttgtggtagtaggagctttgggttgaacataagttttcagcaggagtgcgtggagtgaaaagagagatggggttggatttttggtcaactccaactttaagagattcagaggatgtgattcctgaaaaaagaggaaaaaaaagaccaaaaagaatcaaacagaaagatggttgtgaacgttgagaaactggtatcagaacagaaggaagaggtctgcagtacctagctttgacaggcctcatggaggagggggtactgccgatggtcaggcacagaggagaggagcaaagcctgctgggaaaagatcatctgaatgaaatagtatgtggtatttgctttccatccacacatgggcattttccattaaagagtggaaatgtaaaaagatatgttaaaattgacagtgtttctttgtcccttaacatgtgtatactttcagatgttttttaaaaagcactttggcaccttcctattaaagagtctctctaaatcttctctcaagtaaaaggaagcaatcaaaaatgttcattggcttaattaattagtttaatactaattatgagtattatggacttttttcagaagaaaatttggataagatagtctcctatgcttttgatttctacctttatcaaagaacattgctaaaatgagtagatacctgagtcagtcagcatttatttggctacctccttttgccaagcactttacatagattatctcatttaattcccataagctcaataaggtggcaccattatttccattttacaggtgagaaatcaggttcagaggattagcttctacccaaagtcataagaccagatggtggcagagttaagatttgactcatgtttgtgactcagagctcaagattttgtaacaaccttgatactctgtttctcactcagcagcacaacaagggcaaa

SEQ ID NO: 54337 - DNA, 1033 bp, Homo sapiens; identical to SEQ ID NO: 54336

SEQ ID NO: 54338 - DNA, 1033 bp, Homo sapiens; identical to SEQ ID NO: 54336

SEQ ID NO: 54339 - DNA, 1033 bp, Homo sapiens; identical to SEQ ID NO: 54336

SEQ ID NO: 54340 - DNA, 1033 bp, Homo sapiens; identical to SEQ ID NO: 54336

SEQ ID NO: 54341 - DNA, 1033 bp, Homo sapiens; identical to SEQ ID NO: 54336

SEQ ID NO: 54342 - DNA, 1033 bp, Homo sapiens; identical to SEQ ID NO: 54336

SEQ ID NO: 54343 - DNA, 1048 bp, Homo sapiens
aagttggcccacccctggcctatgtatttattgaattgtatatatttaatatttacattttatatataaacaaggtttcttgtacattaatatttctcttagttggatatcggtggcttactatgaatgaaaacatagagtcagattgtttttcacaaaactgtcactgtattccaggaaaaattaagagttcttggctgtggatatgtaaggtgacatatctattccaaaccccttcccctctctgtgtctcctttctcactgttgaaagaagggctttgaagtagagaatgtctaagggctacttcccacaatattgtttggtgattcttgaaacatactatcatccctctagtttaaaatcaggggtccaaatccactgtttccatcctgagtcctcttgaaggacacattcccttcttgccttttggttgcctagatctgtggctggaatgggaggctttcattagtgtggcttcatcccaactcctgcttgtaggtgctgtctgggcgtatctgtgtgattacagtattgtggtgatatgaattattgtagtgtatatataaaaatgagcagagactttttttttcttaagaaatgaagcataagaaatgtctgatggagaaaaaaagattatttttgaagtactgatagagaaaatactgttggaaaccagatggcaattttttttttataattgcaaaatgttgaaatttgggaggaaaacagttttgttttgtttttgcattacactattaattgtgagctcttataatgaagatcaaagtacatctaagcttttcactagtgagcatatttattttcatgccttccgtacttaaaatttatttattattttattcatttaacaagtataaatggagtacatcattctaggccctggagataaatggcgtttgatcaagactaatctatcagatgggaataagtgttgtgcagaaagttcaaagagggtggtatgttcgagggtgacctggggtacattagaatagatgaccagggaaagttctgcttttagaaaggaat

SEQ ID NO: 54344 - DNA, 1073 bp, Homo sapiens
tcaagcatgcgtgcactcaaaagatctttaccgaactagcttttgcaagacactctactatgttctatagggaaggcagaaatgaccaagttaaaattctgtctttaaagaaattgtggctcagtggtacagaaaacagtaaagtttctagggtatatattatatagtggcttcttaacacaatataagctacctacatagtaattttaaaattatcactacttatctatccctggtagaaatcatcttatgttctaatattcacaattaattaattttttgacctaaacatttaaaatagcaatgattttgaaatagtagtatgtctttcatttaaaatgtaactgttacttttctttttggattttgcctgggtccaactgacagcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtggtaagttttattttctattgttttgcccaaccgttgctgagtttacttcagaggcctgtgtctgggacctccatttcatgctcattacttaggctttatactcaaggccgtgtgtttttagtttctctgttcctctactttagacctgcctaacagtagttcggccatgccttcagagtgctttctttatttctcttacaacttttagccagacgatatgatttcttactttttctactttaagctattctctggaattgttcttaaattcctgcctcttaaatcttacagtaatccacagatactatgctagcagtacttttctagttgcaagatgaagatatttcaaattcttctcctgcaaatgggatcatggactcaactctcaactcagtataataggtatatgttgagggacaactgtgtagcttccagaaaatgcagtgaataagttgacatcttcacttccaagacaaaaactttctttttgtcttcagag

SEQ ID NO: 54345 - DNA, 1067 bp, Homo sapiens
atatctgaatatataatacaaaagtttgatcatggtgacacaaatgttggacatttttttccttataaaaggctctttttttatatattgtacaatatatttggagattcagagcatagtgactatagtcgaaaactgagattgcacttccaaaattggccacaagtaaataatcttatgaagggattctttatcatgtttcaaacaagtgggttacaagcagactttgagacacttttccacagaaacaatactatgaattggtgattgagttcccaggccaagcctccctcaacaggttcaactctaatatacctaacctgtgatactgaaggtgcctgcctgagttttgggtctctgagacagggtagtgtgagtagtttggaggaaggacagtgcaactttccaccccttttcctaagaacaaggtctttctccttttaatttttccactcattttcacctcctaatgcccttgagatccaggtacactcctgggagttttgttcacctctcccaactgagaaccttcccactgggctccatcctccctcctgaggttcttcatattccagagtcacccacccttctcctcccattagtcagttctctaagtacagctgatgtcatgtggtgctgagaagaaagcagatcacacttcatcacagaaagaatgccttgtgattatcttctccacatctgaaattccttttgacacctgcattgggccgactgccattcccatgactgctgcacctgcgtttttagagaatgcctcataacccactgattctcattcacagagaatgggagaacggaatgaagaaagattccagcagcttatagaaggatagcaatattttgggacagggaaaatcctgtcatacctcatctcttcctcaggaggagttctgagctggtcctgcttttcatagttgtttcttttcttccacttaagaactcatagatttttcttactgtcctaaggaagtccttacctctgaggtatctcctcaatgaatactgttttcaaggctgaaatagttcattatgttaataaccttctt

SEQ ID NO: 54346 - DNA, 1024 bp, Homo sapiens
tcttcatctgatatcctttcttccctcattacagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattggtaagaaaacagaggttttgttcattttgttccacaacttgaattttcattatggaccctccttatattagagtcctgttaaagatgtaagaaaaaatttttttcattgaattttttggagtttttgctttatattaatattttaatatgtttcaaatagatgtcaatatcaatatctcatgtgaaactgatgggtacttaactaaaatgacttgcagatggtcaaccagtacaatccagtcacttgcggaaagcactttgcaattgaggtatcataggtacgtattatttttgctgttttgtttttctgtgggcacagtgagataaaaattttctttagaaatattacaacagtagtcttacagattatttgcttcctgaaagaggaaagtataatataatgaatcaggaaatttttgagggattatataaattggtgattcttgaaaaatattcacacctgagattaaaaaattgtaatttgtttttacttcaaattatcttttctgaaaatcaatcaattctgaaaaatttgtattttaactcttgaatgaaatgcaagaaaatgtagtttatatatattttaatttgacttagttgactagaggagaatgtgaaagattataaaagtttcgtatcatttggctaaagattaatgttttggaaaaaagaggtaaaaacagattataagagataata

SEQ ID NO: 54347 - DNA, 1027 bp, Homo sapiens
agacctacagcactacagtggtcctgggactgttgaattcactcaagtaagatacatacatccttgggctgatgaaaacatctatcagtttctctttcctgttattctgggtcccagatcacaggagaatactgtgtctcagcggacatgctcagaggtcagtcttcaatttcagagtggggcaaaatttatttttctatctcttctgtactgtaccttcaattaaataccaataatctataagcatgtatttaaaatgtcaattttactaaaatttttatacatgtaataatttatctgtttctgtgtctctaaagccatgtaaaattatccatgaaaaaaacgcttctccatttatctttgcatagaactaaggctctcgtaccacatcaagtaatgagttgctatcagccctttacctatttcttgtaagggggtcattagttgagtatgtgagatcctgagacatcttaaaaatacttatgacatggaataactttattgattcctgagtggaaattgattataaagtgtgaaaaatatctatcaagtggggtctggaatctttgtcattgtttagaactgctcacttcatagccacaactggactagagatggaatgtagagatttatttaggataacagtaaaattgggagtctcttgtctcggtctaaatatgaaattctgataatttttaaaaacccataggcatatttttgaacactaaagtacttattttgatgatactgatattcttgaaggtcttcttgccactgaacatccaaatgtgcaggtttcttaatttagtttgttgcccaatatgctgtctttgaatttttttaccgtaccaaaagttgaataaataataaacttatgtattaatcttaagttgttaaaggcaaacatgagatctgtgcaattctcacttaatttctcatccagcattatacttctacttaatacattttataatctttattttttctgtcacactcagctaatttttgtgttttttgtagagacgag

SEQ ID NO: 54348 - DNA, 1048 bp, Homo sapiens
gaatttcaacagtatttgtctgatatatttatgaggatcaaataaagtaatatattagaaatgcttactgccatatatggcactcagtaggaatgcaaaaaatgtaagttacatctctataattcttttaaagagttgccagttaattttctaagagagctagataaccatttttattcagttgaatattatcttcttttcaatcatgttagaataattctctagcttcgttttttaaaacaaaatataaaaattgggagaagttgcaatttgggggttgctgtagttatatataacagtatatttactgttatatactgttgtataacagcatacactgctggaagaggtatgttagttcattggtgctctgttaccttgtctttgactgaaggaagggatcttgtatagctttacttgaatagagtctaatggttgtgtgttgttttagaaaaaaggaaccagctagtgaaataaataaagacatgatcaataataattcaattttattaatattgatagtcttaaatctgttcctcttttaaagatttttttttaaaagcttctggattgtctttttaaaaaaagcttcttaattcattgtcttctcaaatatccagctttgtatttacaataagtgggaaccatgttattttgagtgccatgttgtgctaggtataatattattgtatacaaactgcagttttgtccatttaaaatacttttgttttataatagttgaaaagtagttactcgtagaaaatttattccaggtcaacttttaaagtttgaaggatattgaatataaaaagtatgtaattattttcatccaaaataattgtattacaaagatgttgaattttaaaaacattttaaaccaaagttatcatagtgtcactataaatttataatatttttggctgtaattaattgacctttcttttcaattcaatgaaaatcaaaatgtttccatttttccacaatatttataataagtaatgcattatttaattgttattgactatataactattcaaatcctttaatg

SEQ ID NO: 54349 - DNA, 1111 bp, Homo sapiens
aggagttcgagaccagcctgaccaacatggtgaaactccttctctactaaaaatatataaaaaaaaaaaaaaattagctgggtgttgtgacgcatacctgtaatcccagctacttgggaggctgaggcaggagactcacttgaacctggcaggcagaggttgcagtgagctgagattgtaccattgctctctagcctgggcaacaagagtgaaactctatctcaaaaaaaaaaaaaatgcccatttttcagacaagaaaagtgagtctcagagaagtaacttctctgaaggattaactgggttctcaaaccaattccattcaatatgctacttgagtgcctactttgtggcaagcacaatgccaggcactaagagaacaatatagtatgataaaaattcatttagttgtttttcttccatttcttttaacactgccacttcttcctgaagtgatggataacaaagagttcacttcaagtgccttgaaagtcacacgttgtcaagattagcaagggatgtcagcactatgcacatgtcctgagagctagcagatatttcagtaagccttaacaaagctgaacatgagcctcacttcctttctaatcttatctggttcaggcatgggcattatttcatccctatttgttcagtccataaacatttattgagcatttgctatgtcccgggctttatgttataaattgaggatatagaaaaagaggattagtatttgaacttgggatgcttttagtttagaatgggaaaaaatgaaataattacaatacagtatgacaagtgtaataacagagattttgagataataattaacagtaattttgggtgagttgcagaaggtatatcaagaagatgaagggttaaaatgcactttccagaaggaaatgggtaaaggaagtagtatttcctatgcacatagtatatatcagggcccaggccctgaattgagactatatatttattttaatcctgaatccaagaatcagatgatatatagaatttgttcacagtgacaatgtgaaaaataatccctgagctgaatatgtaaatgatattttggagaaaaggcaaccaggtagaagaaacagcatatatg

SEQ ID NO: 54350 - DNA, 1011 bp, Homo sapiens
aagccaaggtttgtcctacggattttaactattccttagaaatttaccaaaatggaataagaggaggaaggtttcataaaaacagcagtgtagcctgtacttatttggcagaaatgaattctttttgctctccctgtcatcatgtcaaacattgttaatgtgatttgggggagtgaagaattctagagtcaaaacccacagattttagaagatagccttaaaagagaggttgggtatgattttgttatggagctgagtcttgtttgcaaaaggctctcaagctagccctttaaatccaggcctaaataaattgagattgctaacactctcagattaaatcattttcattaattcaaaattgatttaatctttgaataacaaggcaagacagagtgttatttatgcacttttcaattaaaagctcatgtggattatcttcttcagaaaaaatatcttgcctgtagaggtactgtatttctccagctcaacttcatatagctttcttaaaaatgcatctgcacacattctgattagatttcagtgttgcatagagaattggatgctctttcttttcacttcttgccttgcaaaccatggcactaaagtatcttctttgaaggttgtaacgttttttgatgctcatgaatgattctcctggtaatatggtctattgtgccatccaagaatgtcagttcaaagctctgtgataagcttatccaggctgcctaaaccaaaatgagaactgcaacaaagacttgtgctggagctgaattagcactattgctctgggtttgccaaatttatctaatgaacaatgttatcttagcactggtatgaattagtatgaattatactatggatacagttgtctttcaccagatcttttgcaagagaaattggacaggtgttcccactggcttaaatagctaaatgaaattaacatttatttctacccatagctcctacttaaatgtttttaagccttattatcttaatagttcggtgacctta

SEQ ID NO: 54351 - DNA, 1046 bp, Homo sapiens
tgaattcttgcttgacaaacaacaattataatagtaccttgatatttacaagtttaacattcagattttttgtatttgtacaatgcgctttaggatcacaacaaggagtaatttgtaggtaccctgagatgtgactatgaatcatccacttagggatgcagaggtttaggtgagggtcagtcagagaatatacctagctcagtgcccagcatccacatctcaacaggtctgttattttctagagtagtaattataatttagggattcttgtccaatgtcaagggtgaactctatttctgaatcagtgaaatagctttagatttttgtacaaatgattgtgacataaggcttttggaattttcccattccatactcagagcagacattgctaataaatcaagtgctctaatcaaatgcagcctgaatcagaattttctgcaaaaggttaattggatgtgatgcttgaaaatgtgaaaattgctcagtattgctgggctttggaaggtctaaagtaaactgcctattttttttccctttaacttgagcctgacattaaactcggatttctctatcctctcctacacatgtttgggtctcttagacagaacatacaaagcattctccaaacacatcagggaactgggtcacttcatttggtctgcacacctctggcaatgggattgggataaatgtttagggaggagtaggtaacgaaaaggaggaataattatcagatttcatgtggagagaaataggtaagcacaggctagacaaaatttccattaggcaaaataatgtcccaaccagaaactcacctattgttaccaaaaacagtctacttcttggcctaatttatgaattgtgccacacctgaaattaacttttgttagaagtggaaatgcactaatctatagaagacacttacactttgtggatttgtgattcagttttaaatacttaatactttttgaattcttccattgtaacaatcagatgccttatatggtaggcctgtttgcatgtcagtttgcctgctggagcatgag

SEQ ID NO: 54352 - DNA, 1942 bp, Homo sapiens
tgcaattttggagagcggcaacttctaatctagactctgcacaacagctagttttaatttttcatttcatttttccaaatgcaatagatattagaggaaattttaaaagaagaatatttgctagatgagggtttcagggagataaaattcttctctgcaaaggggggaaattctctatctgatagaattttagaagggattgaaacaatagcagggaagaattctggggaatgcaaaagagggagtatatgaacaataaagactgggatagagactgcagtggaagcacgaagctgagaaaagacaaagaggactagtgggtaggttccctccattcaccaaggaggggtggcaaagtattttaccaccagcggcagaatatgcttaggaccgaaacttcttgctcaatttgtttatttgttttggtttttttctttagcaaaaatactttgggccttcttagatgtggaaaacttgcccctgggcagagccaaggaaaatcaaggggaaagaaaaaattgaattgctctacaaaaggaagttggaaaattttaagtatttaggaattgcccaggaggggacacgggaaggaggagcatgagcaaggttctggaacaaggtgatgcacagaggggccaggcaatttggcaggtgaaaggttctctgtgataataatggcctgtgatttttaagaatagaaatgtttaaaatgttatctgccttgctgtaatgtaatcctttgttattccatatttattgttgctgttgttaaaatctattactcacactctcttgcatgtggtatttataagaaattgaagaaaaaaacagggaggcaagagcattgccctgaattattggaaacattagtatgaagtagaaagagaaaaaaaaatcagctacaagaggaaaaccacaacatcaagaatttggtataaatacacaatctgaacaagagatgcctaagagggatacaacccacccagtaaaccttgggataataggggagggtcagtgtgtctcagggccggcacgggaggtacttctactttaatactgcaaagtgttacataaggccagaggatttggagctgtccctctgtctgactcccgggttatttggaggaacatgccatgttgcagcaagaagaaactttcaagacacaaatctagtccagagccttcctttaacagatttggtcaccaagacaagagaagagagtgacttgcccgattccaccaaggtgaaggggaagaaagacaactaccagatctcctgactgtgaccctggctctccatccactcggctcctatctcttcacaagggaagactgtgctttgatgatgttttgggaaagtgctagtgatttagagttctccagcaggctgattggcttagcagctgggaaattctgaatcacatcggatggaatgttttgtttacttcctcccagcagtgctaaaggggagaaagagtttgttcccccacccccctccacccaagtaatttgctggaagcagtaaataatttcccagttcatctgatctcccttctaaccaatgtcttcctgtggtagttgaagagaaagaatatcatttgaaatacttgacttattttcagaagctagcaaagagaaagatgaatgtctcttccttaactcttagaaagctactatcccttactgttaggggcaaattgtaacgcagaggtcctatctagggcagccagtcctgccatgaatagatgtgtgtccagagattgttaaacccagactgtaagcaatcatatagttcaacaggtcagaagccctttcttaaaccaaattaaagtcaacattcaataaacaaaaactgataaaattggagcggcttagattgaagttaggagttgaaaacatcttaatcttccccttaccctgctgtaatagtctctgagacaga

SEQ ID NO: 54353 - DNA, 1035 bp, Homo sapiens
atgataatcgcctgtcaaatgaatgcctgcagagtggatcctttctctgtgcatgtcctcctcatgacctaaagagagagaaatacagaaagaccatttttctaccttgcattgtttttctcctatcctataaatctcagagatttgacttccctaaaatggaaagataatcacagttctaaactcccaggtgacagaaatatgctaatatttcacttgtaaacaccaccaacaaatggactctgtcattaagatttaatgatttttagcatagctgggatttatctttagagaaacactgagacttgattcctttaatgaactttttttcccgacccagcaatacctaatttctacctaattgctttgtgttgatattcagtttagttccttgggttcctccccgaaatatgtccttatggaggttgctcccaggctgtttagctgcaatgcattatgttgtccttaagtcttgaattcaaatgcttgaaaacatgcacttcccttttgtttttttcactcttagggactttgtgtatcatcaacttatgatagtagtttcaagctctctgagtgattttaagttcataattttcaggtaaaatataacccacaagactgaatatgcagcccctacataaaagggtctcctcttcagtgtggtgctaggatattttaaagagcctacaacagagagaataaaaatttgacatgagtcatcaactaatgaaggacaactacaatgcgatatatccataagatgaaatattattcagcaattaaaaggaatgaagtactgatacatatacatattataacagggtaagccttgaaaatattgtgtcaagtgaaaggaccgagtcagaaaagatatattgcattattccacttatagtaaatgtccagaataggcaaatctatcaagagagaaagtagattaatgtttgcctggaggtgggagggttggggggaaatggggagagacttctaattggtgtagggtttcttcgtggagtgattaaaatgttccagaat

SEQ ID NO: 54354 - DNA, 1194 bp, Homo sapiens
ggtctctgttctggacctcctttcccactcagttcatggcatgtgcttacagcctggatccctaggtctccttgattaatctggtcaagtatccaggtctacatcatataaactccttaaaagaatgtttgttgtttatagactgaccctgaacaatttcttttaatttacgtgtgtctcggtttgataagcattctctgcttttaacctaatctaaccctgatgcttaactaattaatttcatccttcccggcttcttattctgaccacaacagggcctggtctcatgtaaatgaaggacaaagaggaaagaggttcatgggactattttaactgatgggtgttaccttcatttatttgtattatagtgacaagtgtatttatcctatttctttcttgtaagcatgattccagggatttgtttttctatgtaaaatggggctttgaacataggaagtgctcaaatggttaataattggaatagatacactaattatcagtttagaagagtgatactaatgcagtcctgtgtgtgtgtgtgtgtgtgtgtgtgtgtgtgtgtgtgtgtgtgttgcatacccaaaaagaagaggaggaggaataggacaatgacagcaggctcaaccataggttacattttgaaatttttcttttttcccttctttttcactttccctttctataggaagtcaggattcaagaccagatgtttaattttagcaccaaggttggtttctatgaatcattgctctattaaaacctattctaaccaaaatatctcaatgttatttagaagttggtgtgactttttaaaaaatttacctcttgcagagatatttatattttaatttttttccatttttagaaatacattcctattactactggtactgggcattattgggggtagaaaatatccaatgtcatgtaataatagttccccagtcttgtctatcaccagagtcacatgggagctcctattcctgagcccatccctggagattctgagtcaggatatctgcaggtatctgcaggaactggaaatttgtaactttaaaaagcttccaaagtggggctaatgagcaatggatgtaggaactggggtgaaaagatcaggtcctattcattaggagtttataagctgctcgggaagatcaaatcatgagaaatgctaactcacaagcttgaattatg

SEQ ID NO: 54355 - DNA, 1072 bp, Homo sapiens
atgtcatatccttgcaaagccgagttttagaggcttactgggatgaaatgcaagcacagtccaaaatgtagaaaaaatgtacagaaaaatgtagaatgagaaatgaagaaggcagtgttctacccagggctcagcaagcaacatacccctcattagtaaataattatggttagttaaaaatacaattcggttgttatttttctttcaatttatgtgtattttttcaaacaactactaagttattaaggacataaatgctcaagttactcgaacctaactacttaatgaatgaaactgttaggtatttctgttttatgaaaatattacttaaacatcaaatgaatttgggaacctctgtcctagggcataggggagcatatttcatcatgttatttcatttactcctcataaaatcccataagataggtataatcagcctaattttatacttgaagaaattgagatttacagagttttagtgacttgcccaaatctacaccactggtaggtgactggggctacaggggctaagtgacatgcctaaaaattcacagcaagtcagaggcagaaataaaacaaacaaaatcctggtgtcctgattctcctcccaggagaatcccttttacaaagctgtactctctctccaaatcctcccacgccttctctcttctgagtctgaatgtacagtatgaaaagatagacttccatgctacacatcttatttaactacgggtgtatttatgctgccttaatagctgccccacttgattttgagtatacgaggaaaatgtacaaaatactatgactgaggatttttgttcagtctgaataaatgctaaaacaatattaaaacaactttaggctcctgtaaccgaggaggctgtgaggtcttacagagaatattaccctctcctcgggtttcctgtggctagatggctgatcctgcatttcagggaattggacacttgggatctattttcaacctgatgaactccaattgaacactaaagagagtctagattttcccttcagccttcacagaaatgatccctgataccatctttgtaaccca

SEQ ID NO: 54356 - DNA, 1067 bp, Homo sapiens
gagtccagaaacagatactgtgtattctaagcctgactcaggctctgattccttccaaggtgttaagcagctcatttagtatctgacgaagagtcatcataatgctcagcatagctgggttgtctctgccaagataatttatcattcactgtttttacacattaatgcaaaaactatatatattgagttcctacagagtgagggacttaagttggggtttgtggatacatttaggcagcctgtaaactcccaggaatgttatacacggattagtagatatgttcttgcctgtattttatgagaggatttatagcttttattagattctcactggagtttgtgaccaaaaagagattaagagtcactgctatatggtgtaagacttatcataccatgttcatgaatatgtttttcctagaatcttaaaagacataccctgatgaaaaagggattggagccatgcactgtttctgtgaactgtactacgttgtaaaaggaattttactacatttgattctcaataacagaattcgagcaggcattccaagttgtttcttaattgctgatgaaacatgcttgagtttatagtactcttctcctaaccataaacttttcctcactctctcatatttcaaaaacgaaacactgtttagttatctcaaatgaaaagtgcctcgaggacaaggaaccaggacttggagttttatcacccacagtgttcaggtagcccagtatccttgcatatgcattatttataaataaaacctgctagacactggggtgtggtctcaggcagacatgaacagcaagctatgtcagatgtggcccaccattggccactagctgaatgacagaggatgcaccatagcggtggagtgggtttggctggaaattgatggctgaaagtatttgaagtgaaaaaccagaagtcatctttgtcactctgtcactaaaataaaaactgacaattcagagatagaaacagtactgcttttccccttgccctctggctggatatattctgtgacaggggattctccgaaaggtctagagtaatgccccacccc

SEQ ID NO: 54357 - DNA, 1154 bp, Homo sapiens
taaatgatattaatttttgcttgggtagcacttgatgtatatatccaaacccattttctcatttaatacaataatcatgtgaagaaggcatagaatgtgaattcttgagagattaaatgattttttttgatattacacagttagtggtaaagctaaaatctgatgtcatgtctgactggcaatgtaacaaaactctgtgaggatttgagttcaggaattacggaggtttaaaaagaagtctctaaattagtttaaatcccaattaagattgtcaacattggtatatttacatattgtagcaactggaaaactctgaagtgctaaaaactcagacttggcttattactgtcaaaactagaaaatttttaagagttaaaaactgttcaggtattcagctgttctggtaaattaaatattctagttagggagagtttgcatttcataactcagatatagatcataatttaaatgctagcttttaaacaagtatacagcatagtacttttaacactaaaacaatactcaatataattttgtcttttggtgttgtagaaaacactctatttgtttagcttatcatagtaagtattatagaaattaattactatttccctgaagttttctggcactaggtaatagacattgctgatagggaaaaaaatcagaggatgtcactttcttgtccttctactttgtctacctctctagtactttcaacgactgcccattccacttagaacttaagtttttttgtgttttgttttgtttctgagtcagagtctcactctgtcgtccacgagggagtgcagtggtgcaatctcaactcactgcagcctctgcttcttgggctcaaggaatactcccacctcagcctcccaagtagttggggttacaggcgcataccactatgcccagctattttttgtatttttagtagaaatggggttttgccatgttggccaggctggtctccaactcatgagctcaagtgatgtgcccacctcagtctcccaaagtgctgggattacaggcgtgagccacctcacccagcctaaaatctaaggtctttaacctgactttctaaaacttgcatgattggctcctggcaacctcatcttcatgtcactcttcacctcaaacaccacgcaataatg

SEQ ID NO: 54358 - DNA, 1107 bp, Homo sapiens
aaaaatctaatttctccacccatttgtcaaattgggtattagttgtttacattgcagttcaagtggcctttatttgttgttgcaaaattagaggtcctgtgtccaagcctcatgcgtcaccatttgatgtgtgttgttctgagatctgctatgcgcagtgacatacccttgctccatgtgctaaatataagaatgttgaatgaaccctcctttaccaacgtgatttgtgtttgtcgtttgctcacaagacatagaaaatcttggcaatatctatttgggtgatgccacatctttgctcaagtgcttgtggccatgtgtcatggttgtactaggggacaaagaaaactttaagaagagagtagtgctgatatccagtaaacttgcaatgatgcgtgctcatggaggcacagatcacatgggtgacaaaaatccaccattaatcctcaaattctatttttaaaatttgataagaaaagccatttgaaaaaaacattatttttaataactaggaactgaatgaactgatttagagctgacttactctgtgttttatcaagggggtagttacaaaaaaattgagtgctaaaatgctaaaagactagttaatgacttggatgagtactctttgaatatgttgtaactaattgtatataatagcagcatggaggtaaaagtgttaccatttaaaatacatatatacacggctatatctcctgtagatttagaggattccattacaataaaggtgctgctaattcttcagtaattgaataaaatttgaacagttcatcgttaatatccctgtgcctcagtatcctacaatcttttgtgaaataagtacatatgcccttttatgcagtgtcacagcagctagatttaccattccattacacaaatgtggctccttaataaactgctctaatatgtctttccagtgctggattttgatagcttttgctaaatgcagataagagttaaatgttctttgtccctttgtttttattcaaatgttttccttctaaattcattttcaaatttattacagaagaaaagcaatggggcaccaaatggattttatgcggaaattgattgggaaagatatgtgag

SEQ ID NO: 54359 - DNA, 1236 bp, Homo sapiens
aatatagatagatatagatatagatagttttgttgttgttgttgtttagacagagtcttgctccgttgctcaggctggagtgcaatggtatgatgtcggctgactgcaacctccacctcacgggttcaagtgagtctcttgcctcagcctcccaagtagctgggattacaggcacgtgccaccatgcctggctacttttggtattttcagtagagacagtgtttcaccacattggccaggctggtctcgaattgctgacctcaggtgattcgtccgccttagcttcccaaagtgctgggattacaggtgtgagccaccgcacccagccatgtacatatattttataaatgacatatgcagcacttcctctccagagccagataagcagaaataacctaaaatccagctggtgccatgatcaaaatgacaatgattttggactttcatgtctccagccaaaagagcagacaattatacatctatactttcttcaggcactaaaaaggaaatagggtctacacaagttaatgatatatcagaatattttatttaaactatggtttttatactacaaaagcatcaatcattacattaatagaaatgaggaaatttcaaataataaattattcataacaatggtttacgttggacttctgatttatgtttcttttgaagtttttaagataaagtcgtgcctcacttattcttttcatttatttgttaatatgtatccatgaactataaccaatttgatctcttttatcatgaattggttttattatacttgaatagtttcgctatatatattgggcggtcaaattaacgaatgaaatgaaatgggaggaatgaatgaatcatataattatatgtatatacaatataaacttatctgaaatttacttctcaagacaaagtgtcagaagcaagacaaatcaagattttaattgctggcaacaatcctattgtacagttagacaaataaacaaaattttagtccagattttgccttagcccttgattttgatatagaaataaaatataatgttggccaggacaaggcagagcaccaaaaaggcagaaggctaatgcaggagttaactcacaggtaaaggataataattctttttcttatcatgttccagcctgctgataagataccaagcttacagggcaaagaatgaacatcacccaggtttgccatctggtcaggttgatttggcatctgtgtaagttaga

SEQ ID NO: 54360 - DNA, 1042 bp, Homo sapiens
tcaggaggctgagatgggaggatcacttgagcccaggagttcaaggttagagtgagctatgattacaccactgcgcttcagcctggggaataaaactagaccctatctctaaaaatatatcatataaatgaaaataaaaagaggaagattcaggatacagccatcctatttttaaggttcaatgattgcagactcttaaaaggcttacagattcaacctgacttttatgtcttgatcccactctatgatgcctgatgccaaaattcccatggcagctcaattccttgttaagctaggaagcaagcagagatgtaatcagagcacgaaaccttcatgtaagtgaccatcaaaactggtttatattttcttcattcacctctattagctttgattctcaaacacaattcaattttgaattggtttctaacccctcatgcaaaaatgtagtcctcaacaaaacctaacttgagtgcatacttgcattttaccatgttatttggagtaataacagccagagagagacagagagagagactctccagctgcagaggataagggtctatgagttccttgaaagctgttgattatgggataagccacttttcaacaagctttgtcagtcagaaattgtgttttcttagactattggacaaaaaaaaatccctgtactttgtaaccattcaatggttatattttaggtaaatttatgctttactccaaaaattcacttactctatttctatttacaagtaagcccagaggaatatcactcccatttctcttatttatcttttccataattaaaaataaactctgatgctattagcccattttaaatcgaaaacatctttgttttttcctatctttgtttttattgtttttttcaacattctgaagaaacctttaagctaagaggtcaggataatagcctaggtgttgatagctgctgccatagcaaaacaacatattaaataaagatggtttaatatatgcggtagcctgaggtggagagatgtagaggaggggaggggtaacctttatc

SEQ ID NO: 54361 - DNA, 1056 bp, Homo sapiens
tctccactttacactaaaggaaggcagcgcagagaggttaagcaacctgccaaggtcctacggtcagtgcagaggatagattcaaaccacatccaactgacttcccagcctgtcctagacaacataatgaattacagcagtacttgcatagtccctgccacaggataggtactgagaagcactaactatttgcattatcataggtatttttaataatcagaacaggaagcaaaaagaaagagaagaaatgttaaattcagtgtccttaggcccaaaacctaattgccctatgttcggtgcctaagcactcatttttctggttctcttaacatattcaccaagtgtttttaggatagtttagtttctttttatgatgctgtaaaaggtttatgtaaagacccttcaaggataggaaccactgcatagaatgcaggcgttttcagttttgaagcatatttataggaggctttaaatcaaccaacttacagcaaaacaaatgttcatggggttaatgtctggattttcaaatgggtacctgaaacagagccagtacatgtactgatactcagaatgtccttacgtgaccacccaggaagcaaatgcagattctgctctgaaagtttttatgtagctatatgtacacacacagacactcctcccacccacactcacaccacactcctatttctattctctgcttgaaaagaataaggagcagcacattcctaagttaattttttagtactgagacaagaggaaaataattttgtaaagctcaacttgaaatcgaaattttaagttctaaagtatggggattttttttaactcaccctgggaaatcttcttttttgtttccagttcttttagatcagcctgagatatggggttcaggccaaccaattaatccaagcatggagtcgccaaagttaacaaggccttttcccactggaagtaagttatgtgtctgctctgtctggaaaaataagtgactcattttagtgtctgtctgcatagtgaaattaggcaactcttaaaaagtctatgtaagcaacatta

SEQ ID NO: 54362 - DNA, 1115 bp, Homo sapiens
actcgtctgtgctcctctaattctagagggttacagcatccatctccatccctctattgttctttcaggtctttgaggggatacaaagctccttatctacctgtaaagataataaagaaccactatgtaaatcctccaaaccacaaacccaaagacattactcgtccgttataaaagaggggtgtgtacttttattttctatgcagctctcttaagccagactctcagtctcctaaaaggacatttaaagaacacccacttccctccaagggtaggccacaatgctgtcctcaaaggaaacatctttatcaggagtagagaggacaggtggctttggtaattcatctgtgtttcatctaacacctttcataaagctctcgaagatatttgttcaattgaatttaccactgatctaattaggaagaaaggaaactttgttttctttctggaatttttgagagttttgttgtgattttaatgtttagcttccatacctttatttgaaattattttaaaatgtcaccagtaaagactcttgattcttcataattaagctggaaaaagcttgactttactggtatttaaagattggatttctacgtagaaaattgaactgggccactgaagtttgtgaataaataaaactctgcagtattatctctttaagtaagtcccagtttatttgctgcttaatcttttattggtggaacatatacaagctggaagaaatataaatttaagattgaaacaatagggtatggcctcatgttttaaagattagcagtgcttctcactacctgcttttcataacattaggcctgattaaactaactttcttgtatttctcgaagcatatttaattgtataccactatgcactcatttttaaaattttattcacagcaaggtgattgtcactgaccaagtatagacagtactgataaccttgtgaatcagaagaggtacctgctattgaaaagcagttggaagttaagaatttgctccaataacttcaatttccttatgtcaaaagttataaatacctgttttggccagaacagtactttactggaatgctggttcttggcaaagtctctcttctcccatgtgggttgt

SEQ ID NO: 54363 - DNA, 1044 bp, Homo sapiens
agtccttgcaacaaaggttttgccctaatcttctagccttccagctctctaatttcctgatactacaccttatttttcccttttatttttagatgacagctaataattgtcctatttataggataccaaataatatttcaatacatgtgtactatgtataataatcaaatcagagtaattagcatatccatcatctcaaatatttatcatttttttgggttgtgaacattcaaaatcctctttttggaaatatacaataaattattgttttccctatttaccatacagtgctatagaatactaacatttagtcctcctatctagttgtaattttgtacctattaaccagcctttgaccccactgagacctctgtcctcacgttcttcctgttctcagtccactaatccaggtggagatattcaagttcttttcattatccagatgagaccccagagaggaaaaatacgtttctgaaaggaccttaatcatttacataataggagctacattttttctttttggagttatattatctctgtgaaaaaaataaacgcttgggcattttaaatgtctgaccttcttaagcaggttattaaatacccctacttagtcattggcaagtcacaattatagtcatagagcattcgactttccttaccctgacatagcaataaagtaagaaatgaactggtcaaatttctcacatgcagccacaaagatactaattcattcatttgagagacactaaaggaaggaaaattggaagatatgaccaattttctggggagcaatggctatgctaaattcacattattcttaagtgggaggtgtttgctaatagcacttaccccactgaaggcccctttcaatcaataacaggaaaattattaagtacccactctgcaaatcacagcattaagtaccaggttggggaaacaatacagaaacattaaaagcagttttacaagactgtcttcattagaaatattaaaaccacgctccttagctattctgagtttttatatatggactgtattgtctat

SEQ ID NO: 54364 - DNA, 1033 bp, Homo sapiens
actggataatttctgagaaactactggtcaaagtaattcaaaagtaaataaacgtattcagttccttaattgccttaactgactaatttagacaaagctggtttcatagaaagggatattaagtttgagttaataaataattcactctttaaagctcccaattatcatcgcaattagttaatattactgagcactcactgagattgatagcaacacagtagctcctcctcgtggatattaatctaccaacaccatagcattcagaactgtatttgtatgaaaaccacactactgttaatagattcataataatctctacaaattgtcaaaaaatggctgtacatatcagacgacaatttgctaagatgcttcgtgtagggtttatatttgttttaagatgctactcaatcatttttcttcccaaatgaacagtgataatacacaaaatgatgccaataccaaggaattctgggtaaacatgccaaatttgatgactcacctaaagaaagtgtctgaacaaaaaccccaggctacatattataacgttgacatgctcaaatatcaggtaagcctatttacatgatcggtatctcttccacatgacatatttgttttctaaagtacctactattgaataaaagtaactaaagtaacacttcttttaacagtatttaaaagctataactcatttttttaaatggaaactttaaaagataacttggggactactgacaaaaatattcatacatattcttattagtttaagcttacaagtaaaatattttatcacaaaattagagaaatgtgccacaaaaaaatgaagttgcaaaacattatactaattaagattataagtttatattgataaacaagatgattataattttgttaagaacattactatactaaaacctcttattttaaatgattcaaggtacacaatctgcttttgtttttctagtaagatagtcctatgaaagaattctaataaaatctaacactaagaaatagttcaataataaaggaatgtttg

SEQ ID NO: 54365 - DNA, 1048 bp, Homo sapiens
tcctgagtagctgggactacaggcgcccaccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctatgagcaccctttctaacataagttggattctcacatccagaaataaatctcccaatctattctgggcaaaccccaaacctctgcaaattgttgatctatggaaatgtgaagaggcaactagctgatctgaaaaactgaaaattgatttggaaactttatgtatcttttattcgtattgtacctctgaagtatgcagtatctggctcctaggggtagggaaggaggaatagaaaagttacccatataataattacattattgaactaccagataacctgttgacatgctgttttgttttgcaggaaaatacttggcagataactaatgaaatcttatgcaaggatttggaggattcatataatggagaactgatgtatgagaaacagattttaattttggtttgatgaaaacaaaccaatatctgcacttgggatatatcaggtggaaagtcaatgactttcatctgtgatttccctcacacactaccatgatgaccagtcctacagtatttacttctaggtgtaatattgttaatggttttaaaatgtaattattgtatttgtaaattgtactctcattccagtaaggcagttagacacttgagttttagcattttaccattcctgaaatggatgtaatttaaactgtggtatgtaaatttaatagtagtattgttgaatggcacaatgcttacagaggtagattgcattttgtcaatatataaaatttaaatataatattgatagctgtcataaagggggtgccacatattaaagaaacttaagtggaaccagaagaaaaagaaacaaacttacttttcttcaatgcttagtatgttttactctagtgctaaataaaaactctatct

SEQ ID NO: 54366 - DNA, 1029 bp, Homo sapiens
ttccaaactcccttaacctgctctattttttctcttccctgaggcatgtatcaccttttatcataatatataatttgcttgtttagtattttattgtctattctctgtcttgccttactaaagtaacagttccatgagagcagagaccatagtttgtttttgtttttgttttttttccagtattgcatcccaaagacctaaaatagtgcctggcatataatagtcactcagtacatattttgtgatcatcgaatgaataattgttgcattttatcaattcctgagcaagcaagtttcttttgctcacgaacaagttaggttcacaggtccatgcatgtgttaagtccaggttgactaggggctttcctcttatagacataagatgcatttacagcaaatagaaaaatgcttgttcagattttcttaatgtatacctttacctccatgctgacacattccattgtgcatctatttttaaaaaacccaaaagaacagtttcatttgtgttggaaatctgttgtaataggccacactcctccttgatgatctccacagctttgtagaggtattcatggcacctgcactaccagcatcacctctgatgattgcccagcgtgacacagctttgaaccaatgcatttcatccaagagctgcaacaaaagttcatcagctgtgcttaactatcacctcccttgctcttggatgagcattagctcaacaggcttcagacactaactctgatcttctatccacatacttaaaattgttgtactttgtcaatcaccatttctggattaccttcaattactccagagctgcgcttttcacaggttgcatggttcattctttatccttcagcatcacttctactcgaaaaaaatatgttccacaagacagtgtcatttgtcatgttcctgcctctttcatttttgaaaattatcttttctttccattatagcctttctcttactagtaaaatggagcaaataatgtgagtaaaatacctaaaaactacaggcatactttgg

SEQ ID NO: 54367 - DNA, 1134 bp, Homo sapiens
ttttaaaaaaggaattaacatccaatattctgtattacatactgtacaccagattttgatttcagaaaacaatatttgatgtataacttccacttaatttaaatttaataaacttttatttcagagatatttgattagtttacaatctaagagttattcttaagagtttcagtggaattttcttaatttttctaaagatattcctactctcttgatcatattctaagtacatatgagtacatgtacattcttatacaatgtctaaatgggttagaaaattattatacctatagaagcgaaacttggaaattaatagaatcacttaaaccaaaatctttataagacacaattctattgattttaaagcttctgctttccaggctctgttttccagagtttataattacgtagtttttagtagatgaaaataatggattcttgtacctaacattttatcctcttagatctaagagccgaagctatagaactttgttagactatttggcaagcaaaatatatgacagtaaatatcagaattttatggtttgaccagcgcttatcacattcccaattcagtgagaaaaattcatctgggacacaacagggtactcttctctgtttgcccagaatcagctctggattttaagcccagacttcagtggacccagatagaaaatataaagtctctgatctataggccacatcaggatgttattttatgaagagttctagagcaaggttgcggaaatcggggtggagatggggagcagtgactcctccaaatattcattgctaacaggccattctatgcagtttgttttaacaaatcctgggttaaactgaggccacaggacatgatgggctgttctataaagcattctaagtggagaggagacgatagggcatatgaaattcactaaactctctggaaaaaaaatatgtatatattaaaaaccaagactggaatcagtgcaacagtgggaactaccttttacaagtatccattgcttcataaactccatttgtttggaccaatcccttaaacaaaagcaaggcaaattttacatggatttagagcctaggtcaggttattaggattataaattttccactggtatgtcattgtgattatct

SEQ ID NO: 54368 - DNA, 1168 bp, Homo sapiens
acatgtgatgttttgatacaggcatgcaatgagtaataatcacatcatagaatatggggtatccatcccttcaagcatttatcctttgtgttacaaacaatccaattatactcttttagttctcttaaagtgtacaattaaattattattgactatagtcactctgttgtgctataaaatactagatattattcattcattctatttctttgtacccattaaccatccccaccactgccctacccccaactacctttcccagcctctggtaaccatccttgtactctctatcagtctggagatactttggaatcagaatattcagccactatgataggctttttcagaacatgtgttccatgttttctgttacatgtaatatgatcatctctttggtgacaccatcatctacctcattatgcaaaccaaaacttgagctcctctattctaccctatcatctaaatgatacttaaaatttgattgtcccatcccttccagcccaagcctgctattgctaatgtagttcagatctgtcttattttttacttttactactacagccatcttctaacttccttcattctcaaattcctttaattcaccttaactttgactctagttctcaatgtgggcagggaggggagaattttcccgttagggaacatttggcaatgattggagatatttgtggctgttgcagctgtcaggaattgaggtgagggtggggaagggctaccagtatctctgggaagatgccagagatgttgctaaatatccttcaatgtacaggcagccaccaccctcccagtgcacatcagtccccagcagagaattatctggcccaaaatgtcaataatgcttggttgagacaacctagtctagtgtcctgaggtgtcctttgcataaggaattcaagatgatcatatggtctgtaaataaaaacagttttacttctttctttctaacctgcttgcctttatttctctttcttgtacgattgcactggttacaacctccagtacagtgatgagtaaagatgatgaaagcatgcattcctgtattgttcctgatcttagaggaaaagtatttagccttttactattaggtatggtgtcagatgaaggctttttgtagacagaattaatcagattgagggagttccattac

SEQ ID NO: 54369 - DNA, 1209 bp, Homo sapiens
gggaggatcccttgggacagatgcccgccgctctttactcttgttctttcagcttgtagtggctaggtccctggcctggagcctatctgtggtccctgcatgctgtgtaaccttgagcgagtcactatccctctctgggcttcagttttccctatttaaagcttcctccaacgctagaattctgcatttctgcagaagaacttatgtaattacaagattgacttggctattgaggccgcttcaccaagatgacccggagttgactgaaccttcttcacttatgggtggaatgaggcgacctatttattgggtcgcttttattcctttatcattagttacaaattgcatgacttaaggctcattaaatgtttttctaaaattgtcatgggatccttgtcctgattcccgaccatctttttaaaaatgcgaaacagggtggatggtgagcttgtatcatcgtttctgtctccttgctactgaggctctctttcctttgatccagatggtgtggtcgctcgattctcccagtgcctggctgagtttcggacgtggttaagaaccaactggttgaggttcaatgcagacaagacggatgtgatgctggtaggcaggggtacacttggagattaagggagggaaaatccaaactccctcaagtaatataagattatattactcttcttatatgttccagtgtttgagaactgatgggccaaaaatttccagaatttgggtgagataaaaataacatgtcatcaatgtaaaaaccataatcatagtttgtaatattctgataaaatggggccactggataaaactgtaaaaattatgaaaagaaaatccaaaactgttatttgaagaaccaaaagcctatataagtgttttagagtggcattaataacaaaaaatgaaactaacgaaagatgatgctgattgtcactatagatgtggggcttccaaatgtaataggctaagttttttagatgtaggtattttcaaccaaattagtaattatccataaaattttaccaccacatcataaagacatggtgtaggctgttgcttttaaataaaaatttcaggaaatagtttataaactaatctcaaaagagactcatggacgctgaaaattgttagatatagaattttttagttttggatgtgttgtattaatctatttcagtcagctaaccccagagtctaaattgt

SEQ ID NO: 54370 - DNA, 2121 bp, Homo sapiens
aattttaagcagacacaattaatggtgcattttcttatgcctttagctctctcatgtcctattttcaactcttctagtatgaataggctttaaaaataaatttttttttgttaacccaagtataaatattaactgtttgcatttggatacaaagaagatatctgttgaattaatccaaagtgctgaagaactaagggtaatggatggaaacaacaaggaggtagattctggcataataaaagaaagaatgttttaaacatttgaactttttttgaaaagagcagcctttttatgagatatagtgagtcactggaggggtttaaacataggcagaaagcctggtagtagaagcatgatgagagattactatcttgacagggtagagaattgactaaaagatctctaaggtcccatccaacactaaaattctataactagtgaatagttaatttttatatatttaatactgaagagggtaagtaagcgttttgagaaagacttttcattccgtaaggtggctcctgaaaattttacagttaggtgtatcactaaaataaaataatagtggaaggatactgaattcagtggtaatgtgttacctatgaattgcagtattagagctgtttcttttttataatatctgaacctaaaaaacccactgaatccacatttataaaaaggggaaggggaaaaatgtagagagtttttttccctcaataataataataccatttaaaactagtaatattgatacacaatattaataaacttaaagagttatttaacagtaagatagatacccattcagaaatgtttcagacttccattttcctgacaagtttaggattcattcagtaggttaatagactatgatcccctgctctttatcatagttgggatttctgttggtagtttaactgaagaatcaaagattcagtgtacttaagcaagttatttctgtaccttgtattgtaacacttttaattttcctttggtagccaaatttcataaattagctttcatatgttaatggaaaaccctccttcatctccatggtataaagcctgagtttgtacctctaggcccctaattgtgtctgtacccacctcaggtccatgtatatccattgttctttgccttcagctcttttcattaagtgtattgattgaaaactatttggatatgaactgacacttttaaaaagtcatttttatttcaagtccagaggattgacataattcaacagggtaactattagaaactatatacctctgctaaaatatttattcccccaaggaatcctgaaaaacacttttatataagttttctaaaaaataaaatgaaaatactgtacagtacagttaatggtaaaaattgtttgtagatttgggaaccttaaagttttcctttctcttctttcccttgcttttctttcagtagaaaatgtgcatcagatgtttatgtttaattggtttacagactgtctgtggactcttttcctgtcaaattaccaggtaatgtcctttcacttagcagctacttcatatatctgtaaatgcagtttattcatgcacagattattattggacataacagtttcaaattaacattgaatctttggaaataggaaaatgcttgatagagtctagaattttaagggaatataaataatttaatagcctcccctatattgcattataagttaagtattaactttaagaaaaattgtatatgtacacatttatgcaatgtagtattggttcacattatttggaaggaatgaataattctcgtatttaaatggttgattttggtagccacttttgaaactgcattaagaggaacccttgaagattaggaaaaaaatcccagtcttttgaaataaagactttcaaactggtttagtaaaatatgttagtgactgttttaatgtcacctttgtgttattcagtatgtgccttagtataatggaagtgaaacatgttagttactttgaaatcattggttctggccatcatcagcattggcatcacggccaattggcagctgtaggccaatacattaaaataaactttcaagttacaggcatttcaggcattgcaaataagtaggttctccctc

SEQ ID NO: 54371 - DNA, 1315 bp, Homo sapiens
ctgcccacctgttgtccggaacaggccattctctgggcgggagcttcgcctggaacttagttgggatgggtccgggggtaggaggaagcggaggcgtacttggacttcgggggcagtttgaagggtagtgcagcgtagtagtgcggtgcgagggggagggggcgcccgccggggaaggggtgcctgtggcgcaacttcgccggccggtgctaggggccaggagagaagctgctgcttcctcttgcgaagttttttcccttcctaaccgagatgctgttgcgcccttccgcgtcacccccatccatttgcgactgacatccagtctgtgttagtggggaaaacgtaaggctgacggcctttgattaactctgtaattttcatgatcgtggtaaaatgagagtggataaattaatctggccagccgcaatccagccctccaggttggggggagtctgcccatttatccagacagttccatctcccgctccccaaggtacaacctctgagctgcttttccacctccccccaccaccttcactttccaggcttccccccaccccctttccaaatcaaggctacctattcttgtcttctttctcttctaatttttctttcattggagaagctttttcttgtttctttttgctcgttttatagtaaacaagttcctaaagcccctttttttgattttacatatttgggccgcagttggcgggcatacaactgctgttgatttattaatcggaactaagtatacgctactggaactttaaataactggaagtttaaaaaatgtttaaaatatctgaagttttgtgggatttgttttgtttccgtttttccttacccgtggaagaatttcagtattctttattcctgagagttcgagatgatgtatttggattttttttatgactcctttgaaataagccactgtaaattttgattgataaggcatttctcttgtttgaattgccattttcatggtttcacaggcaccccaaaacagatttaggaaggagggtgagattttgctgtagcagacaggactgtttgctgcgagtattctttttaaaacattcaatatctctaatttacaactaaatttagatcttagatttattttcatttcttttgctcttggtggttaaagaattgtatttccaggcacatgaattggagaacgtagtactttctgtttccccaaaatgtgactgcgtttgttccagtagactgagaatcggtacctggattttagtcctggtgaggttcttattcttaagtgtttgtttccttcatgtttaaggagttgtgt

SEQ ID NO: 54372 - DNA, 2048 bp, Homo sapiens
tcttctatattcttcagttacttgtagatagtttcatgtatagtgaattggggaagagttagaggaactttcgtgatctgtgtcctacaaaaaaatctaagacaggtgaagaagtgaaaagtacaattgatttatagttttcctggcctcaatacttgaataattatgacgatttttgagaccagtggttttaaacaattagacaaaggagaaatgcttggttggcttttactttgagctctcagtagattcattctttatgaagccaatataaaagcatgtgattaaataatccagatgctgaattattgtgcttttgatcaaataaatctgaggatttaaggatagcttgtgaagtaacagtaagtgcaaagcaacagtatatatctatttgttaaatctgagggggaaaacaggttattgaagaagtatgtctccagagaaaaatgtaggtattatgcttctgggcttttaaaaaaaaaaattgatgcttcctacaagagcatgaccctgaccatgtttttccagaaaaatatttaattcttgaatagaaagtgctttagatgagaataggatatactaattttttatatttgatctgattatcttagtccataataggaagtatatattggttcttcagttgtgataacattaaagccgtatttaatgtacttagaataaatagcatatgctcccttgcttaatactttttggcaatatttctcattgcttattatcccttaaaattatttaccaaccttctaaaaggacgctctcctagtcacacttgaaggaaattacaggatagttgcagttttactaactgcaaaaataagaggaaaatgagagaaaaaatgagaggaagaaatagttaatcctttgggttttataaggaatgtactagggacctttgggaacgaacaatttgtcttgtattttagcgtttgtaaacacgtaagggactttcttctcaaggaaaaaaatccatggacaattcaagacctgtcttttcacctaggccacatttctgtgatataaagagaaaattaatggatttgcttctttctatttaagtattttagtactttcaaagagggtatataatctgtttattcactttcacacctatccatttctctttaaaatggactccttgcttagtattttttgagtgtatttggatttttttaacgaaggattatgttaaatgttacttatgaaaacattaatttctactctaagcaaaatgtgtttcactgcagtgaatttaagcttcaaataattctcgacactaataatgaattttttttcatgtttatacttcagagctattaagattttaaaagtagtcaagatcaccagtgcgtgagagtcctaaaaatcttaattcattggcagttaagagttagggtactttaataggtgggaaaggtttggtgggagaaacaagtgaattactttaagataattctggtaagtgagactaaccagttttctaaataattcagaaataaaacactgccattgaagcttaagcatgtctttatgaaaagtaatcagctatctagaaatgcctgcctggcttgatgttcattcaaaattcattgcagtgattaaattgttcaagtaccagtcattgcttggggcttgttctgtttgtcttattctgtggcttagaacaataacttattatgtaggtatgaaattcatgaagtagcaccccaaaaaattgtttttgcaaattgagatttttttaacagtcctagatttaaaaaaataaatttaaacatatcccatgcatttagctgcatactccttagtagtgttaggtttctagagcaatttataataaaagtaaagttaggtcttgaagaaatctaaatcttttgatcatagagaaaatgaaagtgagcagagagtttacgtagtttgtcctaggtcgtgcaattcatctatggcacagtttagactggaacccagccttctgtattcctagattcctagtgcttattttctttttctttctttctttttttttttttttt

SEQ ID NO: 54373 - DNA, 1062 bp, Homo sapiens
cttctgaattattaatactgtagtaaattgctaattttaatttcagtacattcttaacctttttataccccagaattcctgagagtaataacaaagttaagtaacttaattttattggaggagagggatggtgagccagcccttggcacggtaaccatctttcaccctaaagtaggacccctctttccaggcttctatccccatctccattgctgtgagaatctctgacttagagtctacataactaagtagatgacggcaatacttaaaagaaatggtggtagaattgttttgaggggaaaaatttgttcagacggtaatactcattgcaaataagcttttgattgcctggaataaaaaaatctagtaattacttcatgtttttactatgttgttgttagggtttttttggtgaaaataatggtaatgttgtagttagttatttctttactctctctcaaattatagtcttctgttgtatgggacatttcccaccatgttctagaaaaatataaaagagaattatttcagcaaatctgaggcattgaatattcgttacaactattagcaattttatcaactaaatcatacaaatatgtgggtgagggtcaacttgctataaaagttgctagagtttgtttttaatttgttttagcccattcatactctgtgtacagtctttctgtctctctagtgttgttttccatctcagataagataaatatgtaccccctaaaacactgaatttttcaaaattacagcttaaaaaatagtaacaagtactaggttttcttaaaaatcaaaatttagaggaagaaaatgaaaatgtctcataattccacaagataatcagttcccagtgactttcattttaagaaagaatgcatagtacatgaaagtggttagaaaatttcaacagtacagaaaggtattaaatgaaaaaagcctcttctccctgaccccattccctagaggtaactattgttaacaggttcttgtatgtccttttgaggaaaaaaaatttattccatattatttcatattccagcccagtttacgccc

SEQ ID NO: 54374 - DNA, 1366 bp, Homo sapiens
acggatcacgaggtcaggagatcgagaccatcctggccaacatgtgtgaaacccatctctactaaaatacaaaaaattagccagacgtggtggtgtgcacctgtagtcccagctactcgggaggctgaggcaggggaattgcttgaacccagaaggccgagattgcagtgagctgagattgtgccactacactccagcctgggtgacagagcgagactccatctcaaaaaaaaaaaaaaaaaaaaaagagaaaaagaaaaaagtgagggtgaaggaggagagaagtgaagagtggaaaattttagcagttatttctctagaaggtacaaaaggacactataaaaggtatagaaggaagagtcagggtctagacttcaggcctgccttcaccacctaccatggaaccttgatctagtcagtgtgtctccttgggtttactaatttataaaagaggtgggcagggcaggtattattcctatatttatgattatgatcagctaactagatgcttttgaaaatgtgtagcactgggttgggcatggtggctcatgcctgtaatcccggcacttttgggaggccaaagcagggagatcacttgaggtcaggagttcgagaccagcctggccagcatggtgaaaccgtctctattaaaaacacaaaagttagcgagccatggtggcgcacgcttgtaatcccagctacttggtaggctgaggcaggagaatcgattgaatctgagagatggaggctgcagtgagccaagatcatgccactgcacttctgcctgggtgacacagcaagactccatctcaaaaaaaagaaaagaaaagaaaatgtgtagcactatatgaatgtaagctggatgtactattttatttcatatctaaataaaaattacccttattccacacccaaacttcctatattaagatgctaaactcacttgttattttgaaagatcatcatttttgataattagctatacaaagtaatgttttacagtatgaaatgttttcaaataccaattttttagaaactcatctttgatttaatgggatgtatttaactttaaagaatctaatctcaatcctacccccaaacatatagaacagaattttattttggaagtaaaatactaaaatatgtatggatactaaatgtatctgtaggcagaccactcctagttctccacttgtgctaatctagatatgcctttaaatcagtcattgaaacattctagtatgtctgacataatcactaatgttacctttgaacactgggtgttctactctgtatcagctatgcttacaaatgctactagtcctcaagcgtttggtatcttaatcattgggaagtgtttgcagcc

SEQ ID NO: 54375 - DNA, 1109 bp, Homo sapiens
aattattccagtgttcataagtcttattttgtgtggatagtgagctaggattagatgaagatgatcattaacattgcttgtagccttacagagaagattgtgcctacagttgggaagtataactgcgtgaaacacaagtggattaatattttaaaatattgatttactatgtaataatttgtgtggtggttaactccattttgaaccagaaatgtgtagctctgcccaaaagatgttaagcaagctagaaaccctttttgtggttgcattactcttgtcatgtcaccctactctccaagcttcccattagaggaatgagatttaaaagtagcactgtattgactgtgttctggcagagtaactttaaaataatggtagtggtgtaccattggaaatatgcaatactggttattgtcagatttttgctagacaatgctataggaaggaattattctaagaatttaacagaaaaagtaggacctttgaaaaagtgtgccacaaaagaatgagtcaccatatggaatctagaatcccatacttactacaattacataatatgtacagttttaaaaacaaattttaatactttataggaatttgtcttagacacattgtttttgaaaaatagagaatttccctcttttctgttttcttcttgcctctcttccccattacttagcagaaagaaaatactgcaagatccctatctttcctttgctagtgcttttggcctcccaccatctgtattttctaatgggcatgaaatagatacttctgaatgaattggtgaagttttagttcatgttatttgaagcatcttttgagtttttaatatttgttttgtgggagtcttatgtttgtagattatttgtttataattgtgaattaactgaactaagataaaacacaactgcgcattgtcaagcagtaacattactaaaataaattgctaccaattttatctttaaattttcaagttgtttgtggttaaatttatgacaggtagaatggtggagtggaaggagcattataattggaaatctgtgcagtcttgcatcagataacctaaactttctaggcattagcttgaatgcttgctaattctgtta

SEQ ID NO: 54376 - DNA, 1840 bp, Homo sapiens
actttttttaagtcggagaccagcttgatagcaaactttgttcatagttctgtgttgataggagaaaatctatttcagaaaattccaagatctaaaatcatactacttaaaccacatatgttatgaagcccacatgtacctttaaaatctgaattctatactattgtctttatttctggattcaggagtgtttggaatttttctttatgcttaaatataatgaaagggaagggattatatgggaagttttagtttgtcttggaaaatgcagacattaaaactaaaatgcagacattaaaacttactgtagtttttggcatcatagtagtcattgaataatttcggtaatgtttgtgaagatacattatacagaaatactaatttttcctcttttctccccttctcagccatctgttgaatcttcaagtccaggtaagtattttccatattttttataatctcgatttgagtaacatttgtcctactagttgcataaagactagaggagttagactattatctgacttgcttttcttctgaatgcttcttttctctggggaaaaagaaatggatgaaaggtttgactgcccatgaaagtacaggtgaggctactgtgatttcatcctaaaaatgactatttttgggttttctttttttttttttttttttttggtgagttgccatatgtatttctcacagttttgtattattgtttgacttgtagtatatatataaattgtgctttttaaaaaggaatcattagcttagaaatatttgcttgtgtagggatttcaaagtatttttatttgagaaaaaattgttagtgcattacagagggaggggaaaaataaagtaagcaaacgattcaacaagtgaatatttaatgtaaataaggaatattctaaataaggaaatcattcttagatttgaataggatcaagttttaggttctgagcacacatctaggatttttgtattctttctcaaatacagtacatattcattttttcctaacttagagattgcaaacctgtgatctttgaatcagatctgtgccacaaatttttgtttggccactgtagtgatctttaagaatattttatatatgaaatctggatttagggttcccatggtctggcaccactgggtacagtagttctacatggcagtaattcattggagttgaagcagtgaggaaagagtcaagtactagtcttttatcctcagtgtccagtgactgtcaagagaaatgggactgccttctgcatgggatatgtgggttaaagagtagtccaatatagaagagtgagaaagtgaaccctctgaggcatagtaatgttttatttgaaaacatctcacatgtattgaatacttagataggatgtattctgtattactgaattttccagattattgaagcaatcacctttctgtgtttaaagttttagaaagaaagcttttaaaaatgcttaacataagataagcctgttttcatggtgcaaggtcctttctatgaacatgaatcactggactctgagggttggactagatcacatctacatcccttttaaatgactagtgtgctcagctgacgttgattttgtccttttgatttcagctgaaagcatcttactctttttaatatgcttgagagtaaagtacattaggctttgtgcatttctgaaactcaattttttttgaactttgttttataagtatatcctggatggttaagattgggagtaatctggtcttagataagtgttagatcaccatattcatttttaggacatggaattatttccgattttttttttcaaacgcagaaattgttttcata

SEQ ID NO: 54377 - DNA, 1319 bp, Homo sapiens
acacctgtaatcccaggactttgggacgccaaggcaggatgattgcttgagcctgggagttcaagaccagccagggcaacatagcaagaccctgcctttaccaaaaaaatattaaaaaattagctgtgtgttgtggtcatagtcccagctactttggaggctgaggtagaaggatcgcttggccctaggaggtcgaggctgcagtgagctgcaccccagcctgggacagagcgagaccctgtctcaaagaagaagaagaaaaaaaagaattgagacttttttccacacgaaaagcctgttcttatttgatatgaccatttattatttacaattttttcatatttataacattataaacacttttaaagctataaacattttccttccatttttctgttgtaactattaaaaagcaatacataatagttgctgtgcgtagctttttcttggtacttttgacttacatccagcatcaaataaaaatatatacattaatattaataagatccacttaatttggtttaccaaactttttgaaatattccttaccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggtaaataacatgtagagctagggtatgaattggttatgacttttttgtggaaagggaagatctgaaattttgattctctgattaggagagaaattgtgttatatattaatgactgaaaaattttgtgtgatcataggtgggatatttaaagtttgaaatgaaaggatttaaaaacaataactttattatgtgcaataacagaattcacatagttactttggtaaaacatagactgttaaatgattctgctataaaggtctggtcaaaaatggactataaaaggattctacacggcctcatatatcctttgtccttccccagttaccatatcttttacttattctccttcagagccaaaaattcttgaagtatcattttccattcactacataaagtgctctagattatctccactacataaagtgctctagattatctccacctcttcctatcaaggtgaccagtgaactttccttgttacatccatttttatattcacttttctctcactaccttactttttctcagcagtattcaatatagtttaacattcccttcttttacttgaattctggagtacaccactgtctggttttctttatctttttgtttctattcagt

SEQ ID NO: 54378 - DNA, 1027 bp, Homo sapiens
gactgttgtttttttctctgcttgttctttccctgtcctatcagtaaaaagtggtactactatttaccctgttgcctaagtcagaaaccagtgagtcattttccttctctttcaatatcttatttctaaataaacctatcatttgtatccacaagaatatcccttagccgactcttgatccattgctgcctagattaccattctttctagcctaggctattgcagtagcttcctgactggtttccccatttcctcttttaccatctttctcctgatacatttccacccagcagctgtgatcttcttttcaaaatgtaaatcaattaatatcaacctcccagcttcctgttatatccaaagaaaacccaaactcctcaaccaggccagcaaggccacctgcatgataatggcctcttacccatgtatcacactacctctgttatagccacactagctgcttttgttgttaaataggctagtttcttctgcttcaagggttttcagctcattctcactctctggtatatgcatcccaaggccggctccttatcctctgggttcggtgttgcctcctcagaatagcagcctttcctgtcccctaattaggttttaattagttttttgttttatttttatttttttttaaccactgtcccctattcaatgctttctttagtgttaggacacaatttgtaattgtttgtttaatttattgtctgtacctccactggttttgagaagatgaaataaaatgactgttattcaccagtgtatttcatggtaccttgcaagagtgctcactcaaaagtattgtatgaatgaatggatatatcagtctggtatgttctaataaaatatatcatgcatatgatttcctgtactccatgataaaaagaacataagaaataagacatagtgccagtctttaaggatttggaatacataatatcatgaaaaatgaatgcttatacttttatggtaataaagacctatgtctcataattttagtttgtaactttttaaagta

SEQ ID NO: 54379 - DNA, 1013 bp, Homo sapiens
ttaattagtagaaaattactaatgggctgtgctaaaattttggttatatcattgccttttcctgtttttctctcctattcctttccccagccccatatagtgccttaaaacttgctttcaagtgaccctgccttaggaaatagaagttaaaatagaattatttatagagatagggaaaaaaagacagttgaaccaatcctttatcatcctttcaactagacagccttataccttctcagattcttctctgacttctcccagaaacaattaaagctttaagtagcatagaatgcttttcatctgtaacctgaagctaagcaatattttggggccaatttgttggatttcctagagttattaactctttaggtttgaaccaaacaaaattcttgttgtgtttattgaaaaagtgaataagattttgttgtgttgattattgatttgcttttatagaagcaaaacattagttatgtcagggattgatagtgtttttcaccttacaccttggttgcatgaaatgaatttttgatgtattgtggcagaactctgacattcattcaggaaatatcaataactgtatagcatgtggttttaagttcattcaatttgaattctagaatttttcagtgaaaactaactcgaaagaagttttgatgtgtattgttacatttgtatgcatggattatgacaatataaaagataagtgttttaataaaattgggtgtataggttattatttattgtagtgattagtgatcttagagggaatgtcagaatcattctcatagtaaataaatagacttttgttttgttttgtttttttgagacagagtctcactctgttgcccaggctggagtgcagtggcacgatctcggctcactgcaacctccacctcctgggttcaagcaattcgcctgcctcagcctcttgagtagctaggattataggcatgtgccaccaagcccagctaatttttgtatttttaatagagatgaggtttcaccatgttgcc

SEQ ID NO: 54380 - DNA, 1091 bp, Homo sapiens
cctgaggtaacagtttggtcttgtcatttcaggtttctttttttccagtgcttattctaattaatttataccaactttctaaaaaaatgctattgcttttaaataataaaggctaattggcagtttgtgtttatttttcttactttattttgaaataattttagatttataaaaggtttaaagttagtatagaacgttcctgtatactcttacctcaacttctgctaaggttaacatcttggtacagtgctattaactaaactgcagattgaattataccagtttttctgctaatgtactttttcctgttgcaggaaccaacccagaggatgatactacatctagtatattcattttagtcttctgcatatattagaacaaaatttatatgctatggtctttcatctgcaactgttttccttacatcttagagaaatttaatttattattccacaggaggagaatataaaggattcatcaggtcaggaggatgaaactcagtcttccaatgatgatccatcacaatctgttgcttctcaagatgcccaggaaataatccgcccacgtcgatgtaaatattttgatacaagtaagtgttactggttgataatatttgaatataatttttactattttaggtattacctaaaatcctcttttttaaactggtctttgaattcatttagtctgaaattcttttcaacagtaaatggattttgttgtaagttattagtttagcaatgcagggtccctgttgttagtgaatatactatggtaattgtgtcatgtactacttgactttgggtgtatttgttttttctttgccctgtttttaaatgtttgtttcatggtcatctttttgtttctcatagtctttcccttagtttccattttttactttctttgcctcttagccttttttaggtatattcataaatacacctaaatttctctactttaaaaggaagaaaaacacttgaagaaaaataaactgtcatgaaatatgtagtaagataatattatctttattctaaatcagttttttcccctaagtttttataggaaatcatttcatgagaatacaattatgt

SEQ ID NO: 54381 - DNA, 1051 bp, Homo sapiens
gtcgaggctgcagtgagccatgatcactccagcctaggtgacagagcaagaccctgtctcaaaaaaacaaaaatttcatagatgacactgatgctgctcatatagggatcatatttaagaccactgtcttaagtgtagatactctgaaaatatctgaatttgactttgtgttttacatgttttgcagttgtcttactaatggaattatcagaattcacttctttgtctctatattttgaaataaagtttgtatttattgtttacgttgcatttcacctcagtattattactaatattttcatccagtcattatttgtcattcatcttcacaaaggtacctctgaggtagttaattggttgtttttgtattttatgacagagaaaccaggaacagtttactaagatggtaaggctagaaaatggatataaaatctgttactagatcttactaatgttttatgttatttttaaaataggagattatggtgggctccatgtttcaagcagaaattccagttggcatttgtagatacaaagaaaatgaaaaaggtgggttattagtaaagttacgtagctgaatttatgctttcagtgtaatgaactgttactttatatgtaaaatgtgataagaacatgacagcctactaagtaaccccattgtaaccccattggtttgtgaaagaggacccttcattatttctgtgagaagaatgtgtgtactcaattttttcagtttggtctatagaagcctagccaaaaaaggaaaaagtgaatgctttttttcattttaaagtgacttacaatgtctcaacagttttttttacttttttccccgtattttcagtgctctaaactttaacccttctctaatctttataatttagtttttagaagtccattttatatcaatgaaaggcataaaaacaaacgagagtaaataactgatataaacagcttatttgctcctgaaactttcactaagcaaaatggagtgcttattaaaatggagtactttggaccaggtgccgtggctcacgcctgtaatcccagc

SEQ ID NO: 54382 - DNA, 1146 bp, Homo sapiens
cctttttttttttttttttttttgagatagagttttgctcttgttgcccaggctggagtgcaatggctcaatctcggctcactgcaactttcgcctctcaggttcaagcagttctcctgcctcagcctcccaagtagctaggattacaggcatgcgccaccacgcccagctaattttgtatttttagtagagatgaggtttctccatgtcggtcaggctggtcttgaactcctgacctcaggtgattcgcctgcctcagcctcctaaagtgctgggattataggcatgagccactgcacctggccgtatgtgtgcttttaatgagttcatgtgcagtgtgacatcactcaggactagaaatctttatttcttttatttcagttttcttcacatttcaacttaatatacacaaaggcctttggagttgtattaatagaagttttttgttgtttatttctttttagcattctctccaaaaacttactttatattctaagtatgcacctactctcagggcaagcagcaggtcagaggcagtcaagggaacatcacaggccagtacggtttttgtgatagcaatatgttttaatacatcatttaaatgtttaatagctaccacttatttctcaaggtaattcctgcaagatataggaacattgaagctagcagtatggagtgactttattacatatagaaattctgtacatatggtatgttctgtgaacgtataattgtgtgccaaaataaatgatctgttggcttttgtatttatttttgtaattgaaatgtcagttttgtgctttactcgtatagtagttagcaatgttcaccattgaggtttttctttctgcaaataaatgaactgaaagacatttgtttttattaaatttcttttaaattttgacaatgaaagataatagagcctattttatattttagtatttatattataaatttatattatagttgaaaatagttttattgcagtatactttgttttttattttaatatgttcgtattatatatcaacagtgaataatgatcacattctcttatttatgcttagttttaatttttaatttttgtgggtacatagtaggtgtatatagttccggggtacgtgagatgtcttgatacaggcatgc

SEQ ID NO: 54383 - DNA, 3139 bp, Homo sapiens
catattttcaaaaataatagttacagttacaattacaggattttagtatgtgccagaatgattgtaaagtgctttaaatccttaaaactatgtggtagagttattgttacctcctttcacagatgagacagaagggaaataatttgcccaaggtcatcatacatgtaataagtggtagagatggtattcaaccaagagagcttggaatttggtaaactcaagataaagtcagactggatctgcagggggcataaagtggtacctcctctctgtttaaattgtttaatttacttaaactatagtttttgcccaagaacgaagtcaggcaagtagtagaaccacactgtacctcagttctcaacatttggctctgagttgtttatttagtaatatgttttaacacaaactctatcagtttttagaaatttgtttaacattgtcttttactaatttagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggtctgtgaaagaaacaactgttagaactttgccatacacatttatacatgtaaatgctgtcacttgcattgttgttattctgtccaccaaactttttataacattattgacagggaatctgaggttataatccctgtaagatatccgttgttaccacagtgacttcattggtgtgaagctcaaaaacgaaacaaaaacctgttttattttgcctgtatatacttttcattaggctttttaaaattcctttggctatccctaagaatctgtgtatatcaagttggaattctcacctcggattatcttatgtacatggtaagaccagtgcctaccatgaacctatcttttttacctttttaatcattgtttttttctgatttgtttaaaattataggaatctcaagaagccacaaagaagggattttcattgatataaaatgaattctttttagtcctagggatactatggccaccaagtttatgcatatcctactttgtacatatttaaaggtagttgatttatcaggatcgaattcatatttgtttttctttggagttctctatatataacattcactaaagttatttgccctcaaaaaggatgaaaacactggatgtttgaaaaacttttaagaaattgtagcattgaactgtttatagtccttgtcacatattcaagccttttatttttctaggctttatatgaattggttaaatgcaattttgatacagaagaagcattgagaagattaagatttaatgtaaaagcagctagaggtaagtatagtttttattcattttcatgatttggcagaaattttaaaattaagcttttcagtttacctaggtatagcctaaacttaataatactgatttttctgagtttgataaatatttacaaaataccaagtattactaaacaaatcgttacggggagtgggattaagattgtcccttcctcctttgtgggaaaatacagtcatgtaagtaaaaatgtaaaaatttatactgccttatgcattcaaggcatatttataaatattttcttatttgatcttgataattgccctatgaactaggtagtatgacagataatacctttacttaaaggtaaaaattgatgagcctgagatctctgaactaaagtaacttggcgaaagcaaacataattcatcagtaatgaagccatgactaaaatttggatttttcttttttatactatatctggctcctaccccccttcactaagagtactacatatatatatatacactacatatatatatatatatatatatatatagatatgtaacaaatgagagatatttatttaacaaaaatttgagtgccttctgaattctgaggatgtaactataaacaaagtcccttcccctcgtggtgcttagagcttaggtagggaaactggaaaatagctgatgaattcttcaaggaaaattagagggtgctattgaaacctgtagtaatgggacttaacctatttgcagagagggtagtgcttttagggaaagcattcagaatgaagtaatatttttgttgggatgcaaaagaattatctcagtgaaaggggatgaggcaggaaataattctaagcaaaggagagacaccatgcacaaagtctgaagtaagaaagaacatggcaaatttaaggaattgaaaggtggctgagatagtttgatcagtaagaattaagaagaaagtggcacaagttgaagctggagaggtagggaccaaatcattcaaaatcttattaaataaggaattgttgtcactttatcttttgcaacaattagtaatagagctcaggagtaaaatgcttccctcatttttacgagaaggttaagttttcatttgtaattttgttatatgcaataattgggggaatattgcttaacagtttgttcctcccatcttgtcagaggaattatctgtttggacagaggaagagtgtagaaattttgaacaagggctgaaggcctatggaaaggattttcatttgattcaggctaataaagtaagtaatgataatctcttttttgcaaaaagaaatttagttgaacaactcaaatggtcatgtatcgtaatttgttatattgtctagtgttaaaggtttcataattaatatgacaatattttggtatttagtgagtaattatagtaaggctgcctatacttcctaacctataattacctgttggtgactgttttcagtgcatcatattgcaggtgtttaagaattgtactcatttacaagcatgttaatcaacttctagttggggtgtgtatgtgcaatgcaattctttatagctgttttccacagtctgtgactgttttatggagggcctttgaaatgatttggaaactttaaagcactttcaatatgacattatttgcagttaaaatatttattacatttgcttaagtcctgagtggtctaaaatcaaatacttaatatttaacttagttttagtcaacatttaattttctaggagcttctgtgtcgataaatcagct

SEQ ID NO: 54384 - DNA, 1941 bp, Homo sapiens
actggatttccttttaaatggtcagtattgccggtgcagtggctcatgcctgttatctcagtactttgggaggttgaagcatgcagattgcttgagcctgggagttcaagaacagcctaggcaacatggcaaaaccccatctctacaaaaaatagaaaaattacctgagtttggtggcatgcaattgtggtcccagttattgagggtgctgaggcaggaggattgcttgagcctgggagggcaaggctgcagttagcggtttggtgccactgtactccagcctgggcaacagagcatgacactatctcaaaaaaaaaagaaaaagaaaggaaaaaagttatcagtattttatttatatacatcagccctaaatcctcagtattttatatatatacatcaaccctaccaccagttctcccggctaagtaacaaaaaggaattctgtcagcatcatttaattccgtaggcatttaacattatgtgaggggagccattcagttgcacaaataggtacagcacagtaagccgcaagagtaacttagtaaacaaagcattagcattattatgatacttttaactcactgtggcatcttcccagactttctagagagtaaattaactgagtctgggttgctgttgggactagtaagagaatctttcaaaagggaatttaaagatacgctccctaggtacccgtactctgtgagtaaaagtattagcaaactgtttataacatttattttaacatgaatgccacttccaggccttttttttgtgtgtgtgtgtgtgagactgagtctcattctgtcacccaggtgggagtgcagtggtgtgatctcagcttaatgcagcctctgcccccacccccaccccctgctggggttcaagtgattctcctgcctcagcctcccgagtagctgggattacaggcacctgccaccatgcccggctaatttttgtatttttagtagagatggggtttcaccatcttggccaggctggtcttgaactcctgacctcgtgatccaccccccttggcctcccaaagtgctgggattacaggcgtgagccaccgtgcccggccaacttccaagcatttttaatacaggaatatatttttctagtaaattaggatgatggtagcattttaaaaagcacagtgctgtatatctgaagacctgttgccaatatattatttctcttaatagatgtttagaaagaatagctttcaacatagctgctacactgttgtatgttatatataggattatatttcagttaaggactagccaaatttattttcaaacttcagatgtttatcatgaagtaactttgttaaaaaggagattcttaaaagcaagcatttgtttcttacaggtccgaacaaggtcagttggtgaatgtgtagcattctattacatgtggaaaaaatctgaacgttatgatttctttgctcagcaaacacgatttggaaagaagaaatataatcttcatcctggtgtaacgtgagttaattttttccttaagagctatatatacatttttgctaagcttttctagatttttcttgagttaattattattttgataatcttgcttttatatacttgatcttaaccagaaggccgagagtgataaaatcttgcttttataatacacattaaactttaccatctattatatcttcataaataaggcatttagacttttcagtgtcttatgaaatattgtaaactacagttcatattatgtatgagacaagcatatcattaaagcaagatttagaatgtatatttttaatacactgttgagaagaaatggatcagaacagctgtgaaagcatgtttttcttaaattcagttccattcagtataagcacatacagttttaatcttctttttttttttttgagatgtagtctcaaatctgttgcccaggctg

SEQ ID NO: 54385 - DNA, 1107 bp, Homo sapiens
ataataccaaaaatatccaggaaggttttaggaggtaatcagtcctttttgttaggctcaaatttgtcttttaggtatcgcctttaggagctttaaaattcaatctatgtttgtacagaaattcttttgtacttttactagacatcacccctatcacttcagttaagagatcttccagttctagttgggccactctgagcacctgcctacaactttacaagctttaaaatttcctatgggtctctaaaatttgttactttaaagccgttatgcatttttcctataaacatgtaaccaaaaggagcttttcatttaaatattcagatcctggtatgatagatgaagcactggaatgaatgttaagtgaatattaggatatatttgttaagaaagccttctgaatttaacctcaactaatttttaattttcagctctttttaatataaaaattgttttattaattttaagggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggtaagcaaccagagaaacatttctctttcttcataataagggacactttcttgcagtgacttgggaaattccgtttgggtttctattaaacttccagagcagaaagtaaaaaatgataacacatgagacaaacataacatcagcatacatatatactaacagaatacaaagtgattggacatcactaaaaagtaattttaataaagcctactgtcaacagtgactatttcttgtaagaaatttgttctttttcagtagcatctcttttcctgtcttgtctagttgggttgatgcctagatacaagtatttatgttaactcttaggtcaaaaccctgcagtttcacatgagatatacagatcattgcaaaataccttgatgtaaggtaacaagtgcactgttttgaatatttaagttctctttgatagcataataaccttgaataatgagaaaagataaagccggtatcaacctgtatattaatattctacagaaatatt

SEQ ID NO: 54386 - DNA, 3828 bp, Homo sapiens
tttccattaattcagcttagttagactgctggatccagtgcttgtttgctgtcacatatacctaatatgcttttaacatatgccaaattctgttcttagttctttacatttattaacttatttaattttcacaacaaccctgtgaggaatatctattatgatcttcattgtatatatgtaatgaaatggagatacagaaagagtaaataatttgcctaaggcgacatagcttataagtaatagagcaagaatttagactatgtatttgataccttgcttccttgataacaataactacaagctgttttataatagtttgcaaatttaacttttttctaattgtggtttcatttatatttctttcaacttaggagtgtcatctaatggaccaggtgaaatattaaacaaagaggaagtaaaagttgaagggttacacattaatggaccaacaggtggaaataagaaaccacttcatgcagatatggatactaatggttatgaaacagataaccttaccactgacccaaaacttgcccatatgactgcaagaaatgaaaatgattttgatgaaaaaagtgagagacctgccaaaaggcgaagggtaaacagcaatggaaaagaaagtccaggttcttctgaatttttccaagaagcagtctcacatgggaaatttgaagaacttgaaaacacagatgactaaattttagacctattttactttctttggagtaaattctggtgtgactaaaattttcagggttgatgggttaccttaaaaagttgatttccttgaagcagtttgaaaatttgaattgagtcttaactttaggaaatgaggtttcataattctgccttttgcagatttttttactttaaagctgtcagactcttttaagggtattttaaaaattagtaaatttgaatgaactaaagatatatctctaccttctcatttgaatatctttagttcattcagatttactaattttggtaaatctgaatgaactaaagatgtatctgtaccttctcatttgatgtattaatcataaaatttcactacaaggtaatttttgcttagtttgatggatgaatgggaaactcaagtccaaatttctgcttaataccaatttctctgagtttcttgaaatgtctttaaaacagacatttttctcaccaaacagtttgagtatctttattaaggaaacccttacgaatcctgaaaattatgctagcatgatttttttatatatagaagtttaaaaataaaccaggtcaggtttgtatatgtaaaattgttgacatcaatgatgtctttccatattcttatctgggcttaagaaatacattctgtatttttccagattctttgtagcctttgaaagatttttacagtacatatgtcttgactgagctgtcctttcttaatacaaaagcgtgtataattttcttaacttgtacagttggtaaacttttatgagaggaattgttattctgagtctgtcagctttcattttattttgctaaggtttttctaatgaatttttaagtgtttgtgtagtaattaagtcatatttcttatccaggtggttaaagcattcataaaggattataaaatttttttttttttttttttttttaaatttctacttaagggcaagtaatttgagaattctgaaattaagcatgatgcttagattgcagtttgttttgcatttgctataattttcaaaattatttttgaagcaagacaaaagtttaatgtcagcttaagtgcttaaatatatcatgctgaccagaatcctgttatttttatatgcatcataaaatttcccatttctgcattaaataaacagaggaggggggtcaagtgatacttagatattggcacacacaaggaacaactgttggcaggcagtatcgattttatgaagagaaagtgaagtttgaaaacttttcaaacttttctagttacaatccaatttttcagatttgataatgcttttccaaagtgaaaataagatacacaataatcattgctctgtgtgattacagataggattatccatctgcatagccttgtaaaagtgccattttatttttagtgctaaattcttgttaaataatgtagttttatatagctgatagaccaacctatatccaaacttttataaaatattaattattcttgtttttctcacacaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcatcttaatgtacattcactgttgttacatacatatctaagtaaatcaaagttttgggtggaagtgttgagaagtatgagttttttgttgtttttgttttacttaaaacttttaatttatccagaatggcagtagctttagcaagcagatggtcacaatctgttttctaaatcattttttattaaatgaatccaaagtatcctagctctttgtcaaagatggtctgtagaaatgtttttaaagattagggatgctgtactttttgaattgttgcagtgttggagatgccattttcacctttttaaaaagatgcattttatttgcaggtttgtgaagttcttgcaaactcttactacagaaatgttttaaatacattctcaggcatgtttgcaaaaatatggcacatgtatacattttaggaaatgttacttttgttaatctttaaaaaatacacctaatgaaagacattccactattatgcgtaatgctcagctttttgtaaagaaatatttaattgtattttgtgtttatacaggtatttcacacaataatttgttcttaatgcagccactataacttgataagtcattgcactatttaaaaagttttagtaatatcatgaatttaatttgcttaagatttagtacatttcagaacttttgaacttttgacaaattgcattggaaaaagaagtctgttaatagtgatttagtctccccgcctcattcccacccccaacaaagcactatcattttcatttggaatgggtattttctgtttcatgatgtattttcaaatagagttcaggatctgcaattcagttcaacacaagtttgttgagctttaaaatgtatttgaagtaatatttaaataggcatttaaaatttcaaattagatgttaaatttatgcatagtaattttgcactgtaaaataattcccttctcccattccttgtctgccattctgaatatgcttattaaaatatttttttaaacatatttgcctacataatactgtgtgaatattttcattagattaattcactaagattttattagagattgtttgaatgatgcatgttattgacaaggcaaatatatatatatacacagtctgtttcttctattcctagacatattgcactactttttcagtggttcttggtcccctttaccacatcttgggtgatgtatttttgtcttcttcccctttgccacaagagatcctttcagtccctagacctccattcactctgtttctcttctgctggattatataatttaaaaataatgtgttcccgtattttgtagtggagttcatatcacattatgttttgcaaaataaaacttgttttgtcaca

SEQ ID NO: 54387 - DNA, 1490 bp, Homo sapiens
gacaatgcttgatgttttatgatatattttctcataaaaatttaagctgtcttacaaaatttaatgtgtcaatgcctgtttatattttataccattttaatggatgcatagtacttcattgtatgaatttccccactgtgaaactttactcttcatctaattttttggtgtaagtttttttactgagtagagtgtttacactaaaaccctcccttcctccatctctgatagtggctttctgttttgcagcattgctgggagcctggtatattcctatatcactttcactgaagagcagctgagcaaacagtcagaggctaataacaagctggacattaaggggaaaggagcagtgtgaccagaggattgcttcatctgatacgtaggcctaagtttttaatcaactcagaacactggcagttcctacagagacactgaggtgtcttgattatggaggaaataaccattcctttgcacttgtacaatctgaggattgattgctgccttttaaaattttatgaagagagaaacttataattgactctattttaaatatgttgtttgaattaatttatatcagactggaaaaggtactgggctttttaatttatttttcttatatgccgacagtgaaacatcagtgttttgaaagtattttatttcataatttgatatccaggtgtccctgagagctgcatatgtaatgtttgccaactggagcttcatcattcaaattgttgctgcatctggaggcagtttagcctttcctctgctggaaatgcagacgaatatgtgaaatttctcttctttgaatcttatttcttatgattgcattgtcttcatcatatcatcattccatttgccaaggaaaacaactttggcactataaaaatatgtggggctttgaagtgtattgctatctatgttggcttccctgactttcataggatgagcagagtgcattccttgaaaacatgttctttttttgttgtgtagaatggggataatgaagggggtgagaaagtaggccttttactaatttttcatctatttgacttattgattcaactaaaatgttttaagtatatgtgccaggcattgtgctaaatgctggggatacagagatgtttgcagaggtagttgaaacatctcactcctgccatagtgactcaggtaaggttgagaatttagctctgttaatctattcagaagatgtcactaagagtaagttgtttcagcactcaaaagccgcaaatctgtaaattggattaagaacacctgccctacctacccggcaatagtgtgaatccaaatgctgcaatgtgagatgaggtacaagtaaagagctgtgttttgtaaaccagtgcagctcagcattgactccctctctaagtgaaaattgcagacaggcaagtctgttttcccttgccaccttcctttgggtttggttgctctttggatgaatatgatgaggtcccacatttctgaat

SEQ ID NO: 54388 - DNA, 2885 bp, Homo sapiens
aggttatgaattagagttgaaaatcttatctgaacgtgagatttactttctagaatttctgtactactgccaccgggagaagctggatcagaatcataggtataggttttaaatagtgttcatgtctagctccaaatgaatgtgacatttttctgttaaagaaattctgcttcacaaaaattcaaactcactaataatgacaataggtgaaaattttaaaagtgggtgtaataacttatataacaataaatttttgctttatcaaaggggttcttttaaatatcagtttctcagaaatgtttaaaatacgattgtttatagcttttgagaaagcatatcccattttttgcttctgttgtaaaatgagtgtgggaataaagtcatgtgtgtattttaaaattttttgttttgtaggaagactttttcttggggtattaaaatgactgtatttgcaatgattattggagcctttgtagctgccaggtaagatgtgggcctatgactagcacattataaattgtcaataattattgataataaatgattgcttatcaataacaattttttattgcctaaataagaattatatctttgaaaagcatctagaagactcttgaaaaggttaaatctttttggctgtattaagataaaggttgacaaaaataagattcttgggattgttaaaatttaaattgatgtaatttagaatttgttactgtcgttgtgctgagcacatagcatgtgccacacaatatgtttggcattttacacatcttattatgtattcttcacaacacctctgagaggtatgggtataattttcctattttatagttgaagaaactaaaacttaagttcaataacttacttaaggtcacagagctaatggcagagctgaaatttgaatctgtggctttcttcagagcctgtgtgtttttataaaccatgtggcatttcttttttttttttttgagacggagtcttgctctgtcgcccaggctggagtccagtagtgggctctcggctcactgcaagctccgcctcccaggtttacgccattctcctgcctcagcctcccgagtagctgggactacaggtgtctgccaccacacccagctaattttttgtattcttagtagacacggagtttcaccatgttagccaggatggtctcgatctcctgacctcgtgatccgcctgccttggcctcccaaagtgctgggattacaggcgtgagccaccgcgcctggcctggcgttccttaattttgcatgctgctaaagaaaagcatgtctcctcttctgtgaggtgaggaaaatgactatgaaacatttgcttgccttttcgaataatgaacaataacattgctttaattggcctcacataagatatgtcacaaatgccataacttagatattctattaggttattaaagcttttcccatttttcttaagttttagttttaaaatacatgaggaaaatgtatacccacagacctagaaaattataatgatgctagaagtcttctacaacattttaatcagcccagggcatgcatatatgtatttactaatgccacacattctgccagacatatgttttccatccaggagttccagtgtacttcttgaattgactcatttaccttcatcacattcctgtagtataggtggaagaaaatattatcagtccagtcctgttttacaagtccaatctccaagtaaaatttcattctaaaaaaaagagagtggcgtaattggttactagaaattggctatatagctaactgcttttccttctatgtcatattccccccttggagaaaaattctatgctagcctcctacctttctttttagaggtgccctgctagtctttgaaacatttccttgaagctgatgggacccaaaattgtaccaaacaacaggggttcctcagggctttcttgtgtctacaaaaacttctgaaaaggattactgtctggaccagccttatctggttagaccctttgacttggaaaaagattgaaaggaagggaactcagacctctgaagtcagtcagaaggttgttagactgcttggggtagggagtgtgcattaagttagtcctgcctaaaattgcagtggcatagaactcattagataagtcttggctcctatacagtatctctgcaaaatcagagtctgtgcagccactattttagctagggtgctgaagtatgctgaaggcatacctttctcagattttcatttattctgtttaatttactaaattcttatctcgtgcctggtactctaagttccagaaattttcagtttccctaaacccccaagttatacttcacaggttcattgagctattgtttaagtatttgagttcctgctatgtgcttagacattgttctagcttgatctcagaactaaccatgatccacacttcagaaatttcacccaggggcccaactacctatgcaagatagtcctacctttcatgtggaccttcagaaaatgacttgttaatggcctcatccttttggttttcttgtctatgaaattgagctctgcctgcttctgcctgcttcacagatgtacttaatggtaatttggtgcttgttgtcatctggctttgaatgcagagcggtgtgctattaaatgacatgaatgaccgttgctaattatgtgtttaaatgttagtgcctcttatttctgaggaatcccttattgaggtgaaattgcaaactatgaccagaaatcaagaaatactagtagctgataaaatgcctaatattcacttccctagatgagaatatgttcttgtaaatattttagcttatatctatttaaaattaaatgcatgttctttaagttgttcttaaagtgttgct

SEQ ID NO: 54389 - DNA, 2212 bp, Homo sapiens
tttttttaaggtgtgtgaaatcgttgcagagatctgtatctgcactgccttgagaaatcctttgcaggcagcggactgaaactgtagactcggacaagatgggacaagcggccgcccgaggctacatcagcggggtggactgacaaccaacaggcagagagttttctcccaagatttttgtttgatttaggggcggacgttgatgtggcttgtatcggaatgccttattaacgttgccgatgtgcaaattgaattcacggagctaagttaggtttgttctgatcttgtttttttctttgccctttttgtagatttccctcctcactatgtgttggacttggccaggttagttggaatcctcaccattacgtggtttatgttgttagaacttctgtgtgtgtctttatgtgtagaacagtgaatctgtgttctcttgtttacagatggtggccacagtggcagttctctgggtgggaaaggcgctcagagtagtcaagtttcctgaccttgacagaaatgtacctcgaaaggtaaaagaagaaaagcgatactttattttgtgaaatgaagtcagtatgtattaacatattttatcagtgccttgcgtatttaaaaattgcagcctcaaaattgcccagtctagagtggttataatgaatgtaaagaataaaagtagtaatatgtgtcaaagaaggcctacagtctctttaaacttaagagaaaaaataacctaggaatattcttctgtttttaattaatgcacacttgttgagagtacaatagttttgcagtttctctatccatctaatctagccagtgtatcctgcattcattattctttgggcttattttatactgtctgcctctgcttgactccaaacgaagatgaaatgcctttactttttctgctgacaatagagccatgggctctaatacattatcatattttacagcaaatgatgtttctgtctcacattgatcatattcatatttctgtcttttctccctgccttcctccctttctttctgctatagtaatgttgtttatccaagcataagttttgtttgggtgtttgggtgtcaaaattgtgtatgataactaattttacgttttaagtggaaaaaattttgatcatataaacaaaattgtttctgtttgaaaggaccttgttttagctatctttattattgagttttgttatccctttttaaattttctagacgtttccactacctctactatattttgggaaccaaatcacgggactgttcagcacaaagaaactgaagtatggataactttattttactagtgaggttaatataatgtattcttaaaattgtacttgaatgtcaaatatttaacacattgttattgattctggaaaaaaatgaaaggaccagaaagcttctattactactaaataatgaaagtggtgccaaaggttttagtttatagtttatgctcttttctttgaagagaaagaggagttttttgtttttgtttttttacccctcattttgatgttagaagtcttaaaatgttataaaatgctatgataggaaatttttattatttttctagagccacaatagtgaagatatatactaggcttctgggatttcagttctttagtatagttcataaatattttaggcaacttccacacagcaaaattagagggtaggcacaagaacttttgcagtttttcttttaatgtgaagtaaggtaacatcagctagaaccctgataaaaatattattaatatcttacacatggcatgtaactgtagaggcaacatacttattttcagaaagaagcaatagctctcctctccatggtaacactgtctttccctctaacctcccggtttctggcttctgctcttattgtagtgtacatatcggttgtgtgtggtattaaaatgacacaaatagagaaaacatttaacagaaaccccatggcttcaccactaccacacaagctaaaaccctggcattgtaaaatagaatggagagatttttgagcatcaaggacaaggtgtttttcatttcttcctttaaaacccgagaaacctgacagaatgaccgagatgatatctctgaagagggttccaaggaagtcagatttatcatgggtgggacatttttttccatttcattacccaccaggaaagaaatgcaggccttctgcaaagtgctgcttgtgtag

SEQ ID NO: 54390 - DNA, 1031 bp, Homo sapiens
gaggcactattcacgtttccctcccctaaggtgcagataaatcaacaatgtgggttccggcttctgtgtctttactcccattattccctccatctgggctgctttttctcttcctcctctcacccagctcctgaaaaactcttacatttccttccgtattttggcagaacattacctcttctctgggcagccttcacactgccccccacttccctctacataattgatctctctcctttgtgcctctcctaccgcatctttatataccccctttatagagtgtccatctgctgctgctgctataacaaaatacctgagactggataacatataaaaaatagaaatttattttctcacacttctggaggctgagaagtccaagatcaaggtgccaccttaaccactgcatcctctgaaggggaagaacaccatgtcctcacatggcagaagggacagaaggtcagaaagggacaaacactgtgtgaaacctctctcataaggcatgaatcctactcacaaaggcagagccctcatgacttagtcacctcctaaagggcctgcctcttaataatatcacattggtgattaagtttcaacatatgaattttggaggacacatacagaccgtagcaaaggggctctgcattacatgtttacatatcactctcttccactagacagttgcttcttgaggacagtggcaggcaagggtgcctaacacagtttagatattttagttgattgaatcaatggaaacaaggaaaatgattaaatttcttccttgactgctagcttcaaaaggaaaaataactaaaacattgtattttaagaaacatccttgcagaaaaaatattatagaagtaacaatgaccctcataataaaaagcaaatatatacatatatacacatttttacacattttaaaaaacatacctggaatagaaccagagaagaacactaatcctcaagccacacactgctgctgacacttagtagttttgtgaccttgggcaaattactagacatcactg

SEQ ID NO: 54391 - DNA, 1620 bp, Homo sapiens
gggccataaagggttacttaaactgtatcatattttatccattttaagaagaaaataatatgccataatagtaattgcaaatgtggggatttaaaagttctccagaggcatttcttgtgaacctcaaggcctatacaggattggcggggcgctgtggcccatgcctgtaatcacagcactttgggaggccgaggtaggcaaatcacttgagcccaggagttggagactagcctggacaacacagggagactctgtctttacaaaaaaattaaaaaattagctggacatggtggcatgcacctgtagttcccactacttgggaggctgaggcaggaggattgcttgagcccagggaggtcaaggctgcagtgagctgtgattgcaccactgcactcagcctgggcaacagagtgaggcactgtcttaaaaaaacaaagaagtctatacagtactgaagtgactttattgtttgttgaaattctgtctcttcatatgagtaagcaccttgagaactagtccatttacttcatttctgtatccttagcaatttgcttggcacataacacatattcaataaccttctgtttgtgtgtttagatgtcttttctaattcttcattcagttaactttacaagtatttatggagtacttactatatgccaggcattgcgctagcacatgtgtgtagatgtgcacacacacctccttgtgttttcctgacatccaaacaagaaggccccactcactgcatttggttctcacacataccacagagctgaggctgggagttggagtcccgttccttccagtatatcctataatggaggaggcagcccatttgctcctggactggaatgctgttccatgaaattaaaatgctccccttttcctctgtgatggcattaatgtgggggccactcagtggtgctgtaaagtagggcacaggaggcttctgtcaccctccaaatccaaatcattaaactaaagcaaaatttggcaaaagatcccaagactcacctttgtgcttagagttacccaggatggagctgcatcctccttgatcccctgagagtgcatacacacggatttcataacagatgtaggattttatgttctctgcaaggaaaagggaattcccataacagccgtgccattactggtgagtcactaaagggagccattttattatctgatacaaatgctttcaaggtgtttcttgccttttcctagtttaaagatggttcaagcacagtctggactgatgacctatgttacaaattctcagcatctgatttgccatgacgttggcttctggaagttactgctcccaacttcaaaggatgagatcaaccaaccaaccaacctgagtttctttccatataaacaaacaggatcaccatgattaagaaggagacaaaagctatttgagttccaacacggatttaaatataaccacacacacacacacacacagacacacacacgcacccagactgcttttgaaacaaacaaaacaacttgccttcaagaaaaaaaaccttttgattcctacaaataaagcatttgctgtttacaggaaagtgaggctggaattttgcaggcatagaacctgaatagctt

SEQ ID NO: 54392 - DNA, 1004 bp, Homo sapiens
gggattacaggcgtgagccaccgcaccccgccgagtttcagtgggttttgaggttcattttgccaactttgaggttgaggttgaaaaagaaacacaaattacaataggatctgtgacctgtgctgaggacctcaatatttaaaaaggaaagagaggggaaactgggaaggaaaaaaatgggtggggggtggggaagataggcaatgaggcaaagtggtcttgtgaggctttgattagcattcagtgaatctacattttacatgtgaaaggaggggtaaagggtcaattatgcatttttctggaactcagtaaatctatgtttgacataaaataaagtaagcatgtgaagttacagctatctgtttggtaacaaaagaaaggcagtttttgcatgactcagctcccaagcttatcttttcttttggcatagtgagtttggggtcttgagagtttattttcctttcacacctgctagctcattgagatgacttcatctatgctggtgatcacagggaaaactagaactcagcgtcatatactcaacatatactggctcacaaactccagggcaagtcagagatgtcttgcatgctgaatttatttcaacagtcataaatatgagtgcctacactggacaaggcactgacaatacaaaagcaaagaatctgcctcaaagagtccactatctaatggggaaaagagaccccttccattatcccatccctgcttactatgggtaatcagcaagatgaagtcctataatattacctctactccacccaaaggggttgaggcccatgcagataatttattcaccatgactatcacagaatttctatagtttacatcctgttgagaaaagtccttgtggaaaattctcaagtctactctagcctggtgagattgcttgcatagacttaagctatatgattgagctcaaaaagccctttctctattcctaacacaggggattaaaaaattaattttagagagaccttctgttc

SEQ ID NO: 54393 - DNA, 1050 bp, Homo sapiens
gagttcgggaccagtctggccaacatgatgaaaccctgtctctaataaaaaatacaaaaattatctgggcatggtggtgggcacctgtaatcccagctactcaggaggctgaggcaggacaattgcttgaacccaggaggcggaggttgcagtgagccaaaatcacaccattgcacttcagcctgggcgacaagagtgaaactctgtctcaaaaaaatttttttgggggaaaaaaagaatatatatatatatatatatatatatatatatatatatatatataaaatacatttctagttagagattgttagatcaaaagatatatttttaaggatttgacacatactgtcacccaaagtggttaaataagtttagtctctcaccaggaatgtgtgagagtgtccatttccctgacccatggcagcaacagctattatcattttttaaaagcctcatttacccacttggtaggtgtaaccaactcacttttgctggaagtaatgcgttgagaaaatgcccaccatgatgatagcaatgcaaatgcttggtgccacaaacgccatccaattggctttacctgaaaagttaggaaatcctgtgactgagtgagttatcaccaatgaacatttcaaaatcctgattggtgtatgcgccctctgggccttacccacagttcctgggcagctgtgctcaagaataaggtaaattcacttttgtctatgcagtgcgggaaatgggaccctaaggggaccaattctatggttccaagaggagctctggccctacagggctcctccgactcacagggtcagaaagaaaggaggtacggaatgcaaagtacagttgtgaattgggagccttgtcttagtcctggctgtgccgctagcagatgtgtaatctgtggacttcagtttatttccttcttttttttttttttttttttttttgagatggagtctcactgtgtctcccaggctggagtgcaatggcgcaatctcagctcactgcaatctccgcctcccgggttcaagcgattctcctgcctcagcc

SEQ ID NO: 54394 - DNA, 2764 bp, Homo sapiens
aaaaaaaaaaatcatacgacctcatagagatgtttatgggttaaatgttaacgtatgaaaatgttttcaaaagtgcctggtacatagaagataatatatctaaattataataatgaatgtataatattattatataattatatattatatgacagaatatagaaaatatataattatataacctgtatattatatatataaaatagtaataacagcagtttgtatacatatatataaaacagcagtttgtgtgtgtgtgtgtgtatagacacacacacacacacacacacacacactgctgttattatcactgtttttgctgttgtaacttaatagggatgaaatccctcagaggagacttaaattatgggtcttcttgggaagaaagtgaatgatctttgtcttatatgacccatgtgctttacatggcatcttatttaatcctcacagtggtaagtaagaatgatactgtcaactcctgttttattgaggctgaaacttgggctcagatagttgggcaagttgcccaagagtcacacacatagtaagtggcagaggcaggggtggcctctgggcttgatttcaaaggcactaaactatagagacttaaatgcctaaagaatctgtggctgggatccactctttttttttgagtggaggttgggactatggaccactggcttctggcctgaggaagggtgtggatgacagaacatactcggtagttggagagaagcatcttgagcaaggagtgttataaggtcttggaaagggagcctggagttgtcaaagccccaggtgatgggaggaatattgacttgccacttctctctcctatttctccccttaaatgtagtcttcatattcagatactttcaacttccagaccctccaccagggatggcccatcttgcccactgtgagctttctcaccttctttcctgggctgcagcagttcccttcacttcctttactctcccctctctcatctgccagctgatcaacctctcctttaaaaccttttctttgcacaatggaatgatgtactggcttcttgcccaaaccaaaatagtatgggttctatttatcttttctatgcttagacaggaaaatcaaaatcttcaattctcttgaattttggatgactcaatgctcaggctagtactcaacaaatggcaaaaaaaaaaaaaaaaaaaaggaaagtttgctttcttcttttgaaataagttaggtgaggagaacaggagagcagtttggtgagaaggggaaagtgaggcatactgaggtataaaaagctagggggttttagtcttatgatcataaacttcagaagattcctgtgcctggtttctcttaagttcaggaattaaaatgagaatgatgactcagtggtagccaagcgtgaataacttaagctcaaccataggatctcagcacccaggcttcctcgtaactacaatggaaaacttagatgtggtgatcactagaactccactgactgaccacagaggaattgtaccttacctctgcaatgggatatttcttagcgcaagtgctatttgctggatctggaatttctctgctacaccactgaggtctgagggctgctaggagaacaaacaccctatagataaagaaaacagtgacatttccttaggtgtgcacacagtggcatggaagcacaggttctcagtgcagtaacttcagtgtaagggctgcttttgtatgcaaataaaagataaacactgaaagacaaagatgatttatcatccaagactacggtagttttctgtaaaattacaacacagccacttgaggtttgctaaataaaccatggaacttttgatcaacctaatatttagcaatctatcactagccagctatgcattcattcaacaaatattgattgaacccctaatatgtgaccagcacaatgctacctgccaagcattgaagatgacatgttccctacccttactatttagctaattagaatatttacaaagagtttgtaatgacaggtaaattatgtgaacagttgaaaaaaagacgggattcaaaatggtataaatagcttgaacacaaccatgttaaaaatgccaagaaaaaagtattatagggaaatatctgaaatatctattaacagtgattgtatttggcaataagaggaaatacaggtcttttatgatgtagaaggaaaaatcctaaaaacatttcttataaatgcatgtgacttattttttttaaagttcatgaacaatatgaaacatttttaaagacttggctttcataagctttgatttttttttttttttaaaagtatgctttacaatttgtctaaccttttgaagtaagagatgtggccatgtgactaggttttctccaaagaaatatgagcagaagtgtctgtgatctcatagagatcatgcagatgaggacaatacctaagggatggtatgccaaaaagatggaagaaaactgagtccacaaataactatggagcacagctgcccaccagtctggataccttacctcagggctgttatatggaagataaataaagtattatttaagccactgtgctttgggtcctctttttttttttaaggcagtttagcctgcactgtaactgatcttcacaatttccatgaagaggatgcatgtgatcctagttgactccttttgaattaaactttttcaaagtctacccaaagagagcttcacgttgaagtatctatcacacattagatcttcaataaatgta

SEQ ID NO: 54395 - DNA, 1413 bp, Homo sapiens
atcatctcaggaagttctgttgaacagtactgatctgctgtgtacagcctgctgtgtagcaggtgctttagaaatagtcattgcatgaatggtcctctagactgtatgccattactactaagagctgtggtttctactctcctcctcatttccctttctggccagcataccaagaaagttactaggaattcaagttggagtctctaggtccacacagtgaaggatgtaattttaaggccctgggaaaggcaagatgaggcatctgagtgaagaccaactcccagttcctaagactcccccagagctggcttgcctgtcctctagctgcagccagaccgatggtggcacccagagatgacagctgctggagcaggggctgggggaattggggcaggctgtgctggttgagggcacactgactttaaggcttgaagcctcaccactcagagcatgagggagtcacacctcatctttaactgatccagagtcagcttatcaccacaggagaaggtgagtgggtgaagagaacttgaggggaaaacagaaagggagatgtgctgaggctccagttcttccagagagtcagcgagaggtgcctcatgtgaggggaggtcatctatgttggagggtaagtagccatcatgggtgggaaggtcacctgctgggagcaccgtccagggacaggctgggttttcgggctttgggtcggagcccctgctctccagcaccttgtacagatccaccagttgtctgctctcagcttggagagctcttggaggtggtgggcttgaggcactgtgcatcatgtctttctcagaggcctgatgaccttggattcctttttccctttgtggccagttggagcaggggggatgtctgaaaactggggtcacttgatgaaggacttcactgatgaccagcggttcaggatcttcaggcgtgggccagtctatcaggagcctgtccaagggcagctgtgtcttctcctgagagaaaggaggaggaagaggctcacactgctgtagaagtgaccttcacaacctatttctccagggttcccaaaggcctcacaacctgcactgtctcctcagccctggctggaacatgttgggcactggagtttgcgaggtaagagaaacagttaacattgttggggaggcagaggggcaggagccagagactcctctcaacccccagccagtgagtgattcacagccctgctcaaccttcaacctgtttctttctttcttttttttttttttcttgagacgaagtcgccttctgtcacccaggctcaagtgcagtggcatgatcttggctccctgtaacctccgcctcccaggttcaagcaattctcgtgcctcagcctcccgagtggctgggattataggcatgtgccaccatgcctggcta

SEQ ID NO: 54396 - DNA, 3524 bp, Homo sapiens
tttcagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcacttcttaaaagtcataaaaacaatcaaataggatcatgtttattgtcatgtgtttcctggtttctgacctgtgtgcacacccctgtgtgtttataatttttaaattgaattttatatggggtttttatttgctaaaaaccaggctgttgaatcacatttgggaagggtacttatcttaatgactaatgacttaattgggaaagttgaattcttgtaaaatacaaaatccaaggacttcttggatttaatctgattgtcacttcttagcagatcacttttttgataatgaaagttaagcatactgaatgctacttttgattgacaaactggctataatagtctaggggaaaaatccctaaacagataaagattcctaaagtaatggtggcagctgatgtttcagtgaacttttatcttgatgcgtttaaatggaagtaatgccagacctgagatttttaaggcatttttacagcttgtattgaaatgattggagacatggtttctttattagctattttgagacctgtggagttaagcaagacttttaaaaattggcaccatatacatctagttagttcctttactcttatttttttaaataaaagtagtacacatcatttccagggttgtaaatatatttggggcttgtttttggtatggatttaaaaggaggatattaagtattcattctaattttgttatttttctagttgccagagatggttgcactgaaatagaacagggagttgcatacaaagcctaaatgtgtattggatttcgaaaatactaggttggtgcaattggttttgtaccaacctaacatgtctttaggaaagtaccatcatgtggaaggaaacaacaggtgttaaaaggttcaaaggaatgagaaataggaagttactagaacctaactgatgttgaccttagaggtaagattattcaggtatattagtggacctccagtccaatggtatagcaaattccagggatctcaggtgcatgcaattttactttctaaagtaaacacttagaaaatagattataacccagacgttttggattatactgagacaaatatgtaaataagttttagcaagtctgaacatgtaccagcgagatcttcaggttaactaagaaaagcccagaaacttcattatttactgtgctttgtatggcataactggtaacaaggcagtaaaatgatacatatttgaactggaccatagtaattaaatgatttatcaatatcatttgcaagataattgtcaggttgagttaatagtaagtggcagcttcccagaaatttg

SEQ ID NO: 54397 - DNA, 1493 bp, Homo sapiens
cagagtttttctttctgagtgttctttttaacttcagtgttagtgctagtagtaaccttatatgtcatctctccagaggtcttcatcaaggattcacatggcagtcctgatctgaagggcatatttaaaatgtacttgtccagatttcactgctaaagattatgattcagtaggtctaggatgggcttcagccgtttgggttgattgtgatagcatacatgtctttagttgaggactgctggtattacctgcaattttgagatagagaaaagtgcaggaaaatcttcctccaggatcactaaagctgagccctagcttgttacctgtggaggcattgagacatttgttcacagaaagtacagtttggatttttggttttttttagaagaaagctcattatttagaaattttgcaatgttacttttctactaataacacaatcatcttcacttatatttttaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaaggtaatttaagactttcttttccttttacataatttaaggacctcttataagtcactggctgggtcagacttatgtcacttttgggaacataagtagaagtagtagcagtgtctttaagaaaccgcatgttaggttatatttatgtttaaagcacttaaatgcctttttgtgtagtgctgttagtagtgttaagttaccacccttttgagttctttctaggtgccggtcatggtgctgggctaggcattttatgtacttaatgtcatttaattcttgttactgtgatgacattctcattttccagatgagaaaattctggtatagtgaatcaggttaactcttggcctttgctaaggcttacctgaaaaccagtctgttcactttgataattcctaactgctttttaggtctccacttaataaccattgtgttccttgtataattcctcttacgacacttaggattgttgacacttttttcttttactagactcttctgtgagagctgggattcatttttggcttactttctataatctctccaatgccttgaacagtatgtggcacaaaacaagttcttagagaaatattttggtgaattcccaagtaattgatagatttgaactcagatctgatgcttggaaacaaccataatgtcctcctaaattctcaacaccttacacacaaatttggggacccacctacttgattgagtctgtttttgatgattacaggggtaacttaccattgccagtgtaatgatactttgttcctccctctaagaccaaccttttttttttaaggtggtggttgtgttgatgggcttttcccatactttcttttttagttctgttattt

SEQ ID NO: 54398 - DNA, 1035 bp, Homo sapiens
accccgcagatcaatgcacatgtaacctttgactctcccaaaacttaactactaataacctgttgactgaaagtcttagtgataacataaccagttaacacattttgtatgttgcgtattatatactgtgtttttacagtaaagtaagctaaagaaaatgttgagaaaatatatttactgttcattaagtggaactggatcatcacaaaggtctttattttggataggaagaaaagggattgggcttgcttgtctcaagactgacagaggcagaatgttcaaagccacgttgttcaagggtcaactgtattggagaaagtcacattgatggcttttgatttggtagcttccgtttaagctttggggtgtgttcttagaggaatgtttcagtgcggcttcctgtttggctttaaaaactcatacaagccctaactatattatttcttctcctaaattcattttctctatcagcttcctttaaccttttgacatttgtgtttgatttattcatatcataaattgggctgtgccagaaatccagactgagttttatcatcctaaggtaaagttaaattaaaatattgtgagggcaaaccctttcaataaggtattagttatttttattttttttttttgagacagaatctggctctgtcgcccaggctggaatgcagtggcaccatctctgcttaccgcaacctccacctcccggattcaaacagttcttgtgtctcaacctcctcagtagctgggattacggacactcgccaccatgcccggataatgtttgtgtttttagtagagatgaggtttcatcatgttggccaggctggtctcaaactcctggcctcagtgatccccgcctgcctcagcctcccaaagtgctgggattataggcgtgtgccaccatgcccagccaataagcataattttttaaactgcaaaatggctataagacaaacttggaaacattttaaaataaaatggaggttaaaaagattaaaagtttttttaggtttagagatgatttttaac

SEQ ID NO: 54399 - DNA, 1473 bp, Homo sapiens
agaggaaaggatcatattctatagttaagacctgagaattatatttggaaataaatggtttagtattaaataatgaaaccagtgtgtgtttgtggatagttctattagtagtgaatccatggcctcctttccatatacaggttggtttgaaaattggagtataaggattttaggatttgtagaaacacggctattgttttgatttgctctaagtgctagttgctgaaacaaagcatagaggaacagttcttttatattccaaaatttgaaccctggttgctgacagacatcctagaggattaccttcttgtatgttattaagagttacatattgtgggaattatggaaattaaaaatgtggtttaggagaagataggctgaggattttacataagagggtagtttttaaacaaggtagtgtttttaagaaatgtgtattttagtattcgtaaagccagttctagattgtattactgataaatgatcatttaagagttcataagtatgaattccatattccttacttgtctctaattagcaaacactgaattcctggtctctaccaagttgcttagttacataggaaactagggtaccctcatccttgaataatctttctctaaaagattacaaggttaattttctcaattaaaatcataaatttaaaatacttttatgtaatatcagctctctaccaggtataaaacttgaaaaccttttcacagggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggtaaaattaagttttgtcgtgtttgaaaatgttcagatgtgacttgaattgtatttataatttttgttttaaaatttcacatgggttatttgtctgttaaagctttacataggatcatttggggcagataatttgctttataaggaaaataaactgtattatcacatattctaagaaatttagtcctttgatcaatttgtaattatgttttatgtggtagagttactttttcctaaaaagctgttagtggagtatcttgtagttattggtgttcagaaatatgatagttcttttcaaagttgtggttgtatttttgaaatcttgccaaactggggatcattaaagggctgtggtattatggtgttaggttgaaatcttgacattttcatatggtttaacctaaaatgtaagtgacttcatttagaattcaacttttgaaactgtctgcctataccatatataatggccaggacactcagtaaatggcaatgtgcattttgtctaaggaatgacgactttaaaaaccaaagtatatgtgggttttacttaagaaacatggaaactagtgaa

SEQ ID NO: 54400 - DNA, 2045 bp, Homo sapiens
actcctgacctcggtgatccaccctccttggcctcccaaagtgctgggattacaggtgtgagccaccacacccagcccttcactagcttttaaaattacatggtgttttgttttgttttgttttgttttgttttgttttgttttgtttggagacattctcgctctgttgcccaggctgaagtaacagtggcgctatcttggctcactgcaacctccgccccctgggttcaaacgattctcctgcctcaccctcccgagtaactgggattacaggcatgcatcaccacgcccagctaattttttgtatttttagtagagacaggatttcaccatgttggccaggctggtctcgaactcctgacctcaggtgatgcatccgccttggccttccaaagtgctgggattacgggcatgagccaccacgcctgacctaaaatcatgtttactttgccagttatttgttacagtattgtggtttaaagtcttggattacaggttatttaggacagtgattcctaaccagaagcatattcaagttagttggggggtgggaggggcagatgttttctaaactttttcttttttcttttttttttttgagatggagttttgctcttgttgcctgtgctggagtgcaatggcgtgatctcggctcactgcaacctctgcctccagggttcaagcaattctcctgcctcagctcctgagtagctgggattacaggcatgtgccaccacgcccggctaattttgtatttttagtagagatgggtttctccatgttggtcaggctgatctcgaactctgacctcaggtgatctgccctccttggcctcccaaagtgctgggattacaggcgtgagctgccgcaccttaaactttttcttttcttcagaaagaatttgctcttatggtgagcactgttaatgatgggaatatcatattccgtggatttgttgggataaggaaaaatgatatactattggagggagtagataaaaatacatggtattgggtgatgttttgaacttggtaataaaaatttatgcaaaactataatggaatcataattttgcatgataaacaatgaagttgtgattggtgccttaacaaatgaaccctatgcaacgttaagtttctcatagtggtcaacacaacttttttttgtttctttgagacacagtctcctgtctcccatgctagagtgcagtggcgcgattttggccattctgaagttcaagcgattctcctgcctcagcctcccgagtactgggactacaggcatgctccaccatgcctggctaatttttgtattttcagtagagacatggttacaccatgttggccaggctggtcttgaactcctggcctcaagtgatcctcccgccttggcctcccaaaatgctgggattacaggtgtgagccaccgtgtccaaccacaactgtttaatagagcccatgttcaatcactcagtgatatgcaaagattataactgtttaccaaaaggtactaatgtattgataggctattggtagcaaatccttagctcagtgcccaggagcgaaactgagggtgtttggtttaaagaaaataattatccatcacattagaactgtctgtaatcttattccagactaggggagaatctgggcatagcatatggaagtataaatttaagaaacacaacattggctgactttgatgaactaacttatatatagcttccagagcttctgtttggtttttatttaatccttgcagtaattcctgaaaggtaggtgtcatgcctccatgatatgataaaaggtatgctaagttctattcctggctgtgtcataacatatgggtaagcaggactttttttatattcttagatttctcatctgtaaaatgactaggtggactcagtacccaagatcccaagatcctgtcaattcaatataaacttgctctaggaagttttttgttttttttttgcagcatagatgtaactggaggaacttttaagatagcatttgtcaaacagtaaagggcagcatccaggg

SEQ ID NO: 54401 - DNA, 7118 bp, Homo sapiens
ttgtgcgtctcagatgtaaggtctgggagtcaccttgacccccctggagcggtggggaaagttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggtaaagcaggggcagaatgtgggggagactgggatggagggaaggagcgagggggctgccggctgccacttgtttctggagctccgagggtccgcgggagactttgccgcctatatcctcacgtttcttcacgcgacaaaagtccggtcctgcgaaggtgccaggagcgtggtagccccaagttcaagccaccgccggcgaggttctcggagccatccccttcccgcctcaggttgtgagcagaggagcgtggtcggagatgagctgctcctcgagcgcgctcgaggtcctgggaggctgttgccttcccgccggattccttggcgggtgagcgcatggactgaggtgcggggaagccggcccctcaccgaagctttccgtagttacggaggagcttgggggtccatcgctgcttactgcgcagagctgctcctttgaggtgctgttgtttcaggctcctgtcctgccgtcttgtcccacgacggcgcggagtatccccgctgaaaagcagggggtcgttccaggccatcagacgtgtggagtaagctgcaggttggggtgccgcatgtcctttatttgtttctcttccacctctcaactgttaggactttctcataacttgctggggtgagttgagccgttgggaaatggaggagtttggccacactcgattaaccaggagcgggaattatgaatgaagactggtgattgcaggacatcccgaggaacgtcctcgagtcacgatcctctctctcgactccccaaactgaatctttcacgtggtggggtctgggcctcgtgggtgaagtgagtgcagaggctgtcacagcgttagtcgcagcagagctctttagagttcgcagttttttttttccaccacatgtgcgtgaagcatggtcagagtttcactggcggttaatagttgtttctagggcactgtgagtttcacaggattgtcttgatttttgcattcgctttaccagtttgttgcggatgaaaaaaaagagcaagcagtttggagataagaacgtgcatgatcaatagcaagcaggtgttggacctaaggtctgaatctttaaagctgcatttatatgttgaaagttgaaattaccccttcctgccacgtgcttctctgaaaggagttgtttctctttagctttagttgaattctgtaacagtgaactaattttaaaaatcaaaacaattttctcgtggtaggatttgttttaggagggtttttttttttttttttgaggacttttgtgaggctcggaatgaagaacctcggtcctaggtggtgaataaaagaaaataattaattcttgtggtaaaattataggttgaggaaaaatacagttggagtattagaaagcatgtatatcacttaggccaagtatctcttcagccagttaagctttatggcaatctagcacaattaaataaatcatttaattcgtgtgttaagtaacgctgacttgtgtaattatttaaactatgcttaagcttaagaaagtacacgaaaaagttgaatctgacgaataatgtgtaccaggtagatgtgttcactcattttgaatgttcaaaacatgaagcatggtttaaatgcctgagttattttgatcatgaagcccatctatgaaataagctcttacctgaaaagtagtattttaagttaacaaatgtggggaatgatttcatgaagttagaaccaagacttaggttcaccgttcaatgagtctttccatgggaaaactattccatgttagcaatcagcattttccttaggtcagtatttcagagcactactgttaagttgcataaaatacaagcatgtaaaatacaggaaaagtgttgaatggacaatacccgttttgagattctactgtcctgattactgggaataaatctgtaaacaaagtcgctgcatgtagtaggaaggttaacctgattgtgttctgtgattttgataacacattgtgacataatacttgacatactttagacagatatttaatgtttatgttttatgaattaattttgtacattctcttgcccatttgaagaacttgagaattgacagcagaatgtcattgagagtgtagaccagggattttctaaaaaagaatgaatgccttgaaactagtgcagttagtgagcttgcaagttatagataagtatatcaaaagaagcttgcatttttaaatgtcagtctttttcattaggtaggtttaatacgtttttaagattctgtaaacttgatattgggtggggacgccaactattgttcacttgggtgtgtttggcttggatattattgcaaggactggttccataactccaccccagtgcactttattactgatgacatttatttaaataccttggtgtaaggtctaatatttgtagtctatcttgagtatttacagggaatgaacttcaaaattctattgaagagattgatagttactgtttggctccagttaacaggcagcagaacaactgggtgtgtcttgatggtgttctactttcttagaaagaaccaaagtgaagcagcttaaaatcttgtaaaaccaattcctcagctgctttatgactttgtcagaaattgggaattagagcataccaacaatcttaaagtcattaatttaaccatcaatctgttgatccttatgggcaccaataatttaaattggttgcctttgtggggtttcagacattacaggaaaaaagtagtaaagggggaaattagtaaatgcttcagctatcacttagtgtcacaagttttcttatttcttacatgttgcttaaaagcggtcttaacgtgtgtgtatttggtttttaaagattctttgaaaataaagatagttgttagggcaaattttttagaggactctctccatgcataataagtaactgtttcctaacttggaagtacttagggatgtgggagtgtgtacaaacatatatacacttacatgctataaaattttaaactttaataggggaagatggccctttttgtgtgcctgtagctaagaagaccaaaagatgacactttttctggttaaatggctgttttaaactgaagtgatgttctctaataatcctaaatgccatattttcctttcagatttgtaattttatagaattatgagtcttaattgcatttttttttcagattagatagaataacatagtgcggccctcacttttgtgaggggccatatctagtgagtgtgttgatttgcttggttatttatgaatggctgctggtattttctttggtattttaaaagccaaaatgtattgcttgcctaaaattttttaaatttaaaagtttttattaagagactatcttggaaagtgacgggaataatggttgcccaaatgatttccaagtcagttatagaaaatgcttttgagggggagaacttggcaaacttaaatagaagtttaaaataagtttattgtttttattttatttatttatgtatttagtcggtggtatggattggaaggtttattgtctttaaatggcagttttcctaaggtactttgttacacattagagttgcccagtgtttgcttttttccaacaggaaatggtagtggattggaagagaagcagcttttgacagtccaggcctaaagtttttggattgcaaaaataatttgcttatgcaggttatcttatcgttttaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgataggtaagttgtttcttgtttttgagccagggtcttggtctaacatgtaggctggagtgcagtggtacaagcttggctcactgcagcctctgcttcctgggctcaaatgatcctctcatctcagtctcctcttgagtagctcggactacaaggtcacgccaccacactgctaattttttttgtagagctgaggtctcactatatatattgcattggctggtcttgagctcctgtgctcaagctgtcctcctgcaatattgggattacaggcgtaaaccaaagaagtcttcatattttgttactttatagagtcacattttaatgttaagctataaattgggcataattgccaggtagcagtctggctaattgtttctattaatttttcacagaaacatctgtatgtgtgcattgttaagctttagatctttgggtaacagttcaaacttaggtctcttgtaatggaaacactttgttgaattgataaccaatttctttttctttctctctccagatacagagttaaaaggaaaatactgttagttgaaggaaaatactgttggtttattgtttatagcaaataaattacttatgcaagttagatgtgtttaatttttaagtgtattggtaaatagtgatggactggattatatgtgcaatgaatagcagtggaaaagtatatgcactggtagtaatgctttagagtgctaaaatagttttcttgttttgggaggctgtcttgttctggtttcctttgtgtttagaaacagactattttgaattttctgaagtgtatgtatttaactattggtttttgagccagtaaacatgttctgtatttttgatcttttggatgaattttcctcatttcttctggaaaccatggaagtataatttatttgtttatattatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcgtaagtcttactggtttttattttactttaatattttaatctatttaataaacaaactttgaatttctagaactaaagagtattatgttaactcagttttgttagttctttttcacattacagtggcctgaagcacgaggacaaacgtggaggtagcggatctcacaactggggaactgtcaaagacgaattaacgttggtattctgattttcttaaaaattctatacctaactagaggttaatccatacctctgtcaaattttacttgtctctgagataagaatgaatgctctcttctgagagttactatattacaagataatgtcttatgggatgggtttgggttatagtatattgaatgaccggttttttaatatttcgatatatttgttactcattttttcccccccatatgtatttgtagcttttcctgaaaccccacaataaggttatttgggtattctgattatcttagtgtccttaatagttcctattctagcttttgactttgttgtcattacaaaatttgataagctagtaaagcttcattttataattaactgccttgttctgttactttttaagtatgaagtatatgaactaactagtttatattgtttacttttcgacgtcttctggggagtatatttagtaagaaaggagttagagaatgtgagagcttatggtatttttgtatgaagaacttttcagctacatgtaaatggacctagatgcctttctttttctttctttccttagagagtcccccaaatacattcagaaacaaatatcttataattacagtgacttggatcaatcaaatgtgactgaggaaacacctgaaggtgaagaacatcatccagtggcagacactgaaaataagtaagtggtattgcgtgtaatagtaatgacccagaattgaaagcactggagttttaccaataagataacccatagatttaatgctgttacttgatggctttttgtttttgacaagggagacttactgtaccctcatccctcaaagagtatttgaaagaatgctttttttttctttttttaatagagacagggtctcactatattgcctaggcaggtctccaattcctgggctcaagcgttcctcctgccttggcctcccaaagtgctgggattacaggcatgagccactgcacccagcccttaaaagagtggtttatgtgtatatatttgactctaacgctttgaaaaatagaatattttaatgtggttatttctgtttgattagtcattttaccattgtcatacaactgtacaaattttactttgagatagttaaaactagaaaatgtggccattttaacattagttctatcttgaagttatttcca

SEQ ID NO: 54402 - DNA, 1165 bp, Homo sapiens
ggctaattttttgtatttttagtagagacagggtttcaccgtgttagccaggatggtctcgatctcccgacctcgtgatccgttgggccataaaactttgacaaatttaaaagaaatgaaaacatacaaaatgtgttatctaatcacaatgaaatataagtagaataacaaaaagataacagaaacatctccaaacacttgaaagcaaaactacatccatataaatattcctgggtcaaaaaggaagtcttaagagaacttttaaaaaattcattgaaataaatgaaagtgcaacatatcaaactttgcaggatacaactaaagcagtacttggaggtatatctctgtcctctgaatcccccagcatttttcatgttccttttgcaaaacactaaactttctattttaaaaccattatttgtgcatctttcttcttccttagattgtgggtggaaacaatcttccttatttttctatgctagcatctggctcagtgctcagtaaaagttatttgaataaatgaattactggacagaacaagctacttagctaaatggaattgaggccaaaccagttcctgcatggagttgggaagtgtttttagtgatcttatgcaaggtacctgggccgttacacaatgggggccactgcacaggcacaattctgagcaactgcctagtttgtctcacagaagagcctccctggatatatagctgccaaaagtagcatttgccaataaacaatgaaagtagagaaaattcaacatacacaattccatatctctgtccagtttggtaaagataacttctttagttaattaaatcagatctggcctctggcctcctcttattcccctgcctcaactctccaacttttcccatgcatctctctttcccctgctctattcatagaaccataaaacctcaattcagaaggacaataaaggtcatctagtgtggcttcccacttaaaacctaaataccctatagttaacatggggttgagctataagtttttctcagaaccaactcaacttggccaggtgcagtaggttcatgcctgtaatcccagcactttgggaggctgaggtgggcctggaggagtacgagaccagtgtgggcaacatagtgagaccctctctctacaaaaaataaaaaattagcca

SEQ ID NO: 54403 - DNA, 1026 bp, Homo sapiens
caccaccatgcccagctaatttttgtatttttagtagagagggggtttcaccatgttggccaggctggtcttgaactcctgacctcatgatccacccacctcagcctcccaaagtgctgggattacaggcctgagctactgcgcccagcctcctctccccttctgaagctttctctagagtgggttaaaaagagaaagcccctttttaaagaggtaaacgccacagttgggaagttggagtagatttggattgtgaaactggattagatccttagcacatttatatatatatttttgcaatttggggccagctaattagcttgaatcttggtttcctcatctttaaaatggggctaacatctgccttatttactttataggcttgttgttaggagtaaatgaaacataacgtaaaagcactttgtcgtctttatttgcaatacaacagaggttgattctggcatctgagggcataactgggaacttagatctatgcagaccaaaaaccaaaaatagaatcaccattgcacagagcctagaataaaagcattactagctgcctacccatccttccctctccacagtaaatttttcccaggacctttgcattgagctacttgctgaatattcttattctcagatgattcagacctgctttctttaaaatgcctcatatgtctaacacgtaactaccactgtatttagaaacctctgagcagagccacggaatctggaactgcttcccgcagccaagctccataggtacacgacacaactgccagctgcttttcattgcaaatcagcttgatccaattgcactgacagcgacaggctgaatgtaggccagcagcaggggttcatactggctgaatgtaagccagctcatatacttgaagaggactagctaggacaagtcacttcaccacttagcataattacctttaatgggtttagggctgtctacctggaggaagtgaacgacttacgagattctatgaacctattttcctcttcccagtccacact

SEQ ID NO: 54404 - DNA, 1091 bp, Homo sapiens
gagggagatttcaagggccatccctttgtttagatgactgggtggatgaagtgtcattcactaagatagagatcactggaaagaaagtaccagaaggagggcagaagctggtttgtggatatgtggatgaggacatccacctggaacctgttgagttagaggtgacagtgggacatccaggtaagacaagcggtggacagatgatagcttagaccagagatgagacatctagattcaggatagagatgtagaagtcatcagaaaaggctgggaaaaaatgagatcactcaggtgagagagtgtggactgggaagaggaaaataggttcatagaatctcgtaagtcgttcacttcctccaggtagacagccctaaacccattaaaggtaattatgctaagtggtgaagtgacttgtcctagctagtcctcttcaagtatatgagctggcttacattcagccagtatgaacccctgctgctggcctacattcagcctgtcgctgtcagtgcaattggatcaagctgatttgcaatgaaaagcagctggcagttgtgtcgtgtacctatggagcttggctgcgggaagcagttccagattccgtggctctgctcagaggtttctaaatacagtggtagttacgtgttagacatatgaggcattttaaagaaagcaggtctgaatcatctgagaataagaatattcagcaagtagctcaatgcaaaggtcctgggaaaaatttactgtggagagggaaggatgggtaggcagctagtaatgcttttattctaggctctgtgcaatggtgattctatttttggtttttggtctgcatagatctaagttcccagttatgccctcagatgccagaatcaacctctgttgtattgcaaataaagacgacaaagtgcttttacgttatgtttcatttactcctaacaacaagcctataaagtaaataaggcagatgttagccccattttaaagatgaggaaaccaagattcaagctaattagctggccccaaattgcaaaaatatatatataaatgtgctaaggatctaatccagtttcacaatccaaatctactccaac

SEQ ID NO: 54405 - DNA, 1050 bp, Homo sapiens
taatatgtgattcgacaatgtgtttaaagactgacttctcaggtatgtgatgagattggcaagagtttatgaggcagggcgtatgaagtccttggcccagttcctggcagcagactgcactcaggaggtagctcttatgattaggctgttagtgaagctgatagaccatcagtaaagttcttcactgatgttaatagagcatctgcctgggggccaaggaaatgaggacagaaaaaccaccatttcttgagcacttactctgtgccaggcttgtacctatttagtgtagatacaatatagatcaaaacaatacactttgagggagggaaaacaatggcagctgaccccaaaatagctcctctactgtaccaattttgtcatggtacccagaactagtcacaactttgggctgaggtcattatctagaatagtaacatcaggccctatcaaccacttttaccttgaagtgattacatggatcagattaactagccaccccaatggttctgaagtctgatagcctagggtcaaagtctggctcaaccactaactagctgtgtggctttgggtaaggtatttaacctctctgtgcttcaagttttccacctgtaccttagagatgagagtggtaactatctctcagggtttatgtgagctaaagcgagacaatgcatgtaagttctttatcaggcataaatgttatttgtaaagttgaattaattagtgagtcaacaataagaactttgaagcacagatcacaggactgataagtttctaaaagaaagcaaaaggccaaaaatattatggtgcacagaaaaagtcaggtgccaagtagaagccataagtaccttggagaggaagggaaagcctttcttttcttcctttctttcttccttccttcctttctctctctttctttctttctttctttgttttttagacggagtttcgctcttttgctcatgctggagtgaagtggcataatctcagctcactgcaacctccgtcccccgtgttcaagcaattctcctgcctcagcctcccgagtag

SEQ ID NO: 54406 - DNA, 1035 bp, Homo sapiens
caatctcggctcactgcgacctccacctcccgggttcaagcaattctcctgcctcagcctcctgagtagctgggaatacaggtgtgtaccaccatgcctggctaatttttgtatttttttaagtagagatggggtttcaccatgttggccaggctggtcttgaactcctgacctcaaatgatccacccgcctcagcctcccaaagtgctaagattacaggcatgagccaccacacctggcctcttaatatggtttaatttggtgtaataggtataaaataggtataatacagtgtagtttttctcttacagtttaatttttataaaattcgacttaaactcatatttctaagatcatttatattacataaaatcaggaacacacatctgtgattatatttttcatttagtcatttcatcattcattcagcaaaaagatttattagcctttcttcctatgtgccaggcactggggacatagaagtgggcatgaaagataatgttcttactcttatagaactgcaattctagggggagagacagacaataaacaagtcaaccaataaagaagcaagagaagtttagatagggagaagtggtgagaagattggaaagccaagccatgtaatcagaataaactggggaaagaagggcctcctattttagtatgaatggtccaaagaggtgttatttgagctgagcctaaatgaaatactgcaaggtgaacagtgggaacagttgtttaaaaaaaaataaactgaaacatgttttggaaaaaacccaacttaagcctttgcaggttttcacagtggaggaactttccatcagtacgctgcagggtgatgaaggctagggagccaaaaatgagatgggtcaggtaaggagttcaaacaaaggggcaagcaaaacagatgtgggggaggacagaatcagaaaattcacagagtaagaaactggaaaacaaactagtgagggaaatgtttgctaatcaagttagcaaggacttaaaaacatactaaatcccttgcaattacgg

SEQ ID NO: 54407 - DNA, 1564 bp, Homo sapiens
cacattgcctggcagaggatactgactcactaaatatttgtggactgattaaaagggtattatttattcaattactctgtcaacaaatatttatttactcttccagtaaatatttgttaagctcctactgtgtgccatggattgtgctaagcccaggagggagatatgatggtaaaatgatagacattgttcctaacctcatggactttacaattgtatcttggtggaagactgatactgtattaaaagtgttttagagacagatagaatggaactgtgagggattaaagaggaaggcatgtggtgagcctgcaagcatattcagaagtagaactgagccttggcaaatgattgcctgtgatagataaatgagtagaggtatcaaaagtgacttcagatcctggagtaagcaacttggttaatggtagaaccacttaattttttttcttgcagatcattatgcaatagaggccaagattatggatccaccatggtgagggtcagacatctgttggccatggttcaaactatgggtctataatgtatccatcgtataccttggggcaaaggcaatgatttacaatgctggtgcagggcaaaatggtgacttgaaaggatttttatttggtgcccattacctgttgttctgattaccttttcttcctcttgcccatgttcctccctttattccactgaccctcatatccttttcaggtatctgataactcatccctactaaggtgattactgatcattgtggctgtaaggtggagacgcctttttcccacctcccaaacccttacatacccggaatgtttgccttttaagaggaatagaatggatattaggggcataaggatgggtcacagagccagttgttatgattgtaatttcttggtgaaggagtctgcccttatgcctgtgccagttagacctatcctattgctttctatttccctatattctctaccttgcccttttccagtatttttttgtactctgtacatgttagttgtctttattctgaatcctagctctgtgatcttgaaaagtttacttaacatttatcgacctccatttcttcaactataattgggagatacatcaatgtcagtggattcagtgtcttcacatggcagtttctcaggattagttgcttttccccaccacacacttattggatccattgctgagagttctagactcaggaaatcactctcaggtatactcagcttttatagacaagcttaatggtaccacctcattggatttgagaggcatttctctcaactctgttccctctcttacttgcccagtttcatttgtctcaccaaattgtaagtgtataccactggacacaataattattaaggaagagtgtacctgggtctgcacaaatccattcccactgggatcaaagcaattcaataagtctctgcactgattaccaatcacaaatgtccttgtatatgaagactaatccttagtttgaagactaatccttagtttgaagactacacatgtgaatcaagcaaagtaacccaaatcattatgtgtatgaata

SEQ ID NO: 54408 - DNA, 1036 bp, Homo sapiens
ccccacatatagatagataaaagtggaagtgttgtggctgcagtagccggatagcagtgggggtgaagggcagggattggcaagtttaggctccccctcactcccctcctgcaatacaccccatagcctctgagccatgcatattggtcacaatgggaaatgtctggttccctaagacccttccagctctaacattttttacttaataattttattattctataattactctatatttttcgcagtcactgagaaacctcaaataccttaccttaccacaaaaaaagttatttttctgggccttaaaaattcaatcaccagataatgtgtctaaagaatttaaaaaacattcatgttcctctgctttgatatcaattttcaaacatttcaatctgtttccataggtcagttgaagttatgttacaacttgccttattaaccttaatttattgtctggttaccaaatgctatggagtatgatttggcactgtgtcttaataaacaggtcacacctgggagctagtgagacctctcccatctgagaagaaggagctacaacagatggtaaaacgactgaaaaccaggtggggtcactgtttaatgaccatctgaattaagtttggttaatttggcgtgtccctaattatccctagcaactggaccctctactccattttataagtttggatttatatcttttatgtaaactatcaaaacaagtccatctgtgatcctgaagctgtatttgccttaaatctaaccacaggggaaatcctaatttatttggttctagctatgaggagtccttaaacactgggtttttacagtgctctgcaatttactttttctcaggttgtcacctatgatatgagcattgcccttcattcttctccaagtttaatgaaaagacacttagcataatttccaaaactcagacatgtcaaaacttcaacctatgtgcatccctttagaagattttctcatgaaatctgtgtgcagcagtgagttggcttccagagatgtttagaaaattcag

SEQ ID NO: 54409 - DNA, 1024 bp, Homo sapiens
gaaacggggtcttgctttgttgcccaggctggtctcaaacgcctgggcttaagcagtcctcccaccttggcctcgcaaagtgctgggattacaggtgtgagccactgcgcccagccaatttgtgagttttctctctctgaaataaaagaaacaattctattcacccatcaacttcattgcaaagttttcttcttcctaacttcttaacagctcatgcttatacctcttctctgtactcactctcttggtgacctcatatggtcccatggccttaattatttatatgctgatgactcccaaatatatttcaaacctggtcagtcatctcttctgaacctcagcgcttattcatcatatctgcatcaatatatagtaagcatcttaaacttaaaatgacaattgttgctctcctgattgtctggccaaatctgtgcctacaataggtcaatggcaactccattcttcccactgttcagccccccacaccttggtgtcattcttgattcctttttctcacaaccacatccagtccatcagtaaatcctataggctccatttcaaaatgtaaaataattcaaccatttctcatcaccactaccaccagcatcatctcccacctaggaaaatgtaacaactggtctccctctgcttttgcctttcctcccttcacctccagcagccgaagtgatcctgtaaatagtaagtcagatcccagtcaattccttaacccaaagttatcaatggcttttctttttactcagagaaaaacccctagtccttactatggcttaaaataccatataaaatctgtgcccatgatgaaaatgtcctaatattgacaatggtgacaattgtacaaatcagttaatatagtaaaacccattgaataaaatatttagggtgtgtacagaatgtgaattatatcaataaagctgttataaaaatctgatccctacagcaatcttatcttacactgttccccccatgctcatttctctctagccatattggacttccttttgcc

SEQ ID NO: 54410 - DNA, 1034 bp, Homo sapiens
gttaactgctgtgcagctctcatctcattgtgcacacagcatggaaatctttctcaaaactgtttcactcaggtcagggtaacaagtttggtagagcaaaccggtgaatgatactctcatgcaaaactgaacagatatgcaaacatatgtatgtggttcagcttgggttgcatgggttcagactttgcaatgtgtagtttaataggtaattacccttaacgcttttgcagggaacccaactaccttgaagaaactttaatttttttgtgcttctaatttgtctccatgtcacatagccaaaatatagaatgttcaagtgttttctcctcaaaagtataattactagaatatactggtttttaaaataagtttatttttataaatttgtttccagaatccacattcatctcaatggaaggatcctgccttaagtcaacttatttgtttttgccgggaaagtcgctacatggatcaatgggttccagtgattaatctccctgaacggtgatggcatctgaatgaaaataactgaaccaaattgcactgaagtttttgaaatacctttgtagttactcaagcagttactccctacactgatgcaaggattacagaaactgatgccaaggggctgagtgagttcaactacatgttctgggggcccggagatagatgactttgcagatggaaagaggtgaaaatgaagaaggaagctgtgttgaaacagaaaaataagtcaaaaggaacaaaaattacaaagaaccatgcaggaaggaaaactatgtattaatttagaatggttgagttacattaaaataaaccaaatatgttaaagtttaagtgtgcagccatagtttgggtatttttggtttatatgccctcaagtaaaagaaaagccgaaagggttaatcatatttgaaaaccatattttattgtattttgatgagatattaaattctcaaagttttattataaattctactaagttattttatgacatgaaaagttatttatgctataaattttttgaaacacaa

SEQ ID NO: 54411 - DNA, 1017 bp, Homo sapiens
ttaaacacattttactgacgctttgctgtataccaggtctataatcagaaagcaggtgatttaaaggagttggagttgtcaggaaaaagggatggttagagattcagcttgcaaaatttgaataattaaagataaatgatattagcgccgtaataagattatacacaaaatgttgaggaggcagagaggacagagtgactaaagttacctaccagtttttactgaagagagatcattttatgttggtcttagtgagttttatttccctagttacagagggcaaagggatattgctagcagctgcattagtttgtgcaaaggtgtggaggcctgaaagaccacaaccaggtcagtaaaaacagagtgattgtgtgtgtgcctctggtgtagaaagataagggagcagcggggctgaaaaggaaggtggggattaggcccaggctgtgaaggcattctgtgttacccttatgcatttgggcttccttctgtaaacttcaggcagatagcggagcccctgaaggaagtggcatgatcagtgttctaggaaagtaacaccggggtctgtgaaagatgattattgggatgagcagctgtaggtgacaaggccagttaggaagtgactaagaatccaaggttgtgcattttgcagaaccatttttacagagcaaacagggaagtggccaggcaaggttttttgctgcccctagtctcttcctaaagctttgtgctttccagctgaacatttctatggttctgaggggtctgcttaaattctatcagatggaatagatggcagagaagaaaagcaaaagaaaagtcttcagtagaacaatcatttttagttagaacagtcacttgataattaactccaacaatcttgtaggcatagaccaaagaaagcaaaaatgcttatggaggcaaggcctagccttgcttttgtccacaggaattttcttatcctatttctcaaaccgtcccccttatggctcccctgccatctgtctttcatcctagtca

SEQ ID NO: 54412 - DNA, 1351 bp, Homo sapiens
aaaaaaaccaaaactttataccaatgatttagtaattttgaggcatagggtagcttacgtagtggaggatgtgccaaatattctcttcaaatgccaccttctcaatttataactaaaatagtgttatctgactaattcctctgaattttgatgtaagatctatataggcccccaaaatgatcgtagtacatgccagtcatttctcagtgaaataaatacaataccagagtacattatgggttttattgctttcttttatggtagacctgttaatggggaaaaaatacatcaaatcaaatagaatcttatatctgtatgttaaaatagagcacttacctgaagtcagtggcctggatcatagccctggatcatttcccagtctgtcctgtgctgtgtgaccttggacaaggcgcttcatctctctgggcctctatttctccatttgtaaaacaagtggctgcagtagatgatggctgagagcccttcctgttcccagatgccttggtccaaagaccccacccctctgctggtcctgccaacgtgttggtgctataagctgcttcagatataaaattggtttatctataatgtttgttcatttaatagcttctaaaaggcctttttgttatacagtgctttttttctagttttatggacttggttactgtaataatgtcttgtttttagccatgtaactacaaacagatattctcttgatgtcttagtaaatttgcatttgatatatcattgatgagattttgttgttatgtaatattctttggctacgcatctgtccagcatcttattaaccataatactgtgatcattatttggaaatatgtcctatggaaagaataaaagcatgtacttcacagctagcatgttcacagatttgaaagaagtttcattaaaagcaccattgctttctgtactgcgtcagtgcctcattgtatcatcctacttgtgttttgctcaataaatgaataaaagaccatttctcttcccctttcccttccttcactcagttaacattttctgagcacctcctgagagcaagctgctgagagtcaggctcccatgacacccaaatgaataagacttacaccagcccatgtcacagtctgagcaaggaggatgggaatgacagatatgtaaactaatcatcgtagtatcatgtggcaagtgctataactcaggtgaacacagagtgctgtgagagcccagaggaaagagggactagctccacatcaacaaagacctctaaaaaggcttccaagggtggtgatgtttgggctgagtgagagaagaacagtatgcgttggaatgaggtcctgggaggagatgagaggag

SEQ ID NO: 54413 - DNA, 1557 bp, Homo sapiens
attcaaatacgctctgaaagtgtgcaagtaaaatattttctttcttgtttgtttgatttatctccatgtcaggtttcgaaggcatcagcggacctcatgtcctactgtgaggaacatgccaggagtgaccctttgctgataggaataccaacttcagaaaaccctttcaaggataaaaaaacttgcatcatcttatagtggaatagagaaacagctcctcgcctcttcccaacaacgcaaattatgagcagctccttgaagagatttaccttcagcttatttggtaaccactgctaataactaaaatgttctcagcttggaataatggactctgaagtctctattttccaagttgtcctttctcttaaaataccctttactgatttaatacagaataacaatcttattttccacttggtaactatggctttatgttgggttactgtttaaggaaagttgatctgggcctttttaaaaacataattatatactttagaaatacaagggattccgatatgtcaggacctaaatggcctaagcacctgtcaaattaaaattccaaaattcattgaaatcctaaagccttgatattatattctttataaggcgtgtgccagcctgtatagtatataagagagaggggtgtttgtgtgtatatatatatgcctttgtgtatacacttatcaaagctattttcttatgaaaacgtccctctctccataccatcagtttctcagttccagaagttatacctttattttgagctgtgtataggtagaataaaaaattcctttcatatcgttattgtacaaaaagtaaagagtatcctaaagattgtattcattgtaatcaagtaatgcaatcatctctcctctcttgaaatcttgctggacctcttaggctacaataaactgtaccaaactaaactgacagtccttcgataatatgaaacattaatttacaaggacccgttagggcttcaatgatgctgagtctggaaaaggggaggagacccttgggaggactccaggcagctgtgctcccagggctcatgttctctactggattagggataggcacctctgaaatctccaccctgatgattggaatgaaacggagtgaacatgagcccagctgagagaggagcaggaatgtgtgaaaaacagctgctctccttgtcccagctttgtgattgagccctctgtcttgctctctctgccttccctgtgtctttcttctcttaccagagcatctgtttgcagaggtaacattaccttccccagccacaggtatgtggaatacggtgaggaaaaaaaaaattaaaaaaaaaatgcaagctgtcaggatgcttaagctcttttcagacatctgcagtttcatccctaccttgttcacataccatccaagaggcacataggctacccaagagagccttggattcagtggtacactccttgggcccaagggctttagcagctggatatggggttccttgattttcctctgggcccaaatatagccctcacactcttggaatttccaggtatgggggtagcc

SEQ ID NO: 54414 - DNA, 1758 bp, Homo sapiens
ctgcctggctccagtccattgaggaatgcaaagtgctgggtgtacttcacacagtgtgtaagaggatgcagatactaaacactcggaaaccaagtatcctttgtgtttattacactcacatacttattttatctgatgctctttaacagttctttgagataggaaagtattgttatccccatttttccaatgagaaagctgaggcttaaatacgttatcagtcctctcccaaggccttagatctgggaagtggcaggacgggagtgagcccagatgcccccggcgaatccctgaatgtgtccctggaactaaatatccaaggcatagtgtaaaggcagtgccacaagttcaaatagagggcctggcaggtgtaccagcaaatgcttgaaggggcagctgctgctcagatccagcccagttttataggattttctgatttttccagaagtcttccttttaaaaggaaatctctccatttttcaaacgttgacattcaatttaaagttaaaacacacacacacaatggagttaacactgtatggggcccaaccaaacacatctgcagcctggatttagcctgcaggctttgatataaataagaactgctcatgaaaatagaggaactattcttaagaacctaactctgcctactcagtaaggccacattagatagctgttgctacctggtcacattaccttgaaattcttctgttgtttctggaatctttttcatttcccaccaagcacatgtttttcatcttgttagtgagcctaggggccggcatttagtaaacatttgtatgtgcaagggaaggtgcttctgtttctcccctgacaaccctatgaggtctgcattgtagtccctcttttacagaagaagaggcagataaagagctagagaaagacattgaaagttgaaggcaagaccagagagtaagtgggagccagtggcttttttttttcttttaacctgctcttttattacagccacatgggtgtgtttgctcatgaaagttggcttcactccagtgattcaattactggccaggccataatggcttgtgattcagaccctggggcttcctggtgccttcctcccagagtgtgctctgtgacactctttccatccccaccctgctctccctgcttcaggcccctcttgacaaagatgaaaatacccatatttccctaatggaccatcatgttcctaggaatttctaggaacctgagaattcagatgaaacacagcattaaaaccaatgcgaagtatttgaatagctaaatactacatgtgtttattcaaatctgttacccatatgcaaaaatgaaagcaaggctgcagaagtgatagccagagtgttatccgactggcagtctgcacaggcatgcacaggccttggcccttctgggtgggatagaatacttggtggctcaagatctgcagatgctaacttcagtccttgtctaggagccgaaactgtcttgtttagcttgcatgcatgagaagggaggtgttacacaaacacaaggcaatcagcaagccccctactttaggtcaccgcgtgtcagtcacccctgattaagaaccacatagtgggccaggcgtggtggctcatgcctgtaatcccagcactttgggaggccaaggcaggcggatcaccagaggtcaggagttcgagaccagcctggtcaacgtggtaaaaccctatctctactaaaaatacaaaaattagccaggcttggtggcaggtgcctgac

SEQ ID NO: 54415 - DNA, 1052 bp, Homo sapiens
ctttgcagtaagagggaaggaaactcagatcagaaaatgggctgattccagtcacagtcagctctgcaccatgcacactaaactgggctgtgcagtgtgtggcttgggagcctgtgcagttgcaagtggtgctaagttttgcttttcctttcccacgccctccctcgggtaagccacaccagctgctcagatcctccaaggttcagcttcccatgtattgcccttggccatgataaagcgcttaatcactcaggcctggaccaaatggaggggcccaccccaagcacaactgccaggagggcagtagctatcactggtcacccctgcggaaacttgctgcccctacaaaggccttgagatgagtggagagagcctcgtctgagggtcaggaacccggctcctttccctagtcctgggggaccttgggcaagtcattaaatctccttttgcctcagtttcctcttatgctagccagacaaagtgatgaggtgtgataatagacatgaaagagcttcaaaagcaaaggcagtgttatacaaagaaaacaagcagtgtgaacattattagctgtagtgagctatgggacctgccactcgattcctgaactgacttccctcccaatggagtgttttgttctttcttgatttggaggcagagcccctttctttgcagtatttaaagtacttagtcccctcttttaaaataagaaacccaagggcctgaaaggttgaatggtctgtctcttttccccaccttccagatcccatgggaagtcagggaacaaggccaagggttaggctggactttctgatttcatgttctaggtgctaagcattaaacaggcctctcttgataataatagtcgctttatactgggggtcccccgatagtcagttcttttgagaacataggatgtgggacaatattcctcacgtacacttcatatagcatcttaagtaactttaaacattctcctttatgactgcatttttttcctctagatgtctgtcattcagaatagtgaacacttaggcatagacatagaatctaaa

SEQ ID NO: 54416 - DNA, 1034 bp, Homo sapiens
ctccctaggtaagttatttagcttcctgtgcttcacttcccccatctgtgtagtggggaaaatatagcactcttgcatagggtgactgtgaggggtaaattagtgcgtctaaaggacctggaacaccgttgtgcacatacagaagtagtcagtgttctaaatgtagcagaaggagtcaaaacatttaccactgtggggtcagatcacagccaaaatgctgtttccccagtcttcagaaaacctatcaaagaagaagcatgccctcaccctcctttcctctagcactctctctagctgccctgtgctctctctgcctctcaccatctgcttgtactagatagcagcccagacctgggctcaggtctaggcagtaggtctctgccctgcccttgagtcaggaataacacacactcccgctgggacacaggacagctatcagggttagccacacactgtgggtggccccggcagaatctgcaaaaagaacattctggtgagaaaggaactcaagtttcctgcatttgagcaaggcagctgcctgtgcaaaccgttggccctagatttccagaaggcaaaactatcttcaagcattgcacactcactgaacttgccactgccccatttcacctgagactatcctccaaggagaatgggtgctgtatgaggggccttacgattctgcaggctcatcttctgggctgatctctcagtacacagcctgcctgggctatttgttggaaagtcctgcaacaggcagataacatttggttgggtttttctctttcccctcccctgtgtgttctgaagttggtcctgcaatgactcccaggaaggtttgggggaagtccactggggagaaggaaagaaattgcagaaatttacaaattttcaaaattgactttaggtattgtttcatgttgccctttttggtttttttcctataaattttaagaatttcaaaatgaaaaattaaaattataaaaatacactaaccctctgtatgggcaagggtggttacttgtgatatgtttatt

SEQ ID NO: 54417 - DNA, 1048 bp, Homo sapiens
tgtaaatattttccggcccattgtggagttctagtttcacagtggctttcctggctgggttaggtttaaattaagcaggtcatttggtcttcagatatctgaactcactatgtctggtttatgcccagctctgatctgctctggtttgtaggagtaagaacataactcttccctcaaccctgaagttcatctgtcagatattttgagtactcatgagtacatttctaacttacaagtacactgctttgacgcaggctcttcctttgaagatgtagctcatgaacaccactttcaaaaagctatctctgatcccaggacaagatagagcccctattctgtgattttccaacgtagctgtcccaatacttttcatcagttgtgtgatgtcagcctgccctctgtcttctgtctctatatgggacctaccacatagtaggcgttcaataaacttaaattgagtgaagatcataccggtcattgtgatcaactctctgcggatatcaccttgagggagaggatttcagaacaggaagaatctttggggcctgagcatttgggtgaatggtattaccattttagagatggcgaatgccacaggaggaaggattttgacaggcatacagggtgggatccagagatttctacatattaagtgtgttgttgctggggtttttttgtttttgtttgttttaattgacagattctcactctgttgcccagcctagagtgcaatggtgcaatcttggctcaccacaacctccgcctcctaggttcaagcgattctcttgcctcagcctcccaagtagctgggactacagacgcctgccaccacgcccagctaatttttgtatttttagtcatgatggagttttaccatattggccaggctggtctcgacctcctgacctcaagtgatttgcccaccttggcctcccaaagtgctgggattacaggcatgagccaccatgcccagtcccatttctgttgttttaaaagccaaggtgttgctgtgttgcccagaatggaatgcagtgatacaatcatactt

SEQ ID NO: 54418 - DNA, 1062 bp, Homo sapiens
atttttgtatctgattgacctttgattggtagccaccaaactctggaaagccaggaatttctttcttgatctgtaaccaaacttccaaatgcccagaacttccactcttcaaaggaagcatattacaaacagaaaactccttcgaaaagtgaattgtagtccaccctttaggttctctcctttccctgcccccacaaaaaggaaagttctttatctctgccctctgcctttctctccctgccccctcatgcagactaacagtctcttgttctgatatagaatgttctgtaattatttgtcctctgaagattaggataataaaacatttcagccaccctcttttgggttcccactttgccccagtgaatagaactgtgccccaccatccttctcctcatagccagcagcctcaagtcccacaatagctctgccttggtacagggagccaacattgtttgcatagcatacgttcctggacaattagaagatccagtttaaccttcagagcatccccatcagtttgtgggtgtttgttccgggaagaggaggagagatggtgacttttgtggtccacacatgatgctacccacacacaagttcaaatctttagagatgagctgaaaattgtgttgctaaagttcacatgtaaaatcagactttttaggtacttcagtctttctgtccagaagcagatagcattaatatttgcttcttataacactacttgcccacctcactctcattaagtgaaagcttttttaaaatagcccaatttcatgtaaaattaatattcattaatcaagatactgtaatagcacacctttctgaaaatacattctggttatgattggtgtctgatgagggaggctttaaaactcttactccaaagatgatacagtcttgggccatcgaacactcaatagattttttatgggctaggcgcggtggctcacgcctgtaatcccagcacttccagaggctgaggcgggcagatcacttgaggtcaggagttcgagatcagcctggccaatatggtgaaaccccatctccactaaaaatata

SEQ ID NO: 54419 - DNA, 1042 bp, Homo sapiens
cccccgcttcagttctggctggcctgcccaccactccttactttatgaagtaaatttcctccagtcgcaggacttgtcatgggtgatgttcactgtagggcatgaattgaaactcagcaagtacagattgagaatcgcttatctgaaatgcttggatccagaagtgtttcagatttcaggttttttttttttcaggttttggaatatttacattatatacttaccagttgagcatcccaaatttgaaatgcgtcagtaagcatttcatttgagtgttatgtcagagcccaaaaagtttcagattttggaggattttggattttcagatttgggatgctcaacttgtatttgaaaacaagaacttaaaaaaaaattctttcaacataattaccaaacacccactctatattcagcagtgttccatgtgctgggcattgaaaggttaagtaagacatgggtcctgctgttgtggagctaagtagggaagagggcacatggacagaccattgtagtatgacaaagtgaatgcagtggtgacactgtaggaagcaaagggaggccaataattcagcgtagcagtcacctggaaaggttactggaagccataatacaggtcagattcgagccacctttccctgccttgagatttttgtaaggacacagggacataaattggcacttagtgtctaacagtgtctggcaatggatgatatcccatattatttgtagctcagattagtggaggaattagctaagaagtatagagagaatgttgctaaaataaagtaatgataccttagtcaactgtcagttactttaaggaaagaaattaaagtatatgaaatcaattagaacaaaaatagttcattgtttccaacttatgtgattggggcgaggtgttgaaaagaagtattaactagctcatgtctgggcccaacaggaaagaacaccatgactcattagtgatagctgccatgagtgctgatccattagggatgtctaccgtgagtgcaagaggaaaagaggcaacctccatgccaca

SEQ ID NO: 54420 - DNA, 2072 bp, Homo sapiens
cctgcacattttcaaagcaagaataataatcgcacccccattataggattgtttcaagtcaaggatgaagcgagttggtgtacatgaaactcttgaagcagagtccttaatacatattagctggtattgttattgtggattctctgtttatcttcccctcctatttgactgcaaggatcgagacgtgtcctccttgcttactgtcatgtccccggcatctggcacagtgccttactcaggaggtgcccagtcaatgtttgttgaataactgaagaaagtatcttgctgaggatcaaatttaggccaagtctgaatcagaatacgagttctaacactaaggttcagtatttccacacagttctacattagctttgactttaggcaagtcgcttcatttctctgtgccttggtttctttgccttgaacacgatccatcaggtttttcctggtcatgagcaacgtgtgtcttaaagctaaagacacacatcacccgtccatcagccttttcgggcaacccatgtttgtgctccactggccactaggtgtcgtggttggtcaaatatcagagaaagcaaaaaataaataaaaataaaaataaattgaactgattgacctaccaacctaccaaatgatgggagtgagcttatacagttattggaagctagttacctctggatgagttggctgagttgccttggaaactcagggagttgcccaggatttgcatgcgtggactttgaagcaaagcatagattagagcccacagctgtactcacaccagctagcaccttggactcactggaacgtcacagggccttggtttcagtaatgtaatgcatgtaacatgctcagcacttcgccacagtgaaggaagagcactacaaagttagtggttatgagggctacttctggtatttgatactgtaaaatgctgcttttctgttccttgccacgccaactgctaaagctttgaaggctttctgccttgctccctgctttacaaagccaaatttttaaatagccccttaaacagtagagtggacagggtatcagtatcaggttaaaagggcagcctagaatatttggagggacaccagaactccttggaatgtcactgtggagcttagtcaacacaaagcagagtgttttatacatgactgggacccagagtggagggaagtgagtgagcattgttgaaaaatggccttcactgaaattgctcaagtaagggttttctttgttacatggactgtcatttagatctaggtgccttctttttaaaataatttggggaagcttctaggaataacaatgactagtatttattgcacacttactatgtataaggtattatacaaaacatcatacttgcatgatttcatttaactctcacagcaactctttgaggtacatatagttcttatgtccattttgtagatgaggaaattgaggtgcaccaagattataataattacagccaacagatattcgcaggtcacacagggaatgggtgaaagagtccgaacacaaacccaggcctacctgattccagaattcgttttcttaatggctacactgtattgtctcccacagtactttggatgcagttaggcacttgaccagtgtttactgaggtgaatagttctcagactatagttagccaacacagagaagactgcctacgcaggaaccatagagatcttgacactcctcccacccaaagccacatgccctctggcctccattagtactgtgggatgtatatgctgttccatgtgctggatttcacccctaacttcttaaaacattttttattgttgtataatagttgtgcatatttgggggatacatgtggtattttgatcatgtatacaatgtataatgatcaaatcagggtaattgggctgtccatcacctcagacatttatcttttgtttgtgttgggaacattgcacatttttttagctgttttgaaatatacaataaattgttgttgactctaatttttctactgtactgtcagatactaaaacttattctttctccctaactgtattttgggaccccttaac

SEQ ID NO: 54421 - DNA, 1056 bp, Homo sapiens
gtttgtttgctgtccccgattacaatgtaaaggcctcaagtcaagaatgtaatatacttcattcaccactgcatctccagcacctacaaccatccctagcacatgatttacattcagtatacctctcaataataaataaattaatgtcattatttcttatcatgtaaggagatgatatggcaagagtcagaatacagatttatggtttggttgttaagaacaagtgatgctgacatccgtccatgcacatgggaagctagtggattcttttacattctagatgcagtataaagggtggatgttatggctgactgcatttatctgcaagtgggtaggctgggccacaatcctaatacaatctctgaccaggctagagagagctccttctcttcctagagatctgtatatgttctagatcttaaaactttttgcctttctcactgttagaggaaagtattcttctacaagttcaaattccatagccatctgaggggagtttagatagtaatggaaagaaatatatcctggaactccagggtagaaatatccaagccatgtccaggcagccaaaggagatttttcagcatgtgtcttttctggcagtccttgataatggccagccaagacactgggtatgctattgcttaagcatgttattacttagttctacatgcaaagtcaaataaaactgatgaacttggaggtgtgagcaagtctgccaagctccgagttgctccgagttgcttcttctccctctggtattgaacaggcctaggaagtgaccatctccttggaactggctggatttaaaagatgaagtcaaaacttgctttgttaaagtgtgtatttgaagattctttatactggtgcgtttttatcaggcctgggttgatagccttggctcctatcctttcaatgctattccagtgttttcctgtgtgtgtctttactgagtatctacgatataccaagtaccttactaggtcctggagagacaaaaatgagctagacacattattaaccttcagggattctgcaaacctgttgggggagaaa

SEQ ID NO: 54422 - DNA, 1043 bp, Homo sapiens
ttacaggcgtgagctactgcatctggcccagagagggactaaattttgttctctgttttgtctctaccaccttccacattgccaaacacatagtaggttcagagacactcacaagcagcaggatggtggaagagccaacaagctacaaaccctcttcctctacagttttctttggccttgctctgtggctgtctgtcattgtccctccagttctccttgggagacacagctatgctagatctttctcaaaagagccccatcctctctatctggggaccaccgtccaatttagtgttaggtcttaatttgtcccacaaggcactgggcatgttatggaaatagacacgaaacagctaacctcaactgccaagggttacataaatatcagtggggagacacagaatctgaaagtattgtataggctggggtattcagttttgtttattggtatatacatggaataaaaatatttctactggtaacatatttcaataaaatgttaaatcatccccacttttgaagatctcatggctcacaggctatactgtattaaattctgaattttggatgttttcatttcataatttgatccagattatttttctccctagttaacattaatcatttcctgtgaattttcctagtattaggaaacagatgtcccatatttttatctgagtttttcccaaatgctgaccaagactttagtacttgtgtgctgtgtgtgtgtctgtgttgtgtacacagagaatttttgagaaataagttttatctgaatttgcaaataaaagcatcacagatatagttacatatttatacagatttgtacatggttggaaacattcttagacattctgtttaatgtagtttagtatcgtttggctaatgcagacttccagcctaagaatgcattagaagtgtctcatgatagtatgcttgccaaagtaaggaatggtgtagcaaagagaatacagttagtgcaacctgtactttaatgctcttattttaattacattttttaaaaaactgttgtctcttaacta

SEQ ID NO: 54423 - DNA, 1028 bp, Homo sapiens
gcaaaagagtgcaggaatttgggggtcattcagaatgtcaccagtgtggggtttatgttggctcttcccaagttcattattcagagaacagcggaagaaagccacttgcacagcccgagagggatgcagactgcagtggaattaagtccagagttaaactgcacaagcacaacattctaggaggccagatttgtagtttaaaaaaaaaaaaaatcaaagtgcttgacttgaatgaccaaatacttagtatttgatatctaccgttttcttcttttggacaaaccacctaacaagttaaattcccaaacaattgaataggatttcacatcacaaagatcaaaatttttaagctttaaagaaatacatggaaatcaaagttcaccaagacttgcagatgatttattgcattttatttattaaagaggtaaaagggcagaactgatacccatctgtgttttctatttatgttatcactaatgttagaatttgaccagatctttgaactaagctgagtctgacttatttctcaaatgagtcaggattaagaatatcctatttttacacaatgattccaaagtcttatatataaaagatccagaaagattatgcttcaagaaaaggagaaaagacacaggagacaatttccagttgactgaactctctgaagctgaggtttgctaagagtccaaggtggaattcacagagtgacattggtctctgtggggtggtattcactgtcacactgggaaaatgtcagaggctgggagaacgactgtcccctgggagctaactctgtccactgagtgtgtcatgataaatgggtttcattcatgaaggaaacactgctcttctgaaaagcaccaatactggccaggcagccagaaaacccaaatatattggagactcctggcagaaggggcctgaactcccttctagtctcttccaaggagttgtcttaatattccacagtgttttctgtggctgctaggcccaaactgcatggaaccatacaacaaaagttgtgtggc

SEQ ID NO: 54424 - DNA, 1036 bp, Homo sapiens
gtatgtagtaaaatagtcgtactcgttgttattatttgagaaaggtacactcaagttcaggaattctttaacgaaccagagttagctaaaagaaaggtatggaaatgcaggcctcaagcagaaagcatcctgagtgtgccagtctcagcagggaatggttgtccttgaaaaggaaagactgggttatctgaatgtgcaatgtgaaaagagtatgtgtgtcgggcttttcacatacacagcattcagacactggggataatgtagtatatgtttagcctgacaaataaatgaatccaaataaatagatatgtttagcctgccaaataaatggatgtcttttgtcagtagggcatttattttcatcataggcacatagaaggcatggttttctaaatcggtcacatgttaaattgtgagcctgcatttcataagaattcaataacatcgatcataagaagggtatggagattaaacagaagagccagttttcaattattaaattctgaattttaattgtacccgtaggagaaagtattcttgtgagttcagcttcacattctcataccatttagtttccatgtgcatatttttgcatagctggagttagtgtatttattctctgttggtctgcctgcctttgcatctgaccttggttcatgttgcccttttcctgtgtcctcacactccacatcctttttcttgtaatggcaataaaggaaactcctgtgctgataagtggccattggttcaacttttcatccaaatactggatatttgggttgtttccagcgtttcacagatgagaacatatttgctataaaccttgtatccagagagcttagtcagcagcttattaaacaccttctggaatgggactctctgccaaggtttttgaagtgataccaactcattaaattaagagtcctgagaactggcattcaggatttcctgagacagcatcttattctttggcttattttttctcatacatttaatcagcagatatgtatggacgacctagtgagtgccacagagt

SEQ ID NO: 54425 - DNA, 1003 bp, Homo sapiens
tgtgctcctcctaacctcctttacctttaaacatccagtgtagtcttggtggctcaaacgaaaaggtctcctagacctttccagaacctccctccataatatgaagttacatttgtttattgagatattcaagaacatttattaaatactttttaaaactgttttcagtgtgtggtacatagaccctaggggtctccatgatcctttcaaggagttcacaaggtcaagtttaaaatcatattaagatattatttgacgttttcattgtgttgacatttggaatgatgttacaaaaacagaggtggataaaactgctaattaaacaaggcagtagtaatatcccttatcatcacacactcaaaaaaaccaaaatgccattttcacttaagaatgtccttgaagcagtaaaaattaagtctcataattttgagagcacatttaaaaaattctctgtgacataataaggaaactaaagctcttctgctggtaataaagtatgtctcaaggaaaaatgcttgtgtgattatttcaattgcaagttgaacctgccatcttttcacctgacactgcttttgcttgaaagaatgtctgacaagctctgattattcagacttggatatttggcagacattttctcaaaaaagaatagtctgtcacttcaagaaaaatgattatatttattgctaaaataataaaaattcaagccaaacttggaattttggaatacttgtatctgccaccatgagcttgaccacttccccatatttcgactttgctgatgagatcagggatgacgttaatgagtacattttcaatattgtataatgtaatgtgtcaacatttggaaaacctgtataattcagtgaaccaatatttttcagtgaacaatgtgtgatgttaaaaactctgcatgggttaaagttctgttccaatgcaagagagactaatcaattttaatatagcagaatacgggaagttcattgaaaggatttcagccagcctg

SEQ ID NO: 54426 - DNA, 1106 bp, Homo sapiens
ttatcatgtaggtgtaggttcttacgagaggggctttggggataggttcttcaccatcttaagtggttcttcctggtaaatatttagagaaatttttcttgtggctatttcttatgatgacccttgaaataattagaggatgctattcgtattcagcaactgcatttctacgggaaataagtccaagagcatgttctcttgatctaatttgataaagggcccagtttggaaagaagagtggccagagtcaggagcttgccatctggagctttggggacagaattatgggatgttacaacagaaaggggccatcgtcattatggagcctaacttctttttacaaatgaagaaatggatgcccagagatttgccaagttcacatagctaattggtggcagctccaggattcctgattccagctgcccattccagcaactatatccttgtcatgaagagtgtacttaagagcatctctgtgcaaaacgttctgcaatgaaggacaggttcagtctgtctggtgtcatagccaccagccacttgtgcctcttgagcatatgaaatatgactactgtaacttaggagttaaattttgctttatttagttttaattaaacttgttaatatatagctaccattttgggtagctcagcttttatagacatttaggaggaggaaaggccttatccttatctcctacctcattctcaccaagtgagaggccttcttttcgaatggctcctgtgcagctgctttgtgccaaaccaagagaatcactctaagtcttatctcctcccctcctacctctcaagatgaaagttagctcctctgtaaaattgacatgagtggagtagatggctcattgaggcctcttccattctgaagcattatgactttagacctggctctctagtgattatcagtgacctttagcagggcacatagtctgcccatacctcagtgtccttatctgtcagctgaaattaacacccgttctaccctctctcagattaggagaggctcaaagtagaaaatcaatgagatgagctccatttgcaacctttattttttaataatctatggtatctggaaatatttttggttttgat

SEQ ID NO: 54427 - DNA, 1083 bp, Homo sapiens
tgtatgctgctaggtaaaaacaaaaggaatgtccctgaaggaagaacgtcaccgcttccatttcgacacagtaacccacagggtaacagcacagcactctggggatgagggccacaggtacacaaggagcctccgcaaggccttgtcctggcaagtcgtgtttcatggaaagttttcttgagaaagctaaatctgaggattctgggacatgagtgttactcatggccagcgtcatcatacggagcctgggagcaaattgttttttcaagaggtgtatgtaggctattgaattttgactagaaatggctttagtggtcaacattaattttgctttatatccagcagcatttcttatttttatcagggatataagtgaaggaaaaattgtgagggaaggcaacctgtaaagttctcattcatagaaacgatttgtggccttgatttcctggatacaaataccatttaaaaaatttttagagaggttttgtttggattgaatttccaatccacatgtatttctccattcccccttgagaactagaagtcttttgtatggtaacactttccagaagcacctgaaaggagtcctttgggaatggccacaaactggataaaaatgaaaaatggaatctcaaaagtgcagcttggttttgaaactaactttttacaactttgattatgggaagtaactttgttgtgtgtctgttgttgacctggcattacaactccattagggcaatataattagttcattttacagaagacagtacaactcaagagagcttcagtaacttgtacaaggctgcagagccagaattgaaacctgtgcctgtttgagtacactacccctaggactaaagaaacacataactcaagtgttaattttctaatagctttaagagacgtgtttccttttactgtccacagaagattgtcctgataagcatataaaacatgaaagcatataaagcattgtaaagctcgagaatcagaatctacaagaggacagaaagtccagggaagagaaagtggaactgtttcctggcaggtaccatgtttataaaaagcccagcaatcacttat

SEQ ID NO: 54428 - DNA, 1119 bp, Homo sapiens
acaattcttccccttccagtgtggcccagggaagccaaaagattggacacccctggtttagagcttgagtttgcggtttcagtctcctgggcaaatcacctgacttctcagatcctgttttcccgtttgcaaaacagagataataacaccgtatttcaacagatttcagatgtcattgattagatgtgccggtattctatgtgccattattctatgtgccactattctatgtgccactaagaaaaaaaaaaagctgctgattaaattataatgcacatcagctgtaagagtgtgttagtttttctatggccgctataacaaattaccacaaatttagcagcctaacacaacaaatatgaattatctcacagttctgtacattgaaagtgagggtgggcttggctgatttctctcatctgggttttacaaggccacaatcaaggtgttggcctcttattgggaggctttgggaagaattcatttctaggctcatttaggttgtgggtagactccagttccctgcaattacaggatgagggcctccggctctttgctgcctcttagctgggaggcatcctcgactcctagagatctccctctggtccttgcccttgagcccatatcagaactagcaacattatgacaaatccttctcgtgcttgggatctctctgatgtttttttttgtttttgtttttgctgcatctctttgcctccagccagagaaaattctgtttttaagggctcctttgattagatcgggcccacctatagggtactctccatatattaaggtcagtaaccttaattgcataatgcaaagtcccttttgccatgtaatgtaatatattcacatgttgcagggattaagacacagacatccttggagctttctgcctaccatgaagaatcattccaattatcagggatcttaaaatgtgaacaaaatatgcttcttagaattgatgaaacaccatatttggcttaggaataaaacagctactgatatatttaaagtacttagggtgttactagtaagtgctcagatgttaactgttgttataattgacatcattatcatagtggtcacgtaatatccatcatctttaatatcaattaa

SEQ ID NO: 54429 - DNA, 1015 bp, Homo sapiens
attgagataacatcatcataccaagtttaaccagaatctcaggcaaattagaaaggtgtaacctttagactaggtgcctgagctgtgcctagactaatgaaatcttctgaattattagaccatggcctgcacattagaccatggggcttcatgtgggtatataaggtcatgattggctgtgcagataagttgtcatgggagggttggatgtctggccaagaagcagaaggaatggattgtgacttcttgacagggataccttgaactgttatacaggttgttcactgcacaaaagtgcctgggcaaggaggcaaatgggaggctcacatctgctaaacaaacaaaaccacatgcatcctggagtaggattgcctctgctaggagaaaagggaacttctttctgatgctatcaagcctgcaaaagtctaggtgtacatggaaggaatgcctttttttaacacacacaaaggcacaatatggctaccagcagctctgcttctcaaagcccctgtagccacagtagtcctctagatgccatcagctggcagagtctgtcacttaaccatttggtttatcatgtcaggctttattgggaaacatataaacttcatgaatgtcagtggaatgaaggaataaaaccatgttttctgtggtatgtcagcaaggtacatgtaaaaaagtaatactgattatatatgctaggaaacaaacattcagtggtacacattgcctatgatgagtttctttctcttcaattcattatttctgaggggtaggtaaagaccagcactttgggtgctgttgacattgtttattgctacttaaacaccagcatgctcagtattgcctaatacttgccagggtcaccagcacccgttgtgtagttggcctggtgcagggaatggagtagtagtaactcctgggaacgtggagagggattcatgttatttattgaccagccgtaggcctttttccttggggacaggatgcaagtaacagtggttgcaggagcctt

SEQ ID NO: 54430 - DNA, 1057 bp, Homo sapiens
actagcccagtggttcccaaacatagtcatacttgatgtcctagccctggaatatctgattccatatatctagggagggacctggggatctacatttgaacccttctggtgattttactgtggtttttcatctgatccatagtgacgaatatatggtttattagtgcttctcaaatttattgtgtatacggatctcctggggacctggttaaaaggtagattctgattcattaggtctagggtagggcctagattcttcatttctaacaagcaagacaccatttcttttcttacttggtttagaaagcaatattgaacacctccctctgtggtactaatgtgtcaagaaacctatcattggcattagaatatcaggttttaatattttatccccttgaaaattttctacatatttggagacaaaacaagtattgccaacagacctggggagaagggcctggacccggctcaacttggccttggctagcccgttgtttcctttactggacacgaccagatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggtgggcagatttcttggctcgttctggaactggtgcttgcttgatctttccacttgatgtgtaaacacacacaccctggagatagaaagcctttactttgaaatacaaattgagagattctcatgtaggatctctgggcaaaattagaggccaaatcttactctgagaagcatctagctggcctaaatcttggtgttttctgtggtacaaatgtgtttccattttcagtaatgaataaacttgttcagccggttcttcagcttggtgatggaatgtaggttacatactagctgggagattggactatggcataattgggattttgttgggatgaggctttagtcaaagttctgtcccagaatcaaccctgtcctgtaattaaacagggtttagccc

SEQ ID NO: 54431 - DNA, 1071 bp, Homo sapiens
tttaagaagctgactgttccacagagccttagaggaccctgacaacacactgcagataaaaactcttgtagccctggcagacaagattcgtaagatgcgaggttctaatgaagattaaacagcctagaaaggtgttaggagatagaaggaaggtatctctgctttctacctaaaatttctggttctaccttgaatacagctgttttttgttgttgttgttgttgatgtttgttttaggttgggatagctgggtagacgccatgcctccagtatgcattgttactctgtacgtctaaagtgtacctttaagcattagctgcttacaattgatgttatggatccagggtaacagaattcagagccagtctattggaaatagtgaccctgcctcaaaccctctgctctttttccagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggtaagtgaatgtaattgatcttgacatgtgtattggaggggaactccatctcactcttggcacctctatgcctcacctgtctcatctgagaaatgggaataataacatactcatgatggctgagatcataaagtgaactaatttgtgtgagagattacagaaatgggaaacaatgcaattattgtgcccacttaagattttaaatgggcttaagatcacttaagatcattacaatgatgataagatcatgaaatagtcatgattgcataatgaataacactgagataaaagtaaattttcttttttatgtgtttcaccttgcaagcacaaatgttaaaaggaataggggtggtttaggttctttccatcatatttgtttaattggggaaaagttagaacttgctgcaaggaggccatttcttttcaatctcaacaaagtcccacaagaattgtgtagagacacagaaaagcataataattacctgtaatgtcctac

SEQ ID NO: 54432 - DNA, 1049 bp, Homo sapiens
tcctatgacttctaagtcttcaggtttggagtttgatagaaattaatatttcccttttgtctcgttggtttccaagtcaaagcctataagaattttttgagctgtttctaaaatatctttccaaaagtcatttctgaaacgtgcatcctttctcttgcaggagaaaatgcagaagtctccatggacgtttccctggcttaccgtgatgacgcgtttgctgagtggactgaaatggcccatgaaagagtaccacggaaactcaaatgcaccttcacatctcccaaggtatgaccccttgctgtctaagctgacagtttttatttggttctcaggtatgtggaaagatttgcttacttttcataggtgtgtcccttcttcgcatgaggacagctttggtaatacctgctctgcggagcattttatttcctcttctctcctgccacgggcctttcctaactttgcttttgcctattactgttaagatttcctgcaaaatagtaaaaacatgaggttgaagcctctgagtaccttgccccagctttagccatttttttcctaaagaggagaaagattaggtggttttatcactgacggtgtgacctcaggtaagcttacataatctgtctgagcttcagtttttcttctgcaagatgagataagagtacctaccttgggagtctgtttaagggctagatcaagcttgtccaactctgcctgcgggccgcatgcagcccaggacggctttgaatgtggcccaatgtaaattcattactttcttaaaacattataatttctttttgtgattttttttttttttagctcatcagctattattagtgtattttatgtgtggctcaagacaattctcctccttccggtttggcccagagaagccaaaagattggacacccctggactagatgatacaatgacgtaggcaggatgaccttctaatttaacatcttgtctgggacatatttgagagtcaaagcggatattaaccagatgggccactaggagaaaacatataaactaaggccctccatggg

SEQ ID NO: 54433 - DNA, 1039 bp, Homo sapiens
cccttcacttgggagtcttcttgtcctataaagaagggaacagttgacagagtgggaccctttaaaagtgtgggaccctttaaaagtgtggggcccaaacttcaaaggcccctcttgcctgtgtctaaggctagtgttgctctgaaccctatggctccaaggagaacaacctgtgagtaatttgtaacctgtgtgtgagctgatgacattttttacagcttttcatatttatactcttgtgtttctccaagcacccttttcaacacagtttaaagtcccaattcctactcccagcgttataagtaggatgtactttattgcctaagatttgactccatgggagctctgactgattctttctgttgaccactgaggctactaagtggggagaagttgtagccagcttggtccctgaccaaggggagataccaactctgaacattgtttctgccaagctgggagtggcacagtttcttctacagactcttgctcttctccacctccagccctgggtctacatattcccctggtgtcctcaagtccagagtctctccttggatcttgcacagatgggaagatgtgggagaactgaggtccagcagttttgtgtgcagactttgacccagtcaccccattgtcagtgccatgctttgttctgccttctgcaacccctggtactttcaaattctgagtggcttcaggttcctgcagatatgttggctcacttttctagaatatcccctctataggagtgtaggctgtggctgccaggaaaccctacttcatgtattttttatgttttaaaaaaattttgaggccaggcacagtggttcacgcctgtgatcccaacactttgggaagctgaggcaggcggatcacctgaggtcaggagttcaagaccagcctgaccaccatggataaaccctgactctgctaaaaatacaaaattagccaggcatggtggtgcacgcctgtaatcccagctactcaggaggctgaggcaggagaattgcttgaacccgggaggcagaggttgcag

SEQ ID NO: 54434 - DNA, 1048 bp, Homo sapiens
gagagagagagagagagaggggcacgcaggtagattttcacaacgatcaaatcagctattctaaatgctctgtgtactgacagtgtcctggagagaaagcaaagaaacccactgtgtgttttcctcacttgctttcaggtttgttttctttccacattgatgttgattatggtcaaataggaaagtgctgttgccacatttgctttccagtgttttaacacttgctaacttagatggttctgagttctctagctttgttagcgaaagattggttcatcattgggttcagattctttggtaaacaaattccttagaaaatatcctcctggcagtattttccacaaggttaaatcgtcttaagcacactgagaactgtgttagcagtgggcctcagtttccttaggatgtctctttgtctacctggccccccatcccagtccgtcttccgcacagctgccagaatctcctcctttgctttaacatcctctaagcaaaatgctgcagcactcagggcaagcttcttccctttgtcattagacccttcctgttctctagccttccctgttccctccagtccctctcacattccctgccatattgaattagttgctttccctgctattttgtgcttatgtgactttttatacatggggcttcctctgcctgtaatgccttttcctatctcgctgcctagtgaactcctattctgcaattcattggtaaatatcacctcttctcagtagggtgagccagaagattgtgtcttctgtgctacaattcttgaccttctactcagaactcttgatctttttgtgctgactgtatacttcatatatacttctaatgcagtacaaactacatggaattatacttatttatatacctgccttcaccactttactgtaaacaatttgagggcaatgactttgccttatatgcctttttatccctactcttttttttatagaagaagtttaattgtttcactctttatagacatatataaacatacatttttatgtttatatacatgtatatagttccaaat

SEQ ID NO: 54435 - DNA, 1052 bp, Homo sapiens
aattgaacatcacatctctagtgctgaaataaaatgtggaattcaggatttgagactcgtagcttgtcctttgaattatacagcagctgaaaatcgtgtttctttttttcccatctggacttctcacttggtggttttcccaacgggagggcatctgtgaaccttttaatgggagaagtcatcaagctgggttagggctgtgctcccagggctggcttcggaggcaggtaaaatctgactcccttttgcttttcagctacagacacagccattgctgccaccaccagctgggtgactcggaatctaggggttgccagtaattgtgggtttaagtcacagaggaaaaagataagaggagagccaggctggtttttccacaattaaatgttgcctctcaggcttctctgttggcaggaatccaagaggtcaggaaccaccagccatattatttttgtccctggctgcctgctctcatttgtatcccctcctcattcatgggaacgaagaaaaggtgggttggaaataaaaaagcttgttctagcctactttttcctttacgaaacttgtcagaaacaaagctttcctgtgaaacagacgggatcccttctagtagctggcttttcctgcaagcgttttctgtctcttcttttctttctgctggcagcacaaatgtattttccgggttaggggtgttaccattgttgaaatctacttttctccttgtatagtcatgctggtatgcggtgttatttctcaagcactgccctgtagtctggttctctggtatttttgtatttgttaattgtttaactcttccattagtcaaactcaacttgttatcctttgtcactcaaactccattataagtgccctgaggacaggcatggttttatagctctttgttttggcctcagtgccttaagtatagaaggcagtcaacagctggaggtgttttagatttctacattcatgaaatattagaactagaaaggatcttagtaagcctatgatccaactgtagtatttcatgaaataatacattatgtaaagtg

SEQ ID NO: 54436 - DNA, 1047 bp, Homo sapiens
gctaagtggaaatgacaggcaaataactaatcattacagtgtggtatgctgggtgctgtgaccaagttatgcccaggaggatatggaaacttaaagaaaaggcttcacagcagagaaaaggaagacttccctggtagggtgtgtgggtgtgtgttggcggggagagttgtagagaggcaatcagacagctctttgaggtgaatgttaaagagagaaaagcctggtgaggaggtgaggatgagcaaaagaaagagcattctatatagaaggaaatggcttatatgaaggtccaaatttgcacaacagcctcaagcttttaagtggtggttcccatgtccctaaactcttgcttattgactcacttgttcactcactcactcattggttgtgcaacacatttattcatgagttcatttaaactttattaagtcccagccatacgaacactcagtactggggatataagatcacacgagacatgattcttgtaacgggttagggaagagggtgcctggaaaacagacacttaaacctacaaataagaaaaaacatgttatgtgctataataagaatacacaatgtaatgtgaggagccttgggaaggaaagagtttgctatgagattcaaaactgtatgtctaaaaatttttttttgaaacctgcaggtttgggttttagcatttctattcctaagaatgcattcaagcaaaggagaataaggacaacaagaagagccatgggaggatgagataggtagattacctgatttatgtatgtttgggtggaaaggtaaaggacgtggtattctgttatttgggctggttgtggttatttcaggtataatctctcctagacagatccctacttctagctccaagtataaagaaaaagatttaccctgtaataataaataattactgtctactgactgtattaataatgctgggtaacaaattaccctaaaagttaggagctttcaactataaacattttttttttttttttttgagtctgagtttcacccttgttgcccaggctggagtgcaat

SEQ ID NO: 54437 - DNA, 1022 bp, Homo sapiens
cccagcagcaatgctggcagaccttggaaaaatggaacactgggctgttcatgggctgtttccatggagaacatcacatttcataggggaaatacgagtagtcacttggaaggcccacctcttcaagagtgaaacattataccacagcctggtatttcaacctatcttcaaacttcttggcttagtgaattcctaaactttatattcagttgctgttttccacctgcttacaattcttgatcctgcacagcaactcttctgatcagaattggagcaagtggagaagaactacaaaagggacccaaagaggggcaatggccctggaacaggggctatgggggtgcgtggggaccaggctgcagtggctgcagggctgatgagtgagactctgactgaggcagaagcagagctccaggaaactactaaagttccaggggaagcaaagtagcattttataagaacaaaatgaatggagaggagaaaacctatggtggctgtgaaggccctgagatgccatgtatgtcaaattgataccatctgatggccatgaatttattgtaaaaagagaacatgcattaatatcaggcatgataaaagccatgttgaacagccctggtcaatttgccgagaatgaaaccaatgaggtcaattttagagagataccttcgtatgtgctatcaaaagtatgcatgtattttacttacaaggttcgctacactaacagctccactgagattcccgaattcccaatcacacctgaaattgcactagaactgctggtggctgtgaacttcctagattgttaaataaaataaattacattttgaaaaaaaggggcccgaaggaagtctgtgggagctgaggagagggaaaggaaaagagcccagtctgacaggtggtgtttctttttgcactcaccctttctattccccttcccctttaacctctttccccgtttaaccatctttcactatcttccttcccttccaagagatcttccctatgtagcaccatcagttccc

SEQ ID NO: 54438 - DNA, 1593 bp, Homo sapiens
gtattttattataccacaattatcttatatttatgaggtttctagtacttgcagactgagaacagattttttaaatgtattctggctcaatccatttaattaggctgttgaaataattttttaaagttatattacaaatgggaaaaccactcatctgtcttgcacgtttgtaaccgaatgttgcatgtgtcctatttaagtggcttctgaattaagcaactactgtgtatactatactaacaatatatactatagtaatgctttattttttaactttactattgtttttgttttatttttgtccactgtcatacagttgcatcttaatttttgtttcatttcctggtagttgtttgtggctacatcacagtttcagatagatccagtgggatacataaaattcaagatgatccacagtcttcaaaattccttcacttaaacaatttgaattccttcaaatcaactgagtgccttcttctcagtctgcttcatagagaaaaaaacaaagaagaatcagattctactgagagactacagataagcaatccaggatttcaagaaagatgtgctaagaaaatgcagctagttaatttaagaaacagaagagtgagtgctaatgacataatgggaggaagttgtcataatttaatagggttaagtaatatgcatgatctatcctctaacagcaaaccaaggtgctgttctttggaaggaattgtagatgtgccagggaattcaagtaaagaggcatccagtgtctttcatcaatcttttccgaacatagaaggacaaaataataaactgtttttagagtctaagcccaaacaggaattcctgttgaatcttcattcagaggaaaatattcaaaagccattcagtgctggttttaagagaacctctactttgactgttcaagaccaagaggagttgtgtaatgggaaatgcaagtcaaaacagctttgtaggtctcagagtttgcttttaagaagtagtacaagaaggaatagttatatcaatacaccagtggctgaaattatcatgaaaccaaatgttggacaaggcagcacaagtgtgcaaacagctatggaaagtgaactcggagagtctagtgccacaatcaataaaagactctgcaaaagtacaatagaactttcagaaaattctttacttccagcttcttctatgttgactggcacacaaagtaaggctgttgctttcaatgcatgcaatattaactttgagtgtttactaactctgtgttttgcttacctggcttttcttccttgaagttgcttaattttttttcctccaagaggaattatttaaaaagacttttgtctgtgacataaccaagatttattctgtttacctaaggaacttattttcttttttgcaatttcatttattctgagtcactttatttgtaataagtgaagaattttaatacttagaaataagttgtaaagaaaataatgagaatcttaccatgctttagaggaacgtaatttctagaaatagttaaaagatgaaatactaagatattattttaccttctttatatagctgtatatactggtagtatgaaagcaacta

SEQ ID NO: 54439 - DNA, 1651 bp, Homo sapiens
aattattctttaatatttaaagccagaactgaaacctcctaacctacattacattctaaatatgtatatataaaattgtttgtaacccatagaaagaataataaaaatgatagtgagacataattgaaaacaacagttatataatttaagtgtgttttggtttaaattgatttgagggtggtagggacaactgcaaaattaaaaactccattaccatattacattatttctttgggagatactttatagctccacaatggactgatagtaatagaattattgttgctttcaatatttaaaaaatttgagcataacagattaaaccaaaataatccttttttcaggaaaatggcgagaaaataaagcatgaaataatcaatgaagatcaagaaaatgcaattgataatagagaactaagccaggaagatgttgaagaagtttggagatatgttattctgatctagtaagataaaattaagctttaatgaagttcctgatgtgttctgattattaatttgacattttcatcaaaatatgcaaatgaatcagaacagattaattctgaaagcttagaatgcaacctgtatatgtgtttttaaataaatactcttgttatagctctagtagagtagaaattgaatgtttcggtatgattcaccttttctttgaatcaacattatggccatagtttgggatatatattggaatccttttaagattattgagataaatgtatttgaaaggggatactaaatataagtcttagaaatttggttaaaaaaataaaatattctgatggctttgtttactagtcatattcatatgtataatctatttatgaagaaaaaaagttaatattctttcttctatttagcctgcaaaccattttaggtgtgccatccctagaagaagtcataaatccaaaacaagtaattccccaatatataatgtacaacatggccaatacaagtaaacgtggagtagttatactacaaaacaaatcaggttggtattaataaaataattggacttttaaaaacttgccaacaaggttgcagctatagtagtgtaaagagagacccaaatattgaaagtagaatactttcatggagcatcagaggggctatcataagttctttagtaataacagtggaataatttttaagtgagtattattcgtgctagtataagaaatattttgtctgctaagataaattcatgcatggtatttaaaaaaatgacaaagttaagcatccaaaaggtatacaaatataagaaaagttttgattaagcacatttttgttgagggcctccaacacgtcagagattgtgctaaagattaatgataagtaagatagaaatggtccatactctcatgaggcttacatgagtagttatgtacaaattaacaggagtcaaacatatatacaaaactgtaataacacaacaaaataagctcagactttcaagatgaggattctaaagggactggcttttttgttttatatatttatatagttgattgatttcagatttagatacaaaaatcagggaaataattcaagctagatagatgtattagaaaacttagattatgagaaaggtatccataaatctctcaaaatcgtagctgatgtttttatgataagtt

SEQ ID NO: 54440 - DNA, 1107 bp, Homo sapiens
agcctcctgagtagctgggattataggcatgcaccactatgcccagctaattttgtatttttagtagagacggagtttctccatattggtcaggctggtctcgaactcccgacctccggtgatccacccgcatcggcctcccaaagtgctgggattacaggcatgagccaccgtgcccggccagatataaaattttatatggcacaaataagatgaatgattcttcaagaatttttatgatataatcagatgtgaattaaagaattttctttacctaatgtacttcaaatcaatatgagatttaatttttcttcaattttttaaaaatattttccttctttttacagtggaatgaagttaccacatcttttcgagcaggaatgcctctaagaaaacacagacaacactttaaaaaatatggcaattgtttcacagcaggagaagcagtggattggctttatgacctattaagaaataatagcaattttggtcctgaagttacaaggcaacagactatccaactgttgaggaaatttcttaagaatcatgtaattgaagatatcaaagggaggtggggatcagaaaatgttgatgataacaaccagctcttcaggtaatgaacagatatgtaactgtaaaactgaattactgtaaagttttatctctacttatattatacttttactataacagcagcttcttcaaagaagttttatttctttggaaaactattaatgctgttagttcaactaaaatcatttagaaaaattgtaatgtgaaagttaattgctacaaaatttaaagtttttaagtgttagcatatataataaagtagggaattggaagggaaatactgatgtattatcacttccgcatattctgaacactttataacattttaaggacatattactgacctttagttgcatagtttctagattataagttcacagatccttcccttcaaacatataatttaatttaagaatacatgtaataggataatagcaaatcttacataataaataacagacaaataacaggaccaggtaaagtggctcatgcctgtaatcccagcactttgggaggctgaggtgggcggatcaa

SEQ ID NO: 54441 - DNA, 1060 bp, Homo sapiens
ctagagtcatggcaggttgtttcagcagctactacataaaactggtatttgggttacaggaggccatttcagcagctgggcttgagaaaaactcagttattgaagatggtcctatatgccccaagtgttttatctcccaggcccctagactctgattttggacatgaccagaatgacctctaatttgtatggttaatttttaacactctcagaggtaggaacatccatacagatgagcttgatagtataaagaaatgcttcaaatatttttgatcaatcaatgcattctaccacatcttccctccaaaaaataaatggtcatatcattacctgattatttcttatatgaatttgtaacctagcacacaggatgcaactctcttcttttcgtaatttctttgctgcctgattgaatgctgaattattttcatgcatttgtctggctctatattcaagttaatggccttgtcttgaggcttaaattaaataatgtaaatgaaagcatctacacaaccttagcaaatataagtaggtgtgtattatttcttgttcttttgtttccagcttcaactttactgattccattttgcttacatagttctgtggttcttgttcaggtccaactatcttgagcaaaatcactcacctgtgcatggataagaggaattttgctgtcctgtcctcagttactcttgagtgttccagtcattttgacctcagaaacagagtctagcattcgtcacttacacccaaccttctgacagctctagaaattatattctcattcatgcagccttttcacattggactttttagagactagatcacactgttttctcatagtacactaattgttgacaatcaacaacctgcaagtcattttcacacatggccttaagaaatatttcattcatcctataatgtatttgtgtactgtttttttaaagctgcaagactaatctaactagcctgattatagaaggatttgaaagtcaggcagaggagataagatttaatgatgcaggaaatagacaataattgagtttctgaggcaggaagc

SEQ ID NO: 54442 - DNA, 1049 bp, Homo sapiens
taggcctcgtctttaaatcactgttatctgatggcttgtcaccatagttacccaagttatagtcagatggtattttttccaaaagagctgccatagtaggcctagctgaaactggcctggtttgggaggcaccgtaactctctgtactgtagcttctcgcagacaatggcctcctttgggtaaggtttttaaccggaaaacttcccgcctgagctttcacttcttgatatgaagggtgttcatcttcatacctgccattccttttcaggaactgggactcagtcactgtaacgctgctttggcgatccagccctcccctatatgggggtctgccgtacctatcagttgggggcagctcatgaggctcattgacccttctaaacatggccatttctgtggcgctcaccagggagtcggcccttctcaggaagcccgccctggccccttggcttgcgaactgggcattcaccacagcatcctcattcacagatggctgagaaaatgaaaacatttgctccatcggtgggtatcctctgtaagctctaggactaatcaaatccttggcgatgtttttgctggcctgttgcacgtactcgggattgtgttgaaaagggggtggtatcctcttttcggctttcacttccactgatccttgaggattgaagctttggtcaaactgatagactttttttgtcatagaagctttttgttgttgtggccccttactacttccgtaggtgagcatctcatcatccagcattgggactgactggcttcgagacatactggacataccatgctctggtcccagcatcttatccggtcgttcgtggcttcctaagtgatcactcccagaagcatagttttctaatggtatgttatacaccttatatgtaccaatgtcaatctcatcgatactctgtgactttttgaatttattagacttgatatctttcattaggggggaaagcctctctgtgcttttgctaattgaaataacacctttagaagattccgggcggcagtggatttgagaaaagacattacta

SEQ ID NO: 54443 - DNA, 1123 bp, Homo sapiens
tccttaaaaaatatgtaattaatgggtttctagctttagctgatttgaaagtatgaaggaacattttactataatcattacattatttccagaagctctctctcctttatttaattttttatttgatatcttctgtgccacaaaatgttttttaattgtctcttttcatgatttagacatgaaaagactgaaggttaatgaaaatagtatttgcaattccaacaaaaagtagagctttgcaattacagctcatcaatctatcataaaacacacttggtttctgaatttcctctcttgttctctcctggatttatgtttgattaccttctggtaaatgttttgttaaatggataaattatagatgtttatattgcagaaacagtccagatgatgttgtaattttcctagaaattctgttgcattcttattatccaaagctctaagcttaaaaatagctcagagaaggcctggccacagggttggtgggattatccaacagggaggacagcacagttcattttaaactccaaaaaaagaaatcagcttagagatatgggcatgtgatttctggttgatttaaattcaccacccaaaggataatcctttttaaaggaccagtacacataaattttgtatgttagagaaatattagtacattgatatcttgcactttgaatgcctacagctcttaggatgagggaaaatgaaataatgcagtgaccaaattagtgccttaagagcaagccttcatggtgttcaatgatgattgccaggtattatgagaaagagcaggaatctcagataatcctcattgtgcttcacattaactaactagaattaattctcatttcaaattttaatctgataagagtactctcattaagtattgggatatatttagggctgagtatactccataatcaatactatattgactctatgccaagctatttaaaaaactttcctttctatcaaaaacctgaattatagacgttcagttcttagagagttcatatgaaaaatttacattgcttttgtaaatgtgagaaagtttgaagttttaatgagttttattctagtatttaaaaaaaacctttgcagaacaaaacataaataagaattt

SEQ ID NO: 54444 - DNA, 1050 bp, Homo sapiens
taaaaaagcaataaagcagaaagaaagcatttgccattttattaaactgtgagagaaggtgacaatacagtgttctttcctcatattttgtacctacacgatagcatttattagactttttgtgtgtctccccactagactgtgtttcttgaggggtaggaccatggcttatttatatcttccattgttcttataatagaattttgaacataaccccttgttcattaacatttgttgattaaattgaatgcacagtgagaaaaaggcaaattgttttaacagttaaataattttttaaaaaaggataaacatatagattggctagaggacaaaccttagaatggtccggaggcagacttacaagagaattacttaaacatctctcgattcaaacctacaggtctggatgaatactcaaaatataagtatatattttggggtataggtgaacctgcggggcatatttatggcaagaccaagcaaaagaagaaaatatagtcccttcactttgagtagtttatgatgacctagggccctaggtgacagggatagtaactatcattttttgggaaacgtggaaatgcaaaaaaaaaaaaaattgcctgataagatatatagacacacacacacacacacacacagacacacacacagacacacacagagagagagagatattaattcccaagtttgaatttctctgggaaatggccacaaagaaatgcctgaactgtttgctagcaacattcatggttttataaagaatatagcagtgatgtcctgctagaatatctgtcttgatcataatgagactgtgagaacctatcaagtgcaagatacccgttgcttagtcaaacgattctacaagtatggctgaagatttatatcccaaaactggctatcaaagatggctggtttaaaacaatcaagacagtatagacaaatattacagggcaagaatagtttggatgatgatatcctagagaaaaaatcacttttagagaatgggacttgttcactatctaacaactttctcttttacagattcta

SEQ ID NO: 54445 - DNA, 1048 bp, Homo sapiens
atggtagtgaagtcagagatcattaaaaaaaaaaaaaaagtctagagactcttcattttactaaaatagcgacccaaagttgtatcactgcttaggaatttttcttaaacttacagaagagtgaaatatttcactaactgaattatatgagctgaaatgagaaaaagaaaatttatgtgtgtgtgtttggcatatgggaaaatacaaattcatataggtagaagtagaacttctttatagagtagtaaaaggattatgccccaaaataactgaggtcaaaagtaatcaattatgaaatcgtttaggaaaaaataattttcatagatacttagaaaacatccaaaacataatatctagtatccttttacatataattcttaacaaaccatctgaaaacctaccactgtcttccttcagaattgcttatgttagtttaatatttcttttttgaatagaaagaccctagttcatgttatggttttcttatatatagctggttgggggagcccttgggcagttataaagtggaaaaaataaaactgtattattactttcaataagcaacagtaatcttgcagtagtttcacttttttcaaggtcttttgtggtggtctttaaaatttacaaacagaatttggtagatttacttctaattttccactagtaaaaaatttcttcttcatatgaagacaatgtcattatccttaagcttcctttagtccctactgagtacaaagagaaacttgattggctcttcaaacaaaaactatctgtttatctgtcaattacctttctcttcatttcaaacagaaaataggcttgtgttttcaaggatgaaagtgtatttgaggatgttaaagagaaatgcccaaacattataaagccgaagtattaagcattcattgcattccactgacgctaggtgtcatcaaagctaaaaccaaattttctagagtaaaacttacatacaacagtccttactgacctgaaccagatgccttttccacattcaagccaaataagagtcctctgagtggaaagactacaa

SEQ ID NO: 54446 - DNA, 1020 bp, Homo sapiens
tcttttgtttagaacattactactggatggaaatccattccgagttcctcgagcagccatattaatgaaaggaacagctgctatacttgaatatttgagagaccgaattcctacttaacatggagttgctttataacccttgtcatgtattattaaccctggttaattctaaggaggatgtaacatttgttttagtatcatcttaaaaggtgattattgtaattgatcttgtagtttcccagtatcacctacctgttggtataattagcctgggccatattcactgccagtaaatatttttacatttttatttaagatttttgtaaggtgttgtatacatttgtaatggtgataaccacaatgtgttcatacatttgttctaaatgttttgcttatgatttatcctgctaactttcattttcttatagcaagcagttttttcaaaaatgaatttttatttaatgtggttcagtattataataacaaagcatttttgtagaactggttttttttctcatttatttttgtattccatacaatgtgaccaattgacttgaatatgactagccagtttctatgtttttgttagatataaaattaaatcgaattttgttgaatactgttctttggcatttaaaaaataagaccttcttatcttgggccacatgtcaaaagaaaaaggaaacaaaaatatattaaaaataagacttttcattacccatgataggacttttgtgatatggctaatctcagtacacatttcaacttaaaacctttttatttacagcaccataattttaaaatttacttgcaatcttggtaagactaaacttgcagtgtttttctaaaagggaatttgataggtaaacttgatttaataaaaattaaatatcatttttgtttacaccaaaattatcagaagtaggttgattagtcattataacacttaccatatgattctattaagaagtcaattcagtagcatgtatatcaatttatatagataggtagatagctttt

SEQ ID NO: 54447 - DNA, 2338 bp, Homo sapiens
tcaggtccatgtggattaataggaatttccatttggggctttatgttaatgaattgccaagccactaatttttccactgataggaaaagcaaaattaactgaagcctgttaatatttttctcctagaaaaggattcttcacatgcagtcatttgctttatacattgtactgttaaatacattttttgttgttaattacagcaaaatctttagattatgagtgttaatttagtatattgttgaactttaaaaaacatttgttatctagcagtaaactatatacccaaagaaagctgacagataatctagcaattaaaacaacccaatgtgagacaggatagggtactgataaggaacttgagcaatatagtcaattgcttataccatatcccagacctgctgtatagtttttggacaggttaactagctgttcttagttttctcacctgtgaaatagggataataatagtgcctgtttataagaattaaactaaatgacataatccacacaaagcatttaactagagcctaatgcttttatgcacgtaaatacttaagaggaaaaaaaaaggtgatgtcgtggaggagagtgatgtgatgaattgagaaagttgaatgactttcatctgactatcaaaaattttttagatgtttaaagcttttaaaaagtgagacaaaatataatttgctttctatttctcagagcatagtttagggaatgtagatcttaaaagacgacaaatttaagatagtccattgcaaaagggatctctaatccatcttctggttctctcttgttttaaaggactgagaggatatttgatagaattgagcatttagatttgctctcagataggacaagtttgctttgggcggggggtcctggatcaaataagttaattgggaataaagatatacttaagagacattacttattatttactgcctcattttatctcactatctggctcttcttttgcaaaataatgtcattctgttgacacagctattatatcacattttgagcaacttagaatgtcaagaaaataatcaagacatgccttattacatggacatgttgcattaaaaaagccatgcttttctctagaaagttcccaaaccactttccctttttaaaaaaattttaatgaacaattcatgcttttcaccaaagattataaaaataatacatattcataaaattttggaataaataaaggaatatatcagttgtagtttcatcactgatttactcggttaactttgtggcatactgcatattttatttcaagctattctccatttggagttatacatgcaatttgtgtctttttttttttttttttttttttgagacaggatctcactctgttgcccctactggagttcactggcacaatcgcggctcagtgcacccttaacctctcaggttgaagtgatcctcccaccttagcctccctagtggctgggactacaggcatatgccaccacaccccactaatttttgtagagaccaggttttgccatgttgcccaggctggtctcaaactcttgagctcaactgatccacttgccttggccttccaaagtgctgggattacaggtgtgagccaccatgcttggccataatttgtatcttgactggtttatttgtcataagtatttttctgtttataaaccatactttaaaaatgtaatttaactgtatactttaaggttgattatgacaataaaggaaacatattgtttctctaggccagatttctagaaaaattattaagtcagagtttgactcgatatatcaaaaaaagttttatcaagttttatcagttacacattgaaactcattttcttttactacatctttttcagcacagcattttatatcctttcttttttttttctttgctaatgagatagactaagttgtaatttaactttcatttggttgtctttttttttgagacagagttttgctcttgttgcccaggctggagtgcagtggcatgatctcagttcgctacaacctccgcctcccaggctcaagcaattctcttgcttcagcctcccgagtagctgggattacaggtgcccgccaccatgcctggctaattttttgtgtttttagtagaggcggagtttcaccatgttggccaagctggtcttgaactcctgacctcaagtaatccacctgcctcagcctcctaaagtgctgagattataggtgtgagccaccgtgcccagccaactttcatttgttagtaaatcatattaataacaggaataaaactataaaccttgattaggcttacttagaaatgtttaattcttcctcttta

SEQ ID NO: 54448 - DNA, 1040 bp, Homo sapiens
ttctttattgaatggaaacatgaattggacattcaaaaattatctttttctatttgtcatcttttttcaattagaattttgtttccttgctctaagtgcaaaatcaaaacatttggtatcagtgaggatgtctatcttgaatcactgattcattcaaatttatgtttaacatttacttttttagcaaatgttataatttaacaaatgttttatagctcacttttttaaaattaatctcagcatgacaattttgaaaacaaatctgatttttcctttatatgtttagcatttatcttgaaaggaaatgttttaggtctgcattacttggcctttctttgagactattctgtgatatgttgtttgccatatgatgttttatagttaactatggttggagtatacttatatttgatgctttccctgaaatcaatttaatcttttatagtcttccctattcattggggaaccttcatttgaaatttttggcattagaaggaaatcctttgagaacaattcgaagagaaattataagtgtaagtatatttggaattcagctctttgttaaattgaaattcagacatatatgttgatctgtaaaactgcaaagcatgtcttggtgaatgtctttgtctccacccttctagaaaggaacacaagaagtcctaaaatatctacgaagcaagatcaaaggtactttaaaatgttctcttatattttgaaggattcataaaaagtggtgaagaattaatagtacataaatttaaatgtcttttgggtatacatatttggaagtaatagatcctggcatgtgtggctctaattctaaatccatatagtctgtaagtatgctgaggttataaaaatatctttaaactcacaataataatgtactatctgtaatccctttgaattgtgttaagtctgccaattaggaaatttaacaaaaaagattcagtaagcacttagtacttcaactttgaaaaaggagtaaaacttgactttcaggatatatgggttctattgactagaaagtatattga

SEQ ID NO: 54449 - DNA, 1019 bp, Homo sapiens
gactacaggcatgcaccaccatgcccagctaatttttttttaatttttagtagagacgatgtttcactatatgttgcccaggctggtcttgaactccagaactcaagtgatccgcccacctcgggcctcccaaagtgctggcattacagcacaactggcctaagtaataatttttatgttactatttctctttaattataattaaatgtagaaaaatttacatttatttaattcagtggtgtttgaatattcttgattatatggcacaggttcataagtcctcatagcgatttcttacacattctttaaagttgtatacgatcagaaactaatttttttttctctatttttgttttttactgaatatatattacagggttgaagcatttggattgtaattcaaatctcttggaaactatacctcctgaattggctggcatggaatcactagaattgctttatttgcggaggaataaattacgttttctaccagaatttccttcttgtagtctattgaaggtactatttagttgattattaaataactatattttccaaaagttaattattaaaatgcatttttaaaggagctaatcttgttttacattgggagtgtgtattagttataagtactgtgtttttcctatgttaatacttttcagaattttaatatgattacttacattaatggtatttttagtaatacattttttaaaagaaataatttaaaaaatagagatttgtccatttcatctgacaagtagttcataactggagaagtagtagataaagaggctaaaattgtaagtaggagacctggaataccaaccaggattatgtacctaattctataaagtgtcacctctcacctttacctaatcataatcaagtatgtttgaaatgaattacattcttttggctttaagtgtgtagaattaatggtgtcttgtaaatttgccatgatttgccttttttatatatacctttaagctctagtgttaaaagagtttattttaaac

SEQ ID NO: 54450 - DNA, 1600 bp, Homo sapiens
ttcctcaaaaatttgaatggccgtttttttcagcttcatttttccttttctcaggaatttttctttcttgcaaagatgtttttcatttcacatgacagtttattaataatatgcctaattcttcttaggcacttcataaatattggatgaatacatgaatttttgcattgaaaatatgatgcataatatggcatgactttgttttaacagaatccgttatgtaaaatatttttgaagttagaattcatttatatcctgtctactaccattgatgaacatatagtgggcctgcagatattgaaaatcaatcttgaaatgaatgatgatctgtgaaattttcagtgaatgagagttacacaacttatcacatcttaagtagtctcttttatgttgtaattccttcaaaaatttgaaatcctttttagggcattatttatttatttttttacttgtttattcatttattttgtctttctctttttaaaggatctttcaaacaatcatcttacaactgttcctgctagtttttcttctctgtccagtctggtgcgactcaatctttctagtaatgaactgaagagtttgccagcagaaataaatagaatgaaaagtaaatattttctgttttacataatacataaatttgaagttggtgcaacttacatttagaaagtaatttttaatatagttacagagaactaaagtagtagatttttatagtggtaaatgcaaacaatagcaactagtcagattttctccagaccattattatgtatcaactgtctaaagaaataccatcataaagatacttaggcatatgaaaaagaagaaaatatgattattcgttgtagtaggattatatacctaagctatactgtctttcattcattcattcaacattcataaagaggttagtcccctcttactggtgaatctacctatgatatttagttgtattatagctgtagcctcctcatggtccataagtaataatgtcgagaaataagtcttgttttgtctgaggtcccaggttgtcaatcttttttaaaagaaccaaaatgtcaaaatttattggttctgttaaaatttgccatcaaaccataatatctgaagtattgtagaactaacattaagggattaaaaaagtcaaggtacattttagtaccttttaaattagtatacttcaatataaaattcttaagagtctaaaatcattagtgatttttttgtttgtttgtttaaagaaactgttattaccaggcactgtggcttgtgtctgtagtcccagttacccaggtggctgaggcaggaggatcgcttgagcctagggagttctgggctgtagtgcgctatgccaatcgggtatccacataagttcagcagcatcatggtgacctcccatagtgggggaccaccaggttgcctaaggaggggtgaaccaacccaggtcagaaacagagcaggtcaaaactcccatctgatcaatagtgggattgcccctttgaatatccactacactgaagcctgggcaacatagtgagacctcttctctctctctcaaaaaataaaataaaataaattaataaaaaaactgttattt

SEQ ID NO: 54451 - DNA, 2021 bp, Homo sapiens
aagtatgaatcttaggatggagtaattagctaagaaaaggagatggaggaaatctatagctaaaattatctctctccccagttagatccctatcaagtgtgcaaagatttcagctaggtaaccaataacagtaaccgacttaacaatattattggttcttgttttagaagacatcatttgactttttttgtcccaactagttttattttactgtaatttagggttattgtaagcaccttgtatttcccattttccccctgttatttgtaaagtaactgtatatggcatgaaaatagcatggaattcgtaagtgagtatttaagttgtgataaacctgggaactagttcagtcatctcttaattatcatgaagtctatcatcctccatgatttgggacttctaaaccattacactgaatatctctacagaagggcttaactgaaaagaccaagtatgaagaagagtggaattccatattacattcaacttgacatcctaggtcctcaaacagaaatagctatttttgccttaaaaccgaacatataagatgtaactccattgtggtatatgtgtgcatatagttttgtcaaaattctgaaagtcagttatagtatgtattagtccgttttcatgctgctgataaagacatacccgagactgggaagaaaaagaggtttaattggacttacagttccacatggctggggatgcctcagaatcatggtgggaggcaaaaggcacttcttacatggcagcagcaggagaaaaatgaggaagatgcaaaattggaaacccctgataaaaccatcaggactcatgagacttattcactaccacgagaacagtatgggggaaaccgctcccatgattcatactatctcccaccaggttcctcacacaacatgtgggaattatgggagtacaattcaagatgaaatttgtgtggggacacaaccaaagcatatcacagtataacaaattaagtgtctagtatgtcctatcacattgcatgtcaaatcaagagttgattataagcatgcaatcaaaacatcacaaattatttatgtttggctaaaagcctttatttctttgttatttttctttgaaaccccaatgtggttactttagattactattattttaatgagtacatatttttggatatgaattttgataagtacttaaagttagtaactatatttgatttttatgagtccagtgtcattggttagcaagaaatgtctttgataaatatttattgtattgccactaaattattcatcatttattttatcaaccaatagccataataaactgaaaatactccctgaagaaattacaaacctaagaaacctgaagtgcctgtatctccagcataatgaattaacctgcatatcagagggatttgaacaactttccaatttagaagatttagtaagttctgattttccaatttttgtacaatttggggctggtgggatttttcatcaggctgagaaattaagatagatgattgaaactgtgggaacatggacagctgattttgtgattagattatcagaaatgtgcatttcaataagatagctaaatttgtcactgtaaatttggttttcctgtattatgaaatcaactttaagttttaatttaggaagagtttgggaaaggtgcaatgaagattactttgttattcagaggctttacagcatagcagaatagaggaaagttgtctttagcatataccaattctcttttctatacccatttccatttccttccttatattacctgcggcccttctgccttccaaatgtccaggtaattcactgaaggtctgtcttctctacttttcagaatggccacacttcctggcaaaattttaattccattgtttcacttaccttaaatagagataactgtaaagcaatacaaatattattttagtcatatttttattattattttatttttggggggacatggtcttaccctgtcacccagactggagtgcagtggcgcaatct

SEQ ID NO: 54452 - DNA, 1037 bp, Homo sapiens
ggtacgaccctattgtgtctcctgtcagaaagcctttggcccaggcaacctcccttttctctgggctggctttggccccctttctcagactgctagccagaatttctgtgctctaatctaatccctgtgctcatttcgaccggtttggttagcccagttcagttccttcccaggttcccgcaatctctgttaaagggaccctgctaaaaatacggtctaaatttaaacggggcgctttctgggattcccacattctgtgggataagcaacataatatgtgacgaaaccagctatcaaatcacgggcaaatcttttgtttctttggcccttattttcctcctcttattgtaatcttcaagggcaattaccaaagctaaaattatatgttttatcggcccctttgtgaacctgcactgttccctgccgagacgctcttctgtatgcagctgtgcagagttctacttacaaggaataatgagtatattttctaagttgaagatcaggatagatgccacacagagtgtttgaatgtggggacatcctgagaaacctgttaaagaccaagaagcacaaatctgggtaccatgaatgaatggccagatgctcttctgattgtcgtgtgtgtgtgtgtgtgtgtgtgtgtgtaagagagagagggaggggaatggagagatggagaaatagagcatttttcctgtaatgtttttcttcatttatatttaggttttaagactgattaaaaccttccattttccttctaatgattgctttcttattgtgacatgtataaagtagattaggcaagcaaatgcttctgaatgaatgaaaagacacagaatccttactccacctaaaagagtttttgatcaatgggaacatactcattttcaaactacagttgtgcatatatatatatctacttggtttccccaaaacctgaaacatttttctctaaacttgcatacctatcatgctaacattctgttctcttacctgtttaattttttaacagcatttatcactatcagaatttatat

SEQ ID NO: 54453 - DNA, 1011 bp, Homo sapiens
atttcatcacaacacattagtcctttcatctttgtggggttttttgtgttttttttgttgttgttttttgttttttgtttttttgagatggcgtttcgctcttgttgcccaggctggagtgcagtggtgcaatctcagctcactgcaacctccgcctcccaggttcaagcaattctcctgcctcagccttccaagtagctgggattacaggcatgtgccaccatgctcggctaattttgtatttttagtagaggcagggtttctccatgttggtcaggttggtctcaactcccgacctcaggtgttccgcctgccttggcctgccgaagtacttggattacagacatgagccaccgcgcctggctgtgttgtttttttattgaaagtctgccatactagacctgaagttttatgttatcagggacattcacttccttttccctactctatttccagcagctgggaaaatccttggaacagatttacgtacataatatttgaagaaatttgtgagttttttgactgcctctcaatgatattgtagatacagtgaataaaacaggcatgaatcctgtctccagattctatattttctatagtcttgtttaattgtgagcctaaataaatctgaagtgatttaaaactgtcatagattggttatatttatttgctttaatatatctgtcattcgtcttcaggtatatgtcttattcctatgtaaaacagacattaacataattatttaatctattagacctacaagaatcttcaaaattatgattcaactcttcatttgactgaaaaactgacacaggttcttagaagtgaagtgaaattttctcaaatcacatgcttgatgacaggggtgggttttttttgtttgttttttgtgtgtgttttttgttttttgttttttgagacggagtcttgctctgttgcccaggctggagtgcagggacgcgatctcggttcacgccattctcccgcctcagcctcccgagtagctggcac

SEQ ID NO: 54454 - DNA, 2230 bp, Homo sapiens
caggtgactaatgtctccccgagcgctagctctgagcagatgcggactctcttcggtttcctaggcaagatcgacgaactgcgcctcttcccgccggagtgagtatcgtccaccatcactgttcctgctaacgccgcctcagcctgggcctaacacacacaatttccttaggcccctgtcgctgcttccccgggccaggctgcttgagtggctggtggctggtggatttacttaagacggttgtgttccaggcctacaaaaaaatgcagagaggcagggccagggctttttggaattaggaaacactggctgttattctcgggaaattttttttttccgccttaaattgtgccaacgtggtcgtttggctttggggacttaacgcaagactaaccgcagtctgtacgtcgtatataggttaaatcccttttttaaaaaactgagtatttgttctttgcgttcttggaagaaaggtaacaaaattattcatgcctgtgttaatttggtgttaaactttgtaggttgttcacttattgttattgctgttatgtggttctggcccagcaatataattcaaagatcatattctttttgacagacgcttagtttagtgtgagcctgattacttaatttgtataatgtcaaaaaacgggttataaaccagagattttcctttgtttgaataatatacagatttgtgatatttcacagttgttcttgagaaggatttttataaatgttgaaatttgaattagagtgtatgactttttatcctttttgtctcacttttattttgaaaattatttctatcgcaagaatattaagtggatgaattgtaaagaaaaaatagttcaaagaagctaagaagtaagataaagtgtactactaaaacagacaattggaataataataatagtcttgtgctttttggaagacttattggtggagaagtgacaattcaaatgtcattatcagtaaatatcatatattgagaattttatgatgtcacttaaatactaaacaggaaattggaatcctctaagaatctactgttatggtacgtgtaaccattaactttctgctcaataaaataattgacaaaagtttatcataatgagatatttgttaagtattagcatatttcatcactttccacttaaaatactttcacaagattattggtgttttcaaattggtatgtttctaatttttagggaaatgtacatgtggagagaggatttacttagtttgcatgacgtggagttctgggaacaaacacgtaaatctttattcctgttattttgacagatacttgatttggtaatgaaagacaaatagctttcataacatgaacatacaaaaatagatgctttgctgttgttcagttttctcaagacttactgttttaagcttgtaaaattaatgaacagtaaaatagcagaaaatagtgatacattggatgattttaatagttttattagtgagatatttgaggtattcgaattactacaattctttccaatcctacaagttaaaaattttgttatggttgctgacttttaaatgctgtttattctctgaaggcagttttatgatgcatttagaaaaaaggtaagagagatgtaggcattatactggttcatcttttacctaatgcatgaccagtatactagaggaagttgtgatggaccagagtctttttgttttgtaatcaaatgaatagttccttcataaccaggacagctagtgtgtgcttgagaatgtctccctcaactatatgatctgggatattctgcattaaaaggactcccttcccagtattgggagaaagagagataaattgacacatttttactctgactccttcatttatcttcccacatacaagatcattttgtcttttaaaatgtacaaggttacaataagttaaatgttattagtggccttctacatttgatcagtaatgtagatggctacttttatttacttgatgttgcattttgtttttttaactataagtttcaatacactaatctgactggcacaagttgcatatagttcccagtggtccacagggttcatcattccaaaaatatttattcataacattgaatggctcagattacataaaattctatctgttgtgaacaggtcacctgattgtaactattatctacacagttggccttcttcatctctgggttccacatccatggattcagcccactgt

SEQ ID NO: 54455 - DNA, 5117 bp, Homo sapiens
ctgtcttacttacactgccatagcttgcagtttagcacttgtctttcttttacctaaggaagtaatttgttgagggaactagcccttttgcttattgaaactttgcagggtggcactagtggaacgtagtactactcccatgtgtgcctacattttttcttttatctgaaagtgctccaagccagaaatccttgattatttacagtgcataagagttcttacatgctgtgggtaaaagagtgcagggcatggaacctgtttattttatgcagttcaagaaaactcattgattattgagtacatgttcgttctcatgatattcatttgtccctgatataaaaattgttcatctttcttactctgagaaagccattaggaagtttctaagccccaaactactgttacctgtatctaaaaatagctggtattggtattataaagaaactgttgacaattttgtggtcccctcagtctctgagacttcagtaccaaattgtttttaacctgatacactgtaaatataagttatgattataagtttttatctgaactgcaattcactacattatttcagtgaacagtatatgattgagaatgttttcttttgaatttaactacattagtatacagttaggtttttttaatctgttttacttttgaaatgtgttggtttgtgaattagcatttgttttaactgctattctgtttctcttttatgttatttgtttattttttagtgattcgcctttgccagtctcatctcgtgtctgctttgttaagttccatgatccagactcagcagttgtggcacagcatctgacaaacactgtattcgttgacagagctttgatagtcgtaccatatgcagaaggtttgtgctttgtttaactacctatgtgggcatcctaagatgaccatctacctcagtagatgtagagtgagcattagtagcatgttaaatctaagctattaacatttttaaacccttgttatactgcagtccgtaatttttgcttgcagattttttttaattctaaaaattagaaattaggtctgttattataaggtatttaccttttgttttcttttaaaacatttttaagttgtttaaaaccatgtcccttattgtaactccctgagatacatctacttagttaatttaatgttaagttttatgaaaaagccctgaaggtaaatgattcactccatgtatgcttacagagccttcaaataaatgcatgatgttatttctgttttaaataaatgagtaggttgattttattttcttaaagcttcctcacattgataatctggaaaaaaaaaaaacacattgaatttcagtataccaagggttgcagtgattttggttttcgtgaaagttcaagatttcctgtagcttaggtgccaaatgggcactgggtgttttattttatgccagattttcttgttcattcttgctatatttctagaatatctctaaataataaattcttctctctgttatttgtgtgtgtgatttttatagtggagaaggcaaatgcaaaacccttccagatgcctgaaaaacagtgggtcctctgcagctacaggggattctagacattaactaaaggccagcaagcactcaagtgccccaagtgttttcctggtgtaaccatttgttaactacattttctctctttttacattttaggctgttaaagtaatttgacagaaaaaaatgagcaggttttttggatctaaaaagccactgtgacaagaaattttaataccattttgtaaaattttctaaggcgtattttataattagtttgttcccaatgtactgctacttgatttgcattttggtaactataaattttactcgaatcactgaaatatgataaaactgctggattttaagttaataatttaatatgctgaccaggatttaaatgctttcccctttccttaataaactggtcagtggaagtggaatcttaatattgttcattttagatgctatctgaaatctttgaaaacaaatgtgagcatttacaccataccttgtaaaagttgtgaaatgtctagtccttaacagagaagttgcctctggttttctaaagaaattaacttatatttataaatgggttaagacatgttatgtaatagtacctctgtctccatgatattaaagtgtatgagcccagttttaaggttttgtaatgtatagatagataaatttttgagttagtgtgttttggttaagcaatttcttttatgtcagtgtgcctgttgtaggataagaccatcaacagaaaatttacagaattcaaattcaggatgaataaaatagagtataggtcttggaacaagggtcaaatcatgtgagtaatatgtaaaacattttggttagcctgtaaatttaaattttttattggctaagtattatagttcccaatccctgaacataatacagtatatcatataaatgactttcataaatattttcaggccatagtaatttttctagacctatttttggaagtgaagtatttaggaatatacagtatatagaattaggggaatatttcattcagaattctattgttggtgaatttaattctggtatgatatgctgtattaatgttacctccagtaaatacaattccctccagatttagctattacacttcggtgttagctcttggtcagtgttttagaacagtagacatagtctacggtaaggaatagtcttaattggtaaaactaagatagctgaatttggaaggaactcttaatagtaatggatttggggattttttaggttccttggttaatgtttgtttcttttgtctgtttctttttctttcatttctacacattcatgcagtatttcatggttctatcaaagcagcagtaaaaaaaatactcttgacgcatgaaaattaactggtgaggggcctcattgctatttttaaattgtagttttatttttaaatagtctttttttaatcagaggatcagatgcatgacttttttttttttaatggatgcagatcttctatcaggtgtctcacaataaattcaagaggattttagtttgccagaaatgttgcaaatgcactaatttgagtaagatgttgatactgaatatatcctcttgagacataattttgcatgcaaaattatcccataatctttgtaggtttgttaatattgatgcattactgccctatatctaaatgatcttctcccccttcccctccataactcttggtatctaaattgatgacagctctgacacaagcaagataacagtgctgtgtagtatacatttgtttatattatcggcacttctcagtataggtggaaggaaccattacctttatttaacagtggtttttcttttttgttgttgtgttttacagttcttttccctggttcagcctgaactatataccaggccctgctgaaaataccacccaacagttttcttctgcagcttatccagtttctcttaagtgccctgtacatattgtatgttttatgatgagatgcagtttcttaatatgtattacagaaatactactggtatttgcaaatatgtagtttaattgtattattgaactctcattttgggggcttgggcacattaacagattaatccatctgtatagggcttttgctgttggatagaatttaaattgtctacataaatatttgttttaggacccttagattttatctgaatacacagattaggctttaaaaacagatatatatgtcatttttggcttaaggagtttggctaagttagcttttcaactggcactgtatggcagcattttttggtatggttagcatggcacatggcgaaacataaagcattttactgtacaggtaaggaatgtgccatgttgttttacctatctctctttctctctcactcccatgcacacatcctgtgtgtattcagagaccttcagaaacattcatattcattttcatgagtcagcaaaagccctacgcttgattccaacagaatatttcctttacatactttcttctcttaatttttacaaaatttgtatggtaggtgtaaaagaaaatcatagtaactgtaccatattattaacccctaaatcaaactttttttgtcttgtgtatcttgatttttctgtgtgctttatagtgaagcagccgacacgagtcgttgttcataaaacagcttttgaaagttgagagcacacccctggagaaccgactgtgcttgcttacgtttggttcatgacttaaaaatcgagtacaggtgatgaaatcttggcagtgttaacaaaaaagtagtgtgtattgtgctatttttttttactctagaaacttaaccatttgtagagaaaaaggaaacaaattttcacacattgaagttcattctgacataaaattaatgataaataatcatagaaatcaagctttgtattttagcgaacataagtactttcaacaaactcaggtggtgtatcagggagacattttctgggtgtttttgtgtgttttctgtcttagaaaagaatgtgttctaatgcaaggatgtttctctgcaggagttattcctgatgaagctaaagctttgtctctgttggcaccagctaatgcagtggcaggtcttctgcctggtggtggactcctgcctactcctaacccacttacccaggtactagttctattgaattcttaaagggtggggaaaaaaacagaattgtgcataaagctaaacatatttgaactttgtaagtactcataagattctagttcagatagcattatcacatgtctatatcaaaatcacaaatagtatagaagatctcttagacttttgtattttaagaacattctgaaaaatcataaaatatctgttctgtcacttttaccattggctctcaaaataacccatgagtagttttggaacagtctcctgaggcatgaacacttctctgaacacactgttaaaaatatattcatttggaccaggaaagaaaactgaagttaaaatttcacaagtgagcccttcatttttttttccttcccctttatcttttcctgttatttggggggttttgaattacataggtggcttg

SEQ ID NO: 54456 - DNA, 1932 bp, Homo sapiens
aaaataaaataataccaatacagttgaagcttcctatatacccattatttattacatttcctgttctgcccacaaataactactaaatttgttgtctataatttttttttctttcttctttctttttctttttttttttttttttgagacgagtctcactctgttgcccaacctggagtgcagtggcgcaaactcagctcactgcaacctccgcctcccagattcaagcaattcttttgccttagcctcccaagtagctgggactatgggcacaagccaccacatccggctaattttttgtacttttagtagagacggggtttcaccgtgttagccaggatggcctcaatctcctgacctcatgatccacccgccaaggcttcccaaagtgctgggcttacaggcatgagccaccatgcccggcctacaattttttttttacatgtgtaaacctgtaaggggcatctttagcctttccactcaagacttcatgtgtaattttggtaggcctttggcctctgcctcagttcctccccacctacaaagtaaaaggtaatgctcttccccaaaaaattactatgtcataaatttttttttttttttttttttttttttttgagacgaaatctcactctgtcgcccaggctggagtgcagtggcgcgatgtctgcctcccgggttcaagcaattctgctgtctcagcctcccgaatagctgggactacaggcgcctgccaccatgcctggctagttttttgtattttgagtagagatgggatttcaccgtgttagccagtatgatctcgatctcctgacctcgtgatccacctgccttggcctcccaaggggctgggattacaggcgtgagccaccacaccggcccaaaaatttttaatttatatgaataaaagttcttagcatcagcatattttcttgtactggcatttctaaaaatgtgtttgtttatggaaagttaatggatgttcagcaaaataggtatttttctaattccagatgactcttagtcattaaaacaaatacttgtaaatattcaaaacagtgctatgctatatgttgtttaccaaagttatcatggagtcctcccctccctttttttgaaggaatattttgctaaaataatgttatatacttaagtatttatttgaaatgctcgtgtgcattttaaaatatttcagatcccatttcttggttctgtttcaggttgaatcatgtagctgctggtctcgtttcaccaagtctgaaatcggatacctctagtaaagaaatagaggaagctatgaaaagagtacgagaagcacagtccctaatttctgctgctatagaaccaggtaaacaatgtttatgcaattttgttgtgtgattcttagcaaaaatgattttgacataaatgtggaattgtgttgagtgacaccctagtcgtttaaaatgttgtaaactctgataaaagattgtatagtggagtgccactcagacgtatttggagacaattctggtggtcacaggagtaccaactgcatctagagggcaaaggaccaacatgttgctagatatcctgcaacaaacagcacagccttccacagcagtggttaatctagtccaaaatgtcagtaggattatctaatacttgaaacgatattttgtttttcttattatttatgtttttctaagttgggatagcctaattttaatttttttcattgatcaagagaacctagtgaaaatgcttctgtttaaaatgatatttctttaaagaaaattagttgtcttctttgcagattgtctttttgagagtaaatgaatagatatcatattatctgcccatatatatttagatctatggccctggattttctttcttataaatatcttgttcattaataaatgggaatgttttttaatgtgcctattgtta

SEQ ID NO: 54457 - DNA, 3293 bp, Homo sapiens
tcaggaacagaatttttttttttaagttacagtaaaaaggaggggaaggctgtatatcagctgtatatcttcaaagtaattggtgaaagcagggttttgggggactgcaggagggcgattttgctagagtataaggtttctacctttccactaactagttctctgaatttcatctaatgatttaaaggtgaatgtggggatattttattagtaactaccttctatatcacattattgaattattctgtacttactctgaacactgaatgtttgaaccaaaaactaacttcttcagtaatagtttacttcacacgtcacccctctcgcattagttttgttaaatcagttttttctcaagcttagtatttctaacattttgtcatcaattaaaagaattactagaaattaggagttttcttgagggtagtaaagggaaagattcatggtttgcagatgattatattactcatttaattgtttagcttataccagtattgtgaaacaatctttcatttttctgtttttttgagacagggtctctctctgttgcccaggctggagtgcagtggccctatcacaactcactccagcttcaacctccgcaggctcaagtgatcttcctgcctctgcctcctgagtagctgggactacaggcatgcaccaccacacctggctaatttttttgtattttttgtagagacagagtttcaccatgttgcccaggctggtctggaactcctgggctcaagcaatcccctcacctcagcctgccaaagtgctgggattataggcatgagccactacatctggccacatctttcattgttagaatcatctatgatgtgtctgcatttttaagatcacactgtattttaaaacctagtttgcacatttgtgattctagagagagacgacgacgaagaagcaggagtggcacaagatctcctaaaaagcctcggtctcctaaaagaaaattgtcccgctcaccatcccctaggaggtaagaatgttaatcatttaaatgtattttttatatttttcagaggtttttcattttaaaactgtcctgtagtttttcttttcagcagttacagttcttaagaatgttttaatgtattctccttctgacttgtgacttaaacaccattaaggactgaacattttagtcctataaacaagttagttttgtagcctgtgttacttctccaaggttttgaagttggatctttgctgtactacttatatcctgtgaaattgagtcaggctcatcatctaaacaagttaaacctgttgctgtacattttactgtcattctagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaagtatgtttacaaattgatttatttttatatttggggtgatgttggtactttcagaagttatttttctttggagaagtttacttttattattctccttggcaaagcaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttattttttgtgtgggaatggggttggataaagcaatgaactttagtataaacaaatcccacctatatctagcaaatttatattttcggtgaaatacagatatttgcctttctggag

SEQ ID NO: 54458 - DNA, 2100 bp, Homo sapiens
actttgtagtctatgaatattaacatttgattttacaatgctatcattgatgttctctctgtagatatacctgtgtttcccacaatcacagccactgtgacttttcaggagtttcgatacgatgaatttgatggctccatctttactatacctgatgactacaaggaagacccaagccgttttcctgatctttaactgacgtggaaaaggatgccgtctaaccaaggaaagaaaatacagagaccctagaagtggatccaaatagaagggacaaatgctttcagtgaagaaaagggaattacacattgaatcgacacatcagtaatacgatacagtgaaatgggcctctaataagaatttcagcgagttttctgatgtgccattttttgtctttttaaaaatatacatattataaatgtaatagtttgacacattaatgaccctaagacctgcgtatgtgaagcagctatgagtgctgtgatttgtttttaaaaatttttacacttcttgttgaaatatatatgcatataaatatatctatatctatatctatatctaaaacactcctggaccattaacgtaaattaaatgtcttaagagatatggagcccttttaaacttgtcatctttatgcaaggtgacatttataaatattccttcgagctttgttttcataaaatgtaaactatgtaacattatgtatagttcagtaatttgaatgtttgttcaatataatgaactagaaggaatgcaattttctgtagatgaatgaaccaaatggtaaccattaaacaattgcatttatatgttgcaatacatttcagaaggagcgttcactctgcagggaataaggtacctcctttagcaccttagtgcaattcattgtggtgctatttgtttttacctgaatgtttgttactaatcttcctttcatagaacctctattttttttttttctaaacttgagtttgagtccttgttatggtcatcataaggtaatggttagcatgtttaaagatattcctcttccaaatctcagcactttaaaaaaaaatccaaatttttaaacttgcttcctaataagtacacatcggtctgattattttgtttgtttttagtagaatatggatgcattggtgtcagttttaaaaaacaatacacatattttggacaaccctacatatttaatcctttcaaaataagataaaaacattttatatgctaacagaatatatttgttacaagttaaagtccagaagtatacacaagattgattactcctattattttttttaaatcacaggaaaatattgatttcattgtctccaaagtgataaaatcatgtattactcatttttgcacttaaaatttttcttatttattccaaggtggtttgaaggtccaagtatgaaaataaattagggggattaatgtataacagttataaagtatcatgttgtattaaagagcttacttagattgatgtttttaaaatgtatcctgatgaatgtctcaagaatgcatctgtcaagttttttagactgaccagtagcttaaacttttttcaggattttaggtaatttgaaaggagtttagagacccttattgaaaatatgatttaaaaatccaaagcataaaccgtaagaaaaattttaaataaacatctttaaagctgcatcttccatactgatacatgcattgcgtatgttgacattaaatacattttataatgaagaaaaataatcatagtaaaaaattgaaagacctaattactacgttacatggacctattgaattttgggggaacgtgttagtaaacccagactagctttgttgaatagaagttgatcgctgttatttaggaaatgggtagatcaaatgacttagagactgaattatcctatcagtggttacatggggttggagacactgaaaggcagtgatcactgttgcttctaggctcccttactttgtaggaatatggtatactttcaggaatatgctatatatgttttcataagtacagacaccttagggaagaaaaaaagtgggtaattgaagcttatggttgattaatttcctaacagcacagctatgaat

SEQ ID NO: 54459 - DNA, 1050 bp, Homo sapiens
atgctacattgataattttcttttgataatagttaatatagaattccttattcttcacaatatttcttattgatcaatgcagaggctgtaatagacagtaaagaagattgaattgaataagtgactttaaagatatacaataataccttaaaaatttttttactaatgattttctttattcctaaaaatagtggttattaaaattatattcaatgtgaaattagtttagatctaataatttctgaacttttactctttgctattcttttttattgcccttgtcttaatttcttatacatatcttattcccttttagcataactttatttctgtagacagagtaagaaaaattgaaatattaatgaatgtcattgaaagatgacagatgcttcttaggaaggtgatagactatggaaaaagtttcctaacattttttttcctcccattttagagctcctcatctgggtagagaattggtgtgcaaagagagtaagaaaacgtttaaagctacgatagccatgagccaggaatttcccttagggatagagttgtaagtttgttactaactacaaatgtttatgaaagaaactattaaaccctaaaggctgtaataatatttgcaccccagtggtgcatttgagacctttgaaatgaaaagcaaatagccattgccttgatagtgtgtgcactgttctagaacttttctggttcgcaaaagtattgatttttactactttcaccagataaatttttgagtagattttctttctttctttttttttttttttttttttttgagatggagtcttgctctgtcacccaggctggagtgcagtggcgcgatcttggctcaccacaacctccacctcccaggttcaagcaattctcctgcctcagcctcctgagtagctgggattataggtgcccaccaccacgcccggctaatttttgtatttttagtagagatgaggtttcgccatgttggccaggctggcatcaaactcctgacctcaggtgatccacccacctcagcctcccaaagtgctggga

SEQ ID NO: 54460 - DNA, 1767 bp, Homo sapiens
tgtatgcttttgtgtatttttcaacttattgaataacttagatgtatatgttgtataacctagaaaatgtaagatagtttgataatttcaagtaccaaaggaatatttattttcacctacatgttacatatttatggaaaaatatattaccttgacactttttttaacctaaaaattttacttttaaatatttggttttgttttaggaaagagtaggaaactttttggcagacttttacctggtgaatggacttgttttagaatcaaggaaaagaagagaacatctcagtgaagaggatattcttcgaaataaggccatcatggagagtttgagtaaaggtggaaacataatggaacagaattttgaggtataatttttaattcttctaatttgtagttttctaagaagagaggggatagatttcattcttggtggcattcagtaagtatataaatgtactcacagcttttatttactgtgtgttacctttttctgtgaatcttcatttcgttgatgtcattattatgaagacaaaaaaatgtcttttgggatttttttgtgaatctgtactttatctttgagtcttcattaataaatagattaaaagcgtgaaacctaatgttattattatattttgagatggattcttgctgtgttgcccaggctggagtgcagtggctcaatctcggctcactgcaacctctgcctcctgggttcaagtgattctcctgcctcatccccgccaggtagctgggattacaggccctgctaccaggcctggctaatttttgtatttttagtagagacagggttttatcatgttggccaggctggtctcaaactcctgacctcaagtgatctgcctgcctcagcctcccaaagtgctagaattacagatgtgagccactgtgcctggcccctagtgttatttatttatttatttatttagagttggagtctccctctgtcgcccaggctggagtgcagtggcaagatcttggttcactgcaacttccgcctcccaggttcaagcgattcttctgcctcagactcccgagtagctgggattacaggtgcttaattctttctgctttgctaatcaaaatccgctgctttgaaggcccagctaaagatccatctacttcatggtgtcatctctgacttacaccttcccatatgtttcttgtttagcatatgtttactgaaagcatgctatatgcaaagaattgtgtgacagtaaggaaaggggaggagaaattaggaaataaaagatgtatgagacatggtaactgctcctcaaatcttattcctctgtgaagtgaatttagatgcattcttaaatttattttttatttgtataattttatatttccaaaaaaatactagagtcatacaaagaattcttggacaccttcatcaagatttcccagatgggcccaggcgtggtggcttacacctgtaatcccagcactttgggaggccaaggtgggcggatcacctgaggtcaggagttcaagaccagcttggccaacatggtgaaatcccgcctctacaaaattagctgggcatggtgacacatgcctgtaatcccagctactcggaaggctgaggcaggagaatcgcttgagactgggaggtggaggttgtggagctgagattgcgccattgtgctacatcctgggcaacaagagcgaaactccgtctcaaaaaaaaaaaaatttcccagatgttaatgttttactgccatttgtatagcactgtttttc

SEQ ID NO: 54461 - DNA, 1999 bp, Homo sapiens
tcaggcttggcctcctgggcaacatagcaagaccctgactctacaaaaaatttaaaaattagatggctgaggtggcacaagcctatagtcgcaggtgcttggaaggatgaggtgagacgattacttgagcccagaaggttgaggccacagtgagtgatcacaccactgcactctagcccaggtgacagagtgaactcctgtccaaaaaaaaaaaagagagagaaaaagaaatctgcaggctggaaactcaagcagggtttctgtgttgcagttttgaggcagaattgcttttttttttcctggaaacctcagtttttgctcttaaggccttcaaactgattagattaggcccactcacattatgtagggtaattagctctacttaaagtccgttgattgttaatcacatctaaaaaataccttcacagcaacatctagactggcgtttgaccaaacacctggcatcatagcgtagccacgctgacacataaaattatcatttaactttatacataaagctaaaaagccctccttggccactgcccacagtcccacatccccttgcagaatgtcaccagtttttatatcctccagaccttttttatgctctccatatgtaaatatgagctcataataataggtagccttttgttgttgatgcttactttttcataaagtgtcgtgtcatatcgtatctactgttttgcagctggctttttttcctcattctttagtatgtcgtagaaatcttctcttaccagtacatgtagtgctagttcactctttttagcaattgcatagtattctatatgatggatatactgtaacttaacatattcagtcttgtttttggacatttaaatgaatagtcacatttgtgtccagttttctgccattataaatgatgtgtttatcatccttttacatgcctttgcctgttataagtagcaagaaattaagtggctgggtaatggggaatacacacttaacattttgttgatatgataatttacatttactaagtggtttttcattataaggtttcaaaaactgataattaccacctggttatttcccagccacagataaattctgttaggaaatctaagctcactgattttcctctctaagcctaatggcattatagcattctcagttgtgaggtcctacattgcagtccatttgttggctttaaagtcttatttgtttgtactttgttcttctgggcagcattagatggatcacttcaagagaagataaaaattgaaactgctaatcatctagtactactgctaagcagctcaaagctcttgaagcatctaggtgatcttcttaaatctttgacaggtaaggagggagtcagtaatacttatggttcccattttgtaggtagaaacaggtgcagaatgctttgctttttttgcaaggtggactggaacacaactctgaacatgtagttttgaaatgtcagtaaacagcagcagggtggagacatgtgatttgcatgcagatagaaatgggaagcttgttttcagtaagttatttatcttttttttgttttttttttaagtaaggtatttcaaactctgaatacctgtgggtctgaaaaaggtaaaagttaatgttgaaggtttaagaggactttattgaaagaaagtaatgactttttttgatgtcctttacaccacttgagtttccctaaaacactttaattgtattggtgagcaagggtactcttttcctcttttctttgttgaaaacaggcagctgtaacttgaagtttggtgcctgttagagaatagagaatgtgaacaggtcattaattctggttgtactagagattcttgtgtgacatggactatttatttctttttattccactttttttctatctataaaatgggaacagtgttatccctgacccctccttgttactcgtgatatttgactgccagcttaatagttttgagatagctttgtgctacttgggagtaggatc

SEQ ID NO: 54462 - DNA, 1073 bp, Homo sapiens
aaacctagatttttatatttaacttttgctcacatcccaggaatcagagatggaaacagaagaagaggtggatattttaatgagcagtgatatttactctgcaactttatcaacaaaatcaatttctttcacgcgtgcccagacaggatggctttttcgggaagataaaacagtatgtgcaaatctagatttttaaactttaagcattgttcggtatttaatatttccaaaataacgtgatggaaatgcaagaagtagcttacagaattgtctccaagtagtttttttctctcttccttgaatccagataaggaattataatggatggttagagtcagaatgtgtccttggagaattcaggaaagaaagctgagctcatttgaattctgtgtcaggaaggactcttattgctagctgtcttgttattatacagggaacaatgttttcacatgattccattatatttctagtgctttattcgataagaagactacaaaaagggataaacttgactctatttccctgaacctgtttgtctccctactttagacttctcatttacttaatatttttttcttgtattctatacatatgagtaagattaaataaccttacatttctgcaacactgtagaattgttaaatcaaatctcgggggaagtttccccattagtgtaaattatttccataattcccattgtatctgtcagcaagaggttatataagactattcaaatatatattcggaaaattttgaggctaggcgtggtggcttatgcatgtaatcccagcactttgggaggccgaggccggcggatcacgaggtcaggagttcgagaccagcctggccaacacggtgaaaacctgtctctactaaaaatacaaaaattacccgggcgtggtggtgcatacctgtaatcccagctactcggaaggctgaggcaggagaatcgcttgaacccgggaggtggaggttacagtgagccgagatggcaccactgcactccagcctgagacagagtgagactccgtctcaaaaaaaataaataaataaaaataaaaataaaaataaat

SEQ ID NO: 54463 - DNA, 1110 bp, Homo sapiens
cgttttagccgggatggtctcgatctcctgacctcgtgatccgcccgccttggcctcccaaagtgctgggattacaggcgtgagccaccgcgcccggccaatactattttcttttaggacacatgctcaagcaatgataggtgttatttaatagtaaagctgaattctagcttctgggagtggactaaaagctagaattcagctataaagcaacaggcagccccccgcccccccgccgcccctgtgtgagttgatgagttacttttttagggcttcttgatacataaggcaaccatacttccctctttgctctggctcacccctgttttcctggcagaattgtcagtagtgtcactttcattcttagatttattaattttgatgataaattctatgtaaccctagttattattttcatgcagcatgtgaggcatgttttatttctgtttttcctgtctagggaaaccaagaataccaactcactttgccttgtctgtgatgagaactgaaaaacctacagagtaatgaattcttacagttgcattagaaattcagtagccagggtggatttttcacggagccttaaaggagcttcctggggatgtgatcagcatcctttgacagcagggccaaccagtttcttggctttaggactgtgtgttttgagcagccattagctggggtgatcctgatctggtgatttataaagccatgtgcaagactgaagcacgtcagtgtattgtaaactttttattttcagtatttttcctaatttcggcaagtagtgctttgtggaatactgtttgagaccagcgcattaggctagaccatgacaggtccaggttaccaaagagaacagtaaacacacaaatgtgtgaatccatgagtattagatacagaatgatctgtaaggtttccagggtgtggagatattggttgggaaagagagtattagtccaaatctgagaagtcaaatacaaaggccaagaatttaaatggtttatcaagttgaaggataaagcaaggtttggtatcagatggttaggcataaggttacgggtgtatatcagaagaggagttctcaattccaagaatgtggtccatccattg

SEQ ID NO: 54464 - DNA, 1065 bp, Homo sapiens
tacaaaaaattagctgggcatggtggcacgcacttgtagtccctgctactcaggaggctgaggtgggaggatcacctgagcccaggagcttgaggctacagtgagccgagatcgtgccactgtattccaacctgggtgacagagtgagtccctgtcacacacacacacaaaagttaaaacaggaacatgagggcaaaagcctgggggagaaaaattgtgagaaaagttgtaggttaaggggaagttagtaacttagcaagatactagacatggggcttactagtaactaaggatgaaggacaaatgtgataggttctaaagctctcatcaaacaaggcttaccagattaatggagaggatagcttttaggatgtatgacaaaaggttttttgcctaggtgatgagaatctaaaggaaaaaatctgttaacattaaataaaaacttgctattttaaatgtcatgagacaattttttaacaccattttaataaagctaaattttaaaatatattcaaagagaaatctttaagttgacttttatttcatggcagccatgtaatcatttgaaatgtcttctctggtatcaaagagaaactaatactttagtagaaataggaaagtgtgagcaacattattcttgagagtactaacaaagattttgaccataaatacaaataattaagaggtaatctgtaatcactgattgaaagtatatttgtacactttttgtcttacttcaggattttcttgtctgaagtgaagcctttagttccttttttcagtgttatttggcattttttcaggctttcttcttaaaaataatactttctattcaaatctttgcatttgtataaagaacttattgttcttcatggctaattacatgggaaaaattaaaaatatttaggttcataggcttaaagccaaggactagtgaggactttaaaatgttatcgtgataattaacattatttactgaggcatatgtgatgcagcttaccaggtcatctaatatgtcagggatatacagaaaatgtattaccctttttattgcaaaattataga

SEQ ID NO: 54465 - DNA, 1528 bp, Homo sapiens
aaagtgctgggattacaggtgtgagctaccataccgggcctgcattaggtatttatctttaatgttaattagaaaatgttgatgcttttgaaaaagttaactaagaaattagcctttaattttctctagagtctttgtttctaactcaggttaatttatcacccattttaaaaacactaaattttgtaagatatatctgccgtatcttacacacagacagatacacacacacttatgtacacatgtacctctgatatggtcttaatttcaagaattttgagcttcacatttctttcatttctttgtacgtggtagtttattatagcctgttatgcagctttatttgtctgtagaataactcctatctccccaaaatagcagataataaataataaaaaactatcagaatatggcttgtggcatgtatatgagctatagatagcaacataggaatgtagaaatctatagataaatagtatgattcccattttacagattttgaaactcaggtacattgagtctaaataaccaaggcacatatttgggattcaaactcaaatttaactgtctcacttcaaagatgtctctttctattatacacattactttactgcaatttttccaaattatatttacaaaattagataaggttcaggtctatctggttacccattcaggagggtttagttaccatagggttattgtttactcatctataatatgcagtctgtacctgagtggcatcatattgactctgctacccttgtttgtgggtgggatgggagtatagtaaactatacagaaattacaagtaaatagtagatatttgaagttgctcaaaattgccttttaaattttatttatttttaaatggaaaaatactatttgaaaggaaattattataatttgataacagaatgtcacattactcttttaatttaaaagtttgtaaatatctcaaaatttaggtagttattttttaccttttgtttttaaaaatacagtgcctttactttcccgaattctgccttccgatgcatgtaaaatatacaaacaaggtatcaatatcaggtaaggtgatttgatttttttctcagtaaaagaaagttgagatttagaggaagatttttttccctgtaatcataacttacatgtgttttatgacgttaaaatgctgtaacagagtcacaatattttatctcattcgagacataatagataaaaaaccaaagacatagaacctttttttatttttttattacttagagaacaaactcaaagtggaaaagacataaaatcttgactaaagcaaagatattattcttatttaactacagactatccagaaggcaaacagtgaggatcttgatgtaatattaagaagatttacagtggttaccttcctgatcctggatttattaaggaataagggacacataaggaagacccaattcttgcctttttctccatctctttcatgtctttccttcccctgtttactaatccgtgtatccgttcatctgttcat

SEQ ID NO: 54466 - DNA, 1025 bp, Homo sapiens
ttgcatcatttgaatgagtttggttatcttggcacagttaggtaaatcgttactgataattaaaaaactagtaaaagctagtgtgaatatggtataggttgatgttgaaatatctcttctcattattctttggggatcataccagttttattaaacttacttactaacttattctatctatataggtcccatgttctctgacttctatgtctcagcttcttttactgttccaagaggccttcagtaatttaaacattgctctttgatttttggcctttcaaaatatattgtagatgtagatacacacatacacatacacacatacatgcacgtgcatatatgtgtacatgtattatctatctatatgtataataagccagtggtgtttttactgcatgatgaaaatttaaattagttatttttaaaatttaaactttagttacagctcttttgaggaagcttaagcagcaatccagggaaagtgttgaagaaaaacgacctcgattattaaaagccctgaaagaggtaagctatatttctttgttaattttgcaccttggaagtaattataagtgtagttttaagcatttttttcttaatacaacttaaattctcacttattaggggccaaaaaatggtaaaaatcatgcttaaattaagcaataattagtgtatgaatgtgatcttagtagaagcacctcagtttgaactaggaagataaagatttattactttcaataaattagataagagctctaaagaaaaaaaaaggaggtaagtcacagttaatggcaataattttcctttgcctttgaattagaagattctctatagctaaagccattgctactagaagtggcagttttttttgtttgtttgttttggagacagcgcctcactctgtcgcccagctaattttttgtatttttagtagagatggggtttcaccatattacccaggctggtatcaaactcctgagctcaagcaatccgcctgcctcagcctcctagagtgctgggattat

SEQ ID NO: 54467 - DNA, 1055 bp, Homo sapiens
tctcctgagtagctgggactacaggcacctgccacagtgcccaactaatttttgtatttttagtagagatggggtttcaccatgttggccaggctggtctcgaattcctgacctcaggtaatctacttgcctcggcctcccaaagtgctgggattacaggcgtgagccaccatgcccggctatgtctgtactttgaaattatcttaagcactgtgatttaagtttttgattttttggcttgtgttacattaacattttatgttttttgaaaaatcagagataatctaatattattaattactggcaaaaactttgtgacctatttttgtgtccatttcttctgatttctgataattttgctaacattcttgtaccacaaaacagacaatgcaaactacttgtcagagactgtttagaatcatttcactaattaataataaaatttcaagattatgttgcttttctgccttacagtggttacctggtaaacagtgatcagcccagaccagtatgagatagagatatggatacaactaaaaagcctttttttcccacaatttatccctcacccatggttcctagctttctctgatcgagacagctctggtttctttatgcactctgggatctagttgtcttttgtctctccagaagttgttcacagtttgtgcagacttatgtcatggtatacttgtgttatggtagttttgggaattctgtcggcctttgtcttatttttgtggcacatcaaaggtgttaatgtggaggaagagacagcagttcatattggtttgccatcttacattgaactagaagtcttcatttagccttcaattttaaatttctttttgagagaaggcttttctcaacttctagagtaggttaagttcttcttcttgtacattttcaaagtggtttagtcttttcctttgcaatatgttgcatacttctaattaatttttcagtatgtgttccctactctgtgtatcttgataatataagctttgtgagacttcaagtcatgcatatgttatcttattcacccctttatctct

SEQ ID NO: 54468 - DNA, 1057 bp, Homo sapiens
aagataatcacggtgaggagtgctagcccctctccacctctctccttccccgagcctagggtgtgcctccccaggcttctggaatcctaggccccctccagcagactcttctttttgcccatcatccgggccgttcggtaaatcatgatcgactcagtaatagcgtgccagtggtcaaggggttggttcttgtgggtgcaaaggaatgtatcctccttgcccacttcaaagtttgtcgtgagaagctgttttgtttgagacaggccttcgatttgctgattctggactgtcagaaattttaggttgcctcccacccaacatggttttctccctttgtttatggagctatatatctttatttctctctcttccccctaccttggcattttaaattttgaacgcataaattgccctcctcccttcattgctcacatacagatcccatcttgactgcaactggttgtgattttgcctgccaccaggttgtttcttttttgtctgctttcagtaaacttagaatgttagatttctgaaagccacacagtagaaatttgttggtatttgatacgtagaacagttaaagtgacttctcaacagccgatttttgtttgagtagagatttgattttttgcttgttttaagtagataattgctaatagtaatgtctcatcttgatgactgtgactaaaaatagtattatgatttttatggtaattttatcttagtcaatattgaccatttctttttgccttgtcagctgaattttttgtttaattctaaaaaataatgtgactgagttgacttttaagcaacagtaaatttattattgaagactaatgtgaacactgacattttaacatttaatagccgttttaaactgggtagttggcaaatattgttgatcgctctgctattaatatgaaaattgtatacattcagttagaacacactgaaccaactttgtgctcaaaatgatatacgtatcaatgaaatatttgcctgtgaaataagctcacttaattccattggatcgtaggctttttaggacaaaaattca

SEQ ID NO: 54469 - DNA, 1571 bp, Homo sapiens
catggcagcctcctcaggacgggtactcaggaatttcgcccgcagggactaacaccacttggacccagggactccagcttcactccgctttgtgcactgggtggggcggtcgcggtgacgtttcaggcaacgcctctgctgtcagccaataaggagcgggagacgcgtcgggcctgcgctcaatgggccgcgctggtcccgccccactgtgatcgtgagactgcagacccgctaataaaatccaccccaacaatcgctgtgtgccgctttagtgcgctcgccgtcggctctacctgcgtgctttagctccttctcgcctgatccttctgtctctcccaaccccggacacccggcttcgactggttatatcttcggtgttcttttcctctcttcttctttcgcggttcagcatgcaggaaaaagacgcctcctcacaaggtttcctgccacacttccaacatttcgccacgcaggcgatccatgtgggccaggatccagagcaatggacctccagggctgtagtgccccccatctcactgtccaccacgttcaagcaaggggcgcctggccagcactcggtgagctgggtctgtctggggctgtccacagttgggcggtaaaagagatacggcttatgaatttgaaaggcatgtaagtaatttataatatgacttataaattaggaaggcaaccgaaagatgtttctacactgtaattcttgcagcacagctttgtatcggatggtccagtgatcgtatttcttttgataagcaggactggaaggagccgtttgtccagcttgccatttagatttggcctgaaattcaggtgattttgacaaatttgcaattaaaaatcgaaggtcataacttttttgagttacctttagcagcataaattttaaagatgtagtacggagtcagcttaaaaaatattaagggtctgataacttgactagaattaagattgtttccagtagctgtatgaatagttattgagtacctactatatgccaaatacgtgctcgtatatatcatgtgtattacatgtattgtctcatctaatcctaacaacaaccctagtctgaaccgaattctcattttttcccaataaagaagctgagatttagggagttaagtaactagccttagactagtaagtattggagatggaattcaaactttagaaacttgaggttgctttaggaaccaactcctaggcactcagctacactatgctatctctaataatgctagtaacaatttagcctattgcgtcatttaagcactgtggcttagtgattaagaacacaactcatgaccgggtgcagtggcttacgcctgtaatcccagcactttgggaggctgaggcgggtggatcacctgaggacaggagttcgagcccagcctggccaacatggtgaaaccccatctctactaaaaataaataaattagctgggcatggtggcgggtaatctcagctactcgggaagctgaggcaggagaatcgcttgaacccaggaggcagaggttgcagtgagccaagatctcaccattgtgctccagcctgg

SEQ ID NO: 54470 - DNA, 1052 bp, Homo sapiens
agatacttttataatgcaatataaaagtctcatggcaaacataggtataaaatcctgaaaattgttgattttaaagaactttttacattatttttcaattttatattacctagggtcagtctacataccatcaaaagtctagtttctcattaatgacagaatattcttttgttgttgttgttgttattgagtatcaatatcaattttttctttaagtttttatgtgtaaaaatcaaatctaggtgtatttataaaaaattattttaagtcaaatgatttaccttgtttcactgtaaaaatctggtagtttgatttatattgtctcattttatcgattaaaactttcagaactacataacaaaaagatcaaaaaagtacaaagaatagtaaccaattcttttccattacaaagtatattgaaatttattttgaacctttcattgacattgattcatttagtttagagttgagaactaggtagaaattgtttgaaaagatatgatgtttcaggaagcatgtcacttagtggagattggatgttttgaaaaacattatttgcttcatgctacttttggatctcaagtgtgttttatttgactcttgagcctttagagaacaaaccttattattctttactatatcagatagccaaactatttaaccaaactagaattgcttttagttgcattttccttggtgactgagagttccatatattttgtaagtgtttatacatagaaggaatgaatgtttcttaatgcaatgttcttttcattttatctgattcccttctgtctcaggtacaaacaggtacttcaggcaagtggcatctgaatttggattaaagatttcttttgttgattgttccaaaatcaaattactagaggcagcaattacaccagaaaccaaggtaactcagctcattttcagttttgcctgtttttccttcgatgttttgttttcatcatttctgtttactagaggatataatttaatgtgaataacaaattttattttatgccattggaaacatcaacaaaattaagatagac

SEQ ID NO: 54471 - DNA, 1022 bp, Homo sapiens
gtatacggtgtatttctgtgtcttcatttttataaacatttatggaataacttgttttgcaagcattgtgtggagaaatgtcaggtcccaccaaagtttaggcctattttctgtctttgtataggagtttacagttagaccaaaagtcaggcagtctcaccaagttaaaaaaaaaaaaaagatgtctaaataatgacttgaaataattcatgtaacgcagatttttgttagtctttccggaagatgcctgctagtaagtttggatgcacaagagggcacactcagcatgtgaaatgggtttgtttttcacagtaatgaaatgtgtattacgttaagactctcttgtttaaaaaattgtcttaaaataaatctctcctgatttatttagggatttttgtttaaagttgcttggcccccagacactctggtttaggctataaccccgatgccagaggatgagtggatttaggtcagggcttgtctgttctatcacccttcattctgtgtctcccaactctgctgctactagtgcagcattgcaatatgggaggaaggaagtgaagctaatgtgtattagcttagtctcccagcctcacaacacatgtaactctgtgaccttagaaaagttactcatcctccctaaatctcaatttcctcaattttaaaatgtggacaacactctacatagctcttaggtttgttgcgagaacatggggaaaaaaatccctaagctaatgccttcgttcatactaagtacccaataaacgttagcacctactatgaactattatcttttattagacatctctactacattccaagtgcttagaagtgctttatacatgttccttcaaattaatgtctgtgacaaacctttaagacaggtgttatatccaatttttattcattaaaaaaatgaattaatgcacacaaaccacctagtagagtatctgtctcatggtaagcacacagtagatgcatctattattatttcagataaggaaataggcactgaggatgag

SEQ ID NO: 54472 - DNA, 1571 bp, Homo sapiens
aaactaattatgacaggctcttggtccaagagacctcttataagtagcaatccagtaggttggtcatggagtacatgatttctggccaaacttcatttaggcaggtattaaaatatacacattggggaggctatgccttaccctactgcatgggggtacttgacacacactttcagtatttggattgagcatatcttaccaatggtataaacaggataaaaacaatcttgcttttcatttaaaatcatagctagaagagataagtttcgtaattttctctttttttgcctgtgaattataggggtatgcaaaatttgatatttggaccagaaaaatgttgagggtaattgcagtttatgagacagaaacatgcctccactgacacaatatagtgatcaaaaatttgctcatgtcttctttcagggcaatcatgactcatgcatcagttcttaagaatgacagagatgtccttggaattagtgacacactgattcgactttctgtgggcttagaggatgaggaagacctactggaagatctagatcaagctttgaaggcagcagtaagtcttattattgtgtgtgtgtgtgtgtgtgtgtgtgtgtctgctttatcttgggcatggggggtcactatatttacaaagtgtggtctcactgtgaactctaaagcttttctgttcctgtaatagaccaggtgtataaataaacgtatagggagctcagtcaaagtgcatatttaaaggatggtagtattcagaaaaaggacttcttgaggagttgaagctatggcctatatgtttaataacatatttttcttgtgcactgttattatagcaccctccaagtggaagtcacagctagtattccagagctgctattagaagctgcttcctgtgaagatcaaatcttcctgagtaattaaatggaccaacaatgagcctttgcaaaattttcaagcggaaattttaaggcacctcattatctttcataactgtaattttcttagggatcatctctgttaaaaagttttctgtatgtcatgttataattacaggtcaattctgttaatatctttttgttaattttgctctatgtttgcctctgaaggaggtgagatttgtgctactttgggagattatgttcttttttcatgtctaagatttattttgatcatgtttataatataatggtaattcatttttgatgttttgtgaagaatttaaatttaaacgaatgttcttaaatcaagtgtgatttttttgcatatcattgaaaagaacattaaaagcaatggtttacacttagttaccataagccgaaaatcaaatacttgaaaagtttactgtgaaattctactgatttaagactatacttaatatttttaaaaaaataaatcagctgggcgcggtggctcacgcatgtaatgccagcacttttggaggataaggcgggcggatcacgaggtcaggagattgagaccatcctggctagcgcagtgaaacccccatctctactaaaaatgcaaaaaaaattagacggacgtggtggcgggtgcctgtagtcccagct

SEQ ID NO: 54473 - DNA, 1084 bp, Homo sapiens
tggcaggtcaggtttggaaaacaggcaagacccaggatgttcttgatgatgaacttcaggctgcacagccaaagtcctgctggaaaaatgtttgctgcatgcctctgtgatgaatccaatgtctaaaaacccccttcttctttgtgttatgcttgtaaaattcaaacttctgttgccagcctgactgctgtagcttgggttatttacccctatgctataacaaaggatgaaggctcaggcacctccagcacttggtttatgacatatgtgctgggatttctctcccacccagaatacagagaaacggttatccagaattgggatattaataataaaaggtgggggttcatttttaccatctatccaatttattcgtagaaacattataatagtaacatacttttgaagccttgtgcacatgtgcgtgtgtgcacgtttgtgtgtgtgtgtgtgtgtgtgtgtgtgtgtgtgtgtgttttcctgccacctatctgttgggaaattggggtagcagtgagactggtggagcgcaaactgaagagagccacaaaaaataaaaggacttctatttactgaatgcctgttatgtgcaggtacatacttgacaattaccctttccatatattacctaatttaatcttcacaacaatttttgagtttgttacctttcattcccatgtttcagttgcaaataataagacagaaaagattttataactttctctaatcatattcctagtaattagtagatcttaggcttttgtacactataatgctatgtgtcacgtttttctctcttattagtttataaaaatattttcaaatcacttcgttgaaaatattgtacaaaaaagaacaaattgattgagaatagtaaaaaaaaaatcactgaaattgtctgggtcagataattatggtgatggagatttcctgtagaatagctattgattcatcaactgattgacctttgtaggagcttgagtatctagggagcatattctgaaaaatcccgtagaaggtgacaggagttttcacttgtctgacagtaacttgttaaatgattccattcaccacgataccggca

SEQ ID NO: 54474 - DNA, 4982 bp, Homo sapiens
gagattaagggtgcagtgagccatgcttatgctactgcaccacagcctggggaacagagcaagatcctgtctcaaaaaaaaaaaaaaaaatagaagtagagagcaaattattttttattgttaccattatttagtaacaatatttaagcgctttataggtaaaaatccttaagttctggtattccctttgggaaccattataattaaggtttacagaacacccatcatattcttcccaaacattttttcattgcttgtaactttccaaagaattctccttttgggctttctggttttattttaagcccaaaggtgaattttttgggaagtttgagctaaattccttcaaccaaaatatacaagtgaagaaaaaaaatttgtatttaaacatttgcacatttacttctacctgaagcatgtgaatgtcaacacttcatatttcataagtagtgggttttcataaaaatagtattgtaaatataaatcatcttaaagttagtttttatttcttcttgaatatttagcagttaagtacagttactagtcttttgttgctgtgccatatacctggtttttccataacagtttaatgagttgaataattccacatggaattatgtttattttcctcaggaagtggtatataagatacatattttaatcctcaaatggaaggatgtagttcctaaacgtaaagtcctgttaatgcagttatctgctgattttataatactataatatttgtgtatactttgaaaagccttaaaaaaagtttaaattctattttgatatagtaagcagggttttaattacacatgatagaattttaaagagacaaaattaaaatgtttaagtagaatgttttcatggttgatccagaagtcttctgttgaataagcagtaagtattcttccttataaaattttcatagttgttataaatcctgtttatttttggagctatctgataactaaataatcttccttatttcttcttttaatgaaatgtttgatttgtttctcaatcaatgaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaaggtttgggtttctgtagaaataagaatgggtgttcttaagtgtgtttaatagataaagtaaactttcctagtcaagggttagatttttattatctcttgtgttccgactttctacttttcaactttgaacttcaaaaaaacattactttgcttatcctttgtactttgatcaggttgtttagaattgtagatcaaaccattctttgatcattttattgtttaaatttttagttccatttataatttttatagccaactctcggttatttctgtcttttgagattgcaattcagaagctgtatgtcgaagtaatttatgagttgacttttatacttaggcttctttaaatactaatagtcaagaattctagagcatctaataaaaaattaactttcagatcattgggaatctgtcctcatttaaatatgtgtaaatgcatttccacagcaaattgcttcatgccctttgtctataaggaaattattccttgtagctaatacatttttcattttgcagtccaaatcttttttgagaaaggcctatattaggttactttatctgtactgacacttttaatattggaagaatgcaactgtcatctgtcagccttttctgcaacaggctaattactcagtttcattaattttctctttgttcccaattatatagtcattttaatggctttatttgtagtctttgcaaatttttcatattttattagcttgtgaaaataaagattatgtaaagtctattaattgctgggttcagtggtaggattatctcatgattcctacttgtacagaatgattagttttgcttcttcacattttggagtttagatgttaagatttcacacagtcttgtttctctgcatttgtttctttgtaaaaaaaattactctgtttttgagtggaattcattctgttgctttcttaccacttctgcaaatttttatcttagccacatataatccccctagtttgttgtcatctaaacttaatgaacatgttctctattccataagccaggtgattggtgaaaacactaaacaaccctgagcccagggccaacccctacggaacaccactactttacccaggttgatattgacttattcatactagctgcatgaatataaccctatagcaaattgtacaatcatcttgtgtgacctagatttccaaaacttatttatgagtatattttctcatacacagaagccttgctgtatcttttttacataatagacttcttacactttctacaccgtgtcacagggattggtttagtcacacttccattaccaagtttatatgcttttgttgtacattttctgtaattttacacatttttgcaaggcttttctttgatatcttaaataattgagaggtggctatattttgaaatgagattcttttgaaattgtagagaattttttattgtatttatatgataactgggctcatatccaaagtctaaacatcagataattttatgtgtgtaagttcctatctcaatttttaatttttttgctagcatcatggtactgaattttgtatactttcacagtcttaagaatgaatgctgagatttagctctagcttactagaatgcctactctctccattatgtcttacagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctgatctaatgttcatttttaaactaattacagttttctgttacctttgatttgttaattttttacactctttatattcacctaccttttatatatgagtgcttggtattttaaattccaaagccattatcactgcaacctcagaatttttaatttaacctttttttcgttttaaatagagagctcctaaattagttgcacacttcttgccagaacattacatccctcattccatgtggtaaaataccatatcgtagtgtgcttcctgaattactcttaaactgtcaccttatataaagcactcaactg

SEQ ID NO: 54475 - DNA, 2192 bp, Homo sapiens
aagcagtgatttaaatttaacagtgtcctcttgaaaaaccttaatcacagttaagtgatggcatgggcaatgaattttaatcatatttaggaataaaatactagatattagtgtataacaattagatatatgttaattgagcactacaaagcctgaaagcttaacaaagtggggctataactagtaattttttggtaaaaatatagtgatctttttctacagggtattattataagggacaaattatagttgtaaattagattaatgaattttgtgagttttaaaatttgtacgaaccatgtctcccttgtgtcatattttccaataatataattacctaacaatgacagaattatacattttccctttaattctctaagcattgagtaaacagaaaaatatagggatgaaatacacacatgccaacattcaaaactttgtactaactagaaacaaaaatagaaggggatttataaaggaaaatgatggagacattttagagaaattaagtataaatcgcaacattctgttttcttggatgtattctgggtagcttctagttacttgtaaacaaagtattcattgtttttgtaataaagtgataatgttttgttttatagttgagtggctttagggtaatttaatcacctggaaagtgatatttttttaattaccttttgttactaaatcttatctaatttaaaatactatgttttgaaagtatatatcttgtatagttatctttttatatgaaaatgaactctaatacatatctttctttcagtgttcatatcacaaagctcaattaaatggtcctggaaaaaaaaaatcgttccatgttgttccaggtcccgttcaagaagttcttccagttcgcagtcaagatctcgttccagttccagagaacgttcgagatctcgtgggtcgaaatcaaggtgaatgaggtagcatctctctgtaaagcagagagaaaaatatttaaaggctgcagaaggtgttgctgctttttttccccttattttgcttctacttgtcgattttattttagcattagaaaactaatgcacttgcctcagcttaattttctcaccatgaaatgtttccattgccagcagtgtgccaagacattcccatgattgaaatcaggtggctattttgcaatatgcagcgtttattattttggcactaagatgttatgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtctcaaaaaaaaaaaaaattaatagtagttcaaataaaattacatatgtaaataaaaagaaaaattttcttcattattaaaaggaagaaaaataaccctgcctcaaaacaggtcctgttttgcacggcagttgtttcaatattttcagaaacaaatttgccatttatatcagataaagttactagagtactgtatatacattttcctttctaattttacacacgctattatttatagagcacaaaacactcaaaactaaatcaggaagtatagtcggttagttgagataggatgtggtcttaagtagtaaacagtgttctaaagtttcaggttgcatgtagtcacatctgtagagggaaacataatttgaaagatgctcttgcaggaaatttttctttgtttagtcaaaatatgctctctttgtttttaagttaatttattatgacctaaaggcatctaaaaaataaataagaaaatgaaattccatatttgtggaaattcatattgaagtctaactgtggctgttttggtaaaagtatttgctgctttgaatcaaatttagcattaaagggctgccacagtataatcatgttaaggagaaaagaatgttgtgcacacttgcattataagccaataagaaatagataacaaggccaggctcagtggctcacgcctgtaatcccaataccttgggaggccaaggtgggcgggctgcttgagcccaggagttcaagaccagcctgggcaatatagtgagacctcgtctactaaaaataaaaattaaaacaaccagccag

SEQ ID NO: 54476 - DNA, 1103 bp, Homo sapiens
cctgatcataagaggtcttggaatgcaactaaagaaataataagccagttttgaagtttttaagaaaaaagtgagatgtgtttatctgtcctgtgtttcagagtgatgactgtcagtatattgagatactagagaggcagaatggatcttcagatttgaggagaccagctaagaggttactataatatgctagagaataaggaacagagtgtctaagactaaaaatggtgatttcaaggacttttaaggaggtggacttgaaaattcttgggtgatgcataagtgtgacagaaaaagtgtgtatggcctccaggtttatgtctgtgcaatacctgagacaaagttgtcaagtctctatttgagatgagtttagtaggtgaattttagaattcagaattaatttgctgagatacctgtgatatatgcatatggaggtgctcagtacacctaactgttttatctttcctggtaggtaacactaatatctaaatgtctaattataattgaatttttgttaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtaaacgggtacaggtcaagggtaacaccagtcaaaatgtcagtatctaacttttttatttataaattttgtttttcttgacgaaataaactttcctttttattttaaaaatttaattcaaatcaacttttaaaataatttttcagcttagtaccatacagttgttgtccagtatttttagaaaagtaaagtcttagcatgaaacttccttaacctattttagcctcatgcttttgactaaaatagacttaaaaactgaattaaatttttatatacacttatatttaattaatctaaagagatagcttacatatagaaattaagtaaaggggagatctgtattttcattcaagatgttaaaggctagcacagaaattttctaggcattaaatcattgcttattacataatgtttt

SEQ ID NO: 54477 - DNA, 1675 bp, Homo sapiens
atcaacacatacctctttaattttcaatgggagactttttcaaaatatgtcaactcacttttcctaaaactagctcattttctttaattccagtctctcctttaagcttatgtcagagacctgccaattgaattgtatacattggttgtgacatgagagaatagtggtttgctaatctcaactactttttaatagaatcatttaatttcaaaatttactggctacttcagagaacctgtgtgacttttacctatgtgttaaaaccaattaaaccagggccaaaggatggcctttattgtgttattgtgtttgtctgtgtaattaggaattttccaagctctaataaggcctgctacattttaaagtagcaaaatttcagaatatcagaagatttcagactatttgcagttggtaaacagtggaatttaatgcttggttgttactgagcccacccttcccagaagaattacgattaactgtagaggaaagtcctttaaaacttggttatagcagaagtttgagatgttttccaccaatactttctatgaattaaataagtcatgtagggcaatttggaattgaaaagagctagaagtacagccatatgacgttacaactaagttctctgtattttctgtggtgatttctaatatgctttctaaagactagtaatttattagatgggtaggcagccattgttgattagatgttttttgttgtctggagatttgggcatgatgtgtttattatttaaatcaattgtcatagggtaacaatttgtgccctcttttttaaggatatggtggtggttttaatgaaagagaaaatgttgaatatatagaaagagaagaatctgatggtgaatatgatgaggtaagctatattttggtgttcaggttgaatataaattagaaaaacagaaaaaattcttaaatgcaaaggaaaacaaacttttttttaagtgcaatttgagtcttcagcaactgatcattttcaggaaatcataaatatctaaaataattttttagaaaatgtattaagtttaatgcattatcagctgacaagcattttgaaattgtttttctctagtttggacgtaaaaagaaaaaatacagagggaaagcagttggtcctgcatctatattaaaggaagttgaagataaagaatcagagggagaagaagaggatgaggatgaagatctttctaaatataagttagatgaggtgaacaattttcttgtcctatttcccttttgtcttattggagttataccataacatgaatgcttttgacagcctcagacacttggtgaaaatatattctgtgttttcatttgttctcacaaaggttttggatttccactctgccaagtactatttgtacttggaacactactgttctggagatacagtggtgaccgaaacagaaccagttttctcttacacagttctagaggaggaaatatataaataggtaattttgatagcagtaacgttatgaagacacatgatgtgataacagtttaaaagcaactttggttttgccgatggataatgtctaaggaggtgaagtttgagctgaaacttgaatgataggaaggagccagcaataagagccgaggtgagagcacatttaggcagagaacagcaaatacgggttccctaaataggagat

SEQ ID NO: 54478 - DNA, 1100 bp, Homo sapiens
aaatgtttacctaatagcatatagtttttccattatcaccaattagcccaaccacattatctgtttacttaaaatctgattttgtctttcaactgcttatatgtcacatgatcaaaggattccttctatatctagtcaccctgtcagacttaggcttggtgaactgcttccctgttttctttgcctctctaactttaggccgttttcattgtctgtttagtttctagggatcagagggccactgttcaatcttttcgacctagctcttccagacttcaacagaaattctacttttatccccccccaccccttttttaaaacttacattctcatatgtgagaacattataacataatgtccttgatccccccttccccagcccaaccgccactttcaaccctcaaatcctgccttattcttaggaagtgattttgcctttccaccgattgggtaagttaaggccttctgacaaggatctcgtttttttcttccctcacctaaggtatgcaccgtacctccttcaccgcccccaccaacccccgtttgattgattgtttattctgtctcctttgcaggtttctcttcttttggccactgatgttgggattcttcgcagccatccctggccctctttctttcctctattttcatggtgttttcttctaagcccaaagtttaagtaactttgccatgataacccaagtttatgtctccagctcagacttctttgacccatatatccagctgcctattcaacattgccatgcaaatgtcaaactcattatattcaaactgaatttgtgattttacccctgggacctgaccctcttccaatgatctctttctcatgattagtaccactcaccatacatttattacataagctggaaatctagatgtccttcttagcctaaatagccctttcttgatatctcccataccccaaaaattcttttccattaccaccctaggcaaagaattactatgttttgtggaaaaatagccacctagctggtttctacatgtttttatttccaaatttaaaatccttttttaaaaaacccattttgattgcttttaggataaagtctaaaatcttt

SEQ ID NO: 54479 - DNA, 1049 bp, Homo sapiens
ttagtggagctgttaatttaaagttatattttttcataagacatcagaatttctatacaggttcagtatcacttacctgaaatgtttgtgggttcagcatccctaatctgaaaatctgaaatgctcctgtgagcgtttctgttgagtgtcatgtcctctctcaaaaagttttagattttggaacgtttttggattttggatttgtggattagtgatactcgacctgtggttataatttgtcatttacttctcaaaatgacagaggcacttttcatactatataaattttgcttctctgcttaaatggttcagtccgttgttggaacccacatttactcttcaggccactgtacattttctttgtttacattaccacttaataaacatttctttgacagtggtttcatcctagtttttattttaaaattgtaaaatatctaaaaatttgatattcatctatattatagcctactaatttagtatttttcacttctaaagttgcagcaatgtgaattgggccagaagatcagagtgtaatatgtgtaatactccaaagtatgctaaattagaagaaagaacaggtatgataaaaccacattgtaactaaatgattttttttaaagcactaaatattgaaacgataattgtatcaccttcgagtaagagccacagtaagtgaggattctgtttattctgccctgaatgtttgttactgggatttttttccccccatacacacatacaaatcttttgtttcacaatttataaaataacagtgttagggacctttatcctaacaaggagggacataagaatactttcagaaatattctcctcctctccctttcactggtttgcatgtttgttattagtaatgatataatgataccatttttaaattcttttgatagcctgctgtgacttaaagggcaaagccacaccatttaaagtgttcttctaaagctttggcagtaattctgaaacttaagctatgtgctagattatctgaaaaactttttcaaatatcgattgcaaaatgcagaactgtt

SEQ ID NO: 54480 - DNA, 2214 bp, Homo sapiens
aggataaattttcagagtatattttccatgcttaatggagttaaaaggaatatttttaggggaaaaacttaacctaaatattatttagagtgtttcactttagtgtcatcccatacttcacatctgtattgtattctagtataatgccttaaaaatcagctttttaaagtttaagcattccatgttatccagagcatttaacatacttttaccaatatacacgtacacttctaaggtcatgtgagtgaaccagtaattctttaggtttgagtttgttgagtataagcataaagtcttactgtactacatgtgttgagattattggttttggtggttgtgtcatttttttcagcgaagtctcagaggtttgagaaatgccctgtaaaactcagttttcttacaattattgaatctttttgtatttttagtcagtacaacctatcatatttggttccttagcatcctacctactgcatgtaaaaagataatttcattaagatccatgaagccctccttgatttataagtttttttcctcattggtccaccgctagggtttaaaactccctggtagcttgtaagtaattagtgaagtggagttaactctcactttcaactttgtaaagggattataactaatgatatgtgctaatgtgaggacttgaggcagagatcctaagtaacttaatcaagatcacatgactggtaaatggaggattgggatatcttattctgaatttgtggctccaatcaagtatttttcccccagtaaattgtgtggagttttttgttggtaacattgacattaacatgactaagatggattagaagttatgaattccagatatgtagtgaggacaagttaaaatgtaaaattttacaaatttaaatttttataaatgctttttaatctgtttttagatgtggaaatgtaaactttgctagaagaaccagctgtaatcgatgtggtcggggtaagtatttaaagaagattctatttatactgtatatgtatcatttatttatttctccaggttcatattgcatgatttttctgttttcagagaaaacaactgaggccaagatgatgaaagctgggggcactgaaataggaaagacacttgcagaaaagagccgaggcctatttagtgctaatgactggcaatgtaaaacgtatgttttttaaattattgtctgctctttcttccaaaataatagatctggccactacttgtttatattacagctcttattagtgacattgacaagccagggtaaccttttaaatccaaggtattgttattcagtctcatctttaagtatagtataaagaagttttaaattattctttgcattttttaatggtaatagttgtcactatgatggattatgtataccagtaaacaaatgcttatggtaagctcaaaaccaatcggggggtggtggtacttaaaagtactaaggcctattacttcctttattgaaaaatcccaatttttagactgtatagttagtgtgaaatacaccacaaaactcattttgcctgtttacaaaataatgttagattcataagttgtgtgccgtaagtaattaagtctaattataggtaggtttcttaatgatttttattttcaggcttagatttaattcttcattgatttttccaacttccatcttttctctatgcagatgaatcctatgtgtatgaaagaggtctaaatcaaaaaagtattaaataaatttctctttttgtttgtttgtattttttgtttttgagatgaggtcccactcagtcacccaggctggagtgcagtggggcgatctcagttcactgtaacctctacctcccaggctcaagcaatcctctcacttcagcctccttagtaactgggaccacaggcccatgccaccatgcctggctcatttttttatatttttggtagagacagggttttaccatgttgcccaggatggcctcgaacacctgagctcaagcattctgcctgccttggcctcccaaagtgctgggattacaggcgaggcatgggccactattcctgaccctagagtcttaaataaatttctgatcctcaggattataaatttgtattggaaaagtttccagctacagatttggtcactggatttggtatgctttggaattcagtgcttgaactgagacctcaaaaaaataaattaatattatttatagggt

SEQ ID NO: 54481 - DNA, 1059 bp, Homo sapiens
cccatgtgtatgaaataacagaatttttatgccttattaaaataatttctctaaacacttgaagagcccgagccgcctcttaccctaaacgaaccccacgcccctgaattgatcagtcacttccgcctccacctttccagctccacctaaggaagcggaagtactttactcttgggtcctcccacctgtagggggctctccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaagtgagttcaagaagggtcctgaattgggacggagtttgttagtggaagctttccgaggtccgtccggcattttccttttttatgattttctgtgccttaagacgggttgaggcggcgaaccgccagttccctggcgggaagaaggctcccaatctcctcacgagagaggtctttccgggagcctttgttctagatatgtcttcagcgtttcctcgacattacctccgcaaggtagcctctctttttagagtgcgagatggcctacctttttgcccccacccccctcccccgccccggccaggttttagcgataggaaacctctccagtcaggccagcttggtgttggatctcccccacgtgacttttctctgcagaactttactcttgttcacggaaaatattgctttctcgcactcgtccttttgcctcttatagttcaccttgttttgtatttttactcaaacttttcctccatactattttccccttttccggaagctc

SEQ ID NO: 54482 - DNA, 1050 bp, Homo sapiens
ctttcccttagtgtaacatcgaacctacaatagccatacccatattaagcatacctacagtgtttccaaaccagaggcaatgtcatcatgtaattttgtatgtgggaggggaagctccccagcacaagggaattttctgcaaaacccttatcctaataagaattctgcctctggaggtttcttaaactacgcttatccaggagtactttccttgccagtcttcacagtaactgaaaattgctttcaagatgatattaggaagccaatctaaatggtcaccctttatcgactattcattgattactcttctagggtccctttaaggaggtaacaaagcagaagccgaggtgctatgtttattcagttattagtgtctagcacaatgatatgtgaaatcaggcatttattaactagtgttgtttccatagtaataactccaacgtcgagtaggttagtacacttacgcatttgcaaaataaacttgaacacatagagatgaatttaaatgaatatatacccacaagtctgctatttaaagcctccagacctcacgcgtacatggctgacccctatgctggaaatcaatgcttaagcaggactttgcagtgatataaaatgcctagcaattggcaacacgagatgctttgcttttctcaatagtgagaagagttaatgtgcagggtactgttgttgagcatattattttctgttcagaatactgaaaataagtatgtgttaagagtttgtgctcactttagaaatagaagccctgtgaaacagatgataatgacgtggtcttgatctgaacagagccttacgtttcagctgtttacttgtcctcttccctaggaggaattagaatttcccagaatctcaacagcctgctttctgcctttgtttagacttgctatgtgttgcaagactaatgggtaatttctgtagttgtgattaagaaaaaggaacagagatcagaggggtcaccaatgcttagatggcttgttagagttttaaactctaatgaataacttgtggtagggctaaataaagccc

SEQ ID NO: 54483 - DNA, 1041 bp, Homo sapiens
gactatattatatgaacaaatgttggtatctgataaatagcactaatatcaagtgtttatatttctttctgctttcaaagggtaaactttttgagaggattactgctgtcctgaatatttagtatattgagctgttattcttaaactgtatcataaagttttatttacctaacagtcaacaaatatcagtgagtactatgcatactatgtgcaaagcactctgaaagtgcttgcattattcaaaatcagcaagtgtgtggttcctctaaaaataactccacagtagaacataatcaaagatatctcctagaactgaaaaaagcaaaactgaaaagcgtgatgcaaacctgactttttacataggttggtttccgacttgagtttgagggtggaaaaaagaacaccttaatatagattgtcaaggtagcaaagttatataaagtttagagctgtataaatgtgtaaattgtgtgagtacagctagtaggaaagccagtagaaaaaataactaaagagagaaattgtttgaggggaaaaaatagtcctttccagcagacttcagaatacttcatttataataaacatgtgaacagatagtagcctggggaagttattgaaataagcccctggataagcatctctctagtactggaaataacacaagaggcttctggtcccagtgaagatcctttcaatgttaataataattacttcttataaatgttgttccaggcttgctgttatgtaatttaatatttttcctatttaatccttaccgtagttgacatcattttcatttgaaatacacagaaattgaagcatgtatttaagttgcattctcaagatctcacacacctattatatttattcaacaactatgtattgagtacttatcatatgtcagacattgtctcacagtcttgagatacatgaataaataaagcagaccctggcttcacagagcttccactttagcaaaagacaggccataaacagttagcattaaaagcaatagaaaagaagacaaggtaaatgatatat

SEQ ID NO: 54484 - DNA, 1034 bp, Homo sapiens
ttatggctgcatagtattccatggtgtatatatgccacattttctttatccagtctatcattgatgggcatttgggttggttccaagtctttgctattgtgaatagtgccacaataaacatacgtgtgcatgtgtctttagagtagaatgatttataatcctttgggtatatacccagtaatgagattgctgggtcaaatggttatttctggttctagatccttaaggaattaccacactgtcttccacaatggttgaactaatttacagtcccaccaacagtataaaagtgctcctatttttccacatcctctccagcatttgttgtttcctgactttttaatgattgccattctaactggcatgaaatggtatctcgttgtggtttttatttacatttttaaaaagtctttaatgtttttcttggtcaaattgtcttcagtttgaccattaggagtcacaccaaatcggtctcctgtgtccttatgacatgaacccatcattttgtttacttctatgctttctggcataagaaaatacaacaggctcatattttctgccttacttctggaatcaaccatttcatttaactttgattgattttataccatacaattggagttagaatcattacattttgctttaaaaatgtaactttacttaactgctttatagtaaaattatcaaagactcagaagtctaggctacttcctgtgatattcttctaaaccacaataagaccttaaataacttcagggtgagggatagaaaaaatattttgtgtggttttatctaacaagaagcctggaacggagcctgtaatctgtgtgtatgcaaagagcaccagaactagtaagaaaaatatttatctcaaggaaaataaagagggtagttgtcctatggctagagatacaagtaggctcatagatctttacatgtgatcctactgcttctgctcatctatgactggttctttatctgtttcaaatttttcaaggttttttcaaaattcctagtgtgaagtgtatgatttc

SEQ ID NO: 54485 - DNA, 1070 bp, Homo sapiens
aaagagatacactttagcatcatgacataaagaaaagacttcttaaatgtcaatagatcagttcacttcattcaatttttacccttaattcttgttcactcaaagagaacaaacacttttcatatttaaacaagatgatagttgttgctcagtctcatataattttcagacagcacttaactgatggggttagcatggcctgcatctctcccaccactataaaggctgaaataaaaggcttttttatcttcaatgctagggctcacaaaaaaaagactctagagaggccttattctctcttaaacacacctttgataatgcagctcttgcaatttgagaaaaactcatcaccaataaaatcagtttagatagctcacttgggctattgataacttattcttcaaacttgttccatcttacttggaatagcattagcagcaactgaggagacacaggttggaaagaaatttattctggcagagagcgaaattaggtattgaattgtaccttccaagggtgctgttattttctttcttttacttttttttttttgttttgcgctttagtctctttgttggggttccttttttttttttttttgacttctacttttctactattttccttagaatgttgcccattataatttttagaaaggaaaatattcttttaaaaattttcataatgacaagacagtaaaagtatgcaagctggtgtgttctccaaattgcatatatattttttggaaaagaacaacttttatatcttttctgttacaaaaaataaaagtaggtacaacaaatgaaaatcttttagattcggtttttacgaaatctttaaagtggtcatctaaaaaatcattgttgagatacactcgttgaccatttttaagatacctagattttcttcaagcagagaatttatctgaaaaataagaaatagcatcttcaattatttataatcttttgaaatccaaggacaagcaggcactttctagttttttgtttgttttgattttgtttttgttttgttttgttttgttttttttgagatggagtcttgctctatcg

SEQ ID NO: 54486 - DNA, 1049 bp, Homo sapiens
aatggcctacgaactaggaaacaaacccccaaccaaacaacaaatctgttggtgcctttatgttggacttctcaggctccagaactgtgagaaataagtgtttttataagctacccagtttatggtgtttgaggttttgtattattgactaagacaattagttttgatttaaaatatatgattctctggtttaagaatcctatcaggttcctgctaatctataaatgaacttcaaatgtagtagggtactccactattttaagaaagtaaattattaaattacacttgctttgtatgatttgtaattctgggatatacctctaataggcctctagtaaacctatatggtgataggaacttttctctactttaacctttagaatttgtgaacatatttttaaaaattcttgaaagataatatgttaaataataaataaaattccgataattaaggcagacatttttcactttttaattaaactcaagaatgtattttttatttgaaaaatcagcatagtattgaaaatgttttctaactatcctcaataatacaaaatggaattaacgcaaaatattttaaccctggtttagaatcctagcacacacagtcacttgactcttaacagctctatctgcctaacagaaatctctatagattattttatatatctaaactaaaattttactgtaaactacaggaaaaatgaattatatcatcaaaaacagccaagacaactaaagtgatttgttcagacattcaagtatttcaataaaagagaccccaaatataaaggtgttaatgccctttattccagttattcctcttttacagaatggaaagtacctttacaataagaaatagcccacaactagtaggcaatactgaaatgataaaaataataatttacacatgattgagtcacaaaggaggaccaactattgtttatttccaatgatgaactagacattagtacaggcacttcaaaattgtttcgattcaaagttttcacatttggctttttgcatttttttcttcttcttcttttttt

SEQ ID NO: 54487 - DNA, 1178 bp, Homo sapiens
gctttctgttttctttcttttctccttcctcattctcttataccattttccccacctccttgtaactctttttccctccaatatctcttttcataccttttctattttctgttttttccctcctttttaaaatttcttctcatattttctcatttttatctccacgactctaatttctgttcctcacatttaatcccctttcctcctctcttttacccttttttctttttgtctattttttttattcctccttaatgtccctatcctgtgccctgtcttccctcttttgactcccatttctcatccctctccccataccgtttcccacccctgtggcacacacaggcatggtcactgttcccctccagtaccatttactcaccctcataaatcttatttccataaacatactaactcacatactctcacatcctcacatgcactggcacttccatgctgtaagaaccacttccacattcagattgtctctcactgtttttaaaaggcatactctccttctctgttccacattgtcactcacacatgtgtacacactgcctgtctcactcgctgctctcactctgtctctgcttctctctttttctctttctgtgtctttctatcccctttttattcctaccttcctccctccatcagtcttcacttttacttatttttctcattttcccttctttcctctgagcttgagctctgaggtggtttgtcattaataaacatccataccctgattttacccctaagcaacactgcagagtgggagtctgggaatattttatttcctatgaaaatataaatggatgatcagcaaagcttagatctaaacaaagctaaacgccctattccttcatttctttcccatcaccctcccttctccccctgccaccccacctcacatttccctgaaagatcttctttttctccactgggtggtagttggcttgtaagtctggcttgcacaacatcagtgtacatgacatgtctaaggtgaaagagagtgggaaatgtttctgtttgaaacatgcaacatatttaaatttaatgatgtgggtgtggtatatgacttacaccttttggaacatgcctatgagttcaaatttggaatactatcgtattttttaatatacactaatacatatgtttttaataatttctgtttt

SEQ ID NO: 54488 - DNA, 1049 bp, Homo sapiens
tttcctgacctacagtttttaaaattgtcttatatcaaatggcaacaagaaaatttctcttcgaatttttaatttggatttcattattctttcctgatttgcagtaacaagtggcatatattaaatatcgttaaatatattttgatttgtaacttatgggttataaaaccctggggttttgaaaattttataaataatactgcatttttaaatggttatttcgttttaattttataggtggctacagtcaacgacttccaaatgcaagtgctctgggaaaaattttcactgctttacctcttggtaaccccatttatcagatgctagaattaaaactagccatgtacattgatttccccttaaatatgaatcctggaattctggttacctgtgcagatgatattgaactttatagtattggagaatttgagtttattaggtttgacaaacctggctttactgctttagctcatccttctagtttgacgataggtaccacacatggagtatttgtcttagatccttttgatgatttaaaacatagagaccttgaatacaggtcttgccatcgtttccttcataagcccagcatagaaaagatgtatcagtttaatgctgtgtgtagacctggaaatttttgtcaacaggactttgctgggggtgacattgccgatcttaaattagactctgactatgtctacacagatagcctattttatatggatcataaatcagcaaaaatgttacttgctttttatgaaaaaataggcacactgagctgtgaaatagatgcctatggtgactttctgcaggctttgggacctggagcaactgtggagtacaccagaaacacatcaaatgtcattaaagaagagtcagagttggtagaaatgaggcagagaatatttcatcttcttaaaggaacatcactaaatgttgttgttcttaataactccaaattttatcacattggaacaaccgaagaatatttgttttactttacctcagataacagtttaaagtcagagctcggcttacagtccataact

SEQ ID NO: 54489 - DNA, 1031 bp, Homo sapiens
gagtgactcagttataacatccctaaagatgttaaatgctgttaagaacaagtcagcattcagcctgaatagctataagttgctgtccattgaagaaatgcttatctacaaagatgtagaagatatgataacttacagggaacaaatttttctagaaatcagtttaaaaagcagtttgatgtagagatattttaaatattgtacactttgcctttttgagtaacattccagagataggtattttttgtaggctgtttcactgaactcagttaatgaaaactgtattaacataattgttgtagcataatattaatagtgcaaaagtacatataagtcattttgatgaaaaatattccaagactaagttgagaaaagagatactattttggatgtgtatcagtatttttgtttttaataatgattgatttgtggagcattgttttttcacataattagttttaaaggtaattttctaagcatacctttggaatttttccatcttttttgaggcttttggtccagtgaagttctaagtattcactggcacttctctcctcaactgtaattctatttttaataataaaaatggcatactgtagggtcttcagagtagtgtaggaatactgtagaaatactttttcagaaacgaatccatagctgacaaattcactcagtgcccaatatattgtgattattttcgttgataaagaactagatacaaagacctctgaaattgatgataaaatttgtatctcattaattttatcaaaatgaaactaaaagtacatatgtattatacacttgaacatgtgtttgtatatctttaaaattttcctttatgttccattccataggaaaacacacatatgcacacaaaactcagttatctgtggggaaagtggtagtaataattgagattcatcaataatcatataatttcactatagacattacttgcattatctcctatcagtccttctaacaaaacttcaattaccagatgaactgactttagttttcatcttattttt

SEQ ID NO: 54490 - DNA, 1054 bp, Homo sapiens
ggacgtcacttgtcacatcttgtgacctccaggtaggttcctggatccctctacagcacctggagccaagaggtgcttcagtccttagcttacagacttccagggatggaacagtatcccctactagaacaattcaatctatttttggacagttctaatcttaggaaatgcagcattttgttttaattattgttgatgtctaaggttcaacttaactctgtgggaatgtcatctatatgaaataccttcaccatttgaagactgtgtcagttgtcgatattcagtcagtcacaattgaatctaaccactcgtcatctggaacagatctccccttcttacttacaaagcagtcaggagtaattctgtccaacactgtgctagaatccagctgtatgttctagcctattgatttccccttattatttatcttcatcaaaaaaataataaagtaaatctagaatgattttcttttcttaatgtatccatggtagctcctagtaatcagtgtttttctaagagtgcagaaaacttctgtttaaatcattcctttctgaagctttgcctataatgtacattaactcactagcctagtttgtaggctgtcttactcctgctttggggagttgagtctatatttgcatatattatcttctagcacttttcccattcttcttagctcttctgtcattagttttaaatgccctggttcatgtctttacctagggtgcattaattcattcacagacaatgtgaccatttgcaaacaggctagtttgttctgacaagccatggcctaaatggcatgcacactccaaaatacagtttacatattgtggatttgagtgtgaactggtctaattggcagatgttcactaggacatctatacccctaaagcatgaattaattagtaaaaatattttttaaaaatttgtttctgttcttaattttaataaattattcatatcctaatgcacctttataaaaacggtgactgatgatcatttttatatttatgtatacatcatggagctaatttgaattagcactaaaata

SEQ ID NO: 54491 - DNA, 1054 bp, Homo sapiens; identical to SEQ ID NO: 54490

SEQ ID NO: 54492 - DNA, 1054 bp, Homo sapiens; identical to SEQ ID NO: 54490

SEQ ID NO: 54493 - DNA, 1054 bp, Homo sapiens; identical to SEQ ID NO: 54490

SEQ ID NO: 54494 - DNA, 1052 bp, Homo sapiens
cgctctggtacttatagtagaaaaccactcttaccctatactcctggctcagatgtggctggggtgatagaagctgttggagataatgcatctgctttcaaggtattgcatttttaattatttctattttggctgaatttatttcataaaaatatttgaacatagctttcaactgcatcttatttaaggttttaaaaggccccattacacaatttctgccactcgggggactcctctagtcaaaaaaggaattaagaaattagattttatccagaggccttatttgtttactacattgtagtgaataggtgctgggtaatttctgtatcttcatgtccccacagaatgaactgtgattttttttatttaatagaaatatgtaaggaaagaaaacacacaaggaagttagactatttcctaactcttgatgatacataagctaacataatttttaatttctcttataaattttgcttcataatataaagagaaagttaattcttttgaaaaataagtaaaacatgaaaaaatgcaaggtcactatacagttttggagccctgactcagtgaaaatgttatgctcaggatatatatatatacacacacacacatatatatatatatatgcccaaagacatattcatagtaagctcatgtcctagcatctttcctcataattccttgacctgctcaactttggcagcaccttaccaaaattaggttgagacagagaagattactgtgcccctgtacaggaagactggcaaattcatacagctttccacccctcagcttgtggcaacctggcttctgcccccatcgctccactgaaaggattcttgctaatgtcactaatggcctctgtattgctgaagttaatgggcccttttatgtcattatctttcttgatttctctgtgacatttgacactcttagccacttaactttttctttaaactttttctgcagcttctgtgacatcattttcttctgttctcctctccccctcctttctgggcctccgttttcaggcctctctttttctctggata

SEQ ID NO: 54495 - DNA, 1057 bp, Homo sapiens
tacctgcaggttagtttgatttcacattttctagctcaatctgtctcactatcactattgtaaagtttatttctacgaagtaaagggtcttatatgccagcatctcaaagggtgagatgaaaaggatggtaaagaaaaaaatcagctaacaccatttaattacaggacttgggttctagctttgcttctgtgtgaccctgaccaagtctcttaacctcttgtgatgttttctcatccataaaatggatggcgattttatttttacttctgcataaaataatagtttaaataacttctctacctgttctgaaaacagttaagtcaatggaggtggaagacttatgctttttagaagaaatccggtattacaggattttaagtattatcctatttgccatcagtatgccacgttattttattctttgtgtaatctcctttgacaggcttcatcgttatgaagcatatgatgatcccgtggataggtgagttcaaaggcaatgagtgcaggttggagcctgatgaatcagaatgctaaaggctcagtgggagataagatcaacagaagcaaagtaggagatagtgtggtcaggccatgccccatcactttcaagcctgataggataatgtagtcagatagtactgggcaaagcagatgagtcttccaaatccagtaggatgagtcatcttcctttattcctttctcccaacttagccaatgccaaaatgtggggggggaaagatacagatcctatttcagagtaattttacttttattattacaacagtttttttatggtaatcatgagatgtgagtgaaagaaatatgtaggaagtaggtagatatcgaaaatggaaaaagcaagcatctcataggctatgtgtgtaggtgtgagagagagagagagagcacccagcttacagaagctaggggcagggtggggcattttcttcttgctctttgtgttctctgagtttaacacaccacttcatgtacagttaaggttcagaaaaatacgcattgcataacaaccaatatttagtattaatgttttgttta

SEQ ID NO: 54496 - DNA, 1025 bp, Homo sapiens
tttcaccgtgttggccaggatggtctcattctcctgacctcatgatccgcccgcctaggcctcccaaagtgctgggattacaggcgtgagccaccgcgcaagggccaaacttatttttatgatatctttaaaacccttcaatgactgctgatgtatttaaatcaaatttaaaaatcaataacagtgcttgtataatcttgcctgactcttcctcttgcttttgctttgtatcactctctccttccatcactgtacttcaaacacactgcccaccattcattcctcatacactttcagcttatcttttcagtattttaccagtttaaatataattttcagagatgctttgcctgtttgcccagtctaaactgggtgtccctttaattttcagtcatagaagcttatattttttctttgttgtacttatctcagtttctaaatacatgtcagtttttgtggtggtttactgtttcctcctgctctgaactgtaaagaccataaaggtagggactagatctcttttgttctctgctaaatcttctgctttatcaaagtgcctaatacatagtagaggctcataaatatttggtgaaaaggtgaataaacactcaagaatagcctaattattttaagatttgttatgaaattttctcaaaacaaaatttactaaatgtaatttgctttaatcttaaaaatcaaagtttttataatgtactttatagtggtaaaaaaatataaaagaagtattaagaaatacaagtatagactgggattaacatgttatatatactacaaatattggagaaaagacttcaaatatgttctacttcatgaaaaatatttaatgaatagtgactttttctgctgattccaaatttagttggcataacataataaaaagtgaaaaatacctggccttaatcaattttctcctcaattttactgttctcaggttaaactttgttctaaagataataaaatgtccaaagcgttaagtaaaaatggattccttgactatatgaaga

SEQ ID NO: 54497 - DNA, 1044 bp, Homo sapiens
tgggagagctgggataaggaggcatctcatattgaaatgtgcacctcacaagtcctcagcaacacttggtgatggaagatggtaaaattgttttgcagaccataaagtcttcaagttttgctaccctggatacaatctttaatgttggtactcagtatggtgggaggatacattcactgggtatatggaatatgttccttaaccactcttcccagtcctccttctaagctggagataggagaaagaattgacaactgtaaccaagacatacttatgtttcatcaaaccaaagtatgaattcatcactgcactgagcagtggactaaccaatatgtagatatttcttcattaatattttatattaatttatttgctggcttatatgcttaaaatgtctttgttttaaatgcaggtgatccaaggacatatgacccagatttcaaggggcctgttgccaacaggtaagcaattattttttggggaatatgcttttttaaacatacacagaaagctttgggggatgggggaggtactgttttccagtcagtggagaattgtgtctactgtgaggggaaaatgatatatttctgcctaaatgtcaccttatttacacagggaaagtacagagaataaatctttccatgagtcatgaatatcttctcccattagcaaatgaactgccttacattattaaactaagtgtttgtacttttcaaaaagagaagtgaaaaaaaatgctttatgagatttaaccactttgtagagaagcaaactcattcaagtagttgttttatgcacctgtttactctgggactcaccattgcaaatgcagagttgccatgccaacttcttccaagccaagtatttgtgctgctcagcttccaagatcagagtgctttctcagaggcagtcattcaccaatgcatcgtgtgcactttaagatagtttaaaatgctctagggaaatatgtactcatctcagctggtgcttcctgccctctccaaggttctgtgccattttaaaattagccagtaattcatagtc

SEQ ID NO: 54498 - DNA, 1062 bp, Homo sapiens
cccgccaccatgcccggctaattttttttttttttttttgtatttttagtagagacggggtgtcaccctgttggccaggatggtctctatctcttgacctcgtaatccgcccacctcggcctcccaaagtgctgggattacaggcgtgagccactgcgcccggcctaacaagcaattcttaggcctgatcatacatactgtgtcacatattctaaacataattttttattagtgcatttcactatagtagattttcacagattataatgccacaggtcctacatataacctaattttatgaaaatacttagattagcagatttatttcctcattctaacttagaggcaaggtataggccagttctttggacttacctgttaggtgaaaaatagttattttttcattttgaattatagcatctctgaatttacatatccaataaaaatgacttgattttttaatgtcaattttcttcggtagcaaatgcctattattattgctggaaatgatcaacaaaagaagaagtatttggggagaatgactgaggagccattgatgtgtgtgagtatgtgtaactgccgctttatttcacacttaagaagggaacaaaggtgctatttctccttttcagtctatatgtatatattgggatatttagcattgaaacaaaacttagcaacatattattacaatgatgtgtcaaggatgccaagaaagtatcataataggccgagggcaatggctcgcacctgtaatcccagcactttgggaggcggaggcgggcagattacttgaggttaggagttcacagcctggctaacgtggtgaaaccccatctctactgaaaatacaaaaattaaccaggcgtgatggcgcctgcctataatcccagctgctcaggaggctgaggcataagaatcgcttgaacccgaaaagtggaagatgcagtgagcagagatcacaccactgcactgctacctgggcgacagagtgagtgagaccctgtctcaaaaaaaaaaaaaaaaaaaaggtgtcatcataattttgttgcttatttccag

SEQ ID NO: 54499 - DNA, 1747 bp, Homo sapiens
atcagattgtgtttactaaatgttttttctgacatggtaaaatagatagctttcaaacatataatgagatttgtctttgttgataagatgtacttgtagacctttagactagtgttggtttcaaaatttgtgaaacattgttttagattatggttggcaaatttttttgtaaagatccaaattataaatatttcaggctttgcaggccatatctctgtcacaactactcagttctgccattgtagcaagaaagtaactgtagatgatatatgaacaaataggcgtgactgtattccaatcaggctttctttgcaaaacaggcattgcagactacagtttgttgatccctgttttaggtaattgcagaaagtcatgaaacagtgattaaagcaaaaattgatgctggctcaaaaaaaattccttaaaatatatcaattttcttattaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtaagtaatatgggttcataatctttataggatcttttatttattacattaaataagtatttttactttaaaattgtatgttcagtgtgtttctctttttaatatctgcttattttattaaggatataggaaaaatactgttacttttctttctttttttttttttttttttgagacagagtctcactctgtcaccaggatggagtgcagtggtgcaatctcagctcattgcaaccttcacgtcctgggttcaagagattctcctgccttagcctcatgagtagctgggactacaggtgcacaccactctgcccagctaatttttgtatttttagtagagatggggtttcatgatgttggccaggatggtctcgatctcttgacctcgtgatctgcctacctcggcctcccaaagtgctgggattacaggcgtgagccaccgcgcctgaccatattgttacttttcttaattttttaaataattcttcaagttttcttactatacattatagaaattattttagcaactgcaaaattactgtagttggtgctagatttagagaggcagtccaccctaaatatgatcatcctgttaatatgtactcattttctgtttttactcattaagaacatttcccctagtaagatttctcttgttaaacaaaagcaatgacttttttctagagtatgatactatgcctaacaaatgcctcttactacctttaattaacaaataatataaacttacgtgcctattccctgttccccaccagtttcttgttgctgtacatcaccttctctttgtacactccctaacatagacacttaggcagatattgtgtgttttaaagataacatgaacttttgctttataatatcttaaaatactaggtagctgctggtgctgttggattagcacaaagagctttggatgaagctaccaagtatgccctggaaaggaaaactttcggaaagctacttgtagaggtaattttaatactgcttgctttgttcaaatgtaaagacactcattttcatttaatatttagaaatgatttttaaaccacaaactaatcaatttctactttgatagcaagaagataatgtggttttatcaagatgagtttcaaagacatttctttttagagtgtgccactat

SEQ ID NO: 54500 - DNA, 1905 bp, Homo sapiens
tcttggagagggggtgtcaaagatttctttaaaatcgttagtgatgtggtctcgctttaagatttttaatgggatcagaagaaaattcggtacttaatcacttccggtaatcttcatgacctgttatagtgactgcagtgtactctcaatgaggaagatatagatacgaaaagaactagagccgcatcacatggggacttctgcaaatacagagactcggattaaaggtggagaagatggagctaaaggaactgcttatttaatacatttgaacaacttttggggtacttagaaggtgctttgaaacctgcatttgattaagcaagaattcgcttgcaagttaagggttagatttttttattttttaaaaatatgctttctgccacatgtaaaccgtaagttgtcctgaaatgataagctttgatattctatggtgtttattttttacttatctttttgaatgaaaagtgaacaacaagaaatgctggtggtaattttttgggtcaatgatgagttggcatgtattctgaatctaaagttgattattactactttagctctagaattactctgagacctgaaaattacctgaatcgtgactaagacgaagcctgaatgatttaagttcttttttgttggatacaatttgttgttgttgttgttgttttggttttgtttttgagtcggtctccggtcgcccaggatggagtgcagtgacacaacctcagttcactgcagccttaatttccctggctcaagcgatcttctacctcagcctccctagttagttacaatttttaaatggaacgttttcctattacaagatgaaatcaagtgaaaattgagatgtatgttgaatctatgctgtggggcagaagaacgttgtagaggtaaacattgatgagattaccactttattttgaaagggcactccacagaaggatgttattatcaagtcagatgcaccggacactttgttattggagaaacatgcagattatatcgcatcctatggctcaaagaaagatgattatgtatgtataatttttttatgttggaaagtttattttaaagaagtgtgacagtcataagcagtgagacagtatttatgtcttaaaatggcatccaactccatgcagagaactgaggatgtgctgtgcctttgaacttcagttaagtgtgctttggacgtctgaggctgtgggcttattagaatctcagtttttacctatactgagagggcttgccagacaaagtagatgagggtttgaggtacaaaacgggtttctctttttgtagttaggggtaatactttcaaggtcaatgatgtgttggcatgtattatctgaatctattgctgatgtgtaataacactttagctctagaattactctgagaccttgaaaaagttttaccttaaatttttaaatttcgaggaaaactctgggacaatcttagcaaaaagtagtaaacaacttagttaagagtaaatgtttttccctgtagtatccaaactcagttgtcttagtctaccgatttgtgggatatatggtatgtattaattttttacttaagtgttaggttcccataaccttgaaaatactctattagcaatcatggagttaaggccatatggatggggctggactcgtttctgcctttatctgctatctatctttatgccctgaatttgggttagtagcaaactaagatgcaccacctgttaaaaaaacttctttttttccttttgagagctataacctcactttgttgcccagactggaggacagcggtgcgatctgggctcactgcagcctccatctcctgggtttaagtgagccacctgaatagctgggattacaggcacattccaccatgcccagctagtttttgtatttttcgtag

SEQ ID NO: 54501 - DNA, 1922 bp, Homo sapiens
agtgtgggaaaaatttgtttctggaatcctaatactaattttcatgtatcattgattagccactgttttatctgggcttaaacatctttggcatgtttagggcattttgatttttcatgtagttatataatttactaatagataataggttttgtacagagtccacattaaaatagatgtctgataaatatggtataggtactcggaaagaaatactctccctgaacttcactgatgaaaaaggtagatgtttttctgtctctggctcatgggagaaactaaagcactgtttgtattgtcagccatagattaactaatcctgtgcttctcagataattgtttttttctgataatagttgtgtctgaagatggcttctaacattgagcagcacagattttaaactcactactgatcagtgctgttaaggtcaggagaggtaaaaatagcagcatggctaatgagttacctttgtgtttaatctctttataacttgttaccagttcaaatgacagatttaagaaattgtgtattattttaggaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccaggtaaatactaatcaaaattgcaacgatcttgatagtatgttctcttacttcagagttggaaattgaaactgtatcaggatttggtcaaaaagttttgttacaagtgaagctgtcctacaaggtcaatgatgtaatggcatgtattagctgaatctaaagttgatgtgagttctaaaattacactgagaccttggagggtaaaatttttatcttcagtatgtgtaaatactgtaaaatagctaaatggagctatttgattttgatattagtgaacatctacctggtggtttaaagtctttctggtactactgggtgctgagatgggaagatcaggactttgtgtggatgtgagttagtatacttgagtatcttggaatgccaagttaaaatttatatgtagaaaattatactttaaagatttgagttttcttgatactatctaattttattcaataacaggagagtctgcatatttgagaaaaggttatatacacagagacaaaaggatgtgcttgacaacttaaaaagagttgagcataagatcattagaataaacctgaaagggacatttacctaatacttgtctttattgcagattcttacgctgtatgacagtattaatgttattgacgtaaataaagttgtggaatatgttaaaggtctacagaaagaagatggttcttttgctggagatatttggggtaatgtcagatttagtccattctacccaaaataccaatattaaaatgtactggttttgctagtaaccagtttataagtttttcatcttttcaggtcccactaagcagctggtctaactggagttaatggtctgctggaacttccagcatgcactgtggtagttatatcagcatatacaggagcactggaacagagggggccagtctaaaagataaggtaggtggaatttttttccccaatatttggtggctttgtaaagttttttaaaaactacttgctggaaagggaaaaatatttaaaaaaaaaaactttacaaacttgctgaatatttgagtggagggagggaatagaattttatttgataaacgtagataatctctgctttagggatgaacacagtgcaggccagagagaccagctgcttcatgggatgtgaaaaatctacttttataaagtagggtaagtttatttcattattagaaa

SEQ ID NO: 54502 - DNA, 2000 bp, Homo sapiens
caattctcctgcctcagcttacagagtagctgagatgtgcaccacaacacctggctggtttttgtgtttttagtagagatggggtcccctggcctcatgtgatcctcctgcctcggccaccaaaagtgctgggatttcaggcctgagccacaatgcccagccccacctaattttttttaaaaagttttttgtagagatggggtcccattatgttgcctcggctagtctcaaactcctaggctcaagtgattctcccacctcagcctcccaaaatgttggaattataggcaagagctactgtgcctggtcaatttgctgttatttttgacaaaggaattttcttgggaagtaaaggcacttcagatttagctttcctcctgactaccctaaagtgaaagttaagcttgaactcaatttaaagtggtagttgtgcagtgtttgtttttagatgactcatgtatgatttggtaacacctgccttgatttgatctatttttattgtaggagaaattgacacaagattctctttttgtgcggtggcaactttggctttgttggtaagctttgaatatttgattgaaatgattaaagttcatgaatactctggaattttttttttttttgagtctgatctgctgaatactctggaatttaacaggcatctttttttttgtttgtaggggaagcttgatgctattaatgtggaaaaggcaatcgaatttgttttatcctgtatgaactttgacggtggatttggttgcagaccaggttctgaatcccatgctgggcaggtaatttatgaatacagatgaaaatgtattgtcattttggaagccagtgtagtaaaataagaaaattggttatttcagtgtttgtcaaatacacataaagttaattcgactgtaatagggcatcttacataagaattgcttaattgctatcattactttgctttatatactatatacctttctctgtcggtggattcgtctgacctaagcaaacataagtgggtttataagcaccaaaacacttttgttttccattaatttttcactaaccatacagataaaaaaaaaaacaacacatttttctttctttcctaagataaattatgaacctcttttcttgtgccagagaacactgaatatgtgaatggatggctgtgaaatactagccatgaagaaattttgacaataatatttcagtgcagaattgcatactagtaatagtatgcttggattttttcagatatgtggtattaatacatgtttggaattttaagtgtcagatcaagaagaaaaacttaagatataaagtggtgttttaataatttgagttttatcacttttaatgtcaagaaattattatacacataaactttatgtctgtaattttagatctattgttgcacaggatttctggcaattacaagtcagttgcatcaagtaaattctgatttacttggctggtggctttgtgaacgacaattaccctcaggcgggctcaatggaaggccggagaaggtattgtttgataagccatattctgctagctttagaaccttgagtgaatgctgctgctttgtcttgcctgtttctatattgtaaattggccatgagcttatttattacctttccctgttgtgaattttcagtaatatatcctactaaaagactccccttgacaaagtagacccccatgagttgaaatactcattgatcctaatgtccatttccagacagtcttgtacaggaatctccatgtttaaggacagttgattttggcaaattggattttttaaaaattagactacagaatttttgtttgcaatcttcttatttaaggaatacccagataatttggtttggagagaagattattaaattttcctccacataataggtctctcttatcaggtctgtaagggacaaatagtgaatactcatttgcaactatgtaattgtcctgtagagcaagtgcagccataagtggtaaga

SEQ ID NO: 54503 - DNA, 1979 bp, Homo sapiens
aaaatgagatcagccttgagtggggttttctttatagacttctgtcaccatattttgaagagcaagggtttagttgattttaagcaggtgtgtacccccctggacagtgcttgtagaaaaacagaactatacccatggatttcatgattatactgctagcttcttggttaaggggctgagttaggcattcattgcagatagaaacaaagcagatgcatgcttatcagtgagtactgagatatttagcatggttacctatgaattgaagtttggtctcttcttacccattaattgattatctttcattctaagcaagtatttcataccctgcatatcagtatatccctggatttcgtccttccacatggtttgacactttgaacatcagattacctaagagtgagacttaacccacttttaaattgttctcaaaattagggaaataaaagagaatgaaattgtggcaacttttttccctcctagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggcaagtaatatttctgacatatttctataaattatttcagcgtttgcattacttcatggttccatggatttccagggtggcattccgagtgttgctttgaaagcagtttttttttctatttattgtagagtgtatgaaggatatagaacaatcttacagaaatttcttgtcgcttgttgctaacaaaattagtatatggtaaaggtcaggtattcataatttgaagttaaagaagttttcattttgtgatctgtatataaattcttttttaaataggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaagaccggtattttattttctgctttttattctgaagtcctgttattctgactacagttctttgtgtatacttctgtgtctgttatgttcaataactgagctaacataaaataactctaggtttctacttgatttttcccccatgtatacctttcatctgttctatagcaagttgatgtaaattggtttgtcaacaagaatgttaactgatgaaagtggatagaacccatacatgaattaaatgatgcacaaaataaatggctgttgaaatttggaaatgattgataggtttgaatatggttattctgaattggtcacagacttaggttaaatggcaatctaccatcttaaaatggggttgtgattcggactgtcctttttttttttttttttttttttttttttagcattttatatatcagaattacccaaagaaggagttgtcttcaaataaggaaacactaacgggtaagttgatggtcaccacagtatttttttgcacctgtctttttcttaaaaagctaaaatgggtacaatcactcttttttatttttttgtgacagaatctctgttgcccaggctggagcgcagcagcacgatctcagcttaactgcaacctccgtctgccgggtttaagcaattcagccgcagcctctcgagtagctgggactacagccgcacaccaccatgcccggctaatttttatgttactttagtacagacagggtttcaccatgctgaggagctggagaccagcctgaccttgtgatccac

SEQ ID NO: 54504 - DNA, 1051 bp, Homo sapiens
ggcggtttccccgtcgtcgggagaaacccgctcacctcagggtccccgctacaatttcggactccaggagactccacagagccgcccttcggtccaggtggtctctgcatccacctgtcctggcacgtcaggagctgcgggcgaccggagcagcagcagcagcagccttccctgccccgcgccaaactcccggccagctcaaggcaaggagtgattgggtggaggagtctccttgaggctagaggccggcagttcatggaggctcgggggcacgtgggtggtggttaccacagtgaagttgtgatttggttggggcgtgagatctgagtgccctgggaatttggtgagtctgggtgattagaagccttgacttttcaaattggttctattgcaagaccttgactgtggatggctcagttctgagaaaggctgaagtatcccatataacgtccctcacagtgtctgacaaatgacagtttgtgcgtgagtttgctgatagaagttgtgagctgatctttggctgctgaatttaattctccaaatcctgctaaggtgggataaaatagattaaattgaacatttcatctaattcagggaaaataatatgtttagtattaaaagagtgggctgggcggtggctgacgcctgtaatcccagcactttgggaaaccagggtgggcggatcacttgaggccgggagttccacaccagcctggccaacatggtgaacctcccacccccatcccctatctctactaaaagtacaaaaattatctgggtgtggtggcacgtgactgtggtcccagctactcaggaggttgaggtgggaggatggcgagtccgggaggtcgaggctgccgtgagctgagattgcgccactgcatttcagcctgggtgacacagtgagaccctgactcaaaacaaacaaacaaaaaagatgcatgtccttcaaatcatttattattttgttagtctctattcatgacaaagcatcaccatttttcacacacgattgcaacacaatggtaaagtaacaaataccaaatccaat

SEQ ID NO: 54505 - DNA, 1039 bp, Homo sapiens
agcttcttttacgataactcttttgaaacagtttcactcttcctgtactctcaatcacttcactttctacagataatctgcctcctactttttaacaaatttgaggtcatcttgatgagttcttgaacctcccctccttcaaaattttgttttgaatatttctgtttttcttccatctctcttccatcttatctcagaggaagagactgactttcagacagaaggttaactattctaccttttaaaaaaatctccactaagttattattacttctcagttccctttattctcttttgcatctttaatattttcgtcacaggcttttcctttttctaagagtatgcttagatttctcccctaaaattctgcctgtttactctacttttcaaactattatttcattttctttttactgcaaacttatcaaaagtaacccatgcttgcttctttcatttctcatgtttaaactgagtcttattgtcatcactctccccaaagttttctcttaaataccaactaattataaaatcctttgtccttcttttcacttctgatcttccatgatctctctatggcacttgacactacccttgttttctcttttcttaattctgccctctcttggctatgtggaattattctctcctggatattttcattctcctacctgtttgattatttcttctgtcccttcttcactagtactttttcttttctttttttttcttttttttgaaacaaggtctcactgtgttgcccagcctggtttttaacaaattcctgggctcaagcattccacccgcctcttcctcccaaagtgctgggattacaggcatgaaccaccgcacccagccatcatcattactttttcttattccacttactaaatataaaagtttctaagatttttgcccttgtttcttttctttctaaaatctgcacttggtgatctcatcttttctcacagcgtccatcatcatttctgttcaactctgaatctatatatttttctccatatttctcctacatatcttaatc

SEQ ID NO: 54506 - DNA, 1131 bp, Homo sapiens
cggcctgtcctagtgcttttctactagtgttgtatctcaggaatagcattcatggaactggttgagaattgatatgttctgtaacaattatgcagaattaatactggaccaaggacaagcaagtttctgaaaatgcaaaaaaaaaatttgttttaaaaatgggctgccaaaataatttgataaatttgctttgcttatagttggctcagacattcatattcactgctgaggcactgaagaaaaaaaaacagtggagttatatctcttatgagtttatttctgaagtcacacccttaaagattaggggaactactggattccttgttaatttgattggtttaaatttataggggtagctttctctctattaaacggacttctttcttgctactaatgggcatgattcaatttgatgatgacacttgcagttcattttgacagggtaccctgtatgctgttaattgttttctctaaatttgatttattccagaaactttgtaaagaaggtctccacatttctgagggatagatattttcacttgaacaaatattttaagcctttatttatatttttataatgcttgacgttgctttgagaacttgaatggaaaaaatctgttttttgacatatgattgtatttgtggggagaaatgtaacccttattttgaaatattctgttggaaaggaagtctgttaaattttttgattttgtttttaaaggacagagacatcttaaacagttttaaaaatataattaggatataatatatatctacttaatactaaaatgaactatacatataacttaaaattctttcatatttctaaaaacataagaagtaaaggactgtttgagattttccctattatttttattaataggcatatactcaatgatctgtcactggacatattctataaattaaaaattaactgtattctttcctttacagttgaatcttaagattcactaatatttgagcccattttttttaaagtagttttcttacctttatttccttgactgaaatgacagaaagcactctggaacatagtaccaaacatgttttggcatcttcatggatgtcagccaattcacgatcaaccattactcttactctcgaagggta

SEQ ID NO: 54507 - DNA, 1407 bp, Homo sapiens
cttgtggcctcaggtgggagaacttggtgtgagggcctcacttaaaaagaactttccatcccactggtagaggcctcccctgccctcgtttttttttttgcactacctttctacaagaacataacctggatgcatgaatcaaaaacatgaacagcatgaaagtttcctgggccttgactggagaatgcagagacctagttgtccaagcctgggggaactgtgtgacgatggaaaataccaggaaacaattcgttgttgttgtgttattgtgaagtagcatttatttctctataagatgatattaagtcatctactgtgttctggttacctgaatcgtcttctaacgtgcctggtgtcaatgatgaaaataagagactaacctcgtagaagttgtttccccttctttgcgtaaaggagatcagaagtttcctgtgagctttctgaacttcctctttttgtttcagaacattttccaggacatgaggaaataatacatcagtattacagtatggggtatttgaccgggaggctcttagcacaaggactgaaatatgaatatgagtcatctttactattcattgtgttatttgctgaaagggacattgaggagcatgatatttattgctggccatctttttctgttttggtttctcccctgccttgtcctatacatgtggtaaacatctttaatgcacatcccaaactacacatgaatctggtccaatctttctcttctagcacttcacactgctttcagacatttgggacatatctgtccaccttatcttccctccactgaaactaatgtgggctttagactcagaaagatatgtctggatgctggctctgcccactgctacctctgtgatgttggacaagttacttaaatgtctctgggccttagtttcttcaatataagatcaaagtagtggcacctgcttcacaaggttgctgtgggaatgaaataagatagggtatgaaaaatactttgtggcacaggcatttaatatgtgccatttttttcctctaacatataataataagtgcagtttggttgatccttactatatcctcagtctgtttcttataactattattttttataaaatacaaaatgttttttattctttaatctttacataaaaccctgaaagataagtatcattgttttaaaccccattttacagatgagaaagttgacgctccctagtttaagagatttgcccaaggccacacagggttaatgacagagtgatcctggatttagacccagatatgtcaaccttccatatactttactgctgttccagtactttcccaggtgatgacttttaagatggcctaataccattcagttccaaccacctttgagcacctttgagcaatccccttctctggtcatggtct

SEQ ID NO: 54508 - DNA, 1062 bp, Homo sapiens
cctaagtaaattgtccgatgtcctgtggtcagtaagtgatggaggtggggttcaccctgacttcgtgtggttgtaaagcaggggtgttcaaacttttggcttccttgggccacattggaagaagaattgtctgggccacacataaaatacactaacacgaatgacagctggtgagctaaaaaaaaaaaaaaaaaaaagcaaatcgcaaaagaaatctcataatgttttaagaatgtttacaaatttgtgttgggccacattcaaagctgtcctgcgctgcgggttggacaagctatagagcttgtcttttaccttcagtgccaatttagtaaatatttatagggattctgaatttatttcaccatcttctaccccagacaatatccagtctagacaacttcctaatctggtggcctgatggggaccacttttagctgtgtcgtttttatttgttcctttaagtttcctttgtgacagaagaactagaggaactagaggggctgcaaagactgaggagataagaaggctttaattctgtttaattctgaatagatctttgaccctgggcaagttatgtgaacctatgtgtcctttttgggggtgggagtgagggagagttggatttaccctgaacgcaagcttcagggcccttccaaggttctgggaagagacactagcattttggtatttataattttatattcattttatcaaggaatcccacaaatcgtatacatttcaggctccccaacatagatctgtcccttgggtggtgttggagaaccaaagagataatgcttgtgaatgcactttgcaaagcagagtgcactgcataggcatgaagtggaaatggcaaaaaacgttattagtattattagtactgataatagctggaatcgaggaaacctttgttgaaggactagtgggagaaagaaggggtttaggtctgaggaaaacagggaagcctattaagctttctagtaaacgactgagcgaagttatgaaagcttctccccaggagaaaaatttctgtttgtaagaatttaacacacacttatgcct

SEQ ID NO: 54509 - DNA, 2127 bp, Homo sapiens
agacacgagaactgctctctagggtgtgggcagtaagaagactgtggggtgcagaggtcagagctagaccgactctgagtcccatcctggctttgtgattaatatgaataaaacaataatacccttatttcatggtctgtagcagtgctgtccagcagaaatataatgtaggctttttatgcaattgtacatttcctaagagccattattttaaaaaagcaaaaaagaaacatgtagaatttaataatgtgttttatttaacttggtatatccaaaatactttcatttcaaaatgtactcaatataaaaattaatgagatatttatatctttttttttacaaacagttcttaaaactcggtgtacgttttacacttatagcatctctcagtttgaattctaaatttttcatcagaaatatttgatttgtattttgattttactaatttaaagtaaaaaagtaggttcactcgtctaagttgaattgtgcttagaccttttccagtagctgaatggaacattatttttaaaaggtaaattaattaaaatgaaatgaaattttaaaaatgtggtttgttggttatgccagccatgtttcaatgctcaaaagccacatgtggctagtggctactgtattggacagcatgctccttcaggtattcatcttcactatcagaagagaccactagactcagacaatgagagtagcgtaaggggctgcagaaaggattggctgctgggtcaggttcagatggggaggacacacctgttggctggactcctggcagccaaaggctggcgactgatgagcaagtaatgagtgcctgactcagggacacatctgagcgtttgatgagcccttgaaattttatctgaaaatgcagtcctcagtttcaccatatcctgagcctaattttaccccagatgttgtgcagctgtgagttttcccaagggagtgctgctttgtggtatgtgtgagttggctctttggtctcagtgtggtagtgtgaactcctggaggctttgagggcagacacagacttgaagcacttttatttgagttgtttcattgctccaggagggtattacacatatgggagcaatttaaatgtccagaacaaaccacatgtcttcttttaagtccagagagcaaggtgattgcagtttctttgttcggtttgcttattttttactgcttatttctgtgtgcataaattcagcgacatgctaatagacatatggccaatggtgcttagagaaaatctgtttgtaaacctgaatctctgttttgcctacacatttgcattgtattcctgccctgctccaactcgttgtcctagaccatccagtgttagcatttttctcatgagatgaacatttcgttataataatgacagtagctgtcatttgctgagggctttctgcatgtcaggcagcctactaggtagtttacagatatttattgtctcacaacaaccttcagcatgggcaggattggtttcatttgacagatgacaaaactctggcttgacaactttaccagcatgagagtgctagactagggtcagcaaactacctcctctagaacaagcccggcttgctgcctatttacatgcagctcctgagtaagaatggcttttgtgtttttaaatggttgaaaaaaaaatcaaaagaagaataagagttgacaggtgaaaatgatatgaaattcaaatttttcacccataaataaagttttattgaaacacagccatgcttattcaccatatctgctttcatggcacaaaggcagatttgagaagttgagatgggtactgtatggtctataaggcccaaaatatttactacccatctctttacaggtaaagtttgccaacccttgtgctaggctgttgagttctttcagtggactttaagaaccacagtgaagagcagtgtggttctttcatgtctggccagcaccaggcctcatgcctcacactctgaatggtggggatatttactgagcatagagctaaatacggtacgtggaagaggagactgaagcttagagaggccaagtgactgcccaaagtctcatagtggggctggaattcagacccaaagtctgaactcctaacagttatgt

SEQ ID NO: 54510 - DNA, 1265 bp, Homo sapiens
gaaatcgaagactggtgaaagacgatagttttttttcgtgttgatgattcatagccttgttttagacttttataagtaataaaaagcactggatactgctgatttagtctcttcctagaggctcatatttgtgtaaagaaggaaattactctgtaagttttcccttttgctttttcctggctctctctttctgtgcctttgtctatattgaagcctatttttctgatgttccttcttcatctccagccttcatgccccttcccaatacaggtgttgcagggatcgttagctagaatgtctaaggaaccatactatcaacccaagagaagggaagcttggtgaactcttaaaaccaagtagatgaaaccttcttgcagagtcccgggatataagccattccattaggaatccttccctgggaaatatgaatcattgctatgcctgatataaaatcactgacatggtgttcatgacagctcaccatgtcatccctcacacctttgccatggcctggaggctgactacactactacttgtgtttgttcttttattgctgaccttgtcaaccaggtcattctttctctcttcctatttctaagagaaaattcattccccagaaccagcaagtacctgaaccattgccactttatatgtgctgccttatttatttttcatctcattctttggctgggagtaaaagaacctttctctcctaccctggtttatgttgcctgattatctgttcgtcggctggtttgatgtttatttaattctgccatgctgcttaaccttagaagcctggttttgtggcttgatttgagccaagatttctgcatgtgacttctaacttgtgggtaaattaaggtttgtttttctctcacccatctttgacccatgatattaaaacgttatttgaagaaaggacatccaacccatataccactctaggtttctgtgttaaaactattgaaatccactatacattatttcagatttatgtaggttaaagggatctgggtttgaccttttccccacttatcttcagcaaatagagacatgtgaagaggaagtttatttatcaagcacttatagagaatctaagtactgtgggtaagaggaggggtagagagaatggagataaaagattcactgaacatctaattttttttctaggggaatttagggtgtgtatgaatagtaataataattgtaacaatagcttacatttactgagtgcttacctgtactgtgttggggctttatat

SEQ ID NO: 54511 - DNA, 1571 bp, Homo sapiens
taaactgaactttaaaaatcctttgaggctttttaaaaaatgtatttgaagaatttccaatcagatcaacttaggaaggcccacttaggtcaaatcagacatggaggaattaattttcttgtggagctggtgttgagcctaagtccatcgtgctgcctgggtggggaatgccaggcagctttccttctttgctttccctgttctctcctcaatcactcatctctctagataaggccacagaacagccagagtgatcttttaaaaagtaaataagatcatggcagcctatttgtttgttgatctgtcagtcaaaaaactaaaaggatcacaaaaaaaactaaagggatcacaactgttttgcttatcgctgtgtatctatcatctagcacaatgcagtcaacaaaagaatgattaaatgaattaattttaggcaaaaaaattagcatgtgcaaagatccggtggcatgaaggaacaggacattttgggaaacagtgaaaagttgtgtatggctggcattgagctggctttgggagctggaagagataatacagttgggtcagatcataaggatcatgtagattctgtcaaggagtgtagatttgatcctctagaaatggggaaacactaaaggattttgttttttttgaggtggagtctcgctctgtcacccaggctggagtgcagtggcacaatcttggttcactgcaagctccacctcccgggttcacaccattctcctgcctcagcttcccaagtagctgggactacaggcacctgccactacgcccggctaattttattttattttatttatttatttatttattttttagaagagacggggtttcactgtgttagccaggatgatctcaatctcctgacctcgtgatctgcccgccttggcctcccaaaatgctgggattacaggcataagccaccgcacccggccacactgaaggatttttaaacagagtccttgggttggctctggccattgtattttgtatttggaaattatttgtctcaatgatgattttgctacaatgattgcacacgggtaatttcaaacagaactttaaaagttaaaatatgctaaagatataagtgtgcttgtttatgacagagcttggagttgtatgtatcaaaagggtcaagccaatgacaacataactaaacattttatacaaataagttattagttgtacaggttgttaaattttccatttgatgaagggaatcaagtttgagcattatctcttgggtcatttagacgatacattgtggatttatggctccttttggtagagtcaactcttgacattcggttgacagtattgcccttaaggaggatgctaggtggtccttccctcagagtcactatatagcagctgtctgtgagtcctgccttggaaagacaatattattctttcagcagctattatttattgagcacctacaatgtggcagatgaactaatcatcttaccttatgtgagtaaactttatagcatctctttgaggtagatgtgtccccattttataaatggagacactggctcagagaaggtaag

SEQ ID NO: 54512 - DNA, 1138 bp, Homo sapiens
ttggaatatattacgatctttgaatcatgactccacaggcctacaggatccctttccagtctcctccaaggcactcagcctcttattattttctagctactctagggtcttttcaggccctgaatctgaaacatgacatttgtggaaaatgatgggaagtactttatggctaaagcttagtctggactttgggggctggtgggacattaggtagactaagggtttggacttgaccttgtaggtaatggaacacttttgagacatttttagcacaaaactaaacgtaatggagccactgagctgaggagtagaatattcttctattgtctttttagagtgctcagagtccctgcattgccactggtcattgccctttgtacttggaaatgacttgttccaattatgacagccttgcaattgcgcaggccgaatgtttatcagaaaactgtaagttaaaacatggcaatgacatctctctccttgtgtgtcatatttaaggcacatgttctctgaaatcaagaagctgggctaggatcttgcactggccccagaccatattctgttgtgaccatgcttcagtgagaatgtgtcacgtgtaaaatgaagataagcaagaatatcagtctgtttgaaagtgctaataaaagtaaaatattcttggcaaataaagctattaatgtaggtgttgaaattttcatttagtcagagcagtcctaaatttaaatgtaaccttttgagcccttagatcattgagttaagactctttctcatgcggatgaacagtaaatgcttgttatctgaagatgtaaattgggaggagtaagggacttctgccccattgtgcattaatgcctactgtttgtttccctgacttagaatgtggctccatatttttgccctcaaggcagctattgatggagtcatcctatgctccaaaccttgagctaagcaccacatatagtcatgtgccacatgacgacgtttcagtccagtcaatggcagactgcctatatgacagtggtcccataagatgataatatcacatttttactgtatcttttctgtgtttagatatgtttagatacacagatacttaccattgtgttacagttattatacctatagtatatagcacagt

SEQ ID NO: 54513 - DNA, 1640 bp, Homo sapiens
ctgtgatatatatacccctgggatctggggggcaggcagcaaacctctttggaccttagagacaaactgggcatagtaatcatatctgctgtactggttgttgtcagaaacaaaatgaaataagatgatatactttgtataaataatgtttatacaaagtataacattatactttgttatatggctacattgtctctagtgtaagcaattttatttacaatttgtactctacttgttttgatatcatttatggcaactttatgtattatagcatttcaaacctggagggatctaggcagactgtggttgattagttgatgtttagaaagactggttaattcactgccagaatgcagatggggtggttggggaggataactgttttctccaggcagtgggtcagactgttcccaaagtgtgatcttacccatatcacttaacctctctgggcatctgttacctcctggaaaatgaaggcaaagctgcctacttgtagggctgatcatgaagaagattgagatgttttctgtaaagtgcttggcacttagcaagtgttctataaatactattattattttcattcctgaaaaggaaggagttagtattctagtgttgagtgtcaaaagactgggggaaggagtgtgggaggggtttatacactttccttcccatcctctcagttgtcctccctcatctccactccctccatctccaatcttttctcccctcagggctgaatgaaattgaatgtcttgtaaacgtgtgcagcctttgccaccgggccctcggacatgcccttttaacattctgacataatggatgaaaacatgaacagctgacagtcattggttaaatctccaaacttttcattccctcacctgtggggatggtgccctctgcctggtgaacccagcccaggcagagattgcaggagctggctctgctggtggtgggcctggttacctaggcaacgtttacctgtgctgatgacaaagggcctgtcactgcctcctgatgcatgcagaagaatattaagtttgcggggagatggaaagaaacaattttctcttgaaatgaggtagatgcaggtgttaatttctttggagtgaattttctgttttcagagaggcaagggtagagcttaaacacaaacttctggctgaaaatatttagtttgcgaacctggcaagcctcttaagaaaaaaaacaatcctggtgccgggactgttaggcttcctgtcttttcagcagcttattgcatttgttttactgctttgaaggattggaagtctctgaaggccatttctttaatgacttggaatattaatgtaaaaacttgcttgttggacaatacagtgaatactatagctttgcctctaattggcttttcagtccttcacgctgtaaagcccccttcttttaagacattttctttattttgaaatatattttatatttataaattttatttataaaatatctttattttataaataaattaataatgaaggaaagtgcaccaaacaattaaatagcccaatgatttatcatgaagtgaatatattgatgattgctgccgttaacaaggtgaggacagaacatcgtaggtgtcccagaaacagtccttctccccactttca

SEQ ID NO: 54514 - DNA, 1074 bp, Homo sapiens
ttggacttacagttccacagggctggggaggccttacaatcgtggtggaaggtgaaaggcatgcctcacctgcggcagacaagagaagagagcttgggcaggcaaagtcccctttttaaaaccatcagatcttgtgagacttattcactatcatgaaaacaacacgggaaagacctacctccatgattcagttacctcccactgggtccctcccacaacacgtgggaattcaagatgagatttggtggggaaacagccaaatcatatcaaaagttttatctggcatatctagtgagtcattatcagaagcagtagtctctctgaagcttttctcatctatccaccttacatttttatgattaaaaattccaaaaattacagaagtggagggaatagtccaaatattcccccatcactcaaatgcaactcttatcaagattttgtcacaatttgcatggaaatattcacaacctataagaagagaaagttttaaagcaaggcaatatctcaactcacagccatccacttacctctaatggccagcatcagagacaaagacttctgccttggttactgctgtcctgagcttctagcacaggtgtgcccctagatgatttcagtgagctattgttaaatgaatgtgaattcactgaagaaccacagactgtgggagctggaggaagtcttggcttgtcgtaatgaaccacagattacagatggagatgctgacatcctgagattaggtcacagaggtgcatgggagagttaggccaaggtctcaactcagggctctctccacttttccacacttcctcctcattttgctagctcatttaattaccactttttcttcctttctgataacactgaagtttaagagcatttcattacaagtgtgatgatacaatgtggtattaagacatgacaaggcaagttttattggccattactatttgcctcaagtgagtggcaaagcctttgaccactcgaggcatatattaatagccctataaaatacatcctggattgctagtgctattaccgtctggctattacatttaaaaaaatattgta

SEQ ID NO: 54515 - DNA, 1064 bp, Homo sapiens
taggcacttttcttaaactctctgggtctattttcttctctgtcaaatgacaacaagaatgcttgtcttttagaattcatatgtatatgaaaacacctggcatagggccttgaacataatgagtggtcaataaatcttatatttttgttgttgttattattgtcatgataatgaaatccaatgggaaattttttcttttaattagttgatttatttgtaagactaaaaatgttgttgttataacagatccttgtcttgcagggcagtctttctttgtttcctctctagccctcatcccttggaaaaatgagctgaaccatgttggttggtgcaagaggggctgacagaagagagttttgataaatccacaagataactttggaaactctttgccattttccctcctactcaatgctgctgggactttgagctcgctgaggcagtctaaggctgtgctttgacttcagtgctgtgccttgtgcttgggataattgtgttttccatttgatggcccccaatgctttgtgtaggaattggatggtgcacccatgctcctcaaatgctgaagcagtcatgtcacttggtggggtgaggtggatcatcagcaacaacatacttttcttttctttttgaattaagcacacggaaaaatccataatctaaacatgagggacattaagttttggatggaagagagtgaattttgcaacaataacaactaaaaacccaggacacagaacaattattgaaaacaacttgctgaagtatataaataaataaaagtgtcatttctgaagtatctttccttccctaggctcactgccattgtcatgggaaaagtgtgcatggcagcatttactctgaggtaataacatggatacatttcccgttgctcaagacttgtacatagagtctgaagacaaattcttcctatcttgctgagaaattaacttctatttttccattcctgtgagccagaagggtaattaccacatgctgttcagtcatgagtttatggaaagaaacacaggcttcattcagggtcttcaccaactgggtggggt

SEQ ID NO: 54516 - DNA, 1049 bp, Homo sapiens
agggattcacagatcctttgaagcccatctgaggactgccagccaggacccctagcttggtgcactacctttcttgtttaatcacattctaatctccaaatcaaggcctcttccattgtgaatagagatagaaactcagctcagattctttgatggaactgtgttcagccaagttgtgtttgctcatcactgaagctttaagagatggttaaagaaacaaggtaactgtgtggaattacttatgatcacaaaggcatctgtagcaaaggatcagtctttacaggagttgtcttctgagcctgggtatgaagggtctctaaactattttatgggaaatttaaatccctcgatcgaaacaaattatcataggagggaagaaaaagtaaatctcattaatggttaggtgtagtgggttaagtatttgcaaaagtcttggtcattttgaaaatggtaataccagtgcaatgagttctgaaatctgtagacatagtgtgtgtgtgtgtgtgtgtgtgtgtgtgtgtgtgtgtttctgaagaaaataaaaattttcacatctaaaataaaggctcagtttcctttggggtgccttagttcacagcagtatgacagctaaccagaaagctgccatactgtgattctgtttttatattatttaattagatgatttaaagattctctaaaaattctggtgcagcctttgtgttcctgggaggaatcttacataacttggagtcctagaatagaggaagagaacagtggtacccaggcctcgtttgctgttatggtttatgtcgcagacttgctaggtatgacttccaacaacacaaacagaaggtgacaggttacaaaagagtagataaaattttttgctgacttttctcctggctacactctccctacttcctccccattaagagtaatgggagagttcctgaactaaagttgcattgtgtttccatgcagaaaaccaaagactccccgtaagctgagctgaggtaggcagggcatgaaaccgaagggctgcaggtttgtcatttgttgttaagagc

SEQ ID NO: 54517 - DNA, 1986 bp, Homo sapiens
gcccggccaacacagcgaaaccccgtctccaccaaaaaaaatacgaaaaccagtcaggcgtggcggcgcgcgcctgcaatcgcaggcactcggcaggctgaggcaggagaatcaggcagggaggttgcagtgagccgagatggcagcagtacagtccagcttccgctcggcatcagagggagaccgtggggagacgggagagggagggggagggggagggggagggggaggccaaatggcattgttatggggtcttatctgcaaacgcagaactccattatgttttaatgatggatgagccatttttacaaatttgcaagattctagaagaaagaacaatctggaatgtgttcttacatacttttttttggtttattttgtttttctgtttttttttttccaagatggacactcagtgtgaatgttcttatgtactgttgattgtacctctaagatgatgtaatgacctcatctcatctagctgtcaacaatggcccccttttggccagaggttatttgactgcttcagagagatctggaaaacacaatttcttagttttatctgtggccaattgtacctctgtaatggctgttttgtccaccattgttttctgggatttctgaggaaaattctgagacaagtaactcctttgtttgtggaagttagttttggaaattacaaatgaagtatctttttttttttgagatggagtttcgctcttgtcacccagctggagtgcaatggcatgatcttggctcactgcaaccccacctcccgggttcaagcaattctcctgcctcaacctcctgagtagctgggattacaggcgcctgccaccacgcccggctaattttttttttttttttttttttggtatttttagtagagacggagtctcgccatgttggccaggctggtcttgaactgctgacttcaggtgatccacccgcctcggcctcccaacgtgctgggattacagacatgagtcactgtgctcagccagacaaatgaaatttctatcctaaaacagcatgcattacctaatcccaggtggttaaaaaaatgtatatatatttaatggttgctctgaaaaaatatagacagcatgggttccaaaatattaactatagtaaggagtcccatcatggttttcatagcatcctatcctgtacttgtacttgtatgttgttgcatttataaagattgaaattcattactaatgtagttggttatcagtttctttcctagaacagggagcacctgtcctgaaccaggtccagggtagtgtacatgacacctcagcaatagagtgattttctctagttttacagtttctacagtgaacatattatttttcctaattacaaaatataaatctctttaaaatgacgcatgcataattaggtactcagtattacttttaggaaattatatttgtgcaactgaagaaaagacctacatgggaagaactagaatggaaaggaacaggttgagggatgtatataaatggtaggtttctcactttgggaggccaaggtgagcgaatcatttgaggtcaggagttcgagaccagcctggccaacgtggtgaaaccccatctgtactaaaaatacagaaattagccaggcatggtggcttatgccagcacatgcctgtgatcacagctacttgggaggctgaggcgggagaatcgcttgaaccggggaggcagaggttgcagtgagctgagattgcaccaccaaactccagcctgggcaaagagtgagaccttgtctcaaaaaaaaaaaaaaaaagaaaaagaaaaaaaaggtaggtttctgctcttggatctaagtgctcgattgtagagaagatatcataaagagagtccaaagtgtgagttcatacccacaatagccagtaattgacatggcagctttgttttgccttcacttaaaatactggcatggtgtgtattttgttgtctgtccttcagaattggattt

SEQ ID NO: 54518 - DNA, 1352 bp, Homo sapiens
tatatttcagtatgcctctaagtaaaccaagtagctcctcctccccctcaacacctggtatgattcatgactgatttgggtagctgtaatttttctaatgtcagttagaagggaaagaatttaaatttactacatgccaatcatattccaaagccatacttagtattaaaaccacagaaggagtcatttacatttaacaggagctgtgggtcttaagcaatgatcatttggtaatgtatgttttgattttaggttaaaaagaaccttgatattgtgggatttctggttttcagatgagtggctagtagcctgtttttagaaagacattggggatgggaacatgtatttggcttctttgagtacagaaattctgcttcttggtggaccacagtttgactttgttttcggggttaccttggtgtaacaaagcatcccttatgccttcagggctgtccttaccacccatcacctgccaattggttcctgtctatgtcagtgttttgaatcagaatatgaggtgtgaaaaatacttcattcgattttagaccactcctaccttttgggtagtattacatttgaaagtttaggatttggccttgttcacttgtttatatttttactctaaaataggtgttaaatatattttgagcatttactgttgcagggcactgtactaggtactatggaattacatacaaactggagagataggctctgctctcattaagcttgttgtatgataggaaagaaggaaaacaacaatgaaaaagctacatagccctttcattgcagagtggtcagtgctatggtgtggacagagtgtcctgagggagtctaagtggaagataagttgagggagaagtggatagagagtgtgtgtgaccttatgcaaaggcactggagtaaaaaggtgcatctgtcattgaagagaatgaaaaaaaaagttcagggacaggagctcagtgagggaaggtgagtatgcccagaccatgaagtctcctgggctacagtgaggactttggactctatgagctaggagtgttctgcccacttaaaaaaagacatgtaggggacacacattattttatttgcctgaagcttgaccacctctcctttagctcccttccgcattctggaaaatgcttctccatttctgtagctccatggttaccatggaggcagccacgttgttttaagctactctgtgtcccaaccacagatgattgatccagggattttatttgattccttgggggtgttggaattggattataaagtgaagagctgttggagaccaagttctgtcaagcagcctaaagagcagagatggaagaatgaagcaagaccacaga

SEQ ID NO: 54519 - DNA, 2362 bp, Homo sapiens
atacaaaaattagccgggcctggtggcatgtgcctgtaatcccagctactcaggaggctgaggcagaattgcttgaacctgggaagtggaggttgcagtgagccaagatcttgccactgcactccagcctgggtggcaaagtgagactctgtctaaaaaaataaatgaataaaaataaaataaagtaaaatcaagcagagataggatattcctgggctctccacatgctccaggcactggttccagacctttccaacatgaatcctagtcttgggttctataatataacagtattcccctaaaaagttttctgtccccactttctgtttatactagccacaattagtttctgtcactaatgtaaaattattttctctatatgtgcaggtatttgtagatatttataataattttgctttagggcaatcttcggattgtaaatgggccttaaagcttcttaattcatggaaagtcaattatcctctagtttagtttgaggatacaaagggacaggagaagttaagctcatctcatatttcccaagaatgtaaatgtgatgaaagggaactttgcagtctaagcaaaaacacttggacaagataacttacggacttgagtgtaaaaacttaagaagtgaactttcacttgtagcagttctctctgatgtgagtcttgctagtccactcaggttttatttcttttagaaggtgatgcaaacagcaatattattagcttaaacctaaaatgtggtttatttaatgtaaccatgaccaactgcattttcataattctgtctttgctgcattatcagctggcagggttattcacgctggactagctctgagcctgctaattcaaataaacagtccttgccaaccactgctgagctttgagaaggtctaggctaaagatgggcaaattaaagacaattccacactgtggtaagataatcaactactctgattacctagtaactaagctaattgggaagcagtgtagtatatgggataagagcaggctgtgtggattcagacctgtgtgggaattccacctctgctgtctacatgctagatgacttcaagcaagttccctggtctttctgaatctcagttttcctgttgataaaatgaggtaataatagtacctacttcgtgggactattatgatttagtaaaataatatttataagacacagtaagttcttttttttattattactttaagttctgggatacatgtgcagaatgtgcaggtttattacataggtatacatgtgccatggtggtttgttgcacctgtcagcccatcatctaggttttaagccctgcatgcgttagttatttgtcctaatgctctccctccccttgcccccgactccctgacgggccccggtgtgtgatgttcccctccctgtgcccatgtgttctcattgtccaaatcccccttatgaatgagaacatgcggtgttgggttttctgttccaagacacagtaagttcttaagtattagcattattatggatattattttgtaaagcagttaccataatgcctagaatttgataaatgctatttgctcttttaccttaaaaatgtacctatccatatctttgaaacttcagtaagtaaatgtcttccctgatttacctgcctttgggcagcaggttaagaatccctgacataaactgaccttctcattttatagacagaaattgcaaccccaaagagtagcaatttttcagggttgggcagagctggtctggagcttaggggtctgtctcctaattcagtgctttacccactacactgcctatttcaagtgcagatgacctagggcattctttggctgcatcaatatgtataaagagacacatgatgcttgcaaaaggtacagttagagacttttacaaacccccaaacttgtggatatggaaatgcttatatactccttatttttccccaaatcatatttctataaggattctcatttcctgtgcacattccttttttatgtgaatacagttttcctgaagtatcttcccttgcttgatggcaattttttctttttgaggtggagtctcactctgtcgcccaggccggagtgcagtggtacgatcttggctcactgcaacctctgtctcccgggttcaagcaattctcttgcctcagcctcctgagtagctgggattacaggcgtgcgccaccatgcccagctaatttttgtatttttagtagagacggggtttcaccatgttggtcaggctggtctcgatctcctgaccttgtgatccacccaccacgacctcccaaagtgctgggattaccagcgtgagccactgcacctggccgatggcaagttttta

SEQ ID NO: 54520 - DNA, 1089 bp, Homo sapiens
cagagtcctatgctaggtgccctccagggattgtaatccctgttttatagatgatgataatagatatatgtaatagatagatgtaatccctgttttataggtttgggaattggtccttaactggcaggtccgtgggactgtaaagcctcaggaagagcaattgcctccatcacagaaagcataagaggttgtaggaagaatagattctgtgggcacaggcctgccttgtattccactctacccggagtgcccagcactgggcctggcctctgccagtggtcagcaaatggatgtgcaatggacacatgaacagactctgcatttggtgggagctttgaattctctgactggacttgaaggaccttccaaagtcactgaccatttagatggaaataaaatatacatccccatcacttggctgttaaatataagctcgtcacagttaaagtctggcaaggctggactgggggaacagtggcagttcctgagagtgctgagggtgggattttccttacagttctattaattggatgtgtccagagtgatctcgtgtttccttgagaattgtggccacatactgccctaagtgctgctctctgcattttgtggcagttgatgggatatgatgagtttgtggggacaaaagactttaaaaggtctctgtgagaaatgactcctattgcctttgggtgagaggccaatttatcagaatagcaaatgccttatgttagtggcatactttgaacacttgccatagaatgtctcctttgatccttgatagataaagaagatataacccccattttgcagaagacactgaagctcagagaaattataggaattgctcaaggtcacatgaaattccaatctttctctgagctccagggtcagttatcacctgcctacttgataactccacttggatagctaatgggcacctcaaatccagcacgacctaaacagaggtcccaactcctgctctttctctgaagagcactgatgctctctgtttcagtaaatggcatcccagggaacccaggtacattagtcctattgctgctgcaacaaattaccaccgacataaaagct

SEQ ID NO: 54521 - DNA, 1036 bp, Homo sapiens
tgtagtctgcgtcagtgctacttagagtggggtctgtggaccagcagtatcagcatcacctggacatttattagaaatgcagaatctcaggactcaccccagatctcttgaatccagatctgcattttaacaagatgtccagtgattcctctgcacattaatgtttaagaagttttgctggctgggcacggtggctcatgcctgtaatcccagcactttggaaggccgaggcaggtggatcacctgaggtcaggagttcgagaccagcctggccaacagggtgaaaccccgtctctactaaaaatacaaaaattagctgggcatggtggcagacgcctgtaatcccatctaccagctactcgggaggctgagacagcagaattgcttggacccgggaggcagaggttgcactgagccgagattatgccattgcactccagcctgggtgacagagcgaggctccatctcaaaaaaaaaaaaaaaaaagctttgctatagggaaagtgacaaacacataagcagataattactgtgcacaatgagattgtgttaagaatgggaagagtaggaagcacagctgcccagagaggagcgtccactctaagtgagtgtgtgagtgcattttttgtgtgtggccagtaagggggtaggtatagtgcttggtcaggaatagctggcagaatgaggtcatagctgaggtaatgtttgaaggaaggagtaaatattttaataatagtaatcatagctttcacctatcgaatactgaataatagtgtaacaaataatagtaaacacaagtagttcttagcatgctccaggcccaggcctactcattttaattttttttttttttttttttttttgagacagggtctcactctgtcacccaggctggagtgcatgatctcggctcactgcaacctccacctcccaggttcaagcagttctcatgactcagcctcccaaatagctgggattacaagcacataccatgacgcctggctaatttttgtattttttggtagtgataggtttt

SEQ ID NO: 54522 - DNA, 1517 bp, Homo sapiens
gttttgggcactgcacctattgattgatccctcagtggctgctggttggctctttgtcccaccttcaccatcatctggtctttctgggactcctcagcaggctcctctgggtgggctagccctaaatgtgagtgatcctcacagttctgacccctcctccacctctctcccctctgctcctcttccctggtttgggactcagattcacattgaaccttttttaactggcagggcaagcctctgtggtccatctggaaagaaccacaaagcatcctttgtcatcctgttttagtatctagaatacactctgaagatcagaagcagtctctctgtacaagacatgtgtttcccatcagcagacagcagactcttttgtagctgggttcaaaatctttgttgttgaccgcttctggcatcttagcttttgtgaatctggggtgataccttttggtttccctgccttttctttaacaccagatctccttcatcctgatgcatttttaaacaccagtcaggatatgccatttatgttcatgctaaagtcttcactgacactcaccacaccaatctacttttattcccagttactatgttagaatcctatttagatagatggagccaattgagcgggccctgcagaaagccatattcagttagtgtaaatcttcctgctggtgttggagacagcaaggtcccctgggattctgtctggaaatcttattggattttcaagacttaagttaatatagagaccccccaagatagtatagggcctcatttctttgccttgaaagatgtttttagaggtctgtctcaagagtctcgctgataaggaagttacttcaaatatttcaagagaaacaaccacaaagagtcttctattttctcaatattttttctctccctgcccgtccatctttttagtattttttaaatgcctgccctctatatttatttccctctttctctcatgcactcattaaccttaggcccctgtttcaaatggaattaattagtaaccataaaacttggtaagtgatggccttaagggaaaagtctttctttcttctttctttctttcttttccctccctccctccctcctgcctttccttccttccttccttccttccttcctctctctctgtctcgctctctttcatgacgaatgaatataccttgtagacataagtgaatacatttcatgatactgtacttttttcttttcttaatcaagtgaacatcttccttagtgacatatagggtactgtctcctgacttttgctctgagacgcagcactcagcagaacagagtgtgggctttggattcagagccataagtttgagtcccagctctccctttatgctgggcaaacagtgtcgctcttctgcagttccattcccatgttagtaatataggcacgaccatttctgccttgccatattgtgttcagaactaaaggtgattgtgcatgtaaagtgcctcactcccagtgggctttcaggcatccccaggtg

SEQ ID NO: 54523 - DNA, 1078 bp, Homo sapiens
aataaaaaacttgctaatatgccctccatacaaatgtagcatggctaagatttagaggatttgttcctactctgttttatgtttgtttgctttattgcacaaagtagtgttttgcatttgtgttaatctatatttttttaacttagtatgtaagtatgttccatgttgttgtgtgacttgctttaaaaatgaaccaaatattgaacatctactgatatgatggaaactgaattgggtatttttacataaattagctcatttactgcagcactctagtgaggtggacattattatccctattttgcagttgaggaaacttaaggctcagactgtttcacctactcagatcaaatagctaataaggaccaaagtcaaaattcattggacatggggctgacttgaaaagcctgtgttcttttgggtatgcattttactggctaccaaatatcccatctatcatgccatgttgtgacgcaaatcgaacatcaggtgaggggccccatagtggagctacctgtcacccaagataggatttctcctttcaggcaacttcttcaaagcctaattcagcacacagacatcaggtagaaaggtgattatttcctgcctggataggtttccacccatgcggctctcctatactcttaggtgtacattattgattccaggagtcatatgtgtccctatctgtgttgtgggtaaggagccccacagtcttttctcttgaaagacttggctctggctcagctgtgccttgaatctgtgattctgtcgcataccccaggcttttctgctcaggatggggcccttttgagaccaggtctttggtgcttgctcatgtgcagtctggaatcagctgcacagggctgggaagctgcaccgcccacctctaacaggctcacagcagaattcttaacacaggtgctttattttagaagtttatactcttcattgtaaatagctaataaaaagcgacagctacagcccatttataaatgcacttccagaaaccaaattcaaagggtttactaaatggcaggaacctggtcaacagctgttttaaatgcatttatttctg

SEQ ID NO: 54524 - DNA, 2022 bp, Homo sapiens
tgtcagtcaatcctaggtgcttgaaaaacatctcatttagtctttacaatagcttatgaagttgatacttttgtctcagtctttaaataagaaagccaaaactcagattggtttagtgatctggtcaatattacagagccaggaagtaagaggaggaattgaaaacaaggtctgcccgcctgggagtctgtgctgttttaagtcactttactgtcccctgctctgccacactgcctgtgttttcagagaggaggcaaccactaggctaaatgactatctggcaaaaatctatgtggagttggttcttcctattatattgcatctgtctgggacacctgagtgtttgcagagattcttgccccgattttcagcaccctcagctgttagccgtgctatggatgtgatgttggggaatttctaagattgaagtggccagttgcatgtagatgagaagactttctttaatttgccctaagtagacattctgcgcagtcagtgtgttatagaaagacatttctgggaggcaggtgatccaagggatggtggtcaagaagcacagaatatatagagatgggatagaaacaaatgcaatgaaagatcaggacattttgttcaaagtagaaatttcaagtagggaatcttcctcccacctaccgtcatgaactccaaggagattatgatttaataatccttgtctttatgtgtattcttcagtctatgagtaaaacatgttactggtttctcttctctgtaagttgcagtcatgtccctgcaagggagctagtttgtatgtattgctaggggctttaagatggtgattctccaggctaggaacccttccaagagattctatcacttacccaaagccgaaacacttgtccagtttagcaggaaatatctatatgattttgaatttcttggtttcggccatttgtggctctgaattcactgttgccctgaggaagccatctctgacccaaacactccttgttaaaccactggcatagctcaagtgacttggaaacctcactgtaactactattgcataacttcaacaacaaaccttcattctgttgtggtaaaacttcgctctatattcagccacacattaattagtacttatattttcttaaatgtacactgtgcatcatgacatgtcctcaggatatggagataaaatacttcatttttgctctcaaagacctaacagtctagtgaagaagactgcattctgaagtctctgaatgtcaaaaagtgctggttgaaaatatttcatttttttgataaacatgagaataggtaaaatcattttcagaagggcttatggaggggagacatctggtcctttacaaagacagggtcactgaacccttagtgcttttgtgaggtgacagaacacagtgtccccagagtgatgtatttccttgaaagttttttttctttgagaacatagggtggggttcttcctgaggaaaatattgatattgccagcctgctcctggtgaaattgaaaaaaaccaggaaatttaaacaaaggcatgattcaagaccaatatttaggaggaagcactcaccacaggaccagaacctgacccatggacccttgtactctgcatcgctgcagttcccatgctcttcccagcacctccctaaaatgggtcattctatgcaaatcccaacagccttccaaatagaatgtcactgccctgattaacaagtatttgtatactttttctctaaaatgtctacttgacatatcatatctttttgtatgtttcttccagcttctatttgttctttagaacttcagtagagtgcctttttacatttaccaaacaatgcaaaggacttccaggtaagtggacccctagtaaactctccagtgggatagatgcatagctttgtaatggcagccaaaaccagtttgtaaagatctcattttccccttttttacccctgagaataaaaggaggagtttaaaaaaatctatgcactggccgggcgcagtggctcacacctgta

SEQ ID NO: 54525 - DNA, 2657 bp, Homo sapiens
atgctccatcacttcctagggtgttgtctacacctgcatagccatagctaattttccattctcagcaccaaccaggggaagaggaggaaaggtagcctccttttcatgataggtgtgaagttatgcaggacactctcagggtgaatggaccacagtgtggctcctgactgggcagggaggaagaatctgctgctagagaaagaagggaagacagtcatctttgacatcatgagttgcataagatgggaataaaaactggaaaagacctaaatcaccatattagaaaactctagccattctaaagacattgaagaatcctgtttggacctttttagcagtgaggagcgtccagctgtggttatctggagaatgcaataggcagaacttgctggtagaggccccgcttccttgtcttgaatgcctgcctttttttttttcttttaaatttttcatctgcttctggatcacattgctgtgagccacattgggtcaattcacatggaggattagatctgggcacaccgtatcttttatgtcttttatttctttgactttattctgctggaaagtgttggcccacagccagaaccggcagagggcaaaggagggattactttcttatcacagggaaattaaatgcctgagacagcaacatagtgatttttttaaaacaaatttttaggaaaattgaactcaccctgtttactttcatagaaggcttttgggctgtgggaaggaacctatttttgtacttaatgaaatggatcttggcagtaaagggtttaaaactaactttggatttatttaaaaagtaatatccttgccactaacttgtcttctgtctttaaaggaaagagaatttttacagtgcctatagagcatgccattcctcaccagtcatttggcagtcctattagcaaactcatttgtcaaagcctcattaggtgattgcaaaagtactctcccaggacccactttggacttcttaccaagtcgtgtgtgtgtgtgtgtgtgtgtgtgtgtgtgtccgtctgtgtgtgcatgtatttgaaatggaagtgtgggaacatgacagtgtagacaagcttacagcccccatttttctttgagtggccccctctgataaaaggttatatactggaagaggacttaaaacctttgaaaaatcaaattctcttggaatataataccaaagtgttgttgttgtttttcttgcatctacatgttccatgaatattttccaaacaattcaatacattactcttcagcccacgcccatgctgacatcaaaaacttttgggaagaaaaattgttatcgaatagcagtgtcgcaccaagcagatggggtcactgtcccccaggataaggcatttctcatgtgcttgagaagaagactgtggatctgaaaatatgataggggctgcggcttattgaggcctcactattgagagggggcttggagttatggggaacagtgggctctagtgcaggactgctggggtcttaagcccactggaccacttcctagcttgccagccttgggccagtttatagccttttgggcctcagtcttcttatctgtgagaaagtgtaatgtcacctcccatgtcactgtgagcagtacataagtggatctgtgtaaatagcttggagcatcatgtagcatgtggaaatgctcagtaaatgaaccaggtctctcaaactctagggcccatgtttttccccttcaccactaaaacctcatgagaagcatgggctcaggagtagcaggaggcttctggcacagaatgagaagatgggaaagcgtgctgcttggccacaatggaaggaggagaaaggtcaaggagctcggtcagtaatccccactctgaggccaaggaaagaggatggaggaaagggcaaccagaacatcaaataccacataagcaagaagccataagtttctttccaaactaacagttaagaaaacagacctaaccacttctactcagggactacatcttatttgtttttgtatccatagtgcctggcctctagttgaacttgacaaatattggagtgtgttggcctgtttcttgttcactcatttgttcagtcattcaacaaatatttaagtgcctatcatggaacagccactgctttgagagcttacaatcaatgctgaagaaaacaacacggaaggattccccctgccttggcttcacctgggaggggagatgggcagtgagcccatgctagcttctaatgcactcaccacttcttttaataaatacaatactctccccgcttcccctaatgattctgtgaagcaaactagtctatagttcctggtatcttcttttcttgaaaagttgacatagatgacagttgtgtcctgaagtctgatagcttctatgaatttctcaaacattggttaccaactggtttggggatcaccttgacaaactgtgtaatttagaggtgagggcctcctttattggagtcaggagacctcttggatttgtgtcttcactctgttatgagttgagtggcctcaggcatcttctgagtttctcattcctttactgaaaataataatgcttatcttaaagtagcttgttcagaacttgccttgtctcaagaatcagccagacatttataaacaaatctgaatcctg

SEQ ID NO: 54526 - DNA, 1063 bp, Homo sapiens
cctacccctgcctttttttttccagcctccatctgagagcctctttctgtttctggtaagggtatcttcacccgtcaccaccctggtgggctggcttttacgttgagtgctttggtgtgaaaagcaggcttcgttcaagttgacttcaactttcctctttaaccttttatcatgtgttcttgttcactctcttccttcatggtgtcaagtaaagccagtagggatgaatcaggttcactgttcttttggagatgtgaaatccatgaatggggctaggtttcattatgtctccctctgggtagacccaattccctcctaattgcctttttcctgttgatcattcacatcttctgccttggaatttctttgaagttttatcatgttctcccttcatcatgtccttccctttgtgacttcagattttctgtgggtagctgtaatttcctgcagaacagtgtctactagattccctctgagcatggctggtgcagtggtaggattctgtgaaacgttgtcagatgtgtgagtgtgcagattgataaaacagcgtacactccctgcttcgttcccacctctgttttatgtggatgatgacaattacagcacagcacctcatatcggtgcagagatttctcctgctgtgatctaatggtggtctgtgtgcatgtggactgggaaccagaaggtggctttttctaggagatcttggctgcaggcaagcctatttctgccaagctagggattgtccgggtcttgatagagctagctgttttgtaccattgttagtagccaggctgtaattctgacatttcaactacttggactctgaaaaggtgtggttgggccccagatcatcagccaagtcttccactcagcctgcttcatgacctgacatgcttagcatttgggcccctttccaagagtgaagtaacacactgatggggagacaagaaagtgaaatagtggccccttggttctcacggggaagaggggagatgtgttcaggcctccccttcctccgccttcattggtggttcctaggtgagaatcactgggaatcagg

SEQ ID NO: 54527 - DNA, 1101 bp, Homo sapiens
ggcaggattccagtgtacatagtttatgtgggagatgatcccaggaaacttgggaaggggagtggggaatgagaaggggaggaaggaagccaataaaggatgtgctatcaagctcgccatcactgtggacagctgcagctcagttccactgggaacgtctgggaaagagtgtagcacaggtgcctctgagtgatcacacctgagaggggaggttctgctggccagagaacctctggtaaggaggtgcaggggctggcagttggtcaggcccatgggcactgttacaatgaaggctgagggaaaacgggtggggcatcgattgctttgctgcaggtcccatcccggattcaccttcccagggatgctagatgggagtctagacattgtctctacagaggatgaatctggaattcagaaagatgatggaggcccactgtggagaagccggttcttgagagttgggtgagaatccaggcttcctgactcttgctgcagtgccctttccacttggctacttaaggcagaaatttaaatttgtgatgacttttgaggcatactgtacctgattcatggaacaatattgtccttcccaccatgggctctttagtctttcttggagtgaaaaattgtcaaaagattaaatcctatttgggagccagagaaaaagcaaaagaatggctgagcgtgtaaataaagtctcctaggaagatcatatttttgaaggtatttattattcatatctttttgtcattgtcgtgttgtaagtgtttacctgggcttctagctttttgcttttccaaggacactgctgatccatcctagaagaagctgacagccaccaccttgacactggcttattgctgtccaggttatttaagatgcggaggaaatcttatcacagagaagcagcttctaaacatgtcctgccaggtgggtgatgaggtaaagactgcccaggcggccttgtgcacaccacatacttgtggagccactttgatgaaagggtctggattatttgcaaagtcttgtgctaggtgaaggtgggctctttcttaaattctgaaatgcccacgagtctttggtaatgttcatagtgaagca

SEQ ID NO: 54528 - DNA, 2076 bp, Homo sapiens
ttttttggatgccattgtgaattttttttcccctatagctattgcctatttgcataccctctgaagttgcccgttcttgaaggacactgataatgttctcctcccctgccctttcctttttgttgccagaataacctaatctaaaccagaaactccatcttttcttccccagggctcctatagacccataggcggctagagtgtacctgtgagcctctggggagatgtctcaccgccagagagctgtccccaactcaggacctcacctgcctgtgcgtgcgaaattacacctgagatggagtggctgtgtccagctaacaaagccgtttggggaggggatttcaagcatggctattccttgttcactttaataaaacatggcatgaattcaggcaaagggacttactccttactccctcacctcagatttttctgtgttttgctgttggtataacttgtcctgtgttgctaagttttaaacatatctatattttgtttaaaacactaaccatggctttgtttgagtggcttatttttatgtcctaaggagttgacctagacagggaacagttagtcatattctgtttcaggccaatgcctctgagccccttcccttctcgtttttctctgtctgaaatgatgctcttggctggccccattttgctgtttgtccaaacgggcgcccctcagcaatgggcaactttctccattttggtgtcttatctaagaccttgcccactggcttaaagagttggcttgggttccgtcacagtgatgagttgcctgtcccgccgtctgtagtcgggagggctttttccgtgatgagaatgagctgcaaactcaggcaaacactgatcaggagagacatgaaacccaacctggcccagtcggcttaaaaatagtccagtcatttcacccctggaattttctcttgcttatgtgggtggacaattctcttggaacaccaccaagatcatgaggaggagaaaacagagcaggcaccaaccacatgaatccaacccaggctgaccccgtagccggtggtgcattggccctcacaggtttgcaccctgcatgcagggccctttctcccccacgagagggcgctctcgtcactcttaaagcaatcgtactggggaacactcaggttgtttcttagtgaagtccccgaagagcactgcatttaagctgctactttgtgtctcagcttctactttcaaggtttgttatgaatgtaaagacattctccaactcaagcaagtgtgggcaatattagtgtctggaaacgcctgttgcaaatgaagcacagccactgcttgtttgtgtttcgttagtgaaacgtgattgtaacccagggtttttgacgctcacagaagcatccgccttggtaatgctgtacatccaggctgctcttctttgtccctaacctggttgcaatgtggccgtagcatgcttgtgttgacatctgacaggagatgaggacttgacttcctgggctgatcttgcttattttggggagagcaggagtgcccgtggttagtgtggatcagcctgacaggagattttctattgagggaggatttaagactgcatgcaggcaagggaaatacaagccatatttcaccagctcaatacaccagggagcgctaccatttaacgaaaaccaccattctgacttccgggtttttaggtcatctggcagccactgggtggggtcagtttcttggcccttgattagaagttccttctgattacaaaacacctcttgattgaaatctttgcattttctttgcatttgcatttccaccaatctttttattttttattttttttgccttggaggatgtgtgtatgtgagggtgaccttctctttatttgtgggaatcggggagtgccctcctccctacaaagtcactataaagctacgggctttgctgcccttggtacagggtctagaagtggttgttgggtggtgaccagcacagtgacagtttatttcctggacctttgaacctaaattcccacaggaagaacataaaggactcagcaaatcttgccccccgacccccgtctcct

SEQ ID NO: 54529 - DNA, 1059 bp, Homo sapiens
gcaggtcataacacctgcagccacagttcctggggtggccccaagtctggatgcttagggatttattaattttttgagcaactccagtatcttaaaaagaattcatccttctcttccttttgttgttgttcttcttttattcttatttttaaaatttaagcgaggtaaaatcagcccctcttggctacaggtactttaattactacaggagatcatagtagctacctcactggtcataagggttaaataagataatgtataagacagttagcacagggaatgagggaattgtcagggaataagtacctggtaattagtagcttttactattatctaataatagttcttgatatttacttagtgctttgtaatgtgaaccatacactcctgtgtgcttatctccttgacaattgggtggaaatggcatccacattttatggatgagcaaatggccatgctttggggtttgcccagggtcacaaagctggcaagggactgagccaggatccccactcaggcccttcgtcatgtcatgtatccagggttctctccaatgtgccagggtcgtgtggtttcctgggggtgtgatggagagggaggcagtttccctttcccattttagggacaagagtggagatgggaaagtactttcctggggacagaggatggaggtgaaggtggtggatttctttagttatggggagttaagttgggaatgttaggcctctagtcctttccttttctcttttcttttctttttttgagacagagtcttgctctgtcagccaggctggagtgcagtggcacgatcttggctcaccacaatctctgcctcccaggttcaagagattctcatgcctcagcctcccaagtggctggaattacaggcatatgtcactggctaattttttgtatttttagtagagacagagtttcaccatgttgaccaggctggtctcgaactcctagcctcaagtgatctgcctgcctcggctttccaaagtgctgttgttacaggcatgagccaccgcacccggtctgggccctgagtcagtttct

SEQ ID NO: 54530 - DNA, 1243 bp, Homo sapiens
ttgtagagttaagttccagagcctgccctgttaatgatggcactaaactgccttccagagaaggtcagaatgcatagctctttgtaggattgttggtgaaacttgcagagaaggtattttctgaactgatattcaaggatgagtaggaatttataggtggatagaaaaggaattgtattccaagtagaggaaggaatgtgagtggacacacagatggatgaaaatatataatgtgttcagggaatggctagtaatcccagaggtcaagagtggcaggcagtggttggctattacacttaaaaggttaaagctaatgccgtaagcattggggagctctcagaggattttaagaaggggagtctgtgtctagatacacttcaaaagggttcctgtagtagcagtgtgaaggctggtttgggcatgtgtcagaatcatttgaaagccaggagggcctgctggaaggcctcgcaatagtctaggtgagatcatgcatcggctttgggatgtggcagtagaagtgctggcttcttgtggttttgggggttggtgcttcacagagtgaagaaagaggtgtcacaagggtcattaaaatcccactggtgtgcctgttgatataggaggcacccatcttactctctaacggtgttctacaaactagccaggctgtgaactgttcattactgtttgggccaaaataaggggcttgcaccagaatataaatcaatgcattgcttccatcacggagaaaatcttggtgcacacacacacacagtctactgaagcaaaaagtgtgcttagtgacaaagttgatttggattctagtgcaagctcttatttccttgcagcccacaaacaacatgtggactttcaccagtccacaaccataaatagagtaatgctgctgtataatcaacatatcttacttgctctatacttcaaatatcttcttctctacagctgaattttgtagatgaaaaatttattttaaagtttcaacattttaagaggtttctttttactctacaggcaagccacttatgtaaaggacccatcttttaatttttgagttttggaaacttacatgagtacttaaccttgattaataattgataactctttctgtagagatgggccggtgacctcttgctactctccagcattgttaagtgctattgcctttcagacttcagattctttccaacctctaacacttgggccattattccttctccaaggttctcag

SEQ ID NO: 54531 - DNA, 3219 bp, Homo sapiens
tcatgaagatttttttccatgtcaataaatatatttcttctcttttctttttcttttcttttttttttttcttttttttgagatggagtctctctctgttgcccaggctggagtgcagtggtgcagtctcagctcactgcaacctccacctcctgggttcaagcgattctcctgcctcagcctcccaagtagctgggatcacaggtgcccgccaccatacctggctaattttttgtatttttagtagatacaaggtttctccatgttggccaggctagtcttgaacacctgacctcaagtgatccatctgcctcagccttccaaagtgctgggattacaggcatgaccaactgcactcagcccaataaatatgttctataatacgctacttaatgatacctattacattatattgtatggaagttccattacttacttaatctgttcttcctggacatctgatttttctttattgtaaaatgtgacatcttaaacatctttacatattcatcttcttccacgtctttgattacatcctttgtatagctcttagtagtgtttttgctgggtcaatgtttttgtaaataaaaaaaaaatgttaaagactttagacatgtataaccaaagtgccccagcaagagattgtaatccgcttacactgcctccaggagttttttgggagtacttgttttttcctaccctctcccaccagataatatgattctttttaccatttttaacccattggataggaatatattttcatgtttttatttgcatttctttggatttttgaggctacgtattacaaagctgttattttaaggcataccagagaacatgaaatcttattttatccatattttggttttatccatttgctttgaaccccctgaatcagctgccctgatggatagtttttttttttttggtgtgggcttggccatgatggggaacttggttgaaagatgagtgaagttaaggcagttcaaggatgtcatactttttagaagtaccagacaatcagaaaaaagtacagaataggagaaacaaagaaatcaaatacttaaaaaatatattcccccaggtcaatgctttgccatgaaaaggagaaaaaacagttctttctctctaagctgcagtaccccttggtcactgttccaaagcttggggcagaccatttgtcctatactatggctacatgtggatgaagtcatttttgtgtggtcttttaagactgaaggtactaatcacaattttaacattgcttctccagaaaaatactttctgagttacgaactttggggacacaaacctattggtcatttggagatctagtttcccttttatttttctaaattaaacattaaacaagacaatctgagctttgcctttttttcttttgggtaacttgatttcccaattataaataatgattatttaatgtctgttaattctttcacagtttagggtgaattctaattagccatctccctaagatatgtggtttgtggcttgaaaagttttctaatgccttccctccctagaactaatgactcagaactgagaaagactgacacagagcttcatcttctgctggggctgcaaatgctctggagattgcccacgccctcttgcagccactgctagatgaagatgaaagcccactgcccagacggcatcagtatttcacctgctcagtattgcacagaaaagtcttggtttgacttacagcctgctcattgctggaaggtcacagcactgttttttgatggagttttgagtagtcattttttctagtgctttaaacagattaaaatgtggttttatgggtagtcatttcctagatgcttgtgaaaacaattctaatcctaattgatggtagaaactgattcggagactcagtaaagaaagacatctgtgacgttcagttcaaaatagttaattattgattgatcacccaccagcattagcttatagatacacctgaggattaaacatgactttctggaacaaaataacttttttttttcctaaacataatgtacaagctgagcttaaatgagtgaaattataaaaggagataatctcaattttgccctatataagaataaaatatcagtcaaaatatttaaagaacagagatttctgtttggtgcaattttctggttaagaggttaatggaggggaatggaaagttattgttttatggatgcagaattttagttttataaaagagttctggaggtagatggtggtaatgattgcataacaatgtgaatatatttaataccatttagctgcacatttaaaactggttaatgcctggtgcagtggcttgagcctgaaatcccagctcctcaggaggctgtggtgggagaatcacttgagcccaggagttcgagacaacagtgagctctgattgtgctactgaactctagcttaggcaacagagtaagacgttgtctattaacaaaaagtaagaagaaaagaaggttaagatagtaatttttatgttatgtgtattttactacaatttttttttaaaaaagagttaaattggaaacaaaagtcttttaagagccttttggtctgagctttgacttaataaatacaatattaaatgaaattgtgcatttactaaatatttgagggacattattctggaagccaggtctcattttctaggactggagaagacagaatgtgttttggactcaggatgtgtttgtgaaagagcttaaaatttctttaggtgattgtgcattcctgtgatatgcattttctccaaaatgtacagaaagaaaaataatttgaaccctaattaattgggttctaattggtctgtgttttaggctctaaaggatcttagatcctttagatctttattaaatactggtaattcagtatttaattgtaactgatttttatgcaactgcgcaggagaagaagtgttcaggtgcagctttcttcccatccgtgccttccctaggccattgtgctttgtgttcttaagactcggtgaatgtttctgaaggtcagctagagtgcagaggagaattaatattaaaatgcatttaataaataagctgtcagatgattcccgaagataccataagcagcagaaagtcttctttcctctttcattcagatcgctgtgtacagagggaatgatggttaatatagtctctgttggcatctcctaacgggctttggtaa

SEQ ID NO: 54532 - DNA, 1201 bp, Homo sapiens
gtctgtgtcaccaccatgtgtggcctggattattgccacagtctactaatttgtctaccagtttctgcccttgttccttgagtcttttcctaacatagtcatgtaatgatcctttaaagatatgactcaggttcctcccttttactcagaactcctgtctcttagagtgaaaaccaaagactttatagtgtcctacaaaaccctccatgacatggtgtttcccatcaggatctaccttgatcttagccaaaagcccaagaagcgatcttatcctgatctcacctcatctccaacttatttgcccttcagtcactctgctctggccataatttcctcctttactcacttggccaagcatgctgctgcctctgggcccctccctcatttcctctggctgaaagatgtttttgtaagttaggtatttgtatggttccctcacttttcttcaagtctgaccaattttgccttattagagtcagtttcagacctgcctatattaaaatggaacccctttgttaatttcatatactgttttccccttaccatgctttacttttcttcactgcacatttcatcatctgacattccactaatttattttattggtttattatttataaagtgctaacaaatactttaatccaaactctttgggggcagggcccacattttgtttactgcagatccccagtgtttaaaaagaacctagcacatactaggtgttcagaaagtatttcttaaacaaatgtattattagtaaatctgagttttaaatatagttttgtcacttcttaattatgtgacactcagtaagttacttctcagattcaagttttctaatgttaaaaataaaggtaacttccgtttcatggagttgtttttcagagtagaactaacgtttaatcttcccaactaaagtgtgagatcaaatttgcactaaaaatatgttattattattgctgttgatgccgacgggagacagggaaatactgggtggaagagggcggttcccttacaaaggctccaccctcaagcctggatatccctgtccccaagtgagaacagacattcctgttttcatgcacaaaatgttgccttttagcccaccatgccccctatcctatacccatataaaccctgaaccccagactccagaagcagatgaggagacgaacagatgagaagacgagcagatgagcag

SEQ ID NO: 54533 - DNA, 1192 bp, Homo sapiens
ataaaacttttcataagaatgacttcatagaagtttctattctttttagagatatgattacctatctgctttcagtttacactattgcacttgtgtgtgtgttgtggggggtatcctctggtcttgtgcaattattttcattttagttactcaaatgaattgctgattaaaaagtaaattttgatggccatgtaaattggagatgattctggcttaaagggataactaggcaggtatttttgaaaattaataagcaaggctatcactccacataaacaaagcgattttttaaggaacagaacacttgatatactggttgatgcttcagtctggtgtggtatttgaagagcataaagtcgtaacatagattttcattttaatgggagtgttgtaataccttcataattttttttttttacttctcattagtttttacaacctacgaattacctaaaacaactttagtcatttgaattttgacttgccacttattttactatgtgcaaaattgtcccatttgagaaatggaatctgtatgtatggtattggtgtctatggctagacattaggactattacagagtttgcagatgtcactatgtctaatgcagttctaatgcagatctgtttggggttttgtttaatatatggttatggagaagtctagaaaggaatgacaatgaagtagtagttactgtaaatcttgtggtcacgtaatgaaaatttaggagacttttctgtacaccactttagctctgctctttgtagattgactcatctagaggagattttgtacaaatttttttcagctaatttctccagttcatttgtttattgatatagtattacattattatttagttaagcaaatggtctacaccacatgacttcaagcctcaatgtcttcttttttgttgttgatttgtatactaaatttcagaaatggctttttatggggaaggttggagacaaataatgactatatacacatatatttcacatatatatgttattgaaacatatgagtgtcatatatgtgtaagtggatgtagacaagtaatgagtatatatacatatacagtcatgtgtcacttaataacagggatacattctgaaatgcatcattaggtgattatgttattgtgggaacatcaaaaagtgtacttacacaaccctaggtagtagagcctact

SEQ ID NO: 54534 - DNA, 2678 bp, Homo sapiens
ggatttttcactcatgcatgattttgtaacatcttgcattggtcatttgaaaatatcagttcactgagttaatacagatctttgagatgttgacacatttcattatacaatatccaaaaatcacattccttaatattaccactcaaatatctcatcagaaaaggctttatgtactgggaagctttcaagcccatgatggcagatgtgagttttacaaaatccgaatttttgcttgaaaacaaggtttttatcattggcatcaatgactattagttgtttttcttaaagtgttaagattatttcattcatttagaagaaaacatctgccaactgcccacatataaataactttacttggttaattttcctttcaggaaaaaattatgttcatgaaaaaagcaattatttgagtttgcaactcaaacaattgcacaagtgcttttccttgtgacaaccactgtatttacgtgtgtagtagaagtgctttatacattttcccatttcatcacacagaatattaaaaagaatgtgtactcaaggtttaataaaattaataattcttacttctccttcaaggacattcttaattgaaactagtatttattttattgagagtacctggctgtgaagagtacatggctgtgaagaacacatggctactagcacagtttggagccactgccttaatttgtgctaaggcgctagcaattttactgaccattgcttttgtatatttggtgcaaatgtcaacatggttaaaaaaataaaaggcaaatacactttagtattctcacaaagacagttttgaccttgtggttccctagtaaggtcttagggagctcctaacatcccctactccccaacattcctccaggatcaagggcttcttccatgagcatgagttctataaaggaagtcaggaacaagcatgggcttggttggactgtacagttcaagaattagggaatttgaaggagtatgggtgaggaatagggaagccattaactgaggttggtaagaaggagaaaggtttttgcaaggagtcttagagctcagaagctcagattatgaggtgatttctctttaaggaaaatcaggagtttctgtaatttgttgagacaaaaatgacactgtccatgtgtttccttatctgtaaagtgggaatataagagtattattattgtgtgaattaatgtataaacagcttagaacagagcttggcacacagtaggtcctatataagtgttattattgtgaaaatggagttttgctctagttatatgatgaattggagcagctgttcttacacttcagtcagcagcagaatgccttggtgggattgttaaaatacggattgctgggccttgcttctggaatttctgactaaggaagtcggagatggggccatgattttgcatttttatcaggttcctgggtgatactgatgctgctcctctgggtagcacactataagaaactgaatcacaggaattcacacaatgaatactataaatatcaatagatacaactcatataagcaaaagctgtttgagattctcaatacttttttttttttttgagacggagtttcactcttgtcacccaggctggagtgcaatggcgcgatctcggctcactgcagcctcctcctcccgggttcaagcgattctcccacgtcagcctctcgagtagctgggattacaggcttgtgccaccatgcccggctaatttttgtatttttagtagagatggtgtttcaccatgttggccaggctggtctcgaactcctgaccttaggtgatccgcccacctcggcctcccaaagtgctattacaggtgtgagccactgtacctggcctctcaatactttttttaaagagtgtaaagggattctaagatgcaaggtttgatgcccttttctttcctagctactcaacaagccaatgcctcttattcatatccatgtatggaaagtgatgtctacttattctttcacttgttttcatttaactttgctcaagaactgaagtttaccccgtgtttttatttttatctgaacaataagctgggactgtaactggttcagtatttatattttttctagcatgtcctattttgctgtgcctaattgctattaaagccagatggctgggttccaaaaacttgtctgatttgccaacagttttactcacctgaacaattttcactggctctaagctccctgacttatatcacaggccatcattgccacttttctgaacttgccagaggtcttagaaatgtagactagttgttaagattgctgatgaagatgtgctaaatgaagagtgttggtagtttgatgattaccaatgatgttgattttaaatcctacattcacttaacaaatatgtgtgtgccaactgtatgcaaggctttgtgctgaatgctgggaaccaaaccgaggaaaaaatatgcatggactctgattgtcagtctgggagacactaaatcaacaggcaattataaaacagtacaatgtcacaatgtcaagggaagggcaggaagataattgggctgaaggggggatctaatccatggggggcagggaaggctttctagggtaagtgatgcctgagctgaaaacttagaggaggctttgaattcgttaggtaaagaaagcaggcaaaaagcatgac

SEQ ID NO: 54535 - DNA, 2258 bp, Homo sapiens
ccaagtggagattttcatctgtaggtagagttcggtttctggaacttaggagacagaactgagccaatcagcaactagagggtagttgaaactctgggcaaggctaattaagaaaggctccactgaatgggaaggcctggggactaagagccggtcctgggtgacaccaggtagatcatggcaagaggtggaggggctggtgaagaggagatttcagaggaggaaatctaggatgtggcagtgtcagacaagttcagaagagttagctctgtgaagagaagcaaagtttccatccatggctcaaattcttccctttccttcaacaaattcaagtttcatgtggttctagatgctcattagggttcttctgaaacgattggatcctccaagacatagaaggttatgactggttataaaaattgccacatttacctctggtataacccaaatagaagctctgcatcataaaatttagagttgaagacagatgctgtaacttaaaaggattgatgctgggccagactgctgaattctgtagaggctttataatggagacacatctttctaggcagatatcacttgtcacttccataaggaaaattccctggagttgatgagtagtagagctgtgcttctgctttataaaatccacttttgatgaaaaattaacattttaattcagaggtgtgtagctatcaccaaagggttatgatgtcatgtaactaagtctcagataccaacattgttcaatattgtataattttttccagagtggtatgtgctccagataactgacctttgaaggtagtaatgtattatttacatgaaactaaaatccagtgcattctaaatggctgtgatttatcatgaccattttgaaattgggtcctgtggccatatgctaatttgactcaaaggaaattctgtgctgtgtgcttggatttcatgcttaaaaaattcagcaatagtttcaatgctcttttaattaaaataagatgctttataacatttcccacatgatgtggaatgtactctgtagctcatatatgaattaaaacccttagaagatttacattttctggtctggcaaccttcatttttctaatttatgtgtcctgtttgtcctgaaggagttgggaagttgaaatttacagccatcccaaatgagagagttgagattcttgattaaatgagagcttgtttgtgtattcaaatggaaaaatgtgggtggacaaaattaaatttgtagtgggttatctcctgaacagttttctctttcctggtaatttcacactgcccaactatgcacatggtaagtatgggagaaaacttttttgtataataaaactttttagcagtaactgactggaccatggttgggcatctattccaagttattctgatcagcacctgcatctgagactttgtaattggctctatcatattcccagtatgccttttgtgtgtggccattttctgctatgtaaataggaaaactgaaaaatcaggtctgcagaaattgaagaatgaatggggagaagcaaagacaagcaacagagagaaagaattcccagtcattcctggtgcgctgcagtctccagtttctgtgagtttccaagacccagctcatccatgcctttggggtctttgaaagatccctctatctttcaggggtctttgaaaaacccctgtttatttcaaccagctcagatggttgcctgcatgtgggagcaatgaaataacctatattgcttagatttctattttctgattagatggtggctaccatgctatgtgtatattcttaaaacaagcccttgtacataaattagataatattggatggttttggttgagctggtctttggcttaaatgttattgacatttttctgaaaaaatataataaatataggacatgtataatctcacacaagtttgaaactatttaatagactcttaaaacaaaggaagggtgtctatgtagatgtgctgattggttccaggtctaggaatccaggccatttgcagtttgatttgtggagaaggaaaagagactacaatctctcagtggtggtaaggaggcaggatggagtggggaccagaaacgcctctgagatacaatgtcccaaggtccagtgtttttatgattgggaggaagactgctctaaaatctttgacatttgaagattattaataataaatgtcctcactaagttcctctgttcataggatagtaatacaaaacaaattgtacccc

SEQ ID NO: 54536 - DNA, 1511 bp, Homo sapiens
aataatagcttccctgcttaggaagtcagaatataggcggtagggagaaaaaactgttaaaaaaaacttcaaagactggaataaactacatttttgtagagctactatattaaaatataagaggaaaaagaagtggaaaagccggggagtggaaatcgcaggcctctgcagaaaggagataaacaagtgcctttgggtgggatcatttgtgattgtaacagaaagacatacaaaaagacaagactatgtccttagaagcagagtggcaacttcaagtttataattactaagaacccctatgtacacagcatttggcatatgcaaaatatattggcagatgcattagtaaaatttaactatcgtaaagcctctgggagcattgacttggtaaagtaacagaatctccattaaagcaaaagtaatgaactgactcagcactcctgagtaaagtgaccagatgtcagaggtaccctgaaggacacagagggcaaatcaggtgtattttctggctacaatcggaagggtggcacagagagaaacaaaaccatgaatacatctttgatttcaggtttaactcaaaggcagtgatatttacctggagagcagaggaaagcattgatgcttccaagccaattctttaaagaggtgtgggtggagagtgtgtgtgcatgcatgtgtgtgtgtgtgtgtgtgtgtgtgtgtgtgtgtatgtacatacacacatatacaattagctccaaggctttaaataaattcaacacaagtatttattcagacctttgttgtgtaaggcctccaccaggtcctgggagggaatacatatgtgtgtgaagccctaagctttgtttaaataaagctaagggtcaaagaagagtgaagagcaccccacctccaccccaagttctctcccccagcctcttccagtcatggctcttgggaaaccctgcagtaggaacagatgaatgtgtgtataagtagttggaaagggaagtagagatgatacttagacaacataaatgagagaagtgtgaagtgtttgcagtcagagtacctattcccaatagcctgcttttcatgctgataaaaccattcaatcttggatgttgagttcaattttttgtcagtgaaaaatctgcccagagtcttaaaaaatgcaagcaagtcatctgtatatagcctcagagcattgtattttcaatgtactgatttgctaggtatatattgaagtggcctttggaccctgagtgttaaatatggagatctgaatgttcttcagttcattttaattgtgacgaaatcaactattgaggaagaacacacttcctgatatagtctgcagccttatagagagccaagtatgtcacctttaacatataattcaagttcatttgttctgattaatttgtggggagttgcaggattggaatttagaatattttaagtgaaattgttggattacggattaaaaaaattacaaaagtcaattatgtacaagttctgggctaggtcct

SEQ ID NO: 54537 - DNA, 2721 bp, Homo sapiens
aacttgcaggctgtcctgatgatcattaaaacagtgattcagtatgaaagtgctttgcaaatgatgagatgtcacacaaatttagccactgtttggtcattttcactttatctttgaaagctcgtgtttatagctaaacatttggttagaagattaaagtctatgaaaagatttggatccagtaggtcacagcttactagaaacagaacagagacttaaaccatgtgcctctgtcttctggagttggacttttaccatgaggttgcttatctggatgaaatctgagggctttacagtctaactttctgagggagtcattcagggaacgttttagtgtcaagccattaaatcacacctcaaaaggttggaagtggcccacatatgagtccatataggtgggtctggaaaggtggggcgagcaggaatctctttccattatgatgatggggtttctaaagtaattattgctttaaaaaaaatctgcctctgccattttccagtcacactgttcttggagcgagatgcatcatcaatacttttcatactaaacgttctctcctattggatttacctggattctaggggtatttttttcacatttctctggagacaagtagtgctgataaagattttataaggtctctcttgctctcaagctcgttttccttaacttttcttgtcccagttaccagtttatttggtccccagaaaccttctaatcttcatctttaatgataaatttatcttttgtagttctcctgtcaaagcttttgtgtctagtggctcattttgcttaattgctggagttttctctggccttttgttatttggtcctgcgtattttcaaagattctgtagaattttcagactgttactctgatgtttacttggtagattgattgctaagttgcattgtcttcagaggaggtttttgaggttgtgtctattataatgtctgcttctacccggagtccattgcacttggagtgcttcttgaagcccctgagcttatgctgtgataaaagcgtgaatgttttactgtgtcaaagcactgtggctcataaggcttcataagctctggcttttatatcagagcatctcatatggttgtgcagattgcatcctggtcaagcatgccaggatgaggggccaagggtgtactgaatgccagcctgtgcttcatttgccaagccttgcatctgatgtaggactgtatcctcacaggggacaccttttcctaatacacacaaaggtatcatgtgggctagcagctgttctgctataacttagctaggtgtctttacaggagaaggtagtggaagaggtggtggtatttctcctcgggaactgagattagcttactcgacgggaatcttgaagtgtcccaagatgaagccattggtgccccactcccccaacagttgtttaaaagttattaaagaaccaattgacatttgctagcattttaaatgctcaggatgacttatgaggctatgtcagttattctttactcagtaggggacttggagctacaggtctgatttcagcctctgtgcagcccccgggccacccttcctgctgaatctaagccccactctctctagaggattatcttggggtttattttggctcctggctttgaatctgaattgctgcccctcaagttatattcaaacaactctattaagataacgttgtctccaggggctccaaccagccagtttcattttccaactagtttggttggtcagtgcccataacaggtccacttgaaattagagctgcgtttttttttttcttttctttttttctttttattattttactttaagttccagaatacacatgcaggacatgcaggtttgctacataggtatatgtgtgccattatgatttgctgcacctatcaacccatcacctaggttttaagccccacatgcattagctaattgtcctgattagagctgcattttctagaagtcaacaacatagtgtcttgaaagccttctttgtcatattgcagttgtgtctgagacctttatgtaccttagtttttttgggttttccttccccatgtgaaccacagttaccctttctctgactagtatgctgaagttatagtacatttctatttagcaggtgtttcctgtggttgccttttgttctaaatctatgattgaaccttatctatattgaaccaagtctaatatctatttgcctggacacctgtactaacataatatgattctttttgtatccacccttatattaatctggtaggatttccataacaaaatactgcaggctgggtggcataaacaacagaaatatatttcttacagttctggaagctggaaatctccaatcaaggtgttcgcatgtttgctttctcctgaggcctctctccttggcttgcagacaacttccttctctatgtgtcctcacatggacatggacttttctctgtgcatatattcctactgtctcttcctcttatttatttttttgagatagggtctcgctctgttgcccaggctggagtccaatggcatgatctcagctcactgcaacctctgcctcccaggttcaagcaattctcctgtctcagcctcccaagtagctggggttacaggcacctgtcaccacacctggctaatttttgtatttttagtagagacaggatctccaactcctgacctcaagtgatccacctgccttagc

SEQ ID NO: 54538 - DNA, 1034 bp, Homo sapiens
tctttttagtgtttctctatccccatctctcttacacacacacgcacagacacagactcacacacacaaatacgcatatatgtgtatgttttcctctaacaaaatataagccccacaagggccaggacttttgtcggatgtgtttgccaatgtatccccagggcaagtatagtgccaggctttcagaaatgctcaagcaataatttgttgttgaatagatctctgggatcttctggttccttggaatttcaccagtggtagcttgaatttcctattcaggcctggacaaacatcctgtaaagaatgccacctaatttgtatctttgaaggatgaatccaataatatgtgggtacagtgaccactttcaagcttttcttctttcttcttttctccccctgcatcaaacaggaacagcatcttctaaaaacaaaactttattcattggtcagcagtttcatgcaaccattgagtgaaatccaatgtggaaaggaaatccaaaactttactgcagtgtaatttgtttcttctgtgttgctttgtgtacagtaaaggtcaataatgcacaggaaagctaggtttaatttctttgatgtgtaaaaattagtgctttgtcatcagttacagtggcaggaggacaaatcactggcacataaagttgttcctgctacataaattacaaatcttgttcggaaaaaaaatactcacatcatcccttgttattttaaaaatgccaacactgataaacagtcagccttggacatgtattaaaatcttcaaattgtactaaaataaatttagccttttaagataacacctcattttaatttcatacatgattaaatccatcaattcaaaggtcttttaagatgtaagttttgaaatcataatagtaccctctaactccctgcgaaaaacttaaacctctttctacttcattaataatgttcttgacagacaaaatttttaaagaaaatcctcagctttgttttgtgtttttgtgtgtttttcttgagaagaggaaattaaattatga

SEQ ID NO: 54539 - DNA, 1278 bp, Homo sapiens
atggccattctgcaaacccaactttgaatagactatcaaaggttggggctggatatggatctgattactcaccctggccccggaggccaccttcaggcagagcagtcctgcagcctttccagaggaggcagcctcctgcccatgtcaaagaccttggaggctagagtatttgcccttctgctctaatcaagatctccttggaaagaaagctcaatcagcaaatctttattgagtaccttccatcagatagattctccagccccaagctggtatggtgaggataactatatctactgtaaaatacctgacctaaagaaacaatgcaacatgtgcatatacaattttaaaagaaaagctgttcaccattttctaaaggaaaaattatatctataatgtatgtattcacatgtttatttttatatatcaacatttatctgctttttctttccatgcctcccctctttccgtcctttcttttcctcctggatacatccattcctgcagcttaattcttattagctaagggttatattgcagatgtatgaattaagagcaaaggctttagaatctggcagatctatgtttgaatcccagctctgccacttcacaaaaagattgttctatttgttattgttactggcacttttattgccatcatttgtagtatagacaataattacttgtgctatttatgtttattagttatttaccatatcaggcactaagggatttgcatgtattttgaatttaatccttgtaacaattatatagtgtaggtagtattatccccattttatggctaaggaaactgccttgagattttaagtaatatgttgcccaaggtcacataataagtatgtaaaggaactgaaactagctttgtgttttgaacctacggagattctctttatcctctgtaaaatggagatactgattcctgccatggtagctagttgggatgattcaatgatatgggatatttcgcatttgcagtttggttccctgcatataacatatgctcacacaggatatggctgttcctgctctgcttctgctacctccttcaaggttgaataatctttctttcttctctcttagctatttcccagcccctcacttaagtttataactatattcttttcatcaacctagaaaaccaaatgaagcctgaagtattgagaactcaggaaatgtttttgaggtcccatgtgattcagtggcaaaggcagagcaggtgcagatgcaaacctctgggctcttagatgtgaaccctctgcc

SEQ ID NO: 54540 - DNA, 1040 bp, Homo sapiens
cgtgagactcaccccacactgacctattattcaacatttcctgatgcttccatacttctctgcctttgaacctgatgatcattctacttataatgtcctttcctcatccttagctttgcctgttgaaaccttcaagattttactccagagccaccttgtctggagagattttatttactttgtgaggaacaaaatgctgctcttttatcttttctcctcctttataacactcatcacctctccccactaagtttgtggacaaggaatgtattctgtttatctatgcattcccagcccagaggaaggtactggcccagagtaaatgctcattaaatattgtgaataaatgggcaaaaggatagaagacacattctttacttagatggagttgagataaacttagagagttagtgctagaatcaacattgccttcttgcaggcaaatgatttacataatctggacatcaagttgcctgtcccctggatgaggtatctcagtctcctatgttaaataatagtaaattgattctttcttcaacacagagtataacaaatacctctaagtattctaagttttatgaaacaaaagatttctggtgctggagattgattttggtagttataagcttctcaggatatctccaaagagacaaggggcctaggtggatagaaatatttcccttaaatcagcctgataaaaagttctccatggtaaggtagcctttgtcttgtattaaaacgcagttttctcaccaagtgactttggcaggttggtgaatcctttaagaaaaagagatctggtctggagttgtggtcccccggagatttagttgctattgtgatcatctgatgacagcagaaaacccagggggatcagcatggtttatttcagactgcagggatgtcagcctgttattataggagtgggagctacctaggcagatggatgcttcctgatttgtggattgggaacacgaattgagcagcagccaatgcagtgacacttgtaatactcttctgaagccctccttttttttttc

SEQ ID NO: 54541 - DNA, 1098 bp, Homo sapiens
agagatgaaatgatgacaaattgggatgagaggcaatgagtgttgtatgggaactacaggatttaagatttgaaaagaggcattttaagagcccatttttttgctttttctactcagcttaggaccccaattattacttactagcctcatttcactggacttcacccattcacacacctgtcacccaaaatactaccaaatattttctttaatgttatttttgcatttaatcctcatgaaggttaataaagtcttctctctctatgtggtatgaaagcataactgatgactttattggtgcagatatattatggctgcttttgacgtttatgttttccgtccagatagatgaatgattccagtgaaagtaaatcaattgcacccagactgtgggtataaaacaccacgctcagggttttccttcttgtctggcagatagtagagggtgtgaaatattgaaatttgacttaatgctgtatgtttcttctgaaaaagagaatttcctttgactatctcctaaggtacatctgtgattgatatttgccctgtcatttagtgccaatccagggaggggatgccccttttgtggggcctgtttgctctccaagggagccttcatggcttccttcggtctagttggagtaacctgttttttcttctagaggattgaattcaattaacagggattacaaattcagttattaggaatttatcagtgatggcaaatggaattttactggtgtattagtccattcttgcattgctatcaagaaatgcctgagagtgggaaatttataaagaaaagaggtttaattggctcactattctgcaggccgtacgggaagcagagtggcttgtggttctgaggaggcctcaggaaacttcaaatcatgttggaaggcaaagggggaacaggcatcttacatcgcaggagcaggaggaagagagagagttgggggtggggtgccacacctttaaacaaccagatctcacgagagaactcactcactatcacaagaacagaaccaaggggatggtactaaactattcagggaggatccatcccgcctacacacacccatttccaatcacctcctc

SEQ ID NO: 54542 - DNA, 1099 bp, Homo sapiens
accacaaagggcatgcactggtatggttggacagtttttaaagcatttatccatcctaaatgggcagtcccaatgcttgattagtagtgccagtgtaatgcctattgttaagtattttgagtagcatcctcattgctaagaacttcatctacagtatatcatttactctttttctttctgcattagtctttatattagatacttatctatgtatttatgtttatttaaataaacttaggggtacaagtgcaattttgttacatggatatattacagtagtggtgaagtctgggaggaaataccatttacttttaacaacaaccatatactttttgtatatataaagcacagatacatgtgcagtatacaaacagatacacagtatatctgtgatattaaaattttatgtgggggagcaattagaaaaaatgtctaaaaagtgtccttagagggacgataatgaaaacatttaagaattactggcaattgatatttttattaaataaatgtgaaaatataggttgagaggttaaataattagtccaagaacataaaattattaggtgtgagagctctgacttatacccaggtttgtgcgataatgaagtgtgtgcttttatccaccttaccaccttgcttccttgcccttcattcagctctctgaacctctgcttccctccatgtgctttactgcttcccatcctcccagatttctctgtaccctcccccggtagtggcctagattctcctaaactgctctgtcccccttctaggatctgagatcccacctctttggtttcattgttagtgaaggaatgcttcaagggaaatttctgctcttgggttggaggaatgagtgtttgcattttaatgcccattcagagacatttctcaaaggactgagtcttttccagtgggacttcaggatctctcacatgccagtgggaagcaatttggaactgtgtgctttgcaaacccgtgcaaatcatagcaggaaggccgatgcctatctctagctaaagccttatgtgctatatatcttcatgtgaatgtctggacaagaatcccctgctcttatgccataacctgggctctacac

SEQ ID NO: 54543 - DNA, 1052 bp, Homo sapiens
cgtggtgcctgccctgtgaagcatctatgcatgagaaacaggagaaaaatacacatacaaaataattagcaataatttgctaataatgtaatctattttctgttcactccttgacttagcatattctgacttcagtcaaccactctacttaaattgttctcttaaaaaacaatgacactcaccagtaacctcttaggtatcaaacttgatgattttcaaaatctgcatttgtagcttcgacctttcttctgggcttcatcctgaatttccccggcctgtcacacatctttacatagaaatcccagcagcacatctttcacacattgaaagtcaaacttctcctaccctttttttttatcgccttttccaccttcaacaatgtattctcctcctctgatcatggctaaacaactactttaattagcaaattctcccattatcacccgcatgtcactagttttagtccatttacgtgacttcctttctattcccactccttcgtgtaaactttctctttcctaaataatacaagttaaggcctcttccacacccaacttctctaatcctttgtctacattttggctagaatcatttttcaaaaccacaaactttatcctgccagttcttttttcacacatcttcagttattcttcagtgcctggagaataaggtcgaaatctttgagctgcttttgtagacctgctcattcttgcctcaacctctctttctagccttgtctcacatagcactaaacccttcactgttctctcctcacatcatggtcatctgtacatccactctctttcctctccctgaaataccctttcttttgactgtttggtaaactcttagtcattctataagttccccaatccaaagtgaacttggaaagtcttccttgagatccacggcaacttgcgtagacttctgttatgattcttatcatacttctttgtgcacaaatttttctcttgctccaatcccttactcttgtctcctctgatgcatttttcaatctcttgctcttgtttattcctttctcaaactctctc

SEQ ID NO: 54544 - DNA, 1049 bp, Homo sapiens
attttaccacttccatattgtgttgcttacttcatggtattagaaatgctgttggctcactatactagaatattatcaaccagtattttcataggaaacaaaaatatagacatacacacatatatacactaaaagaatggaaatctgaaggaaatagagaggaaaatataattttgtctttaaaaaatcccagaagcccttagactcccatgattaggattatattcaacttatacattcttctgtgtcattcttccttcagtaaattaggaacaactaatatgctctgcctcctttctgaataaggaagtataaatggatgttactgaattccctcaagtcctgggcaaatacactatcacaatgtctttggtttgcatgaagatggaggcgctcatttataatgtgaagcctttcaccgttaaagcttcacgtgaacccgaactgacacagaatcaaagctttcatgagagcaagatggaaagagattatgtcaacacaccccatcccaaaatgttgtaaagtgccagacttcttagggtattccatgacactgctagaatgtttctcatattcagtcacgtagatcattcttttactatttgttttcttttagatgagttcaattggagcctgcccgctatggaaaattattgatgcaattacattaatcctgatcaccatggtgatgtatagttataaaattggcttaaaatactgtaaggcaggaaaactaggcaaccttaactcttttagcacaggtggccctctttgcagagcattctgactttcttagtttccaatattctagcagatggcatgggtagttgggcacaatcaattttcttgcattgcctcacatcttccagtgagattttgcggaagaatggtgtgtgcaccacagatcttgggatcattcaaaggattctcaaagctcctcaatggccaatcagcagtgaagagggaaatggtggtaaatgaggtagaagccctctgtgaatgaagtaatgttctggaaggggctatgcatttggattttcattctggta

SEQ ID NO: 54545 - DNA, 1407 bp, Homo sapiens
tatgtttcactactttgttgcctacgtagtttctgaatgaacttgaacttgcaacccctcgtttaaaaacttgttcctgttatgaaactgtgggtgcttatgctaaggacttaatctttctctcttgcgtgggaggaaaggatatctataacagaacaataattgtaaactagaagagtagaaaaaaggatgaaagaaaagggcaatataaaaggcaggaaaagtaggggtataagaaaataaaataaagatcaaatacatttattactatgagagcttctatgcgggaaaaggaaaaacaaagtataataatacaaggcaaccacataattaaataattttttcaaaagactgtcagtggtaacacacacacacacacacacacacacaattaggaaaagctacaaaagagccccaagtctaacttggcaaaattgaaagtatgtgatagttttaaaataaaaattaaaatactttaaactagtttaaaaatatatctctacttcatgtacatctgcactgtttgacatgttataagaagtgctaaattatcttaataatttaagaagaaaagaaaagtaatggtcttccttctctctctccaattctaattccttggaatagtcgtttctaaatagattgcagatatgttcacttttcaacattgcttatataagagaaggcaaggtatttagaatttttcttgatcataacaaaaagacactgaaactcagaggcagcaagaggccccattatgggggcaaagagtagcagtggaaatgaaagtgagttcctgaacaagttgcttccaacagggtaggtgtattttgaagtggcgttgtaagtggcaccctactgcttccatgagtttaaattgtatcaactgaatataaagtataagccaattttaaaatgagaatttgtagaattcatgtgattagattagaggtttttaaaaagtaatatttgaattttgccaggggggtggggtggggtatgtattatgtgttcacgggatgacagcagatatcttcaaggaagtggtttggagtacattaagttctgaacacataaaatgactttttttttttttcctttttggtcttcaggagacttgagaaaacaagtgctgtgtaagttataaacaggatgaatggaatagtgatttcacaggagttagaaaaatactccagtcacaaaagttaaaattagagtaatctgaggcattctcagtactttggataccctgtccacattcagggctactgattatatttccaaagaaacttataaaaccagatgtctagctggcaattggttttgatgaatctccaaatctcagcaatgagaaaatttgacagttgtcagacagcagctagctattacgagtgagccagggaattttct

SEQ ID NO: 54546 - DNA, 1133 bp, Homo sapiens
tgcatcatgtaattgaagaaatagaaatcaccaggttacatggcagacctaaaaaaattcagcaagtctttttgaatgtacttgtgactgtcaacatttacattgtccaaaattttcttgtcaggtgagggcatcaaagaactcttaaacgctttcaaatgtggtgggagcatcttgcttctgtgagaagatttatattctccctaccttctcaattctgtttccctatcttatatgctataaacaaaacctcgctcacgaaaataaaagatgaatgcatgttctgaaagaatacagaatcatgacagctgaaatggtcatggtttcttttaggagatgaaaaaattaaatacacaggtgaaaacattagaatgcaattctctaggttaccatatgcttacaaaaaatcaaaaggagctgcagaaatggaaatttctaatgacagaagaaatcaaacagcagatacagtagagactttagagataaatgggtgtcaatagtggtaagaacacaggttcagaggagatccaatgttccatctaaatcctggttctgtcactgagtgggaatgattacttgatctttctgtgtcctcgtttcatgtgacaatatctatcacatgcagtgttgggtaaaacacttagcataatgcctggcacccagtcaatgtgcaataaatgttggctattatcatcatcaccacctccatcatcatcattctctaataaaagttaagcccttctctctgttgaatacacccatcagttaataccagtggctccttttaaatagcttaaaagcaaccaacattctatagatttcagtggggaagattgtaagtgaaatgggtgttgtgacctttcttgaaaataacccttctctctattagtatataaatgctagtgctgagtacacatactctgaagttgaacttaattaatttggggcagtagcattttcactgttgatgagcttgtatttattttctttggtttacaaagcagctggtgttgtccaaaaatttagaaacccctttccaaaatttaaatgacccccttcattcccttcatttacactgttgttctagaacctgggatgacactctgcagggtgaatggagactggtccctctg

SEQ ID NO: 54547 - DNA, 2386 bp, Homo sapiens
ggccacatgccatgtgctgatcagcaaacgctgttgaaggattttgaaaagactggaaaaaagaaaactggttgtctagttatctgaagaccctgggctgtgtcacatccactatgaatacaccctccaaaatctgagaccttgttaatgagccctgtcttctctcccagattctaactgctcttcagcgttgtgacttagaggggatgccgtaatgcatgtgtgcctggaacccagggaggcagaggtcctctttttcaccctaatgtgaagcatgaagttagaatcatctctgtgctccctaatagagcctcatgcagagctgttatcattctggataagggattcatgggcatttgcatccataccccccaaatagtggttcctgagaaaatttctctgacatgctgagaaaaaataaagaattcataaagttgaaattattgaacttattttgatattaatgtacttttttactctggttgtcccaaaatatctcattgggtatatttacttgacaaaatgaaaagttggcaactggccaggcacggtggctcacatctgtaatcctagcactttgggaggccaaagctggtggatcccctgaggtcaggagttcaagaccagcttggccaacatggtgaaatcccgactctgctaaaagtataaaaataagccaggcatggtggcaggtgcctgtaatcccagctactcaggacgctgaggcaggagaattgcttgaacctgggaggcggaggttgcagtgagccgagatcgcaccactgcactccagcctaggtgacaagagtgaaactctgtctcaaaaaaaaaaaaaaaaaaaaaaaaaagttggcaaccttagaacagttcctgtcatctctctttattgtttcatttctaaaagagtttcatttggttgctacccagttataatgaaactgaaatccacagtggtctgtgaaatccaagtctgtggccagatttgagccacaccctcagttaatgacagggccgggagagggagggaagggtggaaatgaccaggaacaccaggtacagatagaaaatgtccatcctcagtaagacgggtcacctctgtgaggggtacgtgtcctcattcagtccatactcaaaagagatgtatccaaaagctgttgtaagcagctcaggttttgggggcaggggctgaccttttctagtctttgaaagataatgtattactcttgagaaatgtagaattttattgtcagtgtgcttgaattcagcaaacagacccggagatgaacccaagggacaacgggctcaaagaacatagatgataccatggaactttgacctatttcatatgagcattcctgggcctgcatttgggactggctgccttgtttgttttataaattgatcctcatattgattccttacttgatggctgtggaaaagaagtctccttcttgtttgaactcatgtctttgtgagctgcctttatgcttattacataaaagtctccctgattcttgttgatttggcaagagacttccttgctgagaattttgcgggctgtggtatgggtgtaaagtggtttgctgtaatggaacagcttccagaagagaatccggtctccgttttgaaatgccacttcttggaaccagaagaatttattctaggagggagaaaagaattattgataagttcataattattcacaattatttattgagtacccactctataccaggttgtattttagacactagggctatagtaaccactaagcaaaatgcacagaaatgcttgtcttcagtggtcctatgctttattgggacaaaacagatcagaaacaaaataaaactcacaacatataagaacattacatagtatgtgagaaggagacaattctatctggaaagtctagcagagcaagtgtgatcaagagtttacaagaagggattgctgtttaaaccagggaagtcagattaggtgtccttgattaagtgatagttgagtgacagtgacaactttatttatgctttagaaagactactctggctgctttgggaaaagactgctgaaaagcatggagacctgtcaggaacccattgcaaaagtccttgcaggcagcttggagcagggtggtggcagtagaggtggtgagaagaggttagatttgggatgtatttcaaaagcagagccaatgtggatttccaataaactggaccttttaataaagctgagagagactttacagatcatttagaccccttccgaggccaagtaggtagcacaagggagtgaaactagctgcatgacaatagaggctcttagaaacagggtgcattgtcttattacattaaaaaaattaaagccgggcgcggtggctcacgcctgt

SEQ ID NO: 54548 - DNA, 1037 bp, Homo sapiens
ccatgggttgcctcctgcccctgaacgcccccatccctcagtgacctctgagcttccacagtacccaagagtgctccggaacaatggtaagaccactgagctaggaactagctttgttttgtttgtttgtttgtttctatattattatttgttgatgttacagagtatagaaaattggctttttttctttaaaagaagaaactatgttttctttttttaaaacaactcacattgagctttgctatactactttgttacctgaattggtaatggttttctttttttctatgttataatagaatctttatatttaaataaacttaaatactttcaggcgctgtggtctagagctcactgaaagtgttatgtgtacatgagcaggaccctcaagagccaacctgtgttttttgtctcattaacttggaggaaggcatgaggggtcagggcctacaatatcacttggaaacaaggaatataaagaaaatctggcctgtttggtaaaactgtgcttctccatgtcttgcctcttttgatctcttgcctaagttttgttttgaaaggttaacactattcatcttgtcatgactttaaataatcagattacttttctatgcaacaatgctctgtttttcctaagtttcctatttcttcagtgattctggggtgggatggagagtgaatagaaatacaggcatcaactttagtgttttcattgcaattgttttatttgtgcccctcaagttgaacctctctgaatgagtgtgatcatatatctcacatacttggtgttttttcttcagatgttgggattcaaattgtttggaaatttcacatgttgtaaacctaacttagtgacatcatgtgaccatgtataagggaacctttatcattatgttattaggaacctgatctctttgtcattcatctattttttgccctggcttgttgggattggatcaaaccaatggaaatgccggagaactgagttagaaatgcataggatgttaaaagaacagaaatttatgctttaaagtatt

SEQ ID NO: 54549 - DNA, 1039 bp, Homo sapiens
gccaaaaaagtcattgtgcagctctgacagattgaatgaccatgagagagacacagaatgacaacctcctgatagatagatgcagagagattggcagagaggaacagagacagaacagcgagaaacagatacaggaagatacatgcagagtgagaaacagggacagagagacagagggagatgaaaacagacacacatgcccacacacaaagagagaaacaggcagacacacacccccgcgccccctcccccatctggacccgccccaccaacatcctgacagatacaggaaggcagagagaatgagacagatggagacacaggaaagacatgcagaactagactgacagccataggctaagatgtcacagggaacattctactggaaggaggcagccatcagcttggtcttacttgtttcagcctcccaggatcaaatatgtctgaagagtaacaggcctttccatccactctttatttttagccacagaggaaacagtaagagagaagagggcagatgcttctgtttaccaggattttaattggctacctttggagcctgtgggcctaagctatgactattgtctagaagctttgggagaaaggtaaaaccacagtgtaaaatcacagtggaagcttggagctgaaatgattattgtatcttctctaaccttatacccagtaatgatgtgtttgtaaggccagtggtccaattttttctgcagagtgaacaaaccagtggctcccccactacctccatagagatgttttaacacagacacattctaaacagcaaactacatcggacgccagtctcctataaatgctagagagtaggcctcctcctggcctttatttttccatgttcctggatatatgagagtctcaagagggaggtttgatgccaacccctgcccttgaccttgggcaaccttcttcccctttgtgggtggaatgaggtgccatgacttgttgcttttattcacaaagtgcctcacttgtttatatgaagccaccggcctcatggccatgcctcagc

SEQ ID NO: 54550 - DNA, 1027 bp, Homo sapiens
taggtactaaaggagatggagaagaataacctatgaaaccggcttgttttgagcaggaaaggaggagatggatgttctaagtgaccgccataacttgaaaataaagtggttcctggggcctactaaatgtttaaatttcagagaatccaagcttctttttgatgagccttcttcagtattttacaacggcatatcgaaagggtttcttaattaaaatccccagcacgttggaggggcgggctgattgaggctgcagtgcctgcaggcagggtgcccacctccatcagccacgccagccgaaggggcatcctgcagctcctctgtcagagggattcctgccggagcacctcctggcagagagcatgaggcccggccaattcaatgtggcctcgctgccccagcccagccgggacactccccaggacccaattagcagattggaaatcgcatccaagtatgttacaatcaccaagttaaagaggaataacagacatgaaagaatcaagtgggaaaagaacattttggatcccgaaagagcaggctgcttgtcggagttctaacgaaccgaaacaaaataagtagtagctccttaagcctcttttctaacactgctgggattggttagtgtagagaaaagcattgaaattgcaaaagaaaaaaatgcttattgttcctatgttcaatttgttatttaatataacttgttttttaggaatttaataaaaaaaaagggagggcatcattaattttacattctgcaagaaaatgaaaaatgatctgctgattagtgatgtgcaatttgttccttgaacatctccagtaatgtgtgaatgtcacattacataacacttataatgattaaaccagaagatgaaataagataggatagatcttgtgttctttccttgactggtggacaactcatctcattaatctctctttggcttgcagccttaaattgaataagccgtgttactgggggagatttatggccaaaagacttagcagcctcactgaggaaatctta

SEQ ID NO: 54551 - DNA, 1112 bp, Homo sapiens
tgccatgtcaatcattttgtgcttcctggtcaactaaaacctcaggtttttcttaagtaatataaaggaaacatttcccctcatcttttattggagtcatgttttccttttaatctttttaactgaatcctacttaccattttcaattttaatgatactgcttaaccaatctttctaccttactgagagtttttcaaatgctgattttgccaataatgctgttaccatggtgttgtatcttttgcagatttgatcaacagtactggcatcagaaaaacacagatgctttggtaggtgtcatcagggtcctcatctctccctatgctggcattgatctatcaccttatgtgatctttagccccatacaaattctcatatggcattagaagtaactttagaaaatattaaatccatttgtcctctctattgatactatacatgaggaaactgagtcccaaagagcccatggccacattactggttaatagaaacactcatattagaactaaggtccaagtgacaccaaaggcaggtgtcctttcctgtttatcatagctgccagtctttatattattcacaaggtcaatgcaagaaacatttaaacatctcgttggaatcccaacatattgtgataggtttcctattacgtgagggttatgtaccactgtcaattagaagataaagcaaagtggtggccttttttatctcttattctaagatcttcagtaaaattccttctgtttctaaatataaagctttaaaacaggctatattgatgttgcgaaagaactggtacattataagtagaagtgtgtgtgtatgtgtgtgagggaggggtatacacatatgcacgtgctttatatcataattaaagagtggaagaaacaggattctttactggtcaatgaaaacttttcagaggaaggcaaactggtcatttatacaaaaccgtttgtggagcatgtagacttcctttgcactcactaagaaagcactctttttaacgagggactatacatttgttcaatgaaaagaaaatagctctttgtaccttgctaacggaattgctaactattcttcagataggagtctcattgttcccactattcagt

SEQ ID NO: 54552 - DNA, 1039 bp, Homo sapiens
ttacatttctatgcaaacgaagacttggcccacaatcagtctgattggttgcagacagcagttaatcagaggctgaagtgaagtttcataggtcacactcccatgcaagcatctgattggttgcaaaaagcaaccaatcagagatactttccattttcaatctgccacctagaaaaagtggggttttgcaaagggagtggtctctggtccttttgttacctagccagtggaaagttagggtttttctttcaatttagtcctaggaagtcagcgtgaaacggccttaggttccctgcctccagaccctattctcttgcctcattagtgtaacttgaccacctgagtctaccggtacacccctggtgagaatccacttttagctttgtaaagtacttggcataatgcctgatacttgctgagtacatagtgagctgttgcaagtcccttccactaaaaaataagctattgtccttatcagaagaataggatactcttttgttatctatttctcattccatgatataggattctagctttaagtgttgtcaatctcagacaagagttgattatctaaaaaatatggattcttgtaagccttttcattatgtgccatataaaaaatgttgctccaagcaggtttactagtttatcaccattcagatttacaagttctatcaggaacttcaaagcaatttcctagtaaatttcctagtaaaaagtccagtttaacaaatgtttaaatttttctcacttctctttatattttaaatttttctcacttctctttatatttcacaccctaaccctctccctcactttcccattccccaccacattcacctcaaatctacacagaaatcttaaagtgagatgaattaagaaaaaaaaagaaaattgccttttttcttttatgaaaaaacatatttttataataatctgaatctgaaatttttgaaataatttaggacttatatttagaaaaaatcatttaatccctctgtccttccttctttctctccttcattctttcatttcttcc

SEQ ID NO: 54553 - DNA, 1092 bp, Homo sapiens
aagtgtctttaaattatgggaatgatgggactttacctctgttagagtggataggttgggggtcaaagcatggtggtgaggaggggattgagcaattagaaaaggtttcctgtcattggaaatgtctgattggggttttgcaaactgaataggagtgtacaaggaatatagtgagataaggaagggtggagatgcaatggaagagttcaagaaagcagctctgcttgctctcagcagcccagcacactaggacaatttggtcaccaaataattattttccatttccaggtaaaatatgctgaatgacagaatccttcgacccctatgaaagaaaaagagaagaataaaggaacctccttctgtgactgcctttggttgaaagtcattcgttcttctttttgtttttttaatgttttgtagagaaagtctgtgattgctgtgagcttcatagcagcgttccttttcctgctggttgtgcgtcttgtaaatgaagtgaatttcccattgctactaaactgctttggacaacctggtacaaagtggataccattctcctacacatacaggcggccccttcgaactcactatggatacataaatgtgaagacacaagaggtaagatcccagagggttacctagcagttggagagtatccatggtaacagcttttctttaggagccagagggcttccaactcactgaacttactctgtctgccccggagagcttgcttgggtccctgacaacatcttctgtcttattattcttagacatttactgacaaatgtctaaatctgccacccctcctacattaaatcttctgattcactggcttcatatggagtcaaggaagcaattacttgttttcctggtggtttgtggcacaacgtacatatctctccatttagaagctctgattagcagttaccagctggagaactagctggcttgatttcctgtaggtcaactggttggggagagctctttatagaacttcaaaaatgcatttatactccttaaaactctgtaatccttagacctggagctagaaaaggccaagctgattttaaaatttgcagtggctgcagagat

SEQ ID NO: 54554 - DNA, 1106 bp, Homo sapiens
attaggtcaaacatctagtggacactgtggagtgtagggttgcttaggagcaaaatctgattctttagttatcttttaaaaatagatgactctggtccctttggattggcacaagtgaaaatatagctggtttgtgaatctatgacagcctgccctgaaggccccacatatagtaaattatacccagtttaagctctgcttcattttatcaattaatctgttttttttaaaaaaaataatctgttcccaggggaaatacaaaaattaaaataaaaggaacacaggagagatgtggttttgcttatatttcaagctgtttatttttttccctgatgtagatccataaaaaagagcatgtgaaaactgtgatgactattataaaggggttaaatagaaagatcaaaatattcctcccactgtaataatgatgatctaaatataacagagttggtgattggctttaactctttacctttacccagtctccccttcactttctcaatgagtgtaagctaaggttcttttctatgggggaggggaagtcttgagaagcagggaagaaaaatgagtgccaactaactgggtgagtgctgaaattctgaaagtcttcgctggccacggagccccaaatttctcatcaacacgtgtttaagctgatagcaaccatgatttcaaaccaaagcttggatcaggagtgatttagattttgcaacagaccctgccctcgcctccctgctgtgtcattaccgtgtctataatgcaatcccccattttaaaaatgacaatgtggagattccacctatagcattatggcagaattactgtattatcaactggctttggatatggtaaaaagtatatgtcacccatgtatttttccagaaaaaaattaaaaacagaaacgtgcttcacaatatcctaaaaccctattttccccttgaaacaaatgctatttattttaaattattaattatagcagacagaggaggtataaaggactaaggtagtccagggcttggttcaaggtaatcttgctttctcctgttgagatcatggcagatttttgggaaaaaggagaaaacgaacttcaagctaggttctatttg

SEQ ID NO: 54555 - DNA, 1041 bp, Homo sapiens
tactctccaccttccctttattagagaaggtggcccttccttttgaccacaagggtgagcagaaaagtcaggctagtgattggtcaatcaagtgattggttgaggggtgggctcatggcccaagatgagccattctgaagccttctcaaattttattatgtttttctgggacacactggcaggaaaggcccccttttctctggtggtaaagctgttgggatgtgattctctggatgtcagtagctgtgttcccaagacagaatgagacaaagacactgagagaagcagaaacaagttgcaaggctaatgtgaagacccagacaacacttcaggtcctgagctcaattcttgaaggcagcctcccctcccatcccccatggtttgggtgtataagccaatatatttgtcttctttttacttttgctggtttgaactgtttttgtcccttgcaaccaaaaaagtcctagctgatatattgtagttattttacagccaccaccaccaaatgttcagtaactcatctttaaacaaggtgccatctgaaggaggagaggagtagtctttccaaatctgcactctcaaacctgctggggggccaaacacaagtcacatccatcagtcagtgcaggtgtctgcaaggggtgaacgctgtctatctttctgcttaggtgcatattgcttagtaaactagcttatccttttgtggtagaaaaatgaaggtcaatttcccaaggttataatgccagaaaatggctggacaagactgactactacctgaattgctagtcgtactcaactgataaatcatatagtttcattataattgttagatgaaaatttctctattgctgtgaggcatcagcagtcaaactagattgattttcactttacaaatcacattttttattgatgaaaaatccattattatcataggttttaatgtagtgatcggttcctcaggaagatataccgcagttttatttattacagagccttaggtagaaaagtccccatttgccaactatcttgttaacgcacttg

SEQ ID NO: 54556 - DNA, 1062 bp, Homo sapiens
tagccttacaaagccttattcacaaaagaaagatagccattacagaatatttcatttcaaaaataactatatgcttttatatcaaatgttatccaccactgccccccacccccccacaagtttgggaaatagtatgtctggttaaccgagtcatctgactaataggcatttgccaagtatttaataaatggattctttatttattcatttattgacatggagtctcgctctgtcacttaggctggagttcagtggcacgatctcggctcactgcaacctccacctcctcggctcaagcgattctcctgcctcagcctcccgagtagctgggattacaggcacctgccaccatgcccaaaaattttgtattttgtaaaaatacaaaaattacctctagaaataccctgctgtggtgtttcataatatgtgtatttgagtatttgctctgttgtcttcttcaaatatgaacatttatgaatcccaaagtatacctggttcaaatgattttagataagggattgcaggcctgtgtcaaacacagactataaaaatgattaagaatgaataaaatacatgggaagcaaagttctagcaaaaataaaatatctctgaaaaataattgaatataatgactagaaataaataaataaaattgtaatacctcagtggttaggttaaatgacagtcactgtgttaagtattttatgtgccattttcttttagctcttacagagtacatactattttactgatttaactaatttttcaaggcccccaaagtattgattctatgctagtgtctttcattgtcctgtgtggcaaaacaagaacctaagactatcctagtcaacaaattcctttaaatggtttcacagagtgtctgccaattcatgaagtcagtaagttcatggaatcccatttgttgaatttactacatgcaacgcactgtgctaggctctgaaattgtaaaaaagaaaacactttttgcctagggataaataaaattttttcataatgttaaaggctaataaagaaggtagaataacatgtgaaagattattt

SEQ ID NO: 54557 - DNA, 1049 bp, Homo sapiens
tacaaaattattatcccatataaaagaagaggcagttgaggctaggataggtaatacaactcacccaaagtcacacatgctcaaattggcaggactgatatttgtccctggctccaaagccccaggttttagtcatataatcaattacacagaaaggacatccaatatgctgatacattattcttcagactggccttacttcctttgctcgggagtcacctgcctataactctcatatgtgatttaatcttgattgtttttgttgaattggggaacttcacgaatgagaagtagaggagttgagatttttactttctggcatgagctaccgttaaactgattatctcgctgcagtccacatctggaccaagtacaaaagtgaagcctgacttcttactctgtggtgctgataggaataacagccacaacaccaccatttttgccatcttgctgatgaattgacctcatatttctctacctacatttttcaaaatagtgctcttttatgagttactcaagccccattttaaaagcagtgtggttgataagtatgtttcatacctgcttgtactgagcttttttaaccttgtgctcttgaaataatatgagcttttggacactatgtattcagtacagactttcagagtgaaaatgttgattttcccaaattaaagaactaggggatatggtaatatatgctctcaattttgaattaggtggaaattgacatcgtttgtcagaaatatactgaggataaaaatgaggtaaagttttaggtgctgagctgtgtgccaaatagcccttgtgtttctttcttgaacatctacttcaaagaagcagatttgcctttgatatccctgggagccacatgaatatgaactgactccaattgccctcatcatctccagaatttattttttatttttttagggcatgagtctgtggtcaatttgcttatttgcttctccaaaccagcatgatcattataattctccttttcatgaaataacccactctcagcctgttgttaatcctacctagaggttggg

SEQ ID NO: 54558 - DNA, 1088 bp, Homo sapiens
gaaggaaggagccatgagccaggcatgtgggaagttcctaggaaaaagaaaagacaaataatcagattcttccctagagcattcagatggaacacactcctgctgataccttgattttaacccccaaagactcattttatacttgtgatctccataactgtaagataaaagatgttagtggtaatttattacagcagcaatgggaaaccaatgcattaaggaaggcatttttccttttgaatgtcccactataaaatagggctttatccactataaaataggtgttgctcatttatttgttcctttattcattcaacaatcatttattgagtgcctactatgtgtccaccattctaggcacttgggagagagcagtggaccacagagaccaagcaactcctctaatctagtgacaggagactgataataaacttccaaaaaaatacagaaatctacagtgataaatgttatgaattcaagtgaagcagggtaaggcaaccggagtccacatctatttcttacaaatcattcagagcaggttctgtgataaggtgacatttagcaaaaacctcaaggaagtgggagagaaagtcatacagatattcaaaggaagaatatttttaatagaggaaatggcaagaatacattccctgagctaggagcttgattctgagattcaaagagcaagggaaccagtgttgataatgataataattacctcacaaggctggtatgagaattttgggcaacatacatgaaaccccctggtgaatttcaaaacactatgcaagtatttagtcatcattgcatggtccctcggagtgcattttgggggctgccaagggatgtgtagggtgacctttattttgtgtctatataaaagcgaaagggaaatagctattggcctcaggccatggaaattatgcacagaggcctagaaataggagtattttcccaacatggagctgatgattgatgatgattctatgtgtgtccttcacagtggcaaaccttcaaggggcagggacatcattgctgctgtagtccttaaaccctgtggtccagaagggtgctcccaaggtgccaaa

SEQ ID NO: 54559 - DNA, 1110 bp, Homo sapiens
ctctttttagaagtactgccagcacaatgctgtctatgctccaatgcttaacaaaatttttagtgaaatgttgcttacctttttgatatatcttattatcatcctagagcccagagaagtgcattagattaacatggaatcagaatccgatgtaaccagaataacttccctccaccaagactaatgctttgttactgggtctaaaatgttgggctcagttcttgggaagacttacttcccaggaagctcctctgtgtctcttaggctcacacttcaaggaggctgctcattaatttttcaacatgctcaggtatcactgtgaatcctggccagagcaagctggtaccttgactactcttttttcctcttccacttgcaggtagaacaacaactaataacaaatgtatatatgtagctcactatgtgccaggtattcaccatctgtaagtgatttaccagtagtaacttaattgaaccttgtggtgattctattgcattatctttatttcaccaaggaagaagctgaggcacagagatgttagttacattgcctaaagtcacacagctagtaatgatggagctaggaatataactcagacactctggttctgagtaaatgccctaaacccatgctgctggtgctgtgatagctgagtctcagcctcttcctttctcctacccctaaagaatatacagtcttcattctacccacttctctctcagaatctcagaaactaggaaaaaaggaggggtagaaaacacataacagtgcataacttatggtacagactgagacttgaggggaaatattcagagaccactttagatattaggcaatgctagctctataataagtagaaaattccaaattcaagatattctgagccttgaaaatcatgagggaaataaaaatgcccttgaatggctatgctgctttctctattcaaagagctagcttggaacactaaaaggatgttcttattcactaagtgtttttcactgtttgagtctgcagtggagttttagccacaaataaatgtttttcctaaaattgaaatcaatttgtaaaataatgtagaaaatataaagcctcttgctgtttttctcagt

SEQ ID NO: 54560 - DNA, 1052 bp, Homo sapiens
taatttttatttgcaacacggaatagggagaatccttgtatgtgaaaatgaagtagcttcctagtgcaaagctcaacgaggtggccacatttttcatggttggttcctgctgcggtcctgctgctttatcactgagaaaaacagcaagaggctttatattttctacattattttacaaattgatttcaattttaggaaaaacatttatttgtggctaaaactccactgcagactcaaacagtgaaaaacacttagtgaataagaacatccttttagtgttccaagctagctctttgaatagagaaagcagcatagccattcaagggcatttttatttccctcatgattttcaaggctcagaatatcttgaatttggaattttctacttattatagagctagcattgcctaatatctaaagtggtctctgaatatttcccctcaagtctcagtctgtaccataagttatgcactgttatgtgttttctacccctccttttttcctagtttctgagattctgagagagaagtgggtagaatgaagactgtatattctttaggggtaggagaaaggaagaggctgagactcagctatcacagcaccagcagcatgggtttagggcatttactcagaaccagagtgtctgagttatattcctagctccatcattactagctgtgtgactttaggcaatgtaactaacatctctgtgcctcagcttcttccttggtgaaataaagataatgcaatagaatcaccacaaggttcaattaagttactactggtaaatcacttacagatggtgaatacctggcacatagtgagctacatatatacatttgttattagttgttgttctacctgcaagtggaagaggaaaaaagagtagtcaaggtaccagcttgctctggccaggattcacagtgatacctgagcatgttgaaaaattaatgagcagcctccttgaagtgtgagcctaagagacacagaggagcttcctgggaagtaagtcttcccaagaactgagcccaacattttagacccagtaacaa

SEQ ID NO: 54561 - DNA, 1036 bp, Homo sapiens
ataaatgcatgtctccagtgtctggtaagtactcaatacatatttggtagtaaatttgaatgaataaatgagaatgcttgctcttgcaaataggttcttcttaaagaatctacgatatgttcatgtcattagacatgtcagatgtctgtttcattagtgctgcatgagcccatgattataaaagtgtaataaaaattaggcgatgcagcttttctttggtttttcctcttccggtaaatatccagtagcccttgcaatattccattatgtacaagctctgcctcatccctaaccattattactctatggggcaggactattttagcgtctgatgtattccaccaggtgaagcaaacaaattagacggagtacaacagctgcttgatataggatgtcctcatgttttcgttcttctttttaatacacccaagcatcacatttattttttcaacagctgctgcacattgagcagacttcttaattagctaatgtttgcaaggccttttgaagataaaaagccctatataagtgctaagtgttattattactttgacaaaagagttctcttttaccttggctcactgcaaaatgtgtgagctttccttctgtctaactagaagtagtcaaagtataggctgcataaaccacaggagaaagaacttagaaattcagctgtggaccctgaacagaggcaattgagcactctggaatgttccttcctattttaatgtactcttcaccaggcaccaaaagaaaagaatggtgggggtgggaaggggttagaaaacactttttctgtctctagaatgctttgagagaatggaaatacttacagcaccctctttctgaaaaggactttttttatgtgaaacctaacatttatttctcttagcttgattttataaaacaaagcaaacatttagctatcacagattgcatccttgcaaatagatatctatgatctagggacaaaaaatgatgtacctgaaccaaatttatgtgtaagttaccttatcccctttctcattaccaggag

SEQ ID NO: 54562 - DNA, 1036 bp, Homo sapiens
cctaacctcaggtgatctgcccacctcagcctcccaaagtgctgggattacaggcgtgagccaccatgcccggccaaggtgttcatttttcttagagcatttgcatatctcttactcagttttttcccatgtatttgcattttcgttgctattgcatgttagatttcttctactgtggtctgttttttgtattgttttgttttgttttgtttttgctgatgtactgttggcgattttctgtatccatgttgtggctggttaccatttttaattctcctattagttctaatagtttttctctggttgctgtgtttgcaaggagaactactgtgtcatctgtaaataatgattttttttcttctctatttcagtattaatacttcccttcaccctgcctctgggtttctgtgattacatggagtagagcttccagaacagtgtaaaataaatattagtggacattcttattttggttccagtcctagtaagaatatgtctagttaagagcttctagattatgttccaaaccattattccacgagatgttaattgatttcctacaaaaaaaaagagagtcttctaaataatttccttgaactctgaattaaccaaaatgagacaaatctctttagtgaatgggcttttataacctttactatttaatatgcattgacaatctcctagagatggagaaagtatgtgacttttcccaatatatttgtcatagaacactgtttttgaagaacatttactaacatcttataaaacgatacatcagtggtatctttctggtattgttctggtagggtactgttaattgtgatgtttggggtttttggtttcaaaatgatgttctttaccgtgttaagaaaatatcctacttttagcttacttagagtgttatataaatcaaatcttttactatatgctttattctatctggcttttgctgaatataatgttttttatatttactgatgttgtttatttgttttcaatgctggatagtagcccttacacaagtatcataaaaatt

SEQ ID NO: 54563 - DNA, 1034 bp, Homo sapiens
accatgattcgagttgtgtcccataccagcgttcctcttttgctaaaaaaccctgattattttttcaaggaagcgaatactactatttatgttatttggggacctttccgcaatatgaggaaagatggcaatggcatcgtttacaacatgttgaaaaagacagttggtatctatccgaatgcccaaatatacgtgaccacagagaagcgcatgagttactgtgatggagtttttaagaaggaaactgggaaggacaggtgagccctctctgaagcagctttattgtcttttattatcttttatgctaaatcttcgccaattccttttgcaggatataaaatgaacagttatttatttacgctgattgttatatgttttgactattatgattacttgataagccagcctgaggtctcatttattccacctatactacctcctgttctttccattctgattggtttgagtctccaagaaacactggatacttccccaaggtatcttttgatctttttttattttgttccatttgctattgattgagttggatttcagctgaaagaggaagcctaaacatttctgtttcaaaacctagtaatggtaaggaactttaggattatgcattaatctaaactcctctgggaattttgccaaaattttacctgagaccacaaacagaacaggctactgattctccaataagattgtgtagcttcttgcatgcaaataggcactgtgatcctgaacatcataacttggtatctaacttgttcagcagaataccatattgaaattatacgtcccttaaaatcattagcagttgaattattttaaagaaatgaggtataaatactattcattcaattatccaaaaaccaatttgcattttttattacatccatgttttttctgtagcattctgtaaactacacttcgcacttttttcccttgaagcctgctttcccctccccttccttctcctatttcctctgtttgctccatttccagctccctcatctcttctgtaactgaat

SEQ ID NO: 54564 - DNA, 1803 bp, Homo sapiens
aaaacaaaatacccaagtaaaggagaactgaaaactctcataaaacaacctgagcttctctaccaaactttaaattgccctccagaaaatattttcttctttggtaacaaagaaaataaattgccttactttttaaatgccttcatgatgaacataaagaaaagaaaaaattggtagttgtgtctttcaaccaactgcataaatgaagaataaatttgtatatagactaagaggaaaattaatgaaagcatttctggcatattcagatcatgtcactctcctgctcaaaatcctgcaatagtcctccattttccttagaataaaaacacgtgtttacagtgacttccaatcacttctgatgagtctaccatgatagcatttaaaattgaaatccttacctcacatacccagcattcccaattttccttaccttgttctattttatttttttctcttatagcattaccttctaacattctatataatatacttatttattttaatttttagtgttttctatgtatttctcctactgggatatgagttctctaaggccaaggatcattgttttgttcactaatatatctcaagcacctagaagaatatatgttgtgtagtagacactcaatatttgctaaataaatgacctagaggtggaaaaacaattgaataaaggattcaggcaaacttgcaaaaagttatcatgggggtctttaatcgcttaaagaaaaaaatgcatccactcagaaacagtgcaattaagttacaagtttaaggctgttttttctgctgttgttttacaaaaaggtgctagtattgaagctgtcttatccaagagatcatcattgcactcaaggaactggtctgactgatttttattcttcaacacatggaccagttgtttaaacagaattgatttctgatttctttggtatccaggggaaacagcaaaaatgtctcattcttatttggattagtagaacagcggttctcaaacgtgagcttgcatcagaattacaaggggtgctgattaaaacacagattgctgggctcattcctggactttctgggttggtatgcttggattgaggcccaagagtttgcatttctaacagaattccaggcaatgttgctgctggtcctgggatcacacttcaagaactaccgtgataaagaattctaagatatcaagtcacattcaattattttgaacatttggtcctataatctttattctattggcatattgttgcacgaacatctagcactatttttgttatgatatttttcacggcgaggagttttttaacctcctgtgaaagtcctactgcaactctgtcattttattcttcactttcttaagatcttgctcctctgtaattataccagatggtgctgctcagtagcttataagggagtgatgcttcatcattctagacagagagacaaatcactctgttctctgacttttgaatcaagaatcaacatttgtgtgtatgttcaacctgctatttgctttgcaattttgctcattaggtatttattaccctgacagtgtatgagttagtcattttccttctgccgtgtagttcagattagcactgtttgacaactgccatcatcacagcattacctccaataatatgtaatttcttttttgcctatgttatctgggtgaggtagttatctaggaagtatatctacaaacggaagatcacaaacagcattcagttctctgacttatcatgttagaaatggataactagggccatttccttggagtttctagccctgcgattggca

SEQ ID NO: 54565 - DNA, 1685 bp, Homo sapiens
taacagtttaattttgtcaagtcatgtaaattatagtgagagggatgatgagagttctcagctctttggagaagttaattttgttgtcagcacatccacatttcaaaaatcacaaactagaggcagaacttttcagtgccagtgagatttggtgatcagatactgttttcatttctaatgtctgccttctgtatagcgcctatgcaaataggggctttcaaggatgcaaaagtagcaacttcccctattaggagcgtaactagcagctgctgtgtttctcataaaagagaaaacatcctgtttactaacatacaaccatacgccctcacccgcgtacactcacaccaagctctttttttaaggcagagcttttattttggtttgagataggcagcacagaaatgcagtcttttacaaacattccttgagcacatatcccctgggtgctaagtaggtgtcagtcattgttctagatgtggggaatccactgatacttgaaacacattctctaattttactgggaactcgtcggaacttctgacattcattggcaagttctttgcatctggtctcacctccttatttttaatatttataaaccatgttcatcaggatgtcagtagagaagaaatgaaagtagctgagaaaccttgccgagagagaccaaatctcaaagtgaactaaaaatgtcttgaccacaaggatagaaagtgaactaagatatgttcttgaggcagcaaaaataagtattgtgccaaaatccaggctttacctcagtgtcagataatcaatggactagagatttcactgtgttgcccacagccctgttaagaaatcaagaccatgtgctttgtctataatcctggagtcagcccagaagatgagctcataaatatgttagcttaagtaaagtttatgataatatagacgatgaatcatcttcctgttttgaaaagcatatattctataactcaggatttctggagtccctccagaaatctacatgacttttgccccattttctttaggtcttgattcaaatgtcgccttataagagagcccttttttgacaacactctcccacccccaactctcccttttctgcttttcaaactctattttcctttatgttacttgttatggcctgatatgtgtttgctattttctgtcttcccttattagactgtaagcaccatgagggcataacttgttgtttacctctctgccccctcaaatagcatctgacacacataggtgacactacccagttgttgagtgggtaacatgaggttgtttgggattgttagttcattatcctaggcctacacagggtcagcatcaccaatatcgctgtcttccaccttcacatcttgtctcactggaagatcttcagagacaacaacatgcatggagctgtcatctcctatgatagcaatgccttcttgtggaatactgcctgaaagacctgcctgcagctgttttacagatatatatatatatatctgtacatatatatatatatagggagagagagaaagagagagagagaatgccctctaaaataatgatgaaaaataaagtaaatacataagcctagtaacatagttgtttattatcattatcaagtattatatactgtacataattgtatgtgttatacttttatatggctggacatgcagtag

SEQ ID NO: 54566 - DNA, 1008 bp, Homo sapiens
gcttaagtgaccctcccaccttgacatcccagagtgctgggattacaggcgtaagccaccatgcccagcctacttttgtattctcttataatgttgagtgacttaccttttgggagttatagatattagatacaacttgaagtctttttccttcatttgtaccatcaaaagatgttttcggtgttcaatgaaaattgtttcaaaaggaatttggcagtccccaggcttctacaggcggttttgaggatgaaatgtgggggcatctccattctcattatgttgatttctccttgtgacaaaaaccttttgccaccccgcctgcttcccctcttgtgctctgtcttttctctcctctttctttctgctacctgctcactctgttttctctgtatctctttgttctttctcagagctcttgcctctgacacactttttagtgccatcgttttttgagacagcctgatttgatcactgtcttttctctctccctttgaaagctttctctgttctgtgtatttcctagattactggtgatacttgtcattctggttagattttgttcctgttttgatttcatttttccgtaagatttttgtttggttgattttttttaaccttaagaaaaaaagagatttttttacttgcattccacttttctttctgttctgctctgtaacgtgagtgtgcaatatgctctaaagtccaaaaggatagttaacacagtgggtggtggggctatgcataatttctgccatctttcttatagcattctgttttctgaaattgtttcatggtgcatatgtacacataataagaaagaaaaagcaatgaaacgatttctattttgacaaggaaaaaaatcttaatgagagcctggctttgggtcttgcctctagctctccatgaaacctttttcttatctgtcttcaccaccaagcataaccacaatggctggctgagctggagatggacagcagtctgtggggattgtgtaagtgatccaatggt

SEQ ID NO: 54567 - DNA, 1332 bp, Homo sapiens
ttgtacaatggagtgtttaaattcacagtccattgtgaacataggcatggtatttcatgactataaactgtcatgttttaagcactttggtctgtcaggctaactaaatataagcccctgtcctaaagaatcaagctcacatagtatgacaaatcagcattttatttatttgtgctaaaagcatttattgaacagctgtgtactaaaaatcctgcaacaagaagtaacattgaaatttccttaaagagcttcttctactgaggaatgtagacatattaacaaataaatacaaagtaggattataaaaaagtattttagaagaggtagctatttacaggatagagtaaagggagaggttaaagttaaaaagttaaattaaactattttttattgtcatatgaacaaaagtatcttcatgttaaattaaatacaattagctgatatttgtatgcatctgctttttatgagctgtcactagaagatgactttttactgcctttttttttctctgttttttttttttttttttttttttgagacagggtttcactctgtcacccaggctggaatgcagtggcaagatcttggctcactgcaacctctgcctcccagattcaagcaattctcctgcctcagcctcttgagtagctgggactacaggcatgcatcacgaggcccagttaatttttgtatttttagcagagacggggtttcaccatgttggccaggctgatctcaaactcttgacctcaggtgatccacccaccttggcctcccaaagtgctgggattatatgcctgagccaccgtgcctggccaccattttatattttgataattcatatttagtactctcagtcacttagttactcaacatctgagtttctttatctataaaattgacttaaacgtctatgtattcaatattcaaaaagtatattggttaggaatattttaaaatatacaacaaagaggtgactatggaatctaaaatcaatttgagaatacatataaagttaaaggtattataattcttattagcttatatgtggggaaaacaaatgattaaatatatgcatgttatgaaagaaaaatttatgaagtaaatatgtagaagctgcaaatggtgagaataatccagtgtctcctttttgagaaataaggaatattctttttcatttgctagagcaaaggttaaagaaagttttaaagacttgatattcctgtatttggatagatcatagataatcattgtcctgaatgctgagtaaacaattgaatacatctaaaaatgtgacatgcattatgctgagaccctggtagtactctctct

SEQ ID NO: 54568 - DNA, 1009 bp, Homo sapiens
gttcagtgttgctaaaaatttctttaatggaaaagagtggagagatgtcctggaaatagacttaggtgccagatcagaaagggcatatgtgtcagatcaagaatttgtgaccctaatgtttacattttcgaaaagtaagccttgtggcaaaaaatggagttttgtgaaagaatgtagccatggagctcagtgactaactgcttattataacagcccaagttggagatgatggggccagaatggggacatgctgtccatgtcgatgacaacatgaactaggatttgaaagcagagattatgccaagggcaaaatatccactgcaggtgtatcctttcccttttctagaaaatagaactgtattttgtagaatctttttgttcttcatcaaactctgtttttagacttttaccttcaaaccacccaagaacattagagcctcataaactataaatgattaattttatgactcactatttaaagcaaatggaaattttaaacttgtttttatcatgagagtccctgtctggcaataattgggcaaagaaggcaagataaaaaacggatttttcttcaggatctgctaagtagaaacaacaacatagaggctgggcgcagtgactcatgcctgtaatcccagcattttgggaggccaaggtgtgtggatcacctgaggtcaggagttcgagaccagcctggccaacatggcaaaacccagtctctactaaaaatacaaaaattagctgggcatggtggggtgtgcctgtagtcccaaccacttgggaggctgaagcaggagaatcacttgaacttgggaggtggtggttgtggtgagctgagatcatgccactgcactccagcctgggcgacagagtgagactatgtctccaaaaaaaaaaaaaaaaaaaataagagaaagcaacatagatgctgaactttaaggaaatgtgatataatatggacttgctcaacataaactattgaaaaatgtgtgtagttataattattatt

SEQ ID NO: 54569 - DNA, 1608 bp, Homo sapiens
aggtgattgtactaaattttactttgtacacatcctagtggcaatgtatttgtgctgtgatataattcatttcatgatttagtgagtcatgatggaaaaaagtattaggtacttctttttctcaatcaaccaagaacacatcctactttttccatctgttcccggcaacagatgtgttatttgacaagaacccactgatttgtaccctgcctggcatattagactcataccactgaacaacaaggtacctggcttagtgggcaccttggcatagtcccttttaggacccctcctttggttttcataaacagaatgttactgccaatcataatatgtattttgtaatggaatttaagattcagagatttgagtagaaacaacttagctattcctcctccatcagactcctgctggatacagccctcattttctcacacgtaggactgataaggaagatcaaaatggtctcctactgtgtttaaaatctttacttttcactctttaaattactggctttctgtaacttccttctgtgttttctgacatctacagtttcacaattattattcttcaagatttgtcttccttgaagtctccatttttgaagtctgggaggagcaccaaacttggttttattccatcacatttagtgatagacttcttcttctgttttttttgttgttgttgttttgttttgttttttaaagacagggtctcactctgtccaagctgtagtgcagttgtggtggatcatagttcacagcagcctcaatctctttagcttaagccacccttctacctaagcctcccaagtagctgggactataggcatgagccactgtgttatctatggataaacttttcaatgagaagatccaagtatcttggccaaaccaaagccaaaggcagacctctaatgaattcaaacagttctagggacagcttaagataaacagtgtgatcctactcggccttaagagtgaggacgctatcggttcattcagcccagagctaggaggagtctgcttcctgtctgcaagatgctattgcagggtccaaggcaggatttctcagaattgttgactggagcagggaacttgtggccctttgtaattcctaagcatcttcctccttttctaccttgccctcatcaagaatcctaaaccaaaaagtatttggctaaagtgtgaaggagactgtgattctgctttcttgaaatttttcaagttcttaaagcacacaatatgaagctctataaaaattatttatgatttcaaaagaaaataattttaaaattaagatattatgatagaaagtagccttctagtcttgccttaggcatgacaaagaactcaagttcccacctgagagagatggtgagaattgtacttcacataaatactgtttactttcactctctaggaaactctataatgggtgccatttggcattctaataactgttagtgcagaaaatagtgtttccaattatgtgttctcaacacacattttcattagagtagttggaagcaaggtttcaggtaactggaattgacctcttacttctcacagaattagaagtcaagaagttggcacctttctacagatc

SEQ ID NO: 54570 - DNA, 1118 bp, Homo sapiens
ttgtacagaacagtgaaaattgccaggggagtggagaagaaaattagcagtgtctgcctattctggatatttcacatcaatggaatcatacaataagtggactttgagtctagattctttcacttagcatgcatgatttttcaaagtttgtgttttagcaaatatcagtacttcattcatttttatgactgaataatattccattgtatggatataactcattttgtttattcaatcatcagttgatagatgtttgatgatttctcttttggctactgtgagtagcgttgttatgcatattcttgtacaggtgtttacttgaatacctgttttcagttcttttgggaatacttaggagtagaattgatggatacagtaagtctatgtttaatttattgaagatctgtcaaattgctttctacagtgattgaatcattttatattcctactagcaacgttgaaggttcaaatttcttcacattcttgccaacccttgttatttttcatttttttaaatagccatactaatcagtgagaggtagaatctcattgtggtttttgttttcattttcctaatgactaatgacattgagcattttttcaagcgcttgttgaccatttatatatctttagagatatgtcaagtcttttgcccatttttaaattgggtcgtttgtctttgtgccgtggtgtttcaagcataaatctatagacaaaataaaagctacttgttggctgttttattggaaatcacacaacttgggaaagtctcaaggataaattttgctaaattctttgtccactattcactaagagggtcccttaccctttcttttcctttgatcattggttatctggtttcacctgtcaagaaataagctgccctttgattgtggataataggtgagacaccgcagaatcaagttacactgttgcatctgtaaagtttcatcactgtgtgtttccaggagtcaggatttgccatcaaagtcaattgccgaatgactctgactttattattctttatttgcattaacaattgctctaagcagtaacacgattataacccaaaacagcagcctgttatctatcatttatttgatttaatacatagaaat

SEQ ID NO: 54571 - DNA, 1260 bp, Homo sapiens
taaatgaacagcatatgagcaaaggacctggggaacccccaagtgactaacaatcaaaaatagaattttctgcatgtcagatattgagtcattcgctgcatggcccaattaacctttcttctgattccagattttgaacttgtgtccttggagaacaaaatgcttacccattgccttggctgagtcacttctgtgcagttttagatgaaccctgcttgcacattattccattggaaacaagcattttcacagtaggttaaggactgggactaaaagaaaagagaaagctaagatgtccatctgaaaactgtcagtgtcgtctcaatggaaagttatgatgttttacttctctgaaaaagctaaagaaagcaatctggccagttataaatttaatttatgaaaataataccacaggcctaaatcatccaacactatagctattgattcttctttctagttccttggggaacagttgctgtatttgagaaggtagaactacaattgtcttactttgtcatttaaatgtcatattagccaaacactgagcacagctgaagggttgcaaactgactaggaaagaatgggatagtatttttcattttttttttaaatgtaattggtagacagattttcctgttggtgagggctgattttttttcctcattatttctctctccttttattttctccacaatgttgcattttcttggttttctgtgaggcattaggaaaggataaatcatgacgttctgggtctatggtcttttttaatctctcagattattttctttaacagaattgttggaaagttggctgttacctgacagaaaataaaacaaccaatttttcatcgcaagttaaataaacattgaaaaatcagcattctacaaggaccattagcttatgtatcactgtaaaatgttttatgactcttggtataaaggatgctcatataaaaataaattgtgtcataacaaacatttctcccagtcatggtttgtaatagccttaatctcaaataaatctaggttgaacattgtagtctccagaaaaactgaccttcagtttcaaatagttgggttaaatcattgtgatgatgacatagtctcagatataaggagatatgaacttgtatcagctccccagataatcttttatttagaagaggagagatgtctcaatgaactgaaattgctcttgagtgaaccattttatttatatatcttcttattctgactaccagttcacacacagtgccac

SEQ ID NO: 54572 - DNA, 1246 bp, Homo sapiens
gtatacaatattaaaaagttgtaaacttatcaatagtggttatctggatgttggaataatagacaattaattctctattcctgtccatattcttcaattttttttctcctatactgtgcattactaaaataattaggaaaaattttttgcaattattttttcttaaactgtatgggtacccaaatacataatgaatgagctattgcctgaaataatttaaaaagtggcagcatataaattgcaataaaatgaaatacaattttcactgtataaatggaatgaaagtctaaagcagtactcaggtaaggacatttcgttttaatgtaacgccagtgaggagcttgcatttaagtgccaaatattggtatttatgtatatgaaagctcttctttactctcttatattttctttttttctaaaattttttttttgctaaaattagggtgtcatatataccagaatcaatcaattcttccttctctccttcttttctttctttcttccatccccctacctttcaattctgcaaagataggcaagtgagtgagggtgggtctagcttagtgtttgcccatatgtaaaatgttttgagttcataaaatcctgaaaaaattaaagcagcagacagaaaacagaaaagacccccacttagatactgattagcaaatagacacaaacatttcctctaaatacttcagtgcctgtgatttaagtagctacttgggacacattgaagagtctgttgttagctttctgcattcacatgataagaaacaaagaattctttaggcttgacctttgcaaatagaaaatcctgaaaacgagaatgctgtaatttttctttgtgaagctcaaacatatattgaaagagattggcctcgaatctgtcaccttctcatcactaaatatggcagccctgaagttaattaaataatgcaaatgctcaaggcggccttcactcactcctttcgatgcactgataaatggaggattttagttaggggtttgttcttgttcttactcatttttttaccaaaagattttgtctttgcttgtaatacttgaggatctacactcccattatctcaattgaggctaagggactaagggattccctgtccagtgtgtgatgggccagtgtaatcattataagtgatttcaaatcaatataatttggcaatagcaaaaactatgagaatttctcctcaactttttattggttttaggtaaatacttatgaagtaga

SEQ ID NO: 54573 - DNA, 1070 bp, Homo sapiens
tatctaatagtacagaacatagcattgctccaggacctagcacaatgtcttgcctagtgtaggtgtttagtaaatattgaatgaattaaattcagaaccctgagggagaaaagtcacaaatttatcaagtaattcacaaagagacatatccctgacagctaatccagttaaaagtattaaggtaagctgaaaccagaatatgtttcaaatcatttctcttcttataagagttttgttactggctggaacagttgtttcttggtatgctgatcgaatgtgacttgagccagaaagattcacaatgaataacaccaggaggcttatgaatgatgtataaagccaaccagtctaatgacaggtaaggcagaggtgagcagttactttatttcagagcagccaaagtcttggcaatgtaatgcaaccacgggaatagtgagtggttgtgaccagtttgtagtaaacttctagaatgaaacaagctttaaatgttctgatggatatttgatcttttgtattaatggagccattgcttcagatgagcacaaatgaaaatggcccctcttgctcctctagtatttgcccaggggttacaaggatcagctaagtgctatggagggtattaatcactttttacttgcagtgaaactatatttgttttttggtaactagcaattctaatacagtaaaacttcaactactaaataaatatcattagtattatgactttaattgaagaccaaggtgtcaccatcttgaagaaaatggtgaaagtttactttctgttccctattgatacaccagggccaacactgatgacctgttaacaataatgatataatttttttttaatttttcctgaattttctttctaaaatctaggttcggcaacagaataatcaaaggatttattgctttgccattctgtgcctagcactgtgaatctctgtaactgacttgatagaaacatagatcataatatttttgggtggaaatgaatcacagcttatggttgcaaaagattccacatgaagctaatggattgtagacatctgggaatgggaaatgatatg

SEQ ID NO: 54574 - DNA, 1102 bp, Homo sapiens
gtttcattataagtactcggtaaaaattagctgttgtttttggtgcacgtgcgaagacagcaagttgagactacttttgaagcttaattatgaaaattggagagaaaaacgaggccagaggtagatacaggccaggaattaggtgaaaggtgattattttatattctgggggaaaagaagtggctctcggagagtgacagattacaaatgggggaagaaggattaattgatggagtaatagtgctgaaaggcgagtgaggatggaattcagagaagaggtgaatagatggatggataaatcttggatagaaggggcttcttgttctctaaggctgaggctaaagtggaggtaataaggaggaaaggctaagaatgcatgtctttgtgggtggggagtagagagttgaaaggattgaaccctaacagcttactgtctctgtgaaatagaaacaagctcatctgatgggagacaagaggtttcagagtgaggaatagagtagaactcataaatgaaggagaagtcacacagcagtaactcctagagacccgatgacactagccagaatgtatagtctaaccaaaggattgagaagtcaggtatgataagaaattgtgctcacacagtgagacactggcatttgcttccacaggtgggacatttctaggtggtgacaaatctgagatgaaccatttgaaaatttttgtggtctgcagtgtacagcttgaacttaaaaaatatttttaccacaaataaatgattgattatattcatacctttcttgagttattaaattatcttctgtttcctatacatttgcagtgctattgggatggtagactttcagagttgaattatatcctgcctctattccacctaatgcatccttgagaatagttatagatgggaaagtcacattttattgtgcttatcatgttattctttagtagacattccattaatgtagaaacatacatggtgtgatacggattttatcttgtgatgatcagatgaaaagccctcctttcctgcatactcttttgcaatgttatttcatcactcttcccatcaagaggtggagtctacatttcctcctattgaatc

SEQ ID NO: 54575 - DNA, 1052 bp, Homo sapiens
ttcttcataattctggatgtcagaaaatgaacaatgttctaatgcagaaggcaaactttctatgaaggaccagacagtaaatattttagctttgcaggccacatacgatctctatcacatacttctttgttatttcttacaacccttttaaatgtgtaaaaactattcctagctcatacaaaaacaggctattggtgggatttgcctcatagactgtagtttgctgacccctgctctagtataaatttgtcttgtttattactagagtgcttatgccagtaagtattttttaaaagagagagaaaatgcattaagtaaataacatttaagtgattctttttctgattcagacattttctgggatgaaatgagaccattgatcattttatttgatggaatagaactgtttttcattgcagtgcaatgaggttaggtatgattttgaggactggggaccattcagcacattagttctgaaccatatccttgtgctttgcagaatttttttctcttcctcagaggagcagtttgaatacagggctttatggcatcaggcataagctgccattaaaaccttcaactgaaaattgtgctgccctttatgaaaatgagcagctggtcagccggaccatcgcccaccctcagctctactcatgttgtgtacaagtagcttgaatagcccttcatgagcaggtcttctacagacattttcctatcagtgttgggagggaaagccagaccagcagctagtgtttctttcagcctgtgttgtgccttggcatctgactctctgtggacccaggagtgaaatatcttcctggaagtggtgatccaggttagtcttgtctctctgactcatgtcccaagttgcttccatagagatacctgtggcatcttttccccctttactctgttttcctgaatttccctctatttttcactgactacaaagataaagaaaaagaagaaacaattttaaaacatataaagtactttgaaatatttatccttggataactggagactagatcacattcttatcttttcatcca

SEQ ID NO: 54576 - DNA, 1050 bp, Homo sapiens
atctcatctgattctctgctgtttgcctggtcttggactaatttccctttagcccacatgatgatctttaagttaagtctcagcctatttagactcaggctgcctcactcaccttgcagttgccatctttattatattatggcagtcaaaggttattttgtttggacagagaagttactctactgtatggtggactacctgtcctgaacgttcgcaaacatatccttttgttttctggagttcctcctggtttgttttctgatggatttctgttgactcccagattgaaccaatgtttatcctgtgtttggtgtatcaggcttttctgttctggttgatttcctgtagctaatttctagggagacttcaattcctcactgaagtcaagttccttgtcatagaggcccagtatttctaactcccattcagacagaaaatttgtttttattacccacaagagaaaatgatctggctttcctgctctaaagatacccctagtactactattttttccagtcttgtgttttcagatatttttctttaattgaccttctctatggtcagattcgtgactgtattccttcccctagtttattaattcttttttttttttttttttttgagatgaagtctcactctgtctcccaggctggagtgcagtggctcgatcttggctcactgtaagctctgcctcctgggttcatgccattctcctgcctcagcctcctgagtagctgggaccacaggtgcccgccaccacgcccggctaatttttttgtatttttagtagagacggggtttcactgtgttagacaggatggtctcgatctcctgaccttgtgatctgcccaccttggcctcccaaagtgctgggattacaggcgtaacccaccatgctctgccttattaatttctaagagtcttcctagaacactgtaagtatgcttaacctggtattatagagacatgtaacagaactaaatactttccactccacaaaagaagaggctattttgaactacatgtatcttcacagaggttactccagta

SEQ ID NO: 54577 - DNA, 2816 bp, Homo sapiens
tttttaaatacaatgtactgacctgaaagtagtcaagttatctatagctactggttgataaaggcaacagaattgacagctcccacgtctgtaattaaatgtgtgaaactaacaaatggaaataatagagaaagattatttttctttactggtcatgttgtgacatcaatttgttttaaatgatgagaaaagaacttaaaggatttgctttttattatagtgcaaattaatattcaactactgaactgaaatagatttgcataagagttatcactatcaataatcatttgaaattcatttttcccagataaattagaatctccagtgataacaagcaagagttatctcctgcatttttgaaaaaaggttaaaataatagctatttcctataactagatcttgagattggacataaaccttatacgtgcaactttccttatctgattttaagtttcctttaactgtaaacatgagctaatgccacatgaaactaggaaaatacgatggaatttgaaaatgatgttagatagataaaagtaaggaaatcctagatttgaatgacatggaaatgtcacctagttcagtctcctgtaggggtacatagtgcctctagctgctatcatccttaatgatctccaaggaagaaagtagataaagatcctttcatcatcagttgtaggactgccctcaaccctgccccaaatattagatctttgaactctcttttagcagtaaatgttatgtaggtattaatatatatcttaaataacatatatgacagagatgatagaggtaataataataagtaatcactctccttattactctgaaaatattgtatatagcagtaatatcaaccacaatcaaaatgccatatattgagtatttgaatgggctagactctcctctgatcctttttttaaaagcatcattccactagtttccattgctattatccatgaagaaatagagacttagagaagataagtaattggctcatttccacagtttgtaagggacagagttgtaattcaggagcagaccacatacttcaaaccctcctgaccttgcatcatcatacagtaactgtgtatctattgaaaatctctagttaggtcccttctgagctttctgatctttgaattaattattttccatttctaacatttggccatagtgtcattttccagcattagtcacttacaaagatgtaggatgtgctattattttaaatccacattcatcaagaaaataggcctaattggagggaattaaggtagctgcaatttcctgatgattaagcactagaatatgttgctaggagaaactggagaattttcttttttgaaagtctgaaagaaaagtacaaataaggtttcaacaaactctaacttgaaccccagtttcctgatttgctaaatgaatggtttagagtaggtgatctcccttgggtctccccaaccctaacaacccacaagtctgtaactttaagtagcaattggatgttataacctctcaaggtcatttttagacttctatattttgcttcaatgattcttgactctctttggttcagctccacattctggagtttctttcaaatggagatctcataagagctattatttaacagtatcccaaatgtgcaatgtacagaattaaatacaaccatgcatttaagactttaacaatcatagttcatcagcactatgtgttctttctcctatttgattaaggttaaacaacaagatgatgtttcctcattgggtagcattttaaagtgtattgtgtatgtgacagatgagatcttataaatgcattaggcatgcttattttaatatctaagcatatgcaaaagttctagaaatattttacatgcaaatgtctggggctccactagggcccataatagaactccatactctgtgacttcaaagccctagtctcgacaactaatcacttggctatttccaaatcaaatttcttcaaacaaatcaaaggcatttgtcctacccaaaaaccaagttctgtggcaagtttcacatttcaaaatcaagctgcttattgagatattcatgcactgaaaaaggcacacagaatttcctttaggagatgagacacacctttttatgctccaatgaattagaaatttctcaaagagaattttaacaaattttctttacacacacacacacacacacacacacacatgcacttcatcttagcagtaaaagccaagattcagaatttcagcccaagagatctttcattttctgaaaggttatgagcccctgagatttcattcctttcagagtcataattactgtgttgcttctgagttgttaacaataacactgattaaaaggaagacaaaaaaaagaagagatcgttcacatacccgtattaagtggcttcacaaactaggagtatttttaacaccacaacatttgtggtaagtacaacaaagtgtgtaattcactgggaagcagaacagaaaagatgggaatgataatgtcaaataactcactttacccagggctccctgtgggcaaggcactgggccaagtcctccacaggcattgttgcatttaatacaacaatttttaacaatttttaataaaagccctccaatgaggcacttttactgtagcatttttacccatgaggaaactgaggttcagagaagttgaataacttgacaagagtcacccagactcccaagcctctgttcttaattgctcaactatgctactgccttttcttttatttttattattattattatactttaaattctagggcacatgtgcacaatg

SEQ ID NO: 54578 - DNA, 1028 bp, Homo sapiens
tcaaattctttcttctctcaaaccttttatatcctcagtgtgcctgaattgtctacaagccatgtaattagtttttgttatctctttttcaagtcctacaggctggcctgttgcatagatcattttcgtctctgataaccgtgaaagctgagtgttcagccaaaatttccaattaaacatcctgatatgtacataattagatatacacaactgtcctgtggcatcagcagcatatattgttattcctgtttgatgtatgagtaacctaaagtacagacaagtgaagtaacctgcaccatgactagttgggttttctcactccatgtcttcactctttccctgactgagttaacacattgtccttttaagaacggactgaaggtccagcgagtagatgaacagaagtaaccttattggtgttgcacaggcctacaaaattactaagaagtccttacaacaaataaatataacacatatttcatgggaagtaaaataaaatagtagacttaatgatggtttagaataagtagtattaagtaaggaaaatagactgacataaaaaagaaacaaaaaaagactgaaaaatataggtatagtaaaaattaaaagaaaaacattatctattattgaaaattaagcatctgattatgtgataataaaagcttaacgtagtttgcccaggtttgaaagaaaactgattgacagtcgcttatcaccaataatgaaccccacctgtgccatagaaagtgtcttgggacaccaaaccacccgccaacccccatgttgtaacatcacagtagtacaaggatgtagatgcaccaacctaatttgaatgtgaagtagtccgtggtataggacagcatacgtacaagcccaccctgagggaaatactgagcaagaatctaggtgggctgaaaataagagaatgaataaaggaaggagaacagggttaaataaatatgtgagatgaagcatatggtttgagaagttttggggtcccacagatctattgcagggtactactggta

SEQ ID NO: 54579 - DNA, 1048 bp, Homo sapiens
ctgatttcaggatctgtttaacatgtattgatttatctgttaggcccactttgtcattttaacatgcatattaaaaaaagaagaggtattgaattcagccattcagatctttttcaaattggaagcaacttcagaaatctccacaatctgaaaatgttcctgtgtgtagggccatttcctcaggggatatgaacagtttcatgaagatgtcccacacctccagatttgtcctctttttcatcagagctcctttcttatctttgcctgggcccttaggagggctttctgccatgtcagtatcctgtcaatttctacaactctatgaagtttttcacatagtagaatatattgtcaaaatgtcttgatgtcttattacaacctttacccaatctcggcagcaggatttctgaacacactcctggtgcctttttcctgatacatttattatctattgtgagagttaaatggtatctcgaccacatcctgttcttcctagaatccatatcaccttaaacatctagtagtctcatttctgacattctggtggggaaacctatttttaggtaaagttgcttatttttgttggaggaacgtttgattttactaagtctcttaagtttcttgaattaggttttctaatctatttgttcattcacaaatatttattgagtgtatattagagttctccaggggaataggactaataggatgtgtgcatgtgtatatatatatatatatatatatatatatatatatatatacacacacacacacacactttccctactttcttccacttattacccttggctgaagcatgaaaatatatttcatgtgtataaacacacacacacacacacacacacacacacacactttccctactttcttccacttattacccttggctgaagcataaaaatatatttcatgtgtatgcgcacacacacacacacacacacacacacacactttccctactttcttccacttattacccttggccgaagcatgaaaatatatttcatgtgtatgcacacacacacac

SEQ ID NO: 54580 - DNA, 1391 bp, Homo sapiens
gggctttggtttcctcatttgaaacttagcatgttagccacactgattttgctaacatcacttccaaatcaaaattgcaattattctagtagaccatctctttagatctggattaaggatgaggcctacttggaggtgaaggaatcaagtagaaagatgtgaaatggtccctccctccatatggaaaaatctgcctgagatttagacagacactattcaaaactgtaagtccactgagcaccaactgcggtacaaaaagttaagttcccaggtctcatttacagagtagtagctgcttgttagttatcacacgccagtgattcagctggagaagctaaggcagaaggcaattatgtaaccatcacaaaagggtatgggggaagcacttgaacccataccgggcattctggcttctggtcagatgcgagggatggattcaatgtcattttaatctttattcattgtttcaatctgttagaactgttatagtttggagctccatacagaatgcagatttgttcaaatgacttcccaagaacttgtagcaagagcacttggagccatcctggacaggcccatgctgtgcctcacacatgcacagcatcttcaaggggtcatacagaaactgcctccaaacctccccacccacttccactttgccacaaccccaagagaggacacccatctcaaaaaggtttgctttcctgtggagtaagaggtataattaaattgtgtcccagcagtgaaggttccttaatgataatgagccaaaactaattgtattgatttgtttatcaccggcttaggaggcccatcaaacaaatggactgagactatttccatattcttatctgttaggtaaatgagaaacaaatgacctctccctatgtctgcatcctgaagtcactgccctctaaggctgagtgctctatggcttcgggtgggagctttgtccaaagctggggccattctgccctctggcttcttcaaataggtgaagaaagttgaaaattttggtattcattcttctatttttcatttatgtagaaggatttgtttttaacagttacaatttggatccttgccaaaggtgccagatggcctgctttcttcgggagagctggtcatgagtattaataaccctaatttggaattctctgtggaaggggtagccacaagatttggagtgggaggaaatgtagaatcattgataacaagtgaattcagagaaaaagactcttgaatcttggtcaggagtgagacataacggtaggcaggcagctttggggggccacaggagaagcctgatgtacctgcacctacccctcttagtcttggggagccttcccaatctactgctccacaaattaagagaaatagagagaattaaa

SEQ ID NO: 54581 - DNA, 1060 bp, Homo sapiens
gatgctatcactggcaattttatcacaaactacaagtacccattcatagaacatcagtaaaactgttttattaagattcattctgtagggctgtatgttggatctcacaacacaactacttattctgttgctttgtaaataatctttgaaaggcttgtttttacaattttaagcttgaagctttttgtcttactccaagaaataaagactaatctgtgataaatttattttccccttttaatcaatgtcacaggtgaccacaataggtatacaaactcatgttgaccgagattgtttcaggctaatgtgtctttcccaaacaataatctttagttcaaaattaagtaataaagaaagcttctcataatctcagagactttgcaaagacctggtgataattccctttcttttctgaaagataattttagcagagtaacctcatcatttactcaggcatttgtggaatgtatatagatgtacactcaagtattcaagatatattctgaagtaaaaggacagattgtagaatagtatttacagtgaacccatttgtagaaaataaaaaggctacaccagtaaatgttatctataattatatgtaactacatattcataaacccttcctggaataatacattgtgattaatcctaaggtagtggggggaagaccccaggaggaggaggaagactggaatgttttctctttttacccttgttccaatgttgtcagtgatgtattaaatgaaaattggttttaaaatacatgcctttccttttacttcctcccctctccctccccctacaagctatttctcatttggagttttgcttgctattatcttgagccaaattaaaccagtgatctcctgatggaaaaggccagagcctgttcaatgactccagcccctttcctgtccattctcctctggagccatcaccaaagccctggtcacactctgtaatttgtaaatcctgaaattgtggtttgcaaggcaaatgattcagagcaagggctttatcccgggatcttatcctcctagttgcacaaaaacaaacacca

SEQ ID NO: 54582 - DNA, 1206 bp, Homo sapiens
ttacaaactcggctcaaccatcccctcttccagaaggcttccctgactacatcttgttcactttctgggttggttgtcctctatggcatcctcacagttccctatccattctaatgcattgtcactgttggtttattggacattcttccccaggcaaccacaaacttttcagaggaaggaactgggttttttatctctatatggcaagtaccaagcccagaacctggcatgttgctgatatttgtattaggttcctaggctgccatagaaaattcggtggcttaaaacaacagaaatttattctgtcacagttctggagaccagaattcagaaatcaaggtgtcagcaatgttggtttcttctggaggctctgagaggcaatgtgtcccatgcctttctcctaaattctatggctgctgactacacctggcattccttggcataaagcagtgtaactcccatctctgcctccttcttcacatggaatttccctgtgtgtctttttatctgtttcttcttctcttataagaacttgtgattggatttaaggcccaccctaatccagggttatatcatctaataatgatccttaccttaattacatctgcaaaggcctttattccatgtaagacgacattctgaggttctgggtggacatagttttggggagccaccattcaacctgatacaatattgaataagtatctggggaataaataaatgaacagtcaacatggctccaatatctagtgtgaagaattatactttcataccacatgaaagtaatctgtatttaaagtatacaagaaacccaactgatgctcgaggaacctttatatgcttgtgttaaatggtaagactaagttactttgggctttcactgtatagagtcttagatttgaaagaacctaatgtgttctttggccctggaatgtgatagatcatattaaagtgaggttttaatattgtaagatttatatgatttgctatttgagcttttctaaactattaagtagtagtatctattagtgtcaatactaggtattcagttattttaataagaagcatattaataggatcacatgcactgtcatttttttctatcgtacttcagatgtggcctcattcaaggatagagcagtcagaggcttccagtatttctctctcatacggtaatttcacacttgaaactcagcatacacaatg

SEQ ID NO: 54583 - DNA, 1129 bp, Homo sapiens
ggtcagaatcataaaaagatagagaagccatgctaattctgacactttgaaatgtaagagcagttcttgaggtattgaatctacatgaaagggatggaataaactggaaatgatttataccaacgagatttgagttaggggaatgtgttagttttctattgctgctataacaaattatcaccaactttgtggtttaaaacaacacaaagttattttatacagttcgaagttagaagtctaaaatgggttgttagggctgcattccttctggaagatccaagggagaatctatttctttttccagcaaaaaatgcaagactgcctacatccttggctcacggccccactccaccaatttctgcttccattctcacatatcttttcctcacattgctgtttctctatttctcttttaaggacccccatggttacattgggccagaataatccttcaaattcaagatccttaatttaattgcacctatgaagtcctttttggcatgtaaagcaacatattcacaggtttcaagtattagagtggggatatctttagggagctattattctatctaacacagggaaaaaaaggattttctcagtcctttaagtatcagcctgacggtgacagaaagtaagtgtttgttttctgagggctgagactgatcctgtagggcacagttaaaacatagtggttctgccctgaagtgtcatctgctgctgatgaaatcaaaggcttggatggcatagcttttccctgttagagtaagtaatcacagcattaataggtaggacatgatttaacccacagcatactaggagctctggccaacaactttaaaatgggtcttcaccatttggaggcatgattatgagctaaaaatactacgtgtaagatattgtggcctttgatttctacccttcaccaaaaatatcttgaggactttgtgccaggtgggtgctaggaaaaaaaaaaatgagacacagcctttgcagtctagaagccagcagccagttattacacataaaacacaagaacatattatataggaacaatagagtgaggtatggaaccagagagacggaacctagaaggatggtccaagaagtagaaagtgaagacagagtatag

SEQ ID NO: 54584 - DNA, 1036 bp, Homo sapiens
tcaaatcttgctcagaagagagctgacatcctttaactctcatttgaagccctcaagtgtctgacctcagtcctcctctctgacctcacctccaccttctcttttccacccactctcatcagttacaatccagaaagagtggattccgcctcctggcaggcagctgtgctgtttcaggcccatggacctgcctccaccttttaccttcccccactcactaactcctgctgctgctcacatccctagcctgtgtgcggtgcccctcccctttcctcccacagtgacctgagcacagctcgggtatttatgcctctgttctccccggtaggtttaaagattctttagagcaaagatacagaattttcatcttcccttttccagcccttgtgcagtacctggcacataaaagccattcagccaatgtttgttaaattcagctaaactgagcaggaaacgtctcccttgtgtgtggctgtgcctttttgccattcagagagaggcagtacaatcatggtgatttgaggacacttaaaaatggaaagggctccacatcgaaggcctcttgaatatagtgaaaatgaatatcaaaatcaatatgccgttcagtttagggatatgaataaatgatttcaaatgaattcaattttcctctcaacattaagtggtgaaggaaaataaattattggataatgtatttgaagtaatagctctcttctaactgttcctacaatttgttgttacttgtctttggacctctgtgtgtcatgtgatactgtgtgtcatggcgatctgagaaatatttatctctcctcaccttctaaaggtcagagactgtatcttaggatccaagtttggaattatttcctgacattaatctcttcttcctctgtgctcccataacataatttcttctttttaaatggttgttttaaatagaaaaatgtcgtacttgaatattttgatttttatgggggaaaaatttactactatgaaaaaaatagaataaaactatgtgaaagaacgcctccatttctcc

SEQ ID NO: 54585 - DNA, 1095 bp, Homo sapiens
tgttatgactgtttcctcctagttatcttttaactttgttcactgtagctttttccacatggaaattaaaatatatgtatagtaaaatctttcagtcttataaaaattttttctaagtccttttatcattttctttttaaatttgatatctggtgagacagattccaattaattatggcataatttaaaaatttctttgggattcttgcctattttattgttccatataaaccaacaaattatctgtttaaattgattaataatcattaggattttgattgaaattttatctatagatttatatagaatcaatacattaaaatatggactctccccacccaagaacacaatatattgttttatatgttcaaggctttttgaatgtcttatcatacaattttttcatttttaatatagatcttacacatttttggtacctctatgtttatgtgttttaatgtcttattgttctagtcaatatgactttttaagtataattttaatgttttatttttgtcatatagtcaagctgatttttaaaattttatctaacttttatatagtttttcataaacttgtcaattttttatagattttatttattcttgcagagtcgccttttgctgtgattaatcaagccaaccttgattaattaaaccttttaaatttaaaccttttaaaggcttactgtaaattattgctgtgtttattttccacccttattaattatttccttcaactttgttttactttctttgttgtttattaagttgattatttaattattttcaacatttttgctattaattggtacatttttaaggctacttatttttcctttgagtttatctttgcagtagcctattttagtatatattcacagcgactcagtgattttaattttgaattcctcttacagtcaagatttattaaaattgagattttaaatgtatgcaattggagagttttcttgtcgttctttgtttttgcaggaaggaggtgttcatttttactatttatttatttagccagaaagtgtggaccataatttctactgttacaaatgtgtaaaattattttgtggccttatgtagt

SEQ ID NO: 54586 - DNA, 1001 bp, Homo sapiens
gaaaagaaaatgagtaacaatataaatgactttctggaaaatgaggtctattcaaatttcaggaaaaaagttaactctgaagtattaattgatcataatgaggaggccaaacttcagatacacagaggagccatggaacatttcccataggcctgcagcttgtgaagacgtctaggaacactgacatgaagttaaatttaaaagtaaataaaaatagataagactatcagactgtcaacttgaagaacttcaacaaggaatgctatgctctggctttttgcaattcaaatatacagtaggaagaaacataatcccactaaaaaatacaattgccgtcattcttggccactagaaagaaatttcaaaaaggtcagcctctgctcctttcttccctaagaagtgaatcgatgatatagattatctcatgagcccatgaacagatgcccagttgttttggcagaatttcaaccctcgggagagaatcttaatctagtatctttctcactactggtacaagaggcaccaccactttctacaaacttcccaaccctgtttaatcttcacattctggtcttctcctttgacattccacctgaatattacatttttcattaaacaactatatatatgtgtgtgtatatgtatatatatatgtgtatatatgtgtatgtgtgtttgtgtgtgtgtgtgtgtgtgtatatatatatatatatatatatatatatatatatatgaccgttttgcagggactaagacaactcattcagtacagctcctccaaacaccaaatttttattaccaaatgcttcagatggacacctctttaatatgtacctgtcttaaaaatggaagcagactctcaagttccaaacttaagagcaaataccaaaaacaatgacaaactcagtggctgtgcaatacactgaccattcagaaagagaggcttgatctttcttcatcttacattgtcttctgaattcactaccattagattttggaag

SEQ ID NO: 54587 - DNA, 1050 bp, Homo sapiens
tggtaatacactctaaccactaccttttatcccaggtacaggggcggacaaaacttcatacctgattaatcgtagtacttcttaacctaaggcaaacatgtaaaccagcagggctgacctgaggccccctctgacatactaagtaaggatttgatttgaaataaataaaaatagccttgcctaggggttcattatacttgaaaaatgtgagattggggttaaaactgaccacgttcattgccacatgaagaaagtccagctatagtaaaaaagaatgaagccgaacagagctgagctgagctgagagatggaaaagggagagagttctcttagctttgagttttgatcctagcaattgagaccttgatccctatcctttgatttggtcagatagcacagtatcccttccagccatgtgagccaataaatgttttctttttgtttactttaaaatagtttgaactgggtttctgtctcttgaaacttaaaggatccttacaaaacaaatgctataattcacccatttcgtggataagggaattgaggcttagagagattaagtgacttgctcatggtaacataaccagtgatttttcagagccagaacttcataccctatttaatgactccaaatgctatattctagtcaagacaacaaggccagggagctgggagatggagctggtcattaatgaaaggggcagagaagttatagggcaccatcaaattgtggctatcctcgtagctaattcatgcactggttcatcacatatttgttctaaatatgtgatgcacaaagaaaagaaaatctaaggccagttgtttagatagagaaagtgagtgatctgcaggtaccctcaaccctcaagggtggctgtctgctgtcagctgctgttacccagcaaggggtgagaagccacagagccagcctactcgtgtctccaagttgctattccagtgaatgcaatgtatgcagaacatgtcaaactcttgggccgctcagaaaattgattatggagcttgccccttccttaaaaagcaggcttttgt

SEQ ID NO: 54588 - DNA, 1064 bp, Homo sapiens
atgaaacatgcatttacaaatggcatctgaataccgaatgccactacggaccttaggactcttcctcaggcagcttggtcggagtgagatattgccagcattcattctccccttcactctgattccactctgattgagagtgcattgtttaatatcccctacgaacgacaacaacccaaacgtaacatagaaatcgggagtgaaaagggactgtgaagagtcacatactatatgaaacttgcagcttataaagagagaattaagaaagaaccagaaatgtatatatttggtcagaaggaaagagaagtgtgaacttaagggtattaagcagaggaaactgcctaaaatgataaataaaatggttagttcagttgtttctttacatccctggagttataagtatctccatctgaccatgagttaatggtattgggtatatttactgttgtatgattttcagagcttctagcccaaaactggagacaaaagctctatgttctaccaatgctcacagatgaataatgctttttttaaaaatatcaccaattctgctgtcatttcagacctcagagactctgcttattaggataggaggcaagcaaagaaatgaggtgggcatagaggtggcaggggttaatttcatatttatcatgagatcttgcatgatttccctaaaagatatttaatttccactgggcataataacttgcagctgccagaatgtgctgtgtaccagtggcgagttcttgtctttggagacttatgcaagtcattatttaaaaatagagatccgggagttacagctggctaattaatctaccactaaggaaagctaagcgagtgacccacttaactgctttcaggaaccatggctactctgaagcaaacttttgaaaaagtcctgtacaaagaaccaaactgatacatcctcatggcactgtcgtggtcttctcagggaacatgttccttctccatctgctcctcattcccacaaacaaacaccactaattcagacccttatccatacacatgtgaacgtccacagtgtgggttcccagatactt

SEQ ID NO: 54589 - DNA, 1109 bp, Homo sapiens
tgaagtgacacaatccaattagaagattgcagttacacatggtagtggtagaatgagaggaattgctacctaacaggtaatgtcactgtttgtgccttgtttttgccctctgtggggttgtttctgctttggtccagatctcactctgtccttgggcctactttgggattctgccatcttctgaatgctggtaaatgcctaagctgtaaacagcttgcttttctgcagaacagctcatgcctgaaaaagttgataatgatttcaaaatttcttttaattgagtttttaattacaacacagatagcaaatagccctatcacatgtaattttgacaaagataacaagcaatttcatattctttggagaatgacagtgtgggagcctacagttaagtaccgactgccttgtttttagacaggaatatctgacaaccactcactcagggaaggtcgggaactggaacatctggatctcaataaattgttcaatataacaatccaagtgctataacacaagctgctactgggaatgtaaatctgactggctggtttaggatcttgtctttctaattaatagaccacgtattatgaattgggatactgtagagccagttggtgtatgggcatgccttcaccttaaataaatatttttatcttcagatcttatcacatcagaaaaaaatatgcagataaattattccaaaatgcaaagcttaaatttgatatgggtgccgtgtttcttcattacttttcttttattggcatttacttaagagttctagagccatgcccagagttccagaactccagagctaaaattagacaaagaaacttctccatctcagagagcagagaactcgcccacattagctgatctactggcacctcccacagactcacaaaggccatttgcataactcccatgcctcctagtaacatccaaaggctcaagccgatgtatctttttcaaccacagagcagtaattatcagacttttgcatttcaaaaacctggaaaacaaaaattcttcttaattcaagtcctacagagtggtcaacttcttattttgctaagtaaagatcattaatttttttccttttcactcatttg

SEQ ID NO: 54590 - DNA, 1058 bp, Homo sapiens
ttttcctctcaacttaaatgtcccctcttctaaaaggccaccctatgtgtgtttatctgcttgggatgattttggctgcaaataagaggaaactgtatcgatagtggcccaggccagtagatattaattcacttgcttgaagtccataagcacatagttcagctctggtaccatggctcagcaatgcagtcaaggaccaggcagccttctagctctctgcttcatctcataccattggcttccatctttattatttcaatatatatgcttcaccccagcatcacttccatgccccaggcaggatgacatagcaggagttaagggagcataaagtctttcttacgtgaggcgttgttgcttttttcaggaaggagaatagtccccagagactcctaactatctctgattgattagaactgtgtcacgtgcaagatagtctgaaatatcatgattagctttccaacctctatagtaaaggaaggcaagggccaggggtctgtggatatcttttaggcagccaaacttcagtgtctgccatggtatatgcctctccctctcctaccccccatttaccctcagtcatggttccatatttttttctcttcatggcatttaccatgatttgtagttgtacattttaatcccactgggatagatatcttccatagctggctctgccgccactgtatccccagcctttagtgccctgtgcctgatgaatagcaggtacttaataaacatggtttgatttgtagcttagctggctgctagatgaaaagagaagagaagttatttctgaagttatcacacaatcacaacatcctggaaaaacaggattctggttatcaaaatttgatttacacatacatcctttgtatttattataccatgtttcaaatataaagagatgtatatatgaaataaaataacgaacactcaaattcccaccattcagctctatcaaatttacagattttgccataggcccttgaggtctgttgatactgttatattttaagaaacaaaacatctcaaatccaattgatgtccccgtgtcc

SEQ ID NO: 54591 - DNA, 1073 bp, Homo sapiens
ttgatggctactgtcaaaatgatagataataaaaatgattggcaaagatggagaaactggaatcctcatacactgctgatagggaatcaaaatggcacagcagttttgaaacatagtctagcggttccttaaaatgttggacatagaggccacacatgattcagtaatttcactctgagaaaaataaaaacacatccacacaaaaacttttacatgcattttcaaagcagcattatttttacagtcaaagagtggaaggaacctacatgtctgtcaactgattaatggattgaaaaatgtatgaggtccatacaatctaatattattcagcaattaaaaatacagatacatggtacaacatgtatgaatcttggaaacattctaagtgaagcaagctagtcacaaaagaccaaatattatataattctatttatatgaaatgtccagaataggcacatctatggagatagtagtttagttgtttcctggggctgggacaagggagtaggagcaggaataagaaatgaccataaatggggacagtgtttctccttgggctgatgaaaatgttctaaaattagattgtggtgataaatgcacaatgcagtgaatataacaaaatgcactgaactcactttaaatgagtgaattatatggtatgtgagttttatcaaaataaaactcttaaaaaagtcgggggaggatcactaagtgtcacagtggaggacaggatgtaagaagctgagatgatagacaaggatataagcaaagaccatgtttacatagttcaggaaaattaaaagcagggcttgaactaccatagtggcaatgggaatgatatagtgggaacaaatgcaggatgatgtggtggtaactaggcacactttctctctacatcatcaacacccacttgatagccactttcacccacttgagcgctactgtctctgatgggtagaaacctcactttatttgaaaacacccagagccaaacgtctgtccaccatctcctgagttggcctgcctatgtggagaatcatttaaattatttttactatttgaggcaaaatgtg

SEQ ID NO: 54592 - DNA, 1048 bp, Homo sapiens
ctttcctttctttctcttagatcttcagtaatttctctgtactccatgcagcatgtgcagttgcttaattcaatccatcttttctttttaaaaatttttccaatctcataccttcctctatttactatgataaaactcttctatacttcataggaaactacttaaaagaagtatgtaccttcaatgtctttctccctaaattttcacttacttctaactcaaacagttgattctttatactaacacatgaataaacttgccaatgacatcttatgttgctaaggcttatgcgtgcttttattgtgtttgtttttactcatttttctagagcatttgacatatctccttgtcaaagtgttctcttctcttgccgtgggggacaccactctggttgttctttcttcatttcctttcttggatctcctttttcacccagaaatatcgttctctccaaggacttttttcttggtactctcctttaatcgctcaatgatttcatacaggcccatgtccttaggtgccacttctttgttcatattcccagcctgctgagactcaaataccagtgctcttctagatgtctctacttcagtacccttttagacaactaaaacctcaaactgtccaaaattagcccctcctttcctctctcgaaattgctctttgacttattttcctaatgttgctaatggatgaggcttctatccaggcctaaaactagaatctcagttatccaagtgtcttttgcatttaattttacaccagatattatctattctatctcctatctgtgtacgtcttcccattcataatgccttttaattgtcatttcttcagtgaattacaaagatatcttctgaaatattatcccttcttctggtatggcttcctgcaatattcaattccaatgtcatgctcttgattaaaatctttcagtggtcgctcactgtttctagaccttagctggaactcttggaccaaaaaatgtgagctacctctgtatccacctactttttttaaaaaggcaacttccgcacttataagggac

SEQ ID NO: 54593 - DNA, 1026 bp, Homo sapiens
tggctttatattctttacatgaactgtcttttttcctgcctatcctagtaatatcacagcatctaatttattttcttaaccacataacatatcctttcctcttttctaataagagaatatagttaacttaggcaaatgaagcagtgcctgtgacatattaagtgctattaaatgctcaataaatgtttcatgactgaataaactcaaggccaggtaaacataagaatagagaaaaaataagagtgaagctgtgattggtagttttttgtttgtttcatatctataacctcttggtagcttccccaagaatagttaattgtccatgtgaccaggactttatatccttatgtcacctacttctgcttccttcccccaccagtttctgggaagaattttgccagatcaccagatgcacacagttagctactaaagaatctcttgtctgtctctttagcttctccataaatacacacatttcttcatttgtttttaaggcaatgctgtatgtgtaatcatgtgtgaatctttattgaacacttatggaataagccacctgttcttacaaattagctgagttctcaagaaggcccaaattagtgaattagttgatgaaggaaatttgttgcggagacagcaggcagctaagaaatttttcagcttgtcaaaggtattgttagtctcacagcttggcaaggagagaagaagataccattttgaagaattttaggtagtgtcttaataccttacactcactaaggacgaaaatgaaattgcttgtcttatcagttaaagggaagctttgctgatgtcagaccatagcccagaaagttaactaaaagttttgtagaagtagataatcttttcctggtgatcgatgtggtgagattggaagtgagttgccaggggagtcatggggaaataggcttaatcattttatttgtatttgtgctgaaggcagtgctgaacaaacctctgaagtcacttagccatgtcttttccagggggcatgcaaggcgactgctgatt

SEQ ID NO: 54594 - DNA, 1035 bp, Homo sapiens
gatatggctttgatctgccactcgcttgtcagcagagttgattcactcacttggctagttgagaaggtggcccttcctccatgtgtggtcttcctcaagccccatgctaaggcaaagaagttgacctaagctctgtcttccataggtcaaaggtacctgaatagttgagttattttagtagaaactctgaatatggaattgcagtttgaagcagccaaaatattcatttttatagctgagaagagactctaacatgcagaacatgttgtcttggagaagccagtgatgaaatgtgttggtttgagccatagcaacagttcacctttatatgcagaggaaatggaaatccattttaatcatcaatgaaaagataatcattctaaagttcctttccaacatctatcacaaacatactaagtttccttctaaaaataaaacaactgagttttccctccatcttgtgattttcaatggaacctgaaagctggtgtcctatcctcttatgcccttggtggccagtcaaaagagaacaggttttattcattaattacatcattgatttattcaccaaacatgcattgagcactcacgctgtatcagacacaatcgttagtactaaatgtaagaaatcctgagatcctcaaataaaatagcagaatatgggtggatttgagtagactggtttagaagatattgaggaaggtgatttgatggtaactaaatatgagagtagtgagcgcattaagattaactctcaagtttcttatatgaggagttggggagatggtggtaagtccacaaacttgggtaaggcacccaattttacaggagcaacatactgaaggaaatccgtagggaaaaggtgaaatggtgtatttaccaatgatggtatttgggcatcagggtctggaagctcttcttcagatatggaagcccaggcttggtagtgtagtggactttatggtagagaagtagcatcttttctataaagaaccagattttctttttttttaaataagagctcctggttaaaag

SEQ ID NO: 54595 - DNA, 1051 bp, Homo sapiens
cactgcctctttctgcttggaaggtaacctttaccaagagctatagcctcttaatcttttagtggaaatcgctcttgtgaaaacgagccctgatagtatcttggctcactaattcatgccatgccgctcaaaattaaagcattaaaatttcatagatataataccatttataaatcatgtcataaaaacattcattttcttatagaccttgaaaactgggcatgtattcctcctccagctgttgcttaaagttcattacagcacaccagtatttgtcaaaaacaaagctctggtaaagtggggagatatttaggagcaacaccctcagagcatcaaggcactgtcctcccagcattgtgcacatgttcctcccattagtggtcatggaaactgcaagcccacctctgtgtaatcagagattcccggcagaattgtattaatggagcaagtggttctgggagggtagctttatcattctttatgtccttattctgttcacttggagaaagagactatttaccattttccctaaatttatctcctataaaatttcaatatgtttagtggatgaaggcaacagactaattaagtagacggtaaacatttgccacatttcaaaaaatgacaatgacagacgattctttttgccatttacccttaggcagcagatggggacttgataattgtttaagcagcagaaataacttgccctaatttactatctagttttttgtttgtttgtctttgattatgcctgaataaaaaccttttgtccatttgaagtggtggaaattagaatatccattttgaggtgtttctgggatgtacatgccacatatttggcttgcagatgctaatgggtatctaatcacatttgccaaccataaaatccctattggtaaaacacttacatctgcaataatctgccactttcttgaaacatgctaattttcttaaataatgtagaggcctataaggacttctattttatgtaaacaactagatgtagtaaacaatcagttgcaagaggtcattatatcataatctggac

SEQ ID NO: 54596 - DNA, 2638 bp, Homo sapiens
cagttcatgctggaaccagatccacagttgagggcccaggaataatatgaaagaaaacagtatcttcatgtggcagaaagtgaataacatttattttagcattcatttcatctaatcttattgctcttccctatcataaccaacccattccataagcccttccttagaaatacatagctctctaccatctgtcagtaccttaaaatcaatcaaatacccagtggatttttattttacttatttattgcttaaaagaatagctttagattatgcatctcaaagtctgtggcattgagaagtcactggcctggaataccctgccacctgcaaaaatcaactaacctatctcacttcaatccatttcaaatatttagtttctaattagatttcatttgtgaaaagggttctacaaccaaaaatgcttaaaattactgcttctgacgaggccacgggctcatttcaactactttgaaatgattatcatcaaattctgtggactctgttttggtctgtcctaatctcaacccttcttttcagagcatgtggcagaagcagcttcactacagagataaatattcatgtgcattgcattttgctcacaggcactgtataaactatatttagaagtctgaatgttgagatgtactgtgtcaacattgaaatttaattactgtgatggactttaaatccatggaccttcttgcactgcggagtgaatattacctcttgtgtttcttcattctcctttacattcctatagaagagggttgcaatctgcttaactagaacacccacctgcccttctcctccaagtgaatgaaatgaactctcagttttacgactgttttatctttgtgttgtgaaaaagaaatattgtcttgctaaactctttggacacttcccaatatgcactatctctctcctactcctattatcactcattctggtaataaatgataatgttcattgctaggatttgtaaagcactgtcaagttagcccattattttaaactcaggttaaagtaaggattttagatttatgtaagcctggtgcagtttcattaagaaccaaaggcattttaatttttctccctctacccaagggactttacacttcttaatgtgacattaatcagtgttttaatatttcttcaaaatgtatctattctctgcatgctatttaccgtctttgtcaaagtcagtgaacaggaataaaaagtaactacatgatatagaaactatggtcttcttggcccttgtgtaatagccaagtggatgctgttaaaagtgaatctatccatggtgcctttcctatttctgtacaggattttgatttcattttaaatgaatgtcataaaccccaggtctgaaaactaatagaatttttgcatttacctactgatccataacctttaagttagactgtgtgtccatttgcagtcagttcgttggatgatgcaatgctttaacactgaatgaaaagatttctgctatattccagacaccagatatgaaggccagtttgggtggattattcttagaatgactttatattagtcctgatgggtagtacagaataagctgtaggagctagctacagtcccttaaatgagaggagacaaggaaagagacgtgtttgataacatgacaccgactcactttgggaggtggaaggctaattaggagtccagggattggcagaacatattgtctgagtcctggtcagtacacagtgagtgtgtacactgttgctgactggctggtccccatggagacattactgctcgatcagttctcctcagcgcctgtgtgtccagagctgtgactgtggctttgagatgcctggctgacgggcaaagttctctagatgctgagagtccggcgaacatgtggaggaggctgcattctgctgcccgtcctggccctgggcagtgtgatgcagcatatgcttgcacacaacgaatcaggtccaaatcccacttctaggcttactggttgagtgaccttgggaaaattatttaatctctaaattggtctcttcatctgtaacctgatgttggtgtgaggattaaatatgataatccaggaaaagcatcccgtcaagttctgggcacgtaatggctcttgataaatggaatttaaaaggagagcctgtccctcaggcagttcaaatctgatctaatgacttccaatggatcaagagacgtggcatgtgggtggaaaagcctgaaggctgggattggtgagtgggacgctcaggttaccaacaggtgtagacaggtcctgctactggctgtggcagcaccagttctccataaacatccatcggttaggatccaccaggccttgaggagagtaaagagggcactaggggacctatccctgggagacctggcataaatccaaaggagaggaaggtgggaaacagggatgatgaacatacagagcacatgtttcttcttttccatttttaccggcagccagtctgctcctgaccagaccagatctcagcctagatcccattcctctttgtactgcatattcccctaaagacatcctaaaagagaatgatagacccagtgaatgcttagtagccacaggtagtttttttgtttgtttgtttaaatagggcctgtc

SEQ ID NO: 54597 - DNA, 1049 bp, Homo sapiens
ttgcttctcagacactttatctgaaattctttactctactttccccaaagtttgttttcactccaataattaatttttgagtgcctactccttgtgatacttgttggaaaatcaaagataaatgggacccagtctctgctttcaaagcactcacactggcatctagtgggaacacaggcctgtaaacaaatggtttcagtatgatgtaagaagcatactgatgtggcgatcataggaacagggatggcagaggagggagacctactcatttgaaataagccacctactcattaatagaatctctgaggattactacgattcccacagagcccatcacaagtagcatgagaaagaccccagggtggaagggggcccttgtgctgccccttctccccttatttagtcagcatggagcccctggactggctttgaacatggctctgaacagggcttaggggataactttcagtgactgctgaaatccagtcatatgactatgtgattttagtcatggctcgtggaaataaatatgctttttttaggagtataaacgtaaaaaatactaacaaaaaatgaagctatttctacatatccagaactattttttttagagacatagcagtctcatcagtcaatattacaaatatgacattcttttatttccatctgcaaaattgttcatgaataaacagaaaagaagaatacacctcatctacccaactctttaaaggttatagcctgctcttagaaacatgtttgtcccttatctcaatacctatattgactttcaataccttctaaagaaccaaaggtctctaataccctcttgttcctctgttttcagaggatgtgtgttaacaaatttaactgtgtaataagttattcttaattacattcggatattttctcctcctaaaggaaaactaaataacaatagataaatagatggatggatgaatggatgcatagattagctagctagctagctaggtgatagaatagatagatgtagatagataaatacatagacaatagataaagctgctcct

SEQ ID NO: 54598 - DNA, 1007 bp, Homo sapiens
ttctcaggcctggagacatgattagaaccagctggggaaattgcttttgagtagcagtgactgagttttactcaggggatgcagctttaattgatctgtgcagtcccctcatcccatctttttataagctccccaggtgactataatgcgcggccaaggctgggaaccactgcattggaaaatgcagaatttatctctttaattcagacaaacatatgaaatgtggaccttgtgtattaacatgaagcctggaagactgctagaaaactcttcgacctcctgctttagctttgtttcccctttgcactcaagcagaattaattacttcctacctaataacgtagtcatgcctcttttattttacttatcatgtagaattataattattttttcagtgcctgtctctccagttagacagttggtttccgaggccgagatcatgtcttgtttatgtgaaatagcctcagcttttaacacaattctggcacatagtagttgctcaataggtatcctagaaagggaaggtgagcataaatcagaaaaaagatataaagtgtagtttagtattaactgaaaataatttcttcttggataagcactcacttctaactacaggaaatgtaatgtagacaaatttgtattttcttgtattctgatcttcgtcagaaataatggcagctatcaatttttttatttaaagaatttaacccagcatctcatttcgggaaataaagcaacatatattgaggtagggattgctaacaagtgaatggctagttctgttaagccataataaaattgaaataatatcagcctgggacttttctctacatttcctatgtcagaacatttgcagtaactgttgctatcaatggatcatactcttgaccagctgggattgtctgagtttccacacacaaagagatggatgggatgctattagttagtctctttagacctgaattcaattttgattgaacatgtttatacttgtgagcttataatta

SEQ ID NO: 54599 - DNA, 1023 bp, Homo sapiens
gcaggccgggaataccaagattaggttatctgcagattctctggtgaggacctgcttcttagttcacagacagcatcttcttgctgtgcccttccatggtataaggggtaagagagctccctgagatctcttttagaagggcactaatcctattcatgagggctccactctcacagcctaatgacctcccaaagggcccagctccaaacaccatcacgacaacatatgaatttgtgggagatataaacattcagcctatagccataaccagatgtttttgcaaccaagatggtgaattcttcctgagcacgtgccagtcagactccaggagagcagggatcccatgcacttatgtacttccatccatctcacagcctccatcgctttcagaaggttgagctgcccccaggtaccaaagcaaggactggaatatagctgagagatagaaatgttttgcaaaatgttgcttacagattcagaacttaaactgatttcgatctcttgggaaagaaatatgaattctaatctgatttcaatctctctggaacaaaaaaccttttgtatctatctttcttcaatgatgggaaaaagtaaaataccttccaagcctccactaatccttctactgatgtcttctatattcgtgattcagatgtgccttgtagacaagcacagatcttcactgctcacttctgccataaatgcttcacaaattaaaaaaaaaaaaatggtaagcctccgttagacagaaagaaaatgattcttttcactgtgtttaagaggactgattagggcatttcttcagtagtaccaatgtctaccatatgcttcttcctaaacttatataaaaataaatttctgacaaaaatatgtaaaatctaaacatgtctaactaattctcactgcatttctatgcttttcatggaaagagaaaataacgatgaaacttaagagtattgaaatatttatttttcaaaagtaatctactttattaatattatttgcttcttttttcatggttgt

SEQ ID NO: 54600 - DNA, 1061 bp, Homo sapiens
ttagactggttcacaatattagattgaatcccaaggtgctactgataatcatcagctgcttttcttgccaagaatctttgtttaaatgtattctttcattatccatgtgcttttgaaaaaaatgagggaaagaatgcttttaattgaataatctgtattctgtcaggtatttcttctccgtaggaaggtatctgaaaacttactttactttgctgtttttatttatcctgccagtgtagtatattgatgagagaactgaggtccaatagtgttaaaacaagacatgaaatattgattaattcttcttttaaattctctttttacccctgagtataacagatttcagaagctgctgccaataccatgctctccaataaacctccattattggaaggggggtcttgatacccttcaggctttgataaatgattattatgcttttgaaatgttagctttgagtgcctgaggcttgactttcatcagttcaagaaagaaacagtagaactgaagctgcaaagtttgagccaaaggcccccaaaggaaccatttcatgaaaggagttaaccatagatactgtggcttctgaactcgttgtccttgtcccacctgatactttttctgcattcctaattgtacattcccccattgcaggctaagacttgccctttgggtctaggcctactgagtttgctgatttctaaggttaaaaagtaagataatgggtttagatggacttgtaaagaagggagaaggaagtacgatgcttggttggatgaagaaaatcaggggactgtgaatgagcagagtaggaactggagattataggaatctggctgtttagggtcaaggacgccctcagagcaatcaccctaaggcaagaataggccctggggagtcaagaaatccactgccctcttaggacccagatgagcttggaacagaggggaatctgataaaatgtataagagaactgcacaggacagccactgcacaacaaagagttatcctgtccaaaatgttaatagtgctgagattgataaactctaatctagagaaagtgc

SEQ ID NO: 54601 - DNA, 1050 bp, Homo sapiens
ttttgagaagtttttctatatacgtatatatacacgtgtggttctatttaggtggggaaaaaatgaaaaagcagggacaacaggaggaaatgaaggcagagaaatatagtttcctttcctaggattgagacaattctatttttcatatactcgttgctcattaaatagtaaagggttgatttgctgcaagagtagctgagaattcaaaaacatccttgcagaatgattcaaaagacaaaagccaggctcaacttatagaatgttttggaaactggaagtaatgatacatttcacttcagaagcacttgtaggtctttactagtgctaagtattatggtgagctatcattaaagtgtgccatcttggataaaggccttttgcctactctcttctgcaattttgacacctcaatattcacacccataaacattactaagccccagttctatcgttggaaggagttgttattcttttgttgttcccttatgcaatttttaattctatgaatgttaagtttttttgagctaatgatagatagaaatgcccactcaaagaaaaataaacagagacaaatgttaaaattgccatacagactgtttttccccctgttgtttcactttaaaataaaaagaaatccttgattaatcagaatggcttgggacatgaacttaatttatttagttttctaataaatgaagggccaactcttatttgttctagcccctactgatgagaaacatttgaaaacttgcttgctctcctgcctcgttgtagctttctctgatgaagacttctgcagtatattgtatccctcactctatagcagaaggtgtgtgtggaatatgtagactccagtgttttcttaggaggggtgggaaagggctttctttcctctcctctcctctcgtctcctctttctttcctttctttttgcaactaaactgctactctacactttttattgttgttttctttgtctttttctttctacaaacaggaaacaaaaaaaaaaaaaaacaagtttttctcaatttggagactcaattgaat

SEQ ID NO: 54602 - DNA, 1048 bp, Homo sapiens
accgttttagccgggatggtctcgatctcctgacctcgtgatccgcccgcctcggcctcccaaagtggggatttttaatatacttgatatccaagtcggaaacatatccagaatactactataaacaataacaagagaaaatgttggtctgcctctggaatttgttttgtccatattaactatctgatgctgacatatatttctttttttgctgtgtcagacatattaacaaagttgggttagcacataagctgcatagaacaaagaagtcttccttctttcctcccttccttccttattccttactttcctctctcctcttattttctttctgcaaatctcaacactcttgcagttgaatgtcaaatttggataatttttcttttaacaaatcagcttatagttatctatccaactctataagagatccatatttggaaatgatctcaaaatgagagtcatctttggaaataataacttctacttatatgccaggcttattaaagggctgtgtatctcattcagttcccccaatactttatgaggtacataatgttactatcaccatctcatatataaggaaattgaagcactagagagattaaatagcttacccatggtcacacagcttttgacgaaatgagattggaaccaaggcagtttggcccagagtccatacctatctggggaaggctaataaatgtaaccaataaccccccaaatttcagtagcttaagagaataagatttgtttctccctcaaacataaattctacatagatgctcctctccaaccagcttgtttccaagggtgactcagatacaaagacaccttccatcatgtggctttgccctccttgaggtcctttgagtcctctctattcggcctgctaaaagggaaagagcaaaaaggatcttgtgctggaaggttttatgggcaagcctggaagtgatgtatatcactccacccacattctattggccagcctcactcgcgtgccttggtatgggcaatgctgtctaaatgtgtaggaaaagaatttgatgaa

SEQ ID NO: 54603 - DNA, 1050 bp, Homo sapiens
taatggcttggaaagctatttacaatccagtgctaaaagttttacaatcaggtttcagacaactaggtacaatatgcttcacttttattttaaaaatgtatatatttgcattaaaaaagaatggaaggaaatatttattcaacatatatttcttaagcacctactatgcaccaggcaccctgtgcaagttaacactctaggctgtgagagtatacattgcttttatttcttctctttgattatttgtcttttctgtatctctacactaattttctattaattttataatacaaaattaaagtgcttttatttgcttatgtgcttttgagtggtctgtctttggggagcacattttcagcatatatgaatggccctacctgcatactagtttaccacagtattagtagaagaagctacaaatgaagttattcaccccaaatctcattgcccactcaagtaaatgcagggagagatatgacatcagaaatcaacactcctccagcagctaacaagatattctaggcaatttataaactatgaggataagagtagacattttatcattgcccacccatccctggtctctcagcagtttaattgcttgttagaaagacacttagcaaatccttgagcatgagaaagacaacacacagtaaacttcagtataattttcttgtattcattaaatcactgccaacttgaacatgatttcctctgtactgaggtacacttatcatttctaagaacagtaaattttatgtacaggtttgaagagcgaactttacctagagtttattccctggaggtatttctataacgtgctatttgaagattcctctatttcaattttttaaaacctccatctgcagatgtggtcctaggctgtgaaattctcaggattagagtgggacagatgtttcccagtgctgattttttctcactgccactttgtgctttgttatatcagtcagacaatgaaatgcttaattagctctttccttttgccacaggatcattttataaaatggtaaattaagagctttcaaaatg

SEQ ID NO: 54604 - DNA, 1076 bp, Homo sapiens
ttttagggcttttcccaattgcaaagggagcatggttactcctcctgccatgagagggcagcactgagattgtctccagcccaggaagcagtgggcactgtttagtatgggttagcacctaggtttttatgtggaagcattcaagtcaggctgtggtgatatatgttctcagagtctaccatagtatcattttagtgcttttattacaagtcatcaaacactgtatctgagaaacatgaggataaattatggtacattcaaaaactgctgataaatagcaaagaagagaacagggtactttgggaatataaggccttttgcgtgagaaatgttttgtgctagctatgagtgaattttctacaagcagagaagttccatttggtcctctgaactggttaacattttcttgattctttgcttagtgtagcaaataaaattctgtttattctttttgagagttcccaaaatatctttattgatttggattttgctttttcactttattttatagttgattttaagtttttcttgagtgtgttcatcagatagccatataaaatggaacaatgcatttgtaataacaaatattatacatgatatttttttggccagcccagttgcacagtcaactgagaaagtggaagttatcactttcctcttaattccttttacatatttttcctctggatgagaaaatgttactttctcatatccagaaaagtgttataaaatgatacattgagatcatctgattccctctttattgtgattgtttctttaaaagaaaaaaaagcagaaaggggccatgaacttacaaagaaagttttaaagaatacaccaaaaattgttaaaacaataaatgagttcatcaaggctgcagggcacaagatcaatacacaaaaattaattatatttttatatacttgaaataaatgatctgaaaatgaaggaaacaattctgtttacaatagcatctaaaagaataaaatatttaagaataactataacaaaagaagtgtaaaactaatactctgagaactataaaacattactgaaataaattacagaagatctac

SEQ ID NO: 54605 - DNA, 1061 bp, Homo sapiens
tagattagtgggatagaattgagagtctacaaataaatctatatgtctttggtcacccgaatttaacaagggcaccatggttattcaataaagaatattttttaaacaaatggtgctaggatgattgtatatccacatgtaaaacaatgaaattgggcccttacctcacacaatatagaaaaattaactcaaagcagatcaaagatgtaaatctaagatgtatgtacatataaatctattaaactcctagaagaaaactcagggataaatctgcaggacctcagatttgccaacgaattcttaggtgtaattcccaaaacatgagcaacaacaacaacaaaaaattggttttcaccaaaattaaaattttctgtgcttcaaaggatgctatcaagaagtaaaaaaacaacccatggaataagagaaaatattttcaaattatatatcccctttggaacttgtatccagaatatgtaaagacccatacaactcaataataaaacaaattaacccaattttaaaatgggcaaagaatctcaatagacgtatctccatagaaggcatacaaatagacaaagcacacggaaagattctcaacatcattagccatcaaagaaatgcaaatcaaaatcacaaggaaataactcttcacaccccgtaggatggctgtattgaaaaaaatataacaacaacttttgtcaaatgtggaaagaaattagatctctcatacattgctggtgaaaatgtaaaatgatgctgtcactttggaaaatggactggcagttcctcaaattgtgacacatagagttacatgtgtcccagcagttctactcctaggtatatgccaatataaatgaaaatatctagctacaaaaaacttgtacacaaaggcattattcataacagcattattcataacaatcataaggtagaaacctaaatgtctgttaactgttgaatagataaacaaaatgtggcataaaatatggcgtatccatacaattaaatgttatttggccataagaagcaatgaaaatacagcagttagtgatagatgctac

SEQ ID NO: 54606 - DNA, 1051 bp, Homo sapiens
catccacttagacctcacttccttcaggacacctaggttagacctttgcctgtgtgcttccctagcaccttccactcccttcacatagcacctaacacactctgttgggtttctctgaggtatgtaagctctgtaaccgcagggttcctgtctttcttgttcatccttgcatcttcaaagcctgccgcattacctggcccagagcaagtacttaatgatcatttgttaatgaatgaataaatagatttttccattaatcatctaatcagtgaatttacaattctatgcaattctttgatgctctaagaaattgaagttttattttctgaagttatatattagttttatttcctaaggaatttgatttatccttactttaaatcataactacccagtggttattatagctatgctgccatatggtaaaacacatgaagcatctaatattgccttaagaaagctgtttcacagtaaaaactcttcaggcccttctctcggcacttttcattttatgttgaaattattggtgtttgtatctctcttacctgtaagacattaggtgcctcaaaggcagtgaccatgtgttattcaactttgtatcctcacaaccttgtatctagtgcagtgttggaagtcagtaaatgtttatataaatgcttaagataggccagaatccacatcttggctcaaaaactgtataactgccaacacccatctctgtacttacactcccaaagcctcagtttctacatctgtaaaaatggggattctgctgtttaaaggatcatcttgcagggttgttatgaagtattacataaaatataatgtaaataaggaactcagcatagtgactgaaatataggaattatgaataagctaggatggggataaatctaagtttctttgtgaagacatatggtgtgtcaaaatgttaatttttcactgtcacaggctggcaagacacggtcttagatctagtaaaattgttgcaaaaagaaagcaaagaggcaaacttcccaacttttatattaagaatatttgtctgaaatat

SEQ ID NO: 54607 - DNA, 1051 bp, Homo sapiens
aggtaatttatctagtgatcatgtcctgatgaacacaagggccctattgcaggcaaatcaaaagaggtaggactatgtcccaagtgttgcttctcttaccccaaggttgcccaatgcaatagttttcattctggtacatgcaaacatgtttcctctaaggtgcaatgccagaaacctagaggaaaatgtgtcttggttttatctgagaaaactggcaacaattcctttggaattgattccttttctttttattattttaaagagagaatagatggttattataccacttacgcagctaacagtttgtaggtcaagatgacctagagccaagaatgtgatattcattatgatacagcatgaaaaagagaaagttctgtttgtaaaggatttttttatgaagtcacaggcccaagggagatgagtacagaaagctatttagggtaccaagaataaattggatggccccctctctattcccttttttaatccccctaattatttattctgcaacttctcccccaacaagtatgtaagccacattagggccgggatttttgtttaatgtggcatccccagtgctggtatgtactctgtattaaaaatatattaatgaatgagtgaatgaatgaatgaatttcatctgaagaatgagccttccagacgaattccttgttaaaataagccagcacattgtctataaagcagcttccttgattaaggggcaaggtctcaggttaacgtgagataagagtttctgatttcagcatccagccaaatgatactgttctttggaacgcactctcttcttccctccactagtttttcttccctagcatttgttttggatctgtagttacagcattttctgctcagaattcaactgagggaaaaaaaaatgtgttttgagtaatactcactaaggtgaaaatctgaccatattttgagaaataaggggtttggaggctcaggacagaccatcccactgctgtcttagggacattgggctgctggagcctggcccaaagaaggtcttctgggaaatcaggactga

SEQ ID NO: 54608 - DNA, 1108 bp, Homo sapiens
acaacaatttcactgaatttgaagagaacattgccacctggtcatttgaggctgtttatgtcactaaaccaacaggccaaaaatagggagttgcttcactggttggagtgattgatctcaattatcaaagggatattgagttgctgctacacactggggagaaggaggattatgtggaatccaggggattatctggggtgcccattagcacttcttataacaaccaaaaaaaataaaaaggcagatgactaaggactttacccttctgaaggaaggtttaggtccctctgctggataaagaattgacccgctgaacttctggccaagggcaaaagaaatataagccagaggtatcaactatggccttgtgcccagctactgaaatgaggactgtagtggctttgtgtattttctctttggctattatatgtttatgtgtgtaggctgtttctcctttttccatttttgtttttacacaaactagtggtgcttaaccatacataatagtctttaggcaagaaaataatcaatgaaactatgatagaatttgaggagtaatgactatagctgccaatggatacagtgatggttaggactatgcatctctttattttgtgaagggtgagaatttcttcacttgtgagaatagcaatatcttgttaggtggaaacacagagttgcttcattgtacagaactcacatgagtgaagggtaaatatggaaaatgagtagctaaaggaatgtactgttcccagttatcaactcattgtctcaacccccaatccacttattaccattctatgataatggagctgacccctttaagaatttcttctttacagtgaacatgttgctaagctttgtcaatagacagtgctggaggatcacagaaaaaaggagcttttcttcttgtttcaggtgatcttctcctgcagggggagggagagagagagagagagagtacgtgtgtgtgcacacattctgtgttttctgcagtgcccagtggccggcagcacagagcaccttcctgtggacaactttatagtgggagggctaccagcaaagcatcttcacttgaatggctgcctcaggcaactggttccagcca

SEQ ID NO: 54609 - DNA, 1457 bp, Homo sapiens
aaattgacttagatggactttgatcccagggagtgtgcagggagataaatgataaagataaatataatagtgaataggagtaacaatagaaggagttatagttcaggtactatgggaactcaaagaaaataacatatcaggtgggagagtctggaggaggcatttgagttagtgagttttgaataggcacaatgaataggttaaggagcattctacctcaagggaaaaacatgacccaaggcactggcacttaaacaagtgtgtgttgaatagctgaatggaattgggtagcgtttgttcttccactgatttactcactatgatatatgaatgcctcctgaatggcaagcaccatggcaggttggtgctgggaatataataagatgaccgtcatgaaactacagtctaatagagatagataaaaccgacaaattaatgaatatataaatccaaagtgagaaagactgttaggctactgagtaacttgagtgaggatagatggtatgattaggtagtcagggaaggactctttgaggaaacaaaatataagctgaaactgatctttgttaggagccagtttaccctgtaggatatttaccctgtctgaagtctttaccattgttgctatcccaatgtgtttaatttgactaactagtccccattcaaacacaaccagtgaaatttatctttttcatcaatgtttgctttattgattgctgaattatttacctgttataaaatttatcatgttattcttgttttgcagaaaccgaagctgaaagactggcatcctcctgggggctttattctgggattatgggcacttattatcatggttttcttcaaaacttatggaattaagcatatgaagttcattttttagacttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttggaaaagaaacaattgtgaagacattaaattctcactaacagaagtaactttggttaattattttttgtatatcctcccaatcttttgacttatgcacatattttttcccaatatggagatcatatggaatgtactattttgtaatgtcttttttcattttacaatgtattatcaaccttttccctctcaaaaatacattgtgaatgactgcatagtattcactttatgaatatttaattcatttcacagtcttctattgttggaccacttacatt

SEQ ID NO: 54610 - DNA, 2019 bp, Homo sapiens
tggtccaaacagatataacagcacggggaaactgagagactcctggaggtgcaagtcccaatggggtttggccagtagttaaatataactaaaacagtagactgttaaatagagaaagggttgctggagatgaggcttgagtttggttggagccaggttttgaagacctttaagtgctatgaaagaaacaccctcttttggacagagaattctgaaacatttttgtctcagagaaagacaggatctgagaacattaagtgatgctagctcattttattgcatagttacttaatgtagtctgaatacttctatagtcatttaaaatttttcaatggtagtgtttcaaagattattgataaatactgattatttcaaaaaaaatctatgcattttactatatttcatatttgacatatttaaatatttgctatatttcaaaatagtatttgccttagctctgtgtttttaaattatcttttccagctataaggaagaccagatggatgagaaactaatggaacctctgaaatatgctgaacaacttcctgtagctcagataatacaccaggtttgcatttcattttattcttttgaaagaaacaagatttttaatcgctgagaagtaattgcttttgttaggtttttcagaatcaatgtgctatagctgaaaggcattctgggctgtctatccctatttagactacccctattacagttgaaagtcccattcaaagcacaatattaaaaggctacttgctgtttaacactagaattcttacttacataaaatatgggataaaataaggattatcttttgtgcattatttaattataaaatttaatttcagaaaactttcattttgacccattgtgtatagtacttagtgacaaggaaaaagagctgcaaaaatatcattgagagtaattttttggagtcactaaaaagagaaaacaatcttgccctgcatcctttaccctgcccaatcatcaacccttgcaaagtataattctgcatgtcatgtgggcaatttgttcatttccaattataatgattttatcatccgttctacataactgtaatcattgagaaggcagtgttgtaagcatgtaagcttagactttgtactataatttgacagcatataacctctgccctgctgtgccagaatctaataattttaaatgttctgttgactagagttatagcctttagacctagcagagatttcagaaacttacatattatagtaaatatttaaagcccttaaatggcagagtttctcagaattgttatgaatgttgattgttattgtgagtttttccatatgcctttttccatcaaaataatttttatttagctgatatgtattgattagaagtgccagttagaactttattaaaagaaacagaggcttttactttaaaatgttggctatatatatttttcattgacattaaaatttaatattgcaattctgtgagaaattacaaaaaatgatcagaaatttacacctttgggaagctcgtctgtgcttggtaatcaggtccagtttatatgtcaggaattccctagtgttgtcagagcttaaatgacctaacagtctgcgaatgtcacatttaaaattctgtcttcatgcctgactctcagcataaatgaattaaacagcagagcaggcagcaagtcaatatgttcttaacagtaagagtgagcgatgaaacagtttgtggtttgctcagaattggtaaatagaatctgcccagaacagttcacctagaataaaatctgaaagaggaaacaagaattaacctttaagatggttgaccagatgaaatgtcagtaatatttttatagcatggatgaaccaataaactacctggtttatgtaacagctgcatttgactgttatacactgtgtgaattccaagataaaaaatttttgaccctggtgaaaattttagattgtgatttttttggcagtacaagagactttgttaattttaacactgaattacaaacat

SEQ ID NO: 54611 - DNA, 1030 bp, Homo sapiens
tttccaaagattgtaagaagaaattaatttgatttctctattatttccttttagtttcaagtgcttctttgagctgtcattttcaaaacaggttatactaactattgggctaccttcctatttttggtatgtgtagagaatttcttcctaatgattttggattactctagatgatgtgtctttaattatttattgatattcttaatttttagtttgtttctagcatagcacagtgtctctgctttcttgttcgttttgttggctttatttccagtgtttggaaagatgctttggccttctacctgaaataaactatgtaattttatgtttatttatttgtgatggggtctcactatgtaacccaggctggtatctaattcctaggctcaaatgatccttcctcctcaatctcccacgtagctgggactataggaacatgccatcatacctggctgtatgttattttatacgtgaattgtctgatctcagtgtggcactatagaatataaactttactctttctgagttagagagaaccttctgtgtggacacagtaaataattttacagtgttattttaggagtacttggatagcacagaagagaaagatttttcaggcactggataaacatgaaagagaaaaaggatacagaaagcacagggggattgtaaagactaacttcataggcttcataatttgccaggagtattttatttatgcagaggatttggacagtattttaattgtcttttcatttgagatggtagtatgactctattggagtcaaaatcctattataaagtaagcaaataccatgtgttgtcttctacaaaatctctatttaaaaaaatagtaaagcaaaataaggaatgcacagctttttccatgtagaaattattcccttattaagttatttaagtagattttcttagtgaaggaccttggaaagagatcatggaaaaagaacattcttttaggggggcttctgaaatgactcaaaatgttaagtaaaaggaacacttggatgac

SEQ ID NO: 54612 - DNA, 1301 bp, Homo sapiens
actatttcttataaaaatttaagtggtgatgatgaaaggaaataggaacttaatgcatttctggtggcagtataaattgatacagtcattttggatagcaatttacttgtttctagcaaaatttaaaatgtacataacttatgacccagcaagtccacttctaaataattattctaatgtataggttgggcaactttttctgtaaagggccagatagtaaatatttatttatttatttatttatttttattttttatttttccttttaattacatttattttaatgctgaatttactcccgtgccataagtttttgtttcttcagtttcttctgggatatctttttcttctgggcaacctcctcttctggtttaggaacaatctgttccttttccgtaaggatcatctcaatgtggcagggagagctcatgtatgggttaatccgaccatgagctctgtaggtccggcggcgcatcttaggtgctttgttcacttggatatgctcaatgaccagagaatctacatctaaacccttaagttcagcattactctctgtgtttttaagcatgtgcagcaaaaattcagcactctttttgggccaccgaccttgtgtccagccccactgcttggcctgcgcacacctgccaactccaccattgtaacgtcggaatggtacacactgtttctgtaaagtgacatctttcagatacttcgtggctttttgtatatgcatacccttgatggcctgagcagtttcacgagtgttcttaaagtgaacacgaagattggaacctcttgatttgcatgatttcgtggggttctccgggtcaagtgagtagcgaaccattttcacagattacctcaggctgcttagggaaagagctagatagtaaatatttaaagcatttgtaggtcataggccatatggtctcagttgtaaatatgcagctctgctgttatagtgcaacactgaaattcaaattttgtgtaattttcactagtcatgaaatgttatttttctttagacttattttttctaaccattcaaaaacataaaagccattcttagctaacaggacatacagaaacaggtgacaggtcacatttgagctcacatttgaatgaaaaaagctagtggctgaattacactgtataatttattaatgaaatgatttgtagatattctatatatatttcatgtgtatataaatatgtgtgtaaaagcaaaataaaatgactggaacaatatacattaactcctgatagatttagtagagttcagagtaagtgctcaatgattt

SEQ ID NO: 54613 - DNA, 1085 bp, Homo sapiens
aggttcatttttttttccatatggacatccaaatattccagtaacatttgttgaaaaaattacagatggtctccaacttacttacaatggttcgacttatcatttttgacttcatagtgggtttatcatggtattaaattcattttcaatttacagtattttttatttacaatgagtttattgggacataactccatcataagttgagcagcatctgtatttattcctcattgaattatgttgatccctttgtcaaaaaatcatgttttgggggtctatttctggactttattttgttgcattgtaatatttctatctttataccactattacattcttgattattgtagttttatagaaactcctgaaattatataagtcctccaaattttttttttcattttcaaggttgttttcagtgttctaggttctttgcattttcatataagtttatgaatcagcttgtaggtttcttaaagtaaaaaaagaaaaagaataaaagcctactgggattttgattgggattgaattaactttatattgggctgtatcacagcttaacagtattgagtcctcacaatccgtgagtatatctctacagttatttagatctcatgtaatttctctatattgttttattgtagatatttcctacacattttattaaatttattcctaaacattttgtatgttatttttaaaacattacatttgtttgttgctcaaatgcagaagtattacaattgattttatattgactgtttttctgagatcttattgatttggggtcaacccaattccaatcaaaaccccagcaggctttttatttttttatttttcggtagagattgacaagctgattccaaaatttatatggaaatgtaaaggacctactatagtatatattacattattgaacatatggattctagtctatttataatatttactaggaaattaaatcaaaagttaaatttacatattcaatagtaacatctctttgagattcgggtaaaattgattgtgaagaatatgaaactatgatcacatgattcgcttaaaattgctgatagtaaattgataca

SEQ ID NO: 54614 - DNA, 1050 bp, Homo sapiens
attctagtagaacactgcactgtgatggatacagacaaagaaaaagagcaattctgttttcatcgtgttgagtatgagttctcagagttaagggttcacaatacactttgaagcatataattcaagaaagtgagtatgccttttcccacagtggccagctacctttttattactgtcctaatgtctgtatagttttcttaaaattccaagcattatgataggaatgaaactttaatctttaaggtctttagaacacatagcttctttaggttgggagagttttaaaaatacactatagtttagtgaattatgtgattggatttaataaatgtggtatgtgtgtggatgcatgcatttattattatatattttttcagtttcaggtatgtcccaaaagtctgtgtgtgtctactcctggacatcgcactgatctttttcagagggatcctaaaaatgtactgataactgatttctttggaagtgtacggaaagtggaaattacaacagagactattaaattgcaacaggattcagaaatcatggaaagcaggtattcatcttaaaccattatttgaatagaatactagtctcacagtttgtacatttttttgaaacattgtattaagaggcaaaagttggtgtttgtaaataaaattacacatttatacccagtcttcactttatgtaggctgtatgcttttcagatttatatgtaaaaactatcaatattagtggaaactaagatcatcgttaggattatgttggagctccaaaagacaatcttgctagtggttcagtttgatacttgccacaaaggcctaaaacttttcccataactggctatcccagcgccataattttctgttaggcctcctggtaacattagggaaaggaatgagaagtgtaaaccaggtactgccttggggagtgaattgtatgtgagtgagcagtgagtgagtacagacatttgtaagagagaggaagttgggagacattggttcactttgggtatgtgaattttagaaatacttataatttgttttattttct

SEQ ID NO: 54615 - DNA, 1054 bp, Homo sapiens
agattatatatgttgatgtttattaaatcttgatatgaatttgaatattaaaacttgtgataatgctactttaactgtaaaaaaattatagtcacctaagttccaattacttcaatttgaaagttctcatttttggattgtacattttataatttatgtaaggcatgacatgctatctcgaaagtttaaatatatgtaccttgcacattgaatatctaatgatcgtttaaaaaatacttctattgattatacaggaaagattaaggaaactaatttttttattgctcttaattgctatttagtttttaataaacattcctcactaatacctcatcttaccctaccacctttatttttaagatttaatgatgactattgtaatcttattcaataagaatgattgattttctggcagtttactggggcagtgacttaacctatctctagctcaattgtataataatacctattttctattagagtatatgtgtatagtaaagtttgctgagtatcagctgtattcacagcactatgttagttgctttaggagtagcaaaatttgaagacctggtgttagccccttaaaaatttatagtgtcattggtgacagttgaagagcacatttataaaacattacttgttatgtgaaatgtctggatcctccaggtaattttctttcctttgtgaacatataactcttgccatgtacctttattatacttttagtattgcactgtaattgtttatatttgtgatgtttcctcaaggctttgagcttcttgaatgcgaggtgtaaggaccatgttatattcatcttacactccacagaacttaattacagtacctggtttatttgtagatgctcattgaatatctactaaatgaatgaaaggacatgataacaatgcaatttatatggttcctttaaatatagtgagattagtcataactttttcttggaaaagtaagtacaggtttgaaggaagagaagaagtatagcatactctagggaaataaaatacccgcagacacatggaagttggaataatggatg

SEQ ID NO: 54616 - DNA, 2438 bp, Homo sapiens
tcttcttttctctgtaaaacaaaataacatccctcattgtccgtattgggcatcacctttctctgatctgcttttctttgcagttcctccttagtcctttctcagtgttcattcaacactttgattttgttagactctaggctatatgagggcagggactattgcatctccagcataatatcaggcacattgtaggcactcaatatatatttatagtactcatcacgttccaatgtagttgtatgtttgtctgtgttccacttagagtttatgctctttgagtatagttactaagtcatacttctttttctgaacctagctcaatttctatgacagcatgggtgccaaataagtgcttgttgaatggaatattcatttagattctgaattatatggcatagacaaggaagagggaaaagagctggggcagccaccttgggcacaataagactcgctgtggtttccttggacaaatttatacctttaacttttctgaggtcaaatttctgttgggaattctgctgaaaacttttagctaatgaaatgactaagatatgatttaaacatcttacaaaagtattgtagaaatattagtgtatgatttacagcatgatccttgtcaaagatgttatcatttttctttcagctacaatgagctactgtttattattgatacttgccaaggagcatccatgtatgaacgattttattctcctaacataatggctctagctagtagtcaagtgggagaagattcactctcggtatgtgcattttccccatttgtaaactgtgtctttggaatgtgcagctatttctgaaaccaattaaatgctttatgaatgtatctgttctttcttagactaatacattagaaggaaattttggttacatttaaaacattttgttataatgatactgttagaaatactttttttccccctttccatagcatcaacctgatcctgcaattggagtccatcttatggatagatacacattttatgtcttggaatttttggaagaaattaacccagctagccaaactaatatgaatgaccttgtaagtattcacttgatttgattatagcacataggtatgctaaccttaatgtgaaaagaagtgtattattccctgcactcctagaggatcttgttttatgtgttgaattatagcttttaaaactatttgatatctaccttttacctgtatattagtatttctctgtctctctacaagaggcctgatgttttcctttatttactcattttcttttccttaccagaaatgtactttttttagattcaacttttgaaattctacatattcttcaggggccacctcagattgtgtctccttcaggaagtctccccgaattcttccctgtgggaatttcttgttttttttcagagcctccatagacctttatttctccttggtaacatttaccacagtcttttattgaccttactaattgaatgtaagtctttctcactgaatgggaaactcctggaaaagagagaccttttcttacatatttttgtgggccctacaatttatagtatagtcatttgacaaggcttgttgaatttaatttagatttttttcctgaatttttttgtgctgattcttttcattaaatctactttgaagttgctgttgaaagtaggcataacaaaaagcttgaaacaacaattctagactggataatttactatgtgtcaatgactttcattcttttctccattaatttatagtctgtttattctttcataaatgtttcttgagtgtttgctaagtgccaagcacaggctgttcctaatgaaagaggcagatgccgttcctgctttcatgggacttagaatgaaggtgagactgagtagacagggctctgtcctctagcacttcagccaagcagctttgcattgatctctttaattatatataaatcttttaggtaaattctcagattctgaagcccactgctataggctgtgaaatttgatagaactactgtattagttcattttcatactgctatgaagaaatacctgggcctgggtaatttataaagaaaaagaagattaatggactcacagttccacatggctgaggaggcttcataatcatggcagaaggtgaaggaggagcaaaggcacatcttacatggtggcaggcaagagagcgtgtgcaggggaattacactttatacaaccatcagatctcatgagaactcactatcatgagaatagcatgagagtaactgccccacatgattaaattacctcccaccaagtccctcccatgacatgtgggaattatgggagctacaattcaagatgagatttgagtgaggacacagccaaattatatcattctgcctctggcccctcccagagctcctattctcgtatttcaaaaccaatcgtgccttccc

SEQ ID NO: 54617 - DNA, 1045 bp, Homo sapiens
tgtttgcctggtatttgaaacattttgtgaatggaaactcatttctgatataataatggagccagtggaagagcataaatataggtttctgtaattgaatattagaaaccctattaaagatattatatctgctattttatatagtctatcattctctttttaattggcatagtagaaaattcaatttgtttgttttcatagtatacattttagagtataaaataacaagcgatgtcaaaatgtaatgaatgaagtaaatgtatatatctagatatatgcagtttgcattaaaaaatctattgatcttttttactctttatacaagggcatggtggaaatggtttcttaaaatttcaagattctgaagaaattaccaacatagaactcgcggatgcttttgaacaaatgtggcagaaaagacggtaattagcaaattacttcttttcataagctatattcatacctaattttcacatggttcgtagatttgtaatttttattttttaagatttttaacttattttgacaatttctttgactcttttaaatttacatttgttatttcctctgaactgggttgtttttaaaagaaaaactgagagttattctataacatgaaatagttaaccttttaagattccatctcttgttatttagcatcttttttagaggaaataagtgtccctccaaccaagttagctattattatggagattatgaacatctgtttatttttcaacttgtacctattctttctagctcattctttggcccctaatgttatagacgtatttcttctatggaaaaaaaaatcgctgaaattatgattagcataaaatttgtaacaactcacattaaggatgattgttagtaacccttgctaagcatctctttagttggaagctgtcatgcatatgactgtaagtgaaaaaacttttaacttgattactttcaataaacacttataggctatcttccattcctatggcagaaagtggaatatgatgcttattctgccttcaaagtgtttacaatctaatggaaa

SEQ ID NO: 54618 - DNA, 1056 bp, Homo sapiens
ggtctcgatctcctgacctcgtgatccgcccgcctcagcctcccaaagtgctgggattacaggcgtgagccactgtgcctggccagaaatattcatttttatattgccatttggaggtcaattcagtcttgtttaacaaaggaatatatgattgatatttatttaatgtaaattaatgatctcaagttttaaaaaagagaagatgtattttctgttttaagaggaatgactcactattctgtgaaaatgaatcagtaacagctgaagatctgatctttgaacgtgacagggttggaacactttcaaagtagaaatctagccaattttcaagaaaaataatgtttcagttttgaactttaatgtatttggaacatatgtagcagaacattttcttcttgctgtctcctgccaaactaattacgtatgccacattaatttttcccttatgcttgggaaactcaagatatggtagaatggagaatttcctgattgttactcaccagttttaatggtagagtgaagatgagaagtatcaaagagagattttatttccttctaaagaaattatatgcaaaaattaaaacatttcattcacttaaaattatttactgagtacatactgtatgtcaggccctagtatgtagtatgagtgatacagtggtgaacaggacagatatagcccctgccctcagagagcttatatcctaatgggggtggtggtgataggagatgatggggatttcagattcatagatgtcctgaagaaaataaaacacacaataagatagagtaccatagctaaggctggaattatatgaagatctgggaggagtgaagtctaaatttggtcagtagccacttaagtgggaaaggcttggcatattctaagaacagaaaggccagtgtggaggtagcatagagaatgtgggtggtagaggctgaagttggagagacagagaccagattatatgagccttttagatgatgtaaggagttgcagtttctctctaaatgcaatggggatgcatggaactgcaggtgaacaaaaataaaaat

SEQ ID NO: 54619 - DNA, 1001 bp, Homo sapiens
gttctatcagaaagagtgtcacattctgcagtaaatgcaggaaaaggacatcggggcatgcatgctggggatctgccatcccaggcctaaaagaaacaatatcaagtggaaataagaacagcctcagagctgtacttccctaggtgctgatgctccatgccccatctcctaccttctccttgggctttgttaaatgtgccaagagattttctttttacaatctataggttacaaatgttttgatggactggatcttcagctattctgcaagtcttcctaggtccctgtctaggagtatttgcaatatgtcatctgtagagctgggaaactgaatcatcttagtgctgcacttggccctttcctcctacagccacacaatagaatgcagctctttagagacgctgtgataatcaaatagattcaaagcattggttgtgtatgggagatagtgtagtgcaaaggatcatggtttggaatttggaagcctgcgactgactcttcaccctgccacttgctacatgtgtaacctaatgactgaacatctgaacccctgttttctcatctgtgggaataaataaatcatgttaatatttatttccctaggccgctgtgatgcttaactgagagaatgaaggtacaaatgtattgtaaactatcaagacctcgttattagagattggtgtagtagctaatgctgatatttttaaaatgtttaacagtttcttatgcaaaatacagcagtaaaatttatactgcagtgtcgaacacattcagcacagcttcagactcctggctgtgcgtgaaaactccaagaggataccactggtttatgtcacttgagactccagacattgaacagtaattagggaacatgacagtaatttgatttaaagtctgcagccacagagttcaggctccatccctctctccatcattctccctgagtgcaaatccagagggagggcaagtaggtcgaagcagactctgatggtgtttactta

SEQ ID NO: 54620 - DNA, 1059 bp, Homo sapiens
tcccaacactttgggaagccgaggcaggtagattgcttgagcccaggagtttgagaccagcctgggcaacatggcaaaaccctgtctttacttaaaatacaaacaaatgggcatggtggcacgtggctgtagtctcagctactcgggaggctgagtttgggggaatcacctgaacttgggacgttgaggctgcagtaagccgagatggtgccatggcataatagcctgggggagaacgctgtctcaaaaaaaaaaaaaaaaaaaagcaaggtaatggaaaggacactggagtgaaaattctgggtcttagtcccagttgtggaagtgaagcactcagtaagtgttgacaaagaactacctttcattgcacattaggagctagtaaatgattcgtgtgtcttactaacttttgtttaatcctcagttcctctatgaggttcattactattatgttctccattgtatacatgagaaaactggaggtgcagagagtatgttaaatatgttagctctcaataataattactgtgtgtgggactggagataccaagccgtgtccttatggaggttataatctaatgcagaagaccagcaataagtaagtaaataaaaactattacttcaattcaggcagggataaatgctttgaagataagtaatgctcagagaaaaataataatgggagaatggggaatagtctgccattttagatggaataagcaaagaaatcctctattggccagggtaaattcaaatagaaaccagaatagagcaagggaatttgctgcatgaataatctgtaggaaggggcagaaggatagcagtagcacacgggccctgagccagtagaccgtggcttgttctggcaacattaagatggccagagtagcttaagccaaatgagcaagaggagagtagtagttgatggcgtcgaagagggcacaagccagctcagatgtggccttgaaaacacatcattgtaaaggagtttagattgtgttctgatgtcttctacatacacacaggtctttcgctagacagagacctctaaggtctttt

SEQ ID NO: 54621 - DNA, 1561 bp, Homo sapiens
ctagtcctcttcaacacatagcaatggtatcattgttaattatgtgcacagtttggaaagattctctgctttcccagaaatgacactcacagcatgagagcttcctgagtgttctcgtcaagtacagctctgcaccgttgtggctctagatcactgttcagcagctgaacattcctggtgagcaaaggtttccctggtgaatttttcaccactgcgttttaggtggtgatcttaaatgggtgagatggaacgagagcacacattaaagagagagtaaattccaaaggtttcaaagaacttggtcataaatatgataatgagaagacaaagtatttatattaaaacagtttagtagccttcagttttgtgaaaatagttttcagcacagaaactgacttctttagacaaagttttaaccaatgatggtgtttgcttctaggatatacactttaaaagaactcactgtcccagtggtggtcattgatggcctttagtaaattggagctgcttaatcatattgatatctaatttcttttaaccacaatgaattgtccttaattaccaacagtgaagcactacaggaggcaactgtggcattgcttccttaaccagctcatggtgtgtgaatgttataaaattgtcactcagatatattttttaaatgtaatgttatataagatgatcatgtgatgtgtacaaactatggtgaaaagtgccagtggtagtaactgtgtaaagtttctaattcacaacattaattcctttaaaatacacagccttctgcctctgtatttggagttgtcagtacaactcatcaaagaaaactgcctaatataaaaatcatatatatggtaataatttccctcttttgtagtctgcacaagatccataaaagattgtatttttattactatttaaacaagtgattaaatttagtctgcacagtgagcaagggttcacatgcattcttttatactgctggattttgttgtgcatcatttaaaacattttgtatgtttcttcttatctgtgtatacagtatgttcttgaatgatgttcatttgtcaggagaactgtgagaaataaactatgtggatactgtctgtttatattatagaatgcttgttgtgacttccttttggttagattttggatttttttttttaccagtgttaaaaccagaaattggtattttttaaaatggtttgcttcacatatttaagagttttctttctgtcatttatgaagaataaggaatgtattatggaaaagagggtgatcttaagcaaccctgtaaaaaatggtaaagatttttactcagtgtgtgctgaaacactaaattaaactagcttacaaaaaggaaacacggaccatggttaaagaaaaaggcaattattaatgctcaggtgtgaaaactaaagttgaaaattttttttctagttgtgtctcatgaagataagcccccatgtatttaaacagatggcttttgaaaaatcaccttgtttcctggaaattactattaactataggaaaagatagtataaatattctaagattgatt

SEQ ID NO: 54622 - DNA, 1044 bp, Homo sapiens
atgagttgtactgacaactccaaatacagaggcagaaggctgtgtattttaaaggaattaatgttgtgaattagaaactttacacagttactaccactggcacttttcaccatagtttgtacacatcacatgatcatcttatataacattacatttaaaaaatatatctgagtgacaattttataacattcacacaccatgagctggttaaggaagcaatgccacagttgcctcctgtagtgcttcactgttggtaattaaggacaattcattgtggttaaaagaaattagatatcaatatgattaagcagctccaatttactaaaggccatcaatgaccaccactgggacagtgagttcttttaaagtgtatatcctagaagcaaacaccatcattggttaaaactttgtctaaagaagtcagtttctgtgctgaaaactattttcacaaaactgaaggctactaaactgttttaatataaatactttgtcttctcattatcatatttatgaccaagttctttgaaacctttggaatttactctctctttaatgtgtgctctcgttccatctcacccatttaagatcaccacctaaaacgcagtggtgaaaaattcaccagggaaacctttgctcaccaggaatgttcagctgctgaacagtgatctagagccacaacggtgcagagctgtacttgacgagaacactcaggaagctctcatgctgtgagtgtcatttctgggaaagcagagaatctttccaaactgtgcacataattaacaatgataccattgctatgtgttgaagaggactagtaaatgatgttctcttccatgtcatctgtttgctggaaagtagtttgggtcaaggtaattgtaactggtgccctgagacacacagtagtctctgtctaagaatgtctctgacctataaataggttctaattggtgatcttccttgtgaatatctgtttcatgtagactgtaaagaaaaaaagacacacatcattacatggtagtggatgcattttagtctgtgtattac

SEQ ID NO: 54623 - DNA, 1035 bp, Homo sapiens
acttgcttcacttctcctaattttgctgcaaaacccagccatggcttgtttgccattctgtcagccactatagttgaccagatgatcaaagaaactagaaatgatagatcctttgatttccaaaagtgcacagaacacactgaggactgtcacaatgccaccacgctgagaaagagctagatctgcctttttgacatgatgggcattggttattaggagtctttaggctttgggagagcgattcaataagagataaaagtttagacagaatttcattgttgcctgggtttatgttagccaagagaacctgctaaaacaattctgtatcaattaccaacagtgaagcactacaggaggcagctgtggcattgcttccttaaccagtatttggatagttttaactatggtattaactctctgtttctcaaccatagtcatcatacagtggtctgaggtacctttcaagtagatgattacaaataacaaaacacccaagttggagatgatttacttttaaaaatttttaaataaatttaagctgattgaagattatcccttccaatgttcctctcactcacccatatcttgatattgagtggatggaattttacctagtttgctagaaattgtctctaacacataaccatttgtgtgttatattactgtcctgtgcatggagagagaagagaagatgtctgtgtgcacatcatgtgtttccttgtggaaaataaaaaagatcgtggaacagtataacttaatacattttctctctgaatctgttatagtgtgataactgtggcatagaacccatccagggtgttcggtggcattgccaggattgtcctccagaaatgtctttggatttctgtgattcttgttcagactggtaagtgttttcttcattgtcagtcttcaacttagacaagaaaagagcttctcagccattagtgaatttgatttccaaacatagaaaatattaatacccacacttagtgaattaaattttgttgttctaggcaattaatttttttctgt

SEQ ID NO: 54624 - DNA, 1044 bp, Homo sapiens
atacatttatatagtttttactgtttatgtctcttacagtccattctaaatagtcgtctttgtaactcagttcatcttgttgagtaggagagaaatgttctactttgatcattgggagtacagagcaaaaaacaagagcagaggttggtttgcttgttattaagaaagtgtcatgtttacaggagcaaatgtaaaaatctgttagattggagaagaggaacttccttaaatgagggagaagtagattacaagtcactcaagtaaccgtgaaaatataaagatgggattgggtttgcaatagtgtgtgacagaggtggtaatcatggccgtgcttcccttttacctgcattgaagtagtctgctacaattcagaattactgttgtgttaaaaaaaaaaaaaaaaaaaagtccaaaagcattagtggaaaatactgctaataacagcactaattttctatgagtactaagagatattttaaaaatgaaaaatatcagtagaaaaatattctgtatcagtattacttacacttaattcattttaattaccaaaccaacatttttttttttttttttttttgataggatgacgaaagtattcctatcatgtataggaatttacctgaatataaagaactattacagtttaaaaagttaaagaagcagaaacttcagcaaatgcaagctgaaagtggatttgtgcaacatgtgggctttaaggtaagttctatttaattttaggattcatttcattttatttatttatttatttagagacagagtctcactctgttgcccaggctggagtgcagtggcgtgatctcagcttactgcaacctctgcctcccgggttcaagcgattctcgtgtctcagccacccaagtagctgggattacaggtgtgtgccactatacccagctaatttttgtatttttaatagagatgggggtttcaccatgttggccaggctgcagtattcatttaattttaaaagggtgataagagatactttaaagtggtttctgtagtgttaaactccagaattgc

SEQ ID NO: 54625 - DNA, 1452 bp, Homo sapiens
ggtaaggggcaaaggagggggtggatactagaggaccgatttgaaagcgattgtagaaagtattaagaaatgacaggatttgttacattcgatataagacagagtgaataactgaggataggccaggtgtggtatgcctgtaatcccagcactttgggaggctgaggcaggcagatcacgaggtcaggagatcgagaccatcccggctaacacggtgaaaccccgtctgtactaaaaatacaaaaaaattagctgggtgtggtgacgggcacctgtagtcccagctacttgggaggctggggcaggagaatggtgtgaacccagaaggcagagtttgcagtgagccaagatcgcgccactgcgctccagcctgggtgacagagtgaaactctgtctcaaaaaaagaaaaaaaagaaaaactgaggataacacttagatttctgacttgggctgctttgtgtaagcttttgtttacttgatataaaataaacatagcacttaatacctaatgtagcaggaggaatgggtggggtagggcttgtctggtccgggattgggaatttacagagcatggatcagagaattggggatgcttttaggaaataagtgagcacgggatcagtcataaggtagcaaagaaaagaaatggaacctgggtggcagagcacaaatgaattgggagaataggaagcagaatagtgattagaaatttcaatgaggttaaaaaaataagctgattatttggggtgagaatatgagagaagtaggaataacagtggaggtaggaaatctaagcttaatatttgggatgtaaaacacttatagttgaaggcaaggtccaaggtatggctgttggagtgggagactctgagaaggaatgaagatgaagattatttcagtagaatcagtgtaagattagaggccagaaatagcgagttgggcatctgtgataatcttgaagttgtctaggatgatgaaccacagtgttgtcagcaattttaaatagacaaattttgcatgttaatactttgagtagaaagctacttgtcaatttgggaggtgggggatggtcccgaacatatgtatctaaaagttcggaatcataaatagactttataccttgaaggccagtttattaagggatacttcaacttaatacatttattttattttttaattttgagacggagtctcactctgtctcccaggctggagtgcagtggcacagtcttggctcactgcaacctccgcctcccaggtgcaagcaattctcctgcctcagcttcccgagtagctggtattacaggtgcgtgccaccatgcccaactaatttttgtatttttagtagagacaggcttttgccatgttggctaggctggtcttgaactcctgacctaaagtgatccgtccacctcggcctcccaaagtgctgggattacaggtataagccac

SEQ ID NO: 54626 - DNA, 1056 bp, Homo sapiens
aaattttttttttgttgtttttttgtttttttttttagtgtgagtgtattttatgtgtggcccaagacaattcttccaatgtagcccggggaagccaaagattggacaaccctggcatagaataagcagtcaatcaatgttagataagtattttcagatattcataatgttatagaaattttccttttactttttactggatagttttatgtctggcataggccacttcatcctgtctgatcttctataagatgatcataagaattcagtgcagccagcatttgactgccaagagtatgataaatgctggggatacaaatataagctagatattaaacatgtggtccattttaccgttgttggggtatttcccctacatttaaaaaaaattttttaaagctagttatgctttaaaaacgcagaaaacagaaaaagcaacaacataagagtatgctaaaggatagagtgaaattcttctgatagacttgttggaagtaacatttgtatttttatatttttgattcttgtaatgatttttcactgaaccaattaaaaatttgttttcttacttagtcttcaacaagcagacgacagcaccctcttaataagcatctctttaagccttccactttcatgacttcacatgaaccgccagtgtatatggatgaagatgatgaccgatcttgttttcatagccacatgaacactgctgttgaagatgcatcagtaagttatacacatcaagttgttatatacatcaaggtatagaagagagtaggattttctaattatttccactcttcagagaatgttggtttcttttaatgaacaagtcaaatgtatagtttttaagtaatgtacttttgtgaggaaaatttcaaacatatacaaaaatagaatagtataatgaaccttaacaattatcaacatgaagctaccttattttaatctctactccctacccacctcaactctgctctggattattttggagcaagtcccagatattacacaatataattatcatgtttataaaaggtaatttgttatacagtg

SEQ ID NO: 54627 - DNA, 1068 bp, Homo sapiens
ctagaaatttttcctaccatgaggatttctaattacgtaacccccaaaggtgggagagagtattacattttgaaatgaaatgtgaatgtatttatttagaaatccaatatttaaaattaaatacatattttcttaaatttggtcttgggtatggcttagaaaaagctggaacagctactcatcaaataccctcctgaagaagtagaatctcgacgctggcagaagatagcagatgaattgggcaacaggacagcaaaacaggtaattgaggagatgactgcagattgctggtatgcttttggtagttttttaataaaggagaataatgcagctgacattgggcgatctgccataacactttcagctacagagtgctgtagtatgtggtgtttttttaaaaaaattgtatatattttcgttgatttcagaaacaacttgagatacttctgctttggatcattacgaaatattaaaaaatgaacatataatggacttaatttctcttgaatgcttactaaatatactaattgtatactttttggttatactgagcaaacagatttgtttcattgccttagtgtttcctggttgtctttctaaaaatgtatcttgcagtttactccttcatattcccatctatattaatagatgtgtttttatactacaaatgtaagtgttcacaagttgaaatatgtgtttagctttagaatcaaatttaaatttacttgaataatttttgtttggcctagattttaaaatatatgtgtatttggtggcagtttattgttaattctagattcatgatgagtattgaattcttagcattcattagatactcatgtacgttttaatttttaaaaacgactcaggtattgtatgtcatctcattgtgttaagagacttgtcatgtttccttaggttgccagccgagtacagaagtatttcataaagctaactaaagctggcattccagtaccaggcagaacaccaaacttatatatatactccaaaaaggtaaaagaaaatacatgaaagtaaactgtagattaaatttattaaagtaagaat

SEQ ID NO: 54628 - DNA, 1068 bp, Homo sapiens
ttaacagttctgtatgtggtcttatttttcagtaggtttacctgctagaccaaaaagtcctttagatcctaagaaggatggagagtccctttcatattctatgttgcctttgagtgatggtccagaaggctcaagcagtcgtcctcaggtaagcagtgtgaaatattggagtaggagaatttgaattttagacaaaacaatttaacattttgctggtttgtgttcttaaaattaaagcagtctttcactggaagataaaggagataagaactttgaaattaagagaaacttaggttggagtcctaacttactagccgtgaaccttcagacatcatttacgttgaagtctctaagctgcagtttccttttgtataaaatgtagttgatattacctatcttgtagggttgttggtgagggttaaataggtagtatatgcaatgtgcctagtacagtatccgacacatagtatttactctaaaaatagtagttcctttgtgtgtagtgaaatgtgaccaggatttgagtcctggccttgccactcttagttagatgaacctcagtggacatgttacttttcaattctgagcccacatttcctttcccttttttaaaaaatgaagttacagtactattatgtatttcacaggattgctgagagtataaaaccaaacaaaataaaataatgtgaaggcattttgtaaacagttaaaaaaaaagcatatacattaaaaaacaaatttactcaaatattttgaaattaatttaaaaattccacaatttgcgtgttatttggctatatcaaaggataggtgttgttattttctctctgacaaaagccttgtcttatgtgcagatgataagaggacgcttgtgtgatgataccaaacctgaaacatttaaccagttgtggactgttgaagaacaggtaataaatatttcaaaatcgtgtaggcttaaaaaaacaagtaaacagttaacatcagagtcagtattatgaggccaggtccagtggctcacgcctgtaatcccagcactttgggaggctgatatgggtggatcacttgaag

SEQ ID NO: 54629 - DNA, 1130 bp, Homo sapiens
gccgagatcacaccactgcccactccagtctgggcaacagagcgagactctgtctcaaaaaaaaaaaaaaaaaaaaaagggtcaaagttggagttgatttttaaacattcattgtggagaatttaaaacataaaaaactagatggactagtatggtggaccctcatacacccatcctccatccccagcaacacaaccaatccagccgtatttgtacttcatctagttcctccgtggtataattgtagctcctctattacacttagactccatgcctggtttatcttgataattactaatgcttttagtataatgctttgttttctaagtagataattgttgaattaatgaaaaattgaatcttgccttggatttatgcctggatcagcttctgtagtttgcttgtgtaggtgggtgagcaggattgaaaatagatttgtctatatttactgttttttagatgtcaccccagttttgtttaaataatttcttccatatctgctcatggatatatatggtaatcttactggtgcagtgtctgagtatgctgggaaataattccaattatctgggatagaagacttgaatttactattttcttagagtcttcattattttgagcttgaagactttaccaatgtttatcataggccttccaatctgataatcattttgtcttaactaaatggaagcagaattgaagaactgtactttatttgccatctttgttggaatttttttttaagtcagatttattgtggaaaaatttacatactgtaaaattgtggtaatttgttggcttcaaattagaggcccttcttcccagtgtctgtttgctccaaacctaacaaaaagacggctgccaatgtaattgactgtagcacctttttcaagcttgtttttttgtaaccctatttttacttgtgccttattagttgttactgtacctacagcatttactgaagttttaatagattcacagttgtttttaaagtgataccgaagtgtgtaactcctgcttaaaacagggatagaggcaatataagtctttggttgtattcagctggtgggataggaattctgaaggtgaagtatgacagttaagagtattatatagagaggacagcttct

SEQ ID NO: 54630 - DNA, 1342 bp, Homo sapiens
aagccaggagtttgagacgagcctgggcaacaaagcgagaccctgtccctacaaaaaaaaccaaaccaaaccaaaccccagagaacaaaattcgctgggaatggtggcatacctgtggccctagctactcgggaggctgaggcgagaggatcactttagcccaggagtttgaggccgcagtgagctatgattgcaccactgcccttcaacctgggtgagcgtgagactccatcaaataaataaataaataaataaataaataaataaataaataaataaaatcaacctccagattgctaattccttgatgttctcttcagatgtcaggatttttacctgtatactctttcatataaatgtttttatattcatgaatataaataattcaagaggacttgggtattgaaaagtagtaaaaataacttagataaggacttgaaggggcatttatactttggccaaatatataaagctaaaatgtctttctgtttgagatgtaaaagtaaaaacagttctggttgggtgtgggggctcacgcctataatcccaacactttgggaggccaaggtgggaggaaagcttgagaccaggagtttgagatcagcctgggcgacacagcaagaccctttctctacaaaaaatttaaaaagtagctgggcatggtggtacacacctgtcccagctacgtgggaggctgaagtgagaggattgcttgagctcgagaggtagaggctgcattgagccatgatctgacgttgcccacctgccagggtaacacagcgactccctgtctcaaaaggcgaaaataagaaaaccctaattctttgacacaagtaagttcactgttgttagcattgtgtaagatttagatttagacataaataacaaataattttaatagatttaatacaaagctatccttacggaaaaggtataactatgattttatccaggcaaaaatatgtgtaattttttttttgagttattctattctcttgcttggttcagtgagtagcaaaagtaaaagtaggatatttattggaattaaagagtttcaggtttttagtgcttgaatttcttttaaatatctgtctgaacatctatggtgattgggtgctatcctaccatcttttattagttttgactgagacaaggtttttcttcatattgtgtctttatcacaatttgctcctggtttgaccctttatactctataaaacaagtctatttttttttttcctgcatagctgtttgttaagtaaaaatggaagtggtattctagtggaggttttcatttcttgactaaatattctcagggtctttaaccattcctcacattgca

SEQ ID NO: 54631 - DNA, 1038 bp, Homo sapiens
tctttgagagaatcatgtctgtctggttggttgatgtatcggtggtgaaatttcaagcattatactgctttgaaaatgtcagagaaaaatttagcatgcttttcatagtagaaaaatttaaataccattatttgactttcaagattctgaattttatatagtgttagtgattttttaacatttaaattttcgaaagaaaaatatgcgatatcatcattcatatggttaatttaactcagctatgtggagacatataagaggagtctcatgtttacagatgagttgtccgagtttgttacctagtggtaaaatcatgtttttacatggtcatataagaaatgtaagttcagtttttaataataccagactcccaaagagaagtcattgtgttataaaataaatttaggtttggtattatcagaatgttttatatgattgtaaatacaattttacaatctagagttttgccagtaggcattagaagcctacagagtggttaagaatttgattgtggttgtctttactgaattgaaggacttgaaagaaaatgtgtgtccttgcctttttatgtgtgtctgttctattaaagattttcagtagaggatagtactcaactttcttggttaaaaactcataattttgagtagatgctacaattaatttaaaatgacatgtgctgtgtctttgcagttactatgaaatgatagcctacatatagtttaacatacatgtagtttgggctatatttgaggtatgttgtttgttacagtattagtttttaactagaagttactaacttgcctctgttatatgaaacttttatgtatttgtaatactagaataagaggtaaacattttagattttacagtggattgtttcatagaataggtaatctaaaattctggagtagggaaatatcaagggaatcttgatctgactggttgtcaggggtttttttctagatgattgtgaaatttttattctgttagctataatatagttgcatttagctttctattttaagagagaaaactcaa

SEQ ID NO: 54632 - DNA, 1003 bp, Homo sapiens
tatatttgtacccaagtataatttaaccttttcttttttttcttttttttttgagacagggtctcactctgtcacccaggctggagtgcagtggtgccatctcagctcactgcaacctctgcctcccaggttcaagtgattctcctgcctcagcctcctgagtagctgggattacagacgtgccaccacacccggctagtttttgtattttttttttttttagtagagacagagtttcatcatgttgaccaggctggtctcgaactcctgacctcaagtgatccgcccccctcagcctcccaaagtgctgggattacaggtgtgagccaccatgcctggcttaaccttttctttttgatttaggttcatctttttgacagaggttatgaagtaatacttttctggcatcattgccagaataggtctgtttttttcctgtgataaattattttgggctacttggttttttatgttcttataatctgtttcttttctatgttcttttctaagttctgtgactttttattgttttcttcatttttgttggctttcatgagtcaccttcctttagtaactaagactttccttctaattgactgcttttagttttctctgaaattggatatcagaataacacttgtcagaattatgtctcatgattctttagtgattgatacattgaggagtttatctttgaatgaatatgtgttagtgtgtgggatgtttgattgtgttttcttgtttgtatgctttccggtttaggggctgtgtttcatgtaagttaccagatctaaattctgaacagagaaacaataattatttccttatatatatggtaagaaagactcacttagcaataaaccccatctaaaacaattatttatctacaattttgacactaattgaagcttagcttttagttgcagaaacttaattttggtaattttttatagaagtgtacagaaaacccaacttttttccttctatactcactctgtctcag

SEQ ID NO: 54633 - DNA, 1001 bp, Homo sapiens
aaataggatcaaacttctatcttttaattactagtttgaactatacttggttacctcatccagtgaggacttacttcatgggcttttgggtttctatgttgagaaccctcatggagcagatcttggggactcagttgtcaggaattctttaccctgaggttaggttctgtaattgtagtcatgattatctgatttttatttgttacagaatcagcattataggtaagtactttgctttatttattgaatgaaatactttcatgttcattattttaaagaacatcttatttgtgaagaataaactggtgaaataaaactatggctgtagcttgatttcaaatagaggatttgaataatatgaaaagaatactctggggtattttagaatgcggtaggtatattaaagtcaaagattactaaggaaaactcatgcttggtgtaccttctcaactcaccagaaaaggctgtagaataatagccggatttacccctctggtctggcacaaagattaatgggaagagagaggtagctttctaaaacaggggtccccaaccagtccatggcctgttaggaactgggctgcacaccaggaggtgaacagcacctcctgtcagatcaacagtgaaattagattctcataggagcacgaactctattgtgaaccatgcatgtgagggatctaggttgcacgctccttatgagaatctaatgcctgatgatctgtcactgtctcttatcacccccagatgagatcgtctagttgcaggaaaacaagcttagggctcccactgattctacattatggtgagttgtataattatttcattagatattacaatggaataataaggataatagaaataaagtacacagtaaatgtaatgtgcttgaatcatcctgaaacaaccccatcacccagtctgtggaaaaaattgtccttcatgaaaccagttcccagtgccaaaaaggttggggactgctgctctaaaatatgtaattt

SEQ ID NO: 54634 - DNA, 1100 bp, Homo sapiens
cacctgtctaattttttgtaattttaattgagacaggggttcgccatgttgtccaggctgatcttgaactcctgggttcgagcgatctgcccgccttggcctcccaaagtgctgggattacaggcatgaaccacctaacctggctaggatcgcacttttgagacttttctcttttttcttttttttcaaaggaagcaaatcagaaatgagatggagtatcatgattagcatctcagagctaatttaaggaaaattgggagagggtgtttgatcatgtcagatctaatctctttcagtaaagtctctttcctcccccataccttcattgtctagagccaagagttggttggatataatgttggctctttttaatccaagttgccatcgctaaaagtagcatcatgacacctgtctggtgctttcaagtctcaagtaaatttctggcagtttgaaaatgatgttaaaaagcacttgggttttaaaaaaaggcacttgaaggagatggtttattctcctcctgtacacacatatgtacataccttgtcaaatgttacttctcttccttattctccctgtgctagaaacgttctccaggtaattgctttttgaaaccgaggttgagcattgcccagcctaaatatgaatatctctaccagtagggaatgaatacttcttgatagccagttttaaaagtaagttgttaatagaaaatactgagcatggcataattctttgtctagagccaggaggacataactctgtgttattctagttgaaacttttcctctaacctaacagtgatcaacagccttctatcctagtgttcagcttacagtttatctgtcttgtgtgcaaagatatcccatataaggtcatccgatcacttgtaaatgtttgcgaaagtattgtgtagaatcctagtcttagatgtgatttatagtaaattaggcattagaccagggaaacaaatctgtggatgttctgggtactagcttgatgcctctctagatgccatccctcttctctagcgcataaatccacagtgtgcttttatatatttatttttccaaatggagaaccccactgtgagaaagggacca

SEQ ID NO: 54635 - DNA, 3316 bp, Homo sapiens
atgagtggatcatgatgaccgtattgtagggacttgccatagtatggctgcttcccgatctactcgtgttacaagatcaacagtggggttaaacggcttggatgaatctttttgtggtagaactttaaggaatcgtagcattgcgcatcctgaagaaatctcttctaattctcaagtacgatcaagatcaccaaagaagagaccagagcctgtgccaattcagaaaggaaataataatgggagaaccactgatttaaaacagcagagtacccgagaatcatgggtaagccctaggaaaagaggactttcttcttcagaaaaggataacatagaaaggcaggctatagaaaattgtgagagaaggcaaacagaacctgtttcaccagttttaaaaagaattaagcgttgtcttagatctgaagcaccaaacagttcagaagaagattctcctataaaatcagacaaggagtcagtagaacagaggagtacagtagtggacaatgatgcagattttcaagggactaaacgagcttgtcgatgtcttatactggatgattgtgagaaaagggaaattaaaaaggtgaatgtcagtgaggaagggccacttaattctgcagtagttgaagaaatcacaggctatttggctgtcaatggtgttgatgacagtgattcagctgttataaactgtgatgactgtcagcctgatgggaacactaaacaaaatagcattggttcctatgtgttacaggaaaaatcagtagctgaaaatggggatacggatacccaaacttcaatgttccttgatagtaggaaggaggacagttatatagaccataaggtgccttgcacagattcacaagtgcaggtcaagttggaggaccacaaaatagtaactgcctgcttgcctgtggaacatgttaatcagctgactactgagccagctacagggcccttttctgaaactcagtcatctttaagggattctgaggaggaagtagatgtggtgggagatagcagtgcctcaaaagagcagtgtaaagaaaacaccaataacgaactggacacaagtcttgagagtatgccagcctccggagaacctgaaccatctcctgttctagactgtgtttcagctcaaatgatgtctttatcagaacctcaagaacatcgttatactctgagaacctcaccacgaagggcagcccctaccagaggtagtcccactaaaaacagttctccttacagagaaaatggacaatttgaggagaataatcttagtcctaatgaaacaaatgcaactgttagtgataatgtaagtcaatctcctacaaatcctggtgaaatttctcaaaatgaaaaagggatatgttgtgactctcaaaataatggaagtgaaggagtaagtaaaccaccctcagaggcaagactcaatattggacatttgccatctgccaaagagagtgccagtcagcacattacagaagaggaagatgatgatcctgatgtttattactttgaatcagatcatgtggcactgaaacacaacaaagagtatgtgtaaatatggtaaccatgaattctgctttgtttattattccccaagtttttcagtatctattcgtagtgtttttattacagccaaaattaatgttttcactaaaattttaggtttaatatgattttctcaactcttagaaaaactccaaaaaaagacttaaactcaactttacacgtgtgttctatgacaacatggtctttccagttctgatatttcatgtctcaattagaaaagacatggttggtagtgtttttgtttttttaatatgttttatatcatttttagttaatttatacaatggaaacacattgagttaccacagtatgctttgatttatagttctagatagcataggacaattaatgagtgcttagacatcatccagatatgtgaagtctggcaggcttgacatctacttttatcttacttacatttaattcccaattaaaattttttattaaaaaatgtgctttatgcatcatctttgactttgacttagagaagtggatattactattaacactatgacagtatattgtaattagcatattagcaagggttagtctactggatagtttacataaaacatttgacatagcttttcctgatactaaatataaaggaagactatcttaaaatattatcagctctcaacctttgctaagtcactgttgtaaataaagaattctgtatccaaatttttcacaatatttcttgcctagatttcctataaagtattcagggccataacacaaaagatttggagcttactatgtctagataatcctgaaaagaactagaacacacagtgctcatcataaatatcatgattagcaacaataaaagacagacttatgtaataagttaattacctttattgctacagggtaggcttttgaattaatatcacaaccagattatatagactgtacataaatactttgatttgaggaacatttctagtggttttgttgtgacaattgccagaccctggtatgtgtcagatcaaagtatcaaatcctggttgtgggacataatattttttttgccatgcattgtagatagtgtagatttgtatatggtaatacagtggtctttcagcataggccccttctgaaaagttttcttctgctttcttttgaaatactatcttaatattgtatttgatagttcatgtcatctgagcattttacaattttgtgaaaatgttaggagtctcgagtatttggaatatttgaagtccagttttagatagcaaaacaactcataaatgaagttttttttgtattagaaataagttgagttctgctgttcatatatactgtcagtttttttgtttgtttgtttgtttttgtttttcgttttttgagacagcatcgcacttgttgcccaggcttgagtacacaggtgcaatcatggctcactgcaaccttgacttccctgggctcaagcaatcctcccatctcagcctcccaagtagctgggactacaggcacatgccaccactcctggctaatatttttttgtattttgtagaggcaggttttcaccatggtgcccaggctcgtcttaatctcctgggctcgattgatcctcccacctcagcctcccagagtattgagtataggcatgagccactgcacctggcctagtatcagtttttaaaagtagacctgtttatctgcagtgcagggaaggagagcgtatgtcttaggaaaataccaaaaactaaagaaatgtgaatttttataaaatgatata

SEQ ID NO: 54636 - DNA, 1029 bp, Homo sapiens
atttaatatttaaaaataagtaatcttaaccctttagagtgccagatttggatacatgaaacaagtaagttgcttttcatgtatttcagtttgtgttcttttctttttatttttttttgagacagagtctcgctctgttgcccaggctagagtgcagtggcgcgatctcggctcactgcaacctttgcctcctgggttcaagcgattctcctgcctcagcctcccgagtagctgggattacaggcatgtgccaccatgccctactagtttttgtatttttagtagagacggggtttcaccatgttggccaggctggtcacgaactcctgacctcaagtaatccgtctgccttggcctcccaaagtaccgggattacaggcatgagccactgcccctggccagtttgtgttcttttaaaacatcatttgaagtttaacttaaatgttttacaattaaaagtggaaaattatgggacactcagtgtttgttacccatgaaagaaacagattgtaatcttcatgataatatattagcaaacgataattaaatgtcagctgttcttttaatgaatcccccaaacaatgaaagtttactactgtaagaaatgtgtttctaagttctgatttgtgtcttgtacttattgttcacttggttgctatgaaattctgtagaacatataaccatgctttaattccagggctagttttgtgattcttataagatttaaaaaaattgttaattaaaaatttaaaagtatgccatactttgagacaacactaaactcaggcaacttaaatattttacagggtactttctcacttaattcacttgtcagcaggcaggaacagggagattatttcctgtagtgtttcttttttatatgtggtagcatgttgctgtgtcttctataattcttccaaactttccactgttagatagttctagttgaagcaaggagaaattgtgtttgatttttaggggtaggagtcagaatggcatttggaggtttacatgagaagggagactgtt

SEQ ID NO: 54637 - DNA, 3322 bp, Homo sapiens
gttcatcatcttctttaatccttttttttcattattttattttaaagaaaaatttaggaggttctagtattcttcatggctgaagctgagagagtctgaaaccctgatgcttaagctccattctagatcatagctccaactccttcaggatataaggaaaagagattatatttccacaatgatagatctttggttgtacaggtaagttatttagttttgcagtagtgaagacagctatagtttgacttcttcttcttttttttttttgagatggggagacttgttatttttccatacatcctctgggtggcaacttgtagtttggctggctgtttataggagtatggagctgcagggaatgggttaggaatgaaatatttccctccctttttttttcaatggggtataaatgaagtgactgattatgttggaattttttactcaggaggcattgtgaaattccttgacttccttttcctgatcgtcttttaaagtgtgtgttcatttacttttgtctatctgtctgtctgtctgtctgactgtccgcttatctgcctgcctacctacctacctacctacctaccgaccatctgtcatatatcagtttctcttaatgggaaagaaataagaagtctctttatgtaaaacaatgcataatagagttcccagacttcaaagaggtgactatttaagaaccttaagttgaattgcatgggtgggttaccagccaggttttactcttctacttttaacattatagatatggtggtaattgcactgctgaggtattgtcttaaaataattatatgacaaacatggcctcaacgttattaaatagtttatgtttagacaactagaaaaagaatcatattggttacactttccagttgcatttgctcttttttccttttactttggtttgtctatgtgaatatattctggtatcatgaccagtttactaaaaatttttcacttaataaaactaaatattatgataataaatatcagctaaaccattggtgtgatggaagattgccagctgctcaattcccaaaataaactgtaccactttggtgattatagtaggaacaaaagcttataggcaaggtctttgaaatatctttttgaaatttctttctcttaagtaaatagctggagaagtgtgtcattaggtgggccttttttgtttaataattattatctgttttagttcttatgcgtacagttctacaggtatgatcataggagctggaaatttatgacctgaaatgtagctgataatgcttcaaagagtgtttttcagaatcctatagttatatttgggtaacagtagattcaaatttatgagagggcaattcagcagcaaatatgtgggtaggatatgtgaaattataggtaggattgagggcttaatatgaatggacaagttgaaattcggttgactagtccttctcagatatggcctccaagaggatgagaatttatgaaggtggggaagagagggagggagtctggttaattctagttactgaccacactcttttttctctgaattctagaaagtgcaaccattcattatttggtagataacatataggaaaaactccagtgtagttgttagttagattgcgttttgcccatatgaatatgttaattaatggcttcccttatttctaaaactagattgattgcatttctaatttcagatggatgctggctaaggtttttaccatatacctcttattttgttagccaacagggttatttcctgagataatttgtaaataagttcatttttattccttaacaatatttggcagaaatataattttgtactctaagcttctttattgtattcttaagaaacattttgcaatgcagctaaaatgaggaaaacaactgctttagtctataatattttgctaagcttggcaaaacaatgttgagacttggttgagataatacagactttttattttttattttctaacagaaagggtctcactattgtccaggcagttctcaaactcctgggctcaagtgatcctcttgcctcagcctcctgagtatctgtgactgtaggtgcccccacttccctgcccctgcacctggctaatctagacatttttggtccctttttattaactgaattttgcactcagtttattagataattatagaaagtgtgtacctttatatatgcctatccaaaatagaaaagatatgaagaaaaaggttagaacagaaaaaaatgatcagagggaagattagcaaaattttgtttaactctgatcttaataattttaaccagtttattacctcaagtgcacatcacatgttaatttcaggtaagattttttatagtcttccatttggtgcttccttggtcttatttataaatttttttattattaggatccagtaagaaattaaagggtattttataaatagttctaatttagtttgaaacttgatgactattatcttattagaattctgtctgggttcactagcctaaggcagtgcttctcaaaccctaatacatacatgaatcacctaggagcctaattcgttggtaggtctggggcggagcctcgtattctgcatttctaacaagcttccaggagatgcccgtgattgagctgcaagagcctgaggtaccacaaggatccttgttataaaacaagttctctttcaatacagcccaatagcacagaatttgacaatcctagcactagggctttgttctagttattgagtgaaataaaagcatttttagggtacagaagaaatggaaagaaccttaatcttttatattaatcagtgttttcatattttatttaacttttgtattaatcagtgttttcatattttaatcagtggaatggtgaaaaattaagataggccttactatacgtgattttttttttttttttttttttttcaagacagggccttgctcccatcacccaggctgaagggcagtcacatcactacacccttgacttcccaggctcaagtgatcctcccactcagcctccctagtacctgggactacaggcaggcttcactacacctggataaattttttgtatttttagtagagacagggtttcgccatgttgcccagtttggtctcgaattcctgggctcaagtgatccacctacctcggtttcccaaagtcctgggattacaggcctgagccaccatgaccagcttataggtgatattttatagtaaagaatatatgtataaaaaaaaggtttttagtactactaataataggttcatttcatccaaaatagtctctctttgagaagt

SEQ ID NO: 54638 - DNA, 1518 bp, Homo sapiens
gagtaattgtagacttaaggaaaatgacatatgtctatattggtggtaagaaaaggaacctgaggagctcttcaatttgtaagggtttaagtatggaattaaatttagaatgtttgtatgtgggtactccctgagaagaacttggaagtgttagccaatcatcttagtttgttgaagacacatatttcacagctaaatgtaaggaattacttgtgaagtttagtagaaaatgaagtgtgctatataagtgtttggaaatattaccaattttattcacaaatttgtaaacggtaacacatctatagtgactatattatggtttctcttcacagatatcaagttattctagtacaaccatataaataaataatacctgaagtctcagtgtaacatggacaattaacagtgatgacagataaatacagacgcatggggatcaaatactaggcaaaacgctttttaaaaggtaagaaataatgtaatcttaattaaggccatgtggggtttagttagaagtaattgattgaagtttctttttcagtgtatcaggcttttaagaaacactgcaggatcctgtctatcttaatgctgatagagctcagctgtaagtatcagttctgtgaaaataacagttgcagatgttcttgcctgctaaatatcgtagtggataatcttcctatagtgaactctattcaaatagagtagttatgtggttgattagaacttgatagagtgctactagggcacattccagtatgctcagagatatactttaagttgtagatgttctttgcttttgatgattgctactaccatcacacactgtaaaacgtaatgttttgccatgtttgtgaaaggcttcagtgtttggtacaaaggagttgtcacttggagtctgttataagaagagtgggttttcaagtcaagggttactttatgtaggatcatgttttcgctgagcttctccccatgttaacttagaacatttcttaatgtactgtagtattaaatggttattagacaattttcctaccttgtgctttttaaagcatttccagggcatgtttgggagaggtggcatctatagatattagatattactatccctattctctttctagctgactagagcagtaacctatttttattatgcagtaagtctgcctagtaattacaagattttgtaattatatcagtctttaagttgtaatgctttccccaaaatgtatcactattataatatctagttttatgcttataataaagcgacagtttctgtcataaacatctgctggtcgttttcttagtcctcttccttgttttcagatgggcactcatagtaacccatttagcagattgtacattctctctttttttttttttttttgagactgagttttgctcttgttgcccaggctggagtgcaatggggtgatcttggctcactgcaacctctgcctcccaggttcaagcgattctcctgcctcagcctcctgagtagctaggattacaggcgca

SEQ ID NO: 54639 - DNA, 1137 bp, Homo sapiens
tgaggtcaggatttgagaccagcctggccaacatggcaaaaccccatctctactaaaagtacaaaaattaaatgggcgtggtggcaggcgcctgtaatcccagctactcaggaggctgaggcaggagaatcacttgaatccaggaggcagaggctgcattgagtcgagatcgcaccgttgcactccagcctgggcaacaagagcaaaacgccgtctcaaaaagaaaaaaaaaaaaaagaaagttatttctgtctttgaccatatctttatgctttttacaactgacgttgaatgtctctttcttataaaatcatttaaaatcatagtatagtgcctatatgtgatactttcacttacaacaagtgaagaatcaggtaataaatatgactctgttgtatgaccttccttttgaattttttccaagctcttataaaactaaaaaataatttgcctgagaatttagggattgtgcttaactttgaacttcattgttttattttaatagtaagttgtgtggcttataccctggttatatcactagggctgtatcttctagtgagatttacgtagtcttttgaagtgattacatgtgtgctgtgaatctgagatcacgtaatctatttaacacagtagtaccagtgttaagactgcaagaagtaggaaaagtaattcttttcagtgaagattggttttgggtttgctttggaatgcttgaatagtcaatgaattttattagtacatgaaaacaagcaaagctctgttccaagggaataaataagatggctttaggaataggacttggatagtttgttttctattttgtatgctttttaaaagacaaaatgctgttttttaaacttctagaagtaagtaactgtagttaaataattcaaatgaaaaaattactgtgtattgtcataattcaaagcagtgtttctgctgcaaaaagcatataacagttttgcagaatgcttgagtttgaaatgtatattgaatgaggtgaagaacacaatacaggggctacaagagttttggctagtttaatttccttgcttttttgttacaagagatgtcatgacaatttttaaacttaaaaaatacttagatcggttttttctttttttttttctttgttac

SEQ ID NO: 54640 - DNA, 1107 bp, Homo sapiens
tttaagcgattctcatgcctcagcctcctgagtaggtggcaccacaggtgtgcaccaccatgccctgctaatttttgtatttttagtagggatgggttttcgccatgttggctaggccggttttgaacccctggcctcaagtgatctgcctgccttggcctcccaaagtgctgggagtatagatgtgagctgctgcagccagccttattatgtccttatggtagaaacactatgtaatgtataatgtgttgccatgtatttttttccgattcttattcactgatatgtcagtagcttgaaattggctgtggtggaagtatatataccacaaacattagtaaccctataaactaggaactacatactacttacccttcagttattacatgttttctggcatacccttgcctatggatgtctttccctgttttactgatcaatactcagctcaagatttaaggaggtcccctgcagattatctgagatcttgcctctcctttctgctctctcctctgtggtactatgttctgggagactgtagctaccttggcctcccctaaactcctcacttcattatcttaactccagaaaaccactgagcttgcttgggacaccttcctttctctgcagcttagaaattctccagtaagtaaactggggacaattgtaggctttacctcatttattttttctctttcattgatcactgtcctgtgttgtcttgtttcttttgtcagaaataattttcatactttttttggtccagatttttagttgtttcaggtgggagcataagtttcatccctgttactctatgttggcaagaagcataagtctcttggaagaattttaggtaggagaatgacatatcattctgtagagcatgcatttttaaaggataagacttaacgaaagcagagctgggcgccataactcatgtctgtaatcccagcactttgtgaggctgaggtgggaggatcacttgagcccaggagttcaggactagcctgggcaacatggtgtgaaaccctgtctctacaaaaaatacaaaaattagctgggcgtagtggcatgcaccagtagtctcaactacttgggaggctgagg

SEQ ID NO: 54641 - DNA, 1311 bp, Homo sapiens
cacttaatggaccattcacaatctatgtaatgtatgaagaggaaatggggagaagagaaagagaagataagagaaacttgatatctatagttccatgatgatactgacaacctcagagttcttgtctgtggtggttatttggattctggaaaactactgtgtgtttctgttgtcttgatctgaatgcctctcaagaatgacactttcttttaagagctttatctctacaagctatgtgttttaagaactctggggatgaataatcacacagtgtgctgacttaggatatcgttgtgcataaggctgtttttttttttttgtaacacaaaaatatctgaagaatatgtttggcatagtttgatacagtttttggttttgattaattaaataattcactaataataaagatcagagcttctgataaattcttgtttttgctggtagtttaatctcctaaaagttgaagagaattgctgatatgaaattgattcttaccaacaaggaagaacacttagatatagaattaaccattatcgaacatctgttttgggcaaatggactgtgtttatagtcacttttttgtggtgtggtaaaaagaacatggacttggaatcagatagactttgatttaaatcctggctctagcactgagagcactgtaactttttttttttttttttttgagacagggtcttgctctgtcacgcaggctggaatgcagtggtgcgatcatatgagctctataattttaagcaagttacttatttctaagctttgttttccttattataaatagatatggtactttctacttatatagagagtatataatgtacttgatataaaatagatgctcagtaagtgctctttgttattgatgtggaaacagaggctcagagaagtttgtcacacagctagtaactgacaaatatctgactccaaagcccatgcttttccatgcctcccagctagaaattgaaatgatgggaatcaaaagacagtgatcattctatgctgtcttggagtttaccttaggtagcaattcccagaaaagcaggtttcagaaagttcagaaaagaaactggtaatgaccacagatagtttaagcaatcaatactgataggctcttaaaaatgaaacctgttatttaaattacaaaaaaaattccattggggaagaaaaacgtgagtaatctaaagaaattaatatgacttcctcataagtaaattttttcaaaagaaaaacatatcaaggatacccattagccaggtgtagcggctcacacctgtaatcccagcactttgggaggct

SEQ ID NO: 54642 - DNA, 1054 bp, Homo sapiens
ttttgagcctaggatttatacagtatgtattgtttttgtgtttggccttttttgctcaatgttatgtttgtgagattcagctgttttattgtgtcttcatcctgttctgatacgagtaacctgagaaatcctataactcaacctgatttgtaccttgagatctcaacacttagacatttttctcatggcattcatggttttcaagaactcctaggaggggacatcaaataaaagccttctttgttttaaactctgtggtagacctttttttgtgttttaatgaccttttttgtgttttattgctatttgggtaaatagtagattttaaaatttatgtcactgatggcttatgcagtacctcagctgcttttttttttttttcctacttaaaaattttgttttaaaaactatggtacaggattcctggccagctaatggctttttggacttttatgacttggtagcttgcttttcattctttgaattcctcaagcagtgattcccattctaatttttatgataccatgtagtatcttcagttatttcaaagcatgttgtgagcctccccaccaagaaaaagattccaatttaagtttaagccactttactttcaaaatacttaacatttatgaacagtacaacttttatatttatgaacagtacaacattgtggtgtgtagattataaaatcaaataggctggtaaaaaattgggaatcagctaagagacttacctgcttattaacccctttcaagctagcttcaagtgtaaagtgcaacttttatttgtgtgtgtgtgacacagtctcactctgtcacccaggatggagtgcagtggcgcgatctcagctcactgcgacctccagctcctgagttcaagcaattttcgtgcctcagactcccgagtagctggaattacagccgcctgccaccatgcctggctaatttttgtatttttagtagaggcggggtttctccacgttgtccaggctggtttcgaacccctgacctcaggtgatctgccctcctcagcctcccaaagtgcagggatcaca

SEQ ID NO: 54643 - DNA, 1063 bp, Homo sapiens
ctaatgtctcagaagtgaatttacagtatacctttgttttttcgtattcttaagtagtatttggattttatttagtagttgcagtactaaataaggagtggggagttaattacaaaacgaatcaggtgactagttaatttattcatagtttgttttttaaaactacaaaagtgtttttttttcctatacataatacagagaggtatatagtatagagtaacacagtgcttgtttcacggtaccacaaagttccattcctcagtcttaaatctctgtaaccagcctttgtggttgctgtgtatcattccagatatttccatattttggtttagtttttgtttcttaaatgaaggggagaaagtgttgttttaatggggtaccaacacaatattggcaatcagtaaacattttttaactaaattaaatttttatttagtgatatatgcctgtttgtcaagacttacgtatgcatacttacgcagattttttttgtttgtactgatttttttggtagtataatcttgtgaaaatatcacaagtaacttatttttgcagtaaagttgatttattgtgcttggtagctttgcacagaaagaaagtacatgtaaaacaagatttaaataaattaatgttttatcacttgagttttatatttttatctttaatgtgtgttatgtatttaactttatatattatatattctaaactgtaacctaactatataggagtttttcagacgttttaaaagtttatcactgtgattaaaatgatagtttgaccatgcaacttagtgatctcaattggagagtggtagacattagtagttagtacaaacaaaggtatatatacttgaagttgctaagcggctatcattttgtaagtgttgtttttgtaatttccccccgccaaacctaccagtaataatatttatcagaccagtcacataagagaattgtccactctttgggcaatgtggttttttgttgtaacagtgcaagtagaaatgttgaggaatagaagtgagtgttgagaggtatgatgttggaaagaggaaaaggggaca

SEQ ID NO: 54644 - DNA, 2080 bp, Homo sapiens
cttttacttgtgagtgatttgtcactgttagaaatatgttatcattagtcatctatagtacttttttattcaactgaagaatgtaatccatacattaactagggcaagtaatgaaaagcagccactttttttttatctgaggaaaggtcttaaggctgttgttaagagcaaagcaaaagcatctctgactttttaagacaagccatatgtttcagcttataacaatatgggctggtagtctgcagattcatgttccagaagttctcaattatcccgagaagattcatgctggggggtacattatgaacgcttttgcaatatgaatatataggtttgtaaacattatttcttctacgtaattttaaggagcagattctggccagatttctgaagaaacatggaattttctgcagtctatttatggtggagggcctgaagttatcctgcgacctccggttgttcatgttgatccagatatacttcaagcagaagaaaaaattgaagtagaaactcggtctttgtaatttttaggatgtagagagttctaatgaggaatcattttcatgtgccctgacatgtacacatgcgaaaacattcctaaaagcgtgtttatttgctttattttttttcatcatttatcccatttatttcttcttagtgggcattatggaagaatatattaaaatgtgtaatataccacaggttggtatatttagttttaaatacttaccataaagtctttcagtgtaatttttttttgagacagagtcttgctttgtcacccaggctggagtgctgtggtgttacctcagctcactgcagcctccacctcctgggttcaagcgattctcctgcctcagcctctcgagtagctgggattacaggcacctgccaccatgcccggctaatttttgtattttagtagagatggggtttcaccatgttggccaggctagtctcaaactcctgacctcaggtgatccacccacctcggcctcccaaagtgctgggattacaggtgtgagccacagcgcctggcccagtgtaatatttttgaaagaggagggacaattgtgaaatcagtaggttatctttaatctttacactacatgcagatccatagtatcctttgtagtgttgtaaatacttttgctttgaaaactttttcattgtcctaaatcaccctgactctgaccagtctttcagttctccaaaagcccaatttaattgtatagttttgtcatggcttcatataataaagagcctattttaagttgaaagtagtagtcagaaaattgttaatttcctaaagctcaggaaactagggtgtcactttttttgcactgcagcatatacactaactagcttattaaaatttacaaaatgtctttttgaatgtatcaaggatatatttagtttgagtggaatttgtcagcagatatcagtaacttattgccgcttatattgtacaatgttaaacttcaattcctgtaacctggttagtattaatgtcagtgactaaaaaacttagagttagttttagggcactttttattttgagagcatgaagtgtggaatgtgtcactacgattgttgataaagctgaggccacttgcaacttgattttttaaatgaaatagataaagtctttttgaataatatagtatgcactgctatttgcttgattatgtaatgtcaaaagtttaactatattccaagtacaaaaacatactggattacattgaggatgttgaatagcattcatgatggctttgttttggtttggggcagctgtcaccagctaaagcaatgttgttaaaattagctcaataaaaatgtctttaaaatgtaaaacttgaatgttgaatttatttgatagatgttaaaggtaaaaggtgcaaagtttgttaatattaataccttcttgctgttcctattttattttatttatctattcttttgagacagagtctcaccctttcccaggctggaatgcagtgtcacagtcttggctcactgcaacctccgcctcccaggttcaagtgattctcctgcctcagcctcccaagtagctgggatt

SEQ ID NO: 54645 - DNA, 1062 bp, Homo sapiens
aggtcaggagtttgagactagcctggccaacatggtgaaaccccatctctactaaaatacaaaaattagccgggcatggtggcaggtgcctgtaatcccagctactcgagaggctgaggcaggagaatcgcttgaacccaggaggtggaggctgcagtgagctgaggtaacaccacagcactccagcctgggtgacaaagcaagactctgtctcaaaaaaaaattacactgaaagactttatggtaagtatttaaaactaaatataccaacctgtggtatattacacattttaatatattcttccataatgcccactaagaagaaataaatgggataaatgatgaaaaaaaataaagcaaataaacacgcttttaggaatgttttcgcatgtgtacatgtcagggcacatgaaaatgattcctcattagaactctctacatcctaaaaattacaaagaccgagtttctacttcaattttttcttctgcttgaagtatatctggatcaacatgaacaaccggaggtcgcaggataacttcaggccctccaccataaatagactgcagaaaattccatgtttcttcagaaatctggccagaatctgctccttaaaattacgtagaagaaataatgtttacaaacctatatattcatattgcaaaagcgttcataatgtaccccccagcatgaatcttctcgggataattgagaacttctggaacatgaatctgcagactaccagcccatattgttataagctgaaacatatggcttgtcttaaaaagtcagagatgcttttgctttgctcttaacaacagccttaagacctttcctcagataaaaaaaaagtggctgcttttcattacttgccctagttaatgtatggattacattcttcagttgaataaaaaagtactatagatgactaatgataacatatttctaacagtgacaaatcactcacaagtaaaagcttaaatacgagtcaaacttaccttgcctaagcatcacattaccacatttagtgactgcaatcttagtattgtcaataggacctggagg

SEQ ID NO: 54646 - DNA, 1051 bp, Homo sapiens
caggagcagtggctcatgcctataatcccagtactttgtggggccaagacagcaaatcacatgaggtcaggagttcgagaccagcatggccaacatggcaaaaccctgtctctactaaaaatacaaaaattagcctagcgtggtggggcatgcctgtagttccagctacttgggaagctgaggcaggagaattgcttgaacctaggaggcagaggttgctgtgagccgagattgcaccactgcactccagcctgggcgacagagcaagattttgtctcatacacacacacacacacacacacacacacacacaaagggagaacataactcaacagaactgtagtgaactgcctgaggtcattcaccattatgcacctagaacacttgaaatctattacaactctttcatctaatcattttattaatatcatataactctgataattgtcaggtcttcatctttatcctagatcaatttgaaaagcatcacttttttacccgaataaaaatttccaattcagtttttcttcttttttcaattttctccgcctcaatttggcaagtatgacaaatgtacagatggttgacagctggtcctccaccatacctaaagcatgaaaaatttaagaattaatgttctaggaagtttgtttctaacatttaagtcagtggccaaatacccagtaaaaataaatcctcttaataaaattctcaaagtaatataaaaatcaaaaatcatataaggacttgttattatgtttattaaggtcagtgactttatcagtttattgcttaacctgctttatctatatttcaactttcccttatttctgctccaaaatgttagagccaacaacaaactaaaagaagtggtttcaaaaagtatcatacaacatataaatcttagttacacatcacagtcatagtcaagttttcatcagatgaaggcctcccctggcctctcaagtaagaagcattcaatgtatgaattatttttaatatttaattaaagaaaacataattagtaggaaaactgtggtggaaaatgttt

SEQ ID NO: 54647 - DNA, 1025 bp, Homo sapiens
gacggggtttcaccacattggccaggttggtctcgcaactcctgacctttattttaaaacattttccaccacagttttcctactaattatgttttctttaattaaatattaaaaataattcatacattgaatgcttcttacttgagaggccaggggaggccttcatctgatgaaaacttgactatgactgtgatgtgtaactaagatttatatgttgtatgatactttttgaaaccacttcttttagtttgttgttggctctaacattttggagcagaaataagggaaagttgaaatatagataaagcaggttaagcaataaactgataaagtcactgaccttaataaacataataacaagtccttatatgatttttgatttttatattactttgagaattttattaagaggatttatttttactgggtatttggccactgacttaaatgttagaaacaaacttcctagaacattaattcttaaatttttcatgctttaggtatggtggaggaccagctgtcaaccatctgtacatttgtcatacttgccaaattgaggcggagaaaattgaaaaaagaagaaaaactgaattggaaatttttattcgggtaaaaaagtgatgcttttcaaattgatctaggataaagatgaagacctgacaattatcagagttatatgatattaataaaatgattagatgaaagagttgtaatagatttcaagtgttctaggtgcataatggtgaatgacctcaggcagttcactacagttctgttgagttatgttctccctttgtgtgtgtgtgtgtgtgtgtgtgtgtgtgtgtatgagacaaaatcttgctctgtcgcccaggctggagtgcagtggtgcaatctcggctcacagcaacctctgcctcctaggttcaagcaattctcctgcctcagcttcccaagtagctggaactacaggcatgccccaccacgctaggctaatttttgtatttttagtagagacagggttttgccatgttggccatgct

SEQ ID NO: 54648 - DNA, 1927 bp, Homo sapiens
cagtgaaaggctgtatatgtagaatgattctttgttcagaaaatgctaaatcatttacttgaagagcaaagggatatattttgttttagaaagattaattttagtgccgggcacagtggctcaggcctgtaatcccagcactttgggaggccaaggcgggtggatcacgaggtcaggagttcaagaccagcctggccaagatggtgaaaccctgtctctactaaaaatacaaaaattagtcaggtgtggtggcaggtgcctgtaatcccagctactggggaggctgaggcaggagaatcgcttgaacccggcgggtgggggttgcagtgagcctagattgcgccactgcactccagcctcggcaacagagtgagacgccatctgaaaaaaaaagaaaaagaaagattaggtttaatttaaaaattaggcattgatggtctgaattaagtaccaaattttctcccaaagtagctaataatgaaagtattactataaaaatatttgtttttttttagcatcttataaaagaagatgctagcttctgaaacagaagcagattaattatttagcttgatcttattaacaaacatttgaatgcttactgtgttccagtagttatgtggatacctgtaggtaagatacagtttcatccctatgagtatataatgtatttggtggataatacaaagtatatttctcttgaaattcccaagacctaataaagatagtgttaatatgtgtgttaagtctaataagaagaaaaatccatctactagtaatgtagtaaaatgcatattgaatttaactaatcattgtccttaataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtaagaactcctgtaatgcaaaccggtagtagaagtttgctgtaaaataatttgcaaattaggagagccaagaattttcctctcccacttatttcccatttccccacctgcattcaaacttaatgtgttttaattccatatggtttcagaaattcacccttcctttttaattgtaggtaatctctagcttctttattgaacatatatttactgagtacatgctttctaaactttttgctagtgcctaaggacactaaaaatcctttttcttctgtgaaagctctaatttcatagtagagtaagatacataaacagctgtttacattacagtgagctcctctattatacatcatttttcctacctgaggcattcctgtgctggtgattttatctatcgactatattggtggttcttaaccccattgtctaaatgaatagctggcttttttcccaagtatggaaatgtatctgggatttaagaaaaaaaagcctcataattaaatataactttggcccttgtgagattggctgtgttaatgtttatttctacaataaataggacctttgtgtgatgccaattaaacttcaaggttgaagatgggatattcatggtaattatgtttgtagtgaaaccagaagggatagggatacctgtattggacatagaaattttaaggtgtatgttcatcttgaggaaacacaatcaccaaaaatgctttataattaccgttcttgggagagagagtgtaagaataatgattgagctgggtgcagtggctcacacctgtaatctcattgtctcaggaggctgaggcaggaggactccttgagccctagagtttgaggttgcagtgagccatggtcatgctgctgcactccagcctgggtgacagagtgagaccttgactcaaaaaaatggccagacacaatgg

SEQ ID NO: 54649 - DNA, 1951 bp, Homo sapiens
ctattgatgagcatacatgcatttattgtgtttacatcaacacaaatttgattctaggtgtagaattttttttggaagtagcagcatcctgtttaaaggatggtgacccatcattggacaggcacatattatccttcgtcatctattttggttacatataaaggtgagaagttgctcagcaacaagaattggtaacacctgcatattctcccaggctgatgaaatttgtatactgggaatctgttgatattcacaggtacaaagctgtgaatgtatctcttacatttggtcatatatggtttgtaaatatttttccatgtttaggatgggactcagatactaaaggtagtatcaaattcatagacaataacaaagcatacattaaaatcatcatgaattttttaataacacttcttcaaagtttctttgagcttttcttaagtacagttttactttagtgcaatgatgaatatgaaataacatctcaaaaacaaaaagaagatttcaattattgtgttagaatctcaagtcaaatctaagaactttcaatcgggtcgttttaatgtaggttattttggtactaaatatttaagtggaattatcaggcatgtttttagctatttaaaattagatgccagattttgtctcacccttttaaaaaaatattttaaaactaccatcaaaggtcaattttcaaaaataaatacaatagtgcttaagagtttggacctcaagatgcagtggctggatttggggtgtttaatgctgcagtgtctgtgattgtaatggggatgctaatactactgcacaggacttacgtgaagatacctggtacagagcaagtgtgttttgttttttgtttttgtttttttttttgctattatgactatgaaagcagttcaatttgcgtgtttttttttgttttttgttttttttgcttatttaaacatgctttgatctttagagtctaaaatctaaccttggaaatgttttactgcattatgttcatcccatttttaaaacacaaaacaattttaggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtatgtatttattttctttgtattacatgattgttaaacctgctgtttctgctgtactggcagaacacttccttttttttctatcaatgatgtttcaggtttgttgtctcatgtgtccctagctggttttggggtccagtagtaaccttgcaagattgtcttgctgccttctttgccagagatgaactaaaaggtaagaaatataatatctatggctaaatttttgtaggtaaatctaaaatactagtgggactaaataataaagtgtattcataaaagctcagttttaagacagcttaatagtacattcacatattggcattcggttagtgtctaccttgataatataaatataacaagaaaaatcacatcctgaaggaattcatgtgaattcctgtagtataagacaaatgataagtgaaatgttttaaagctgttctgagatccatagaagggcaaactcaaccaaaataatggacttatttgtgtgtctgtaattgtgaactactccatatcatttaaggtcattcactatttttgtgtgtctagcaccttgcttggacatatgacaggcagtcagtaagttttgttcaatgaataaatggaaaagatattatttgaggtaggtcttcaatgttggcaggagttaagggaggggaaggtaaacagtaacctgattcatgagcatagattaaaaaaatggaaccttgtttttctgtgctgggaggtcagcatggggc

SEQ ID NO: 54650 - DNA, 1031 bp, Homo sapiens
agaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaaggtaaaacgtttctcttattcagtctcttttgctttgggtcttagtttaaaatgatggttttggtacttgataatttaaagtgttaattatgaaatatgatttgatcttttaaaattgatagcataattttacatagacatgattaaaaattttgtgtgttggtactctgcttttaaaattttacatacagttgaattcactttttcttgtatagagctttatgaattttaacacttgcagcatagattcttgttaccaccaccacaaacagaatacagaacagctctaacaccccaaagaattcctgcatagtactactttgtaatcagatcatttctctattcctatgttctggcacccttgatcctcttttcttattgttttgccttttcctagaatgtcatataaatgaaatcatatagtatgtagtcttttgatttttttaaatcttttcatatgtagtcttttgaaacaggtttgcctctcaggataatgcatttgaaattcagatatgttactgcgtgtctgaatagtttgttccttttactaccaagtaatgtttctttttttttgttttgttttgagatggagtctcactgtcgcccaggctggagtacagtggtgcaatcttggcccactgcaacctctgcctgccaggttcaagcagttctcctgcctcagcctcccgagtagctgggactacaggtgcacgccaccatgcctggctaattttttgtatttttagtagagatgggccatgctggtctcgaactcctgaccttgtgatctccccacctctgcctcccaaagtgttagaattacaggcatgagccaccatgcccggcctaatatctcattttttatgggtataccactgtttatttacct

SEQ ID NO: 54651 - DNA, 1164 bp, Homo sapiens
gtcatgccacaacactccagcttggacaacagaatgagaccccatctcaaaaaaagaaaacttttatttacataactttttggaagttaatgcatctcatttatctagtgccttatgctctccaaactggtatttgctcaatatagtgctgtaccttcatatataagtttgtaatgacattttgtatattttcccttacgtttctatatacacatgtaatgaagtggttaacattatgttgctgatatattaggatgctcaagaattccttcgatgtttaatggatttgcttcatgaagaattgaaagagcaagtcatggaagtagaagaagatccgcaaaccataaccactgaggagacaatggaagaagacaagagccagtcggatgtagattttcagtcttgtgaatcttgtagcaacagtgatagagcagaaaatgaaaatggctctagatgcttttctgaagataataatgaaacaacaatgttaattcaggatgatgaaaacaattcagaaatgtcaaaggattggcaaaaagagaagatgtgcaataagattaataaagtaaattctgaaggcgaatttgataaagatagagactctatatctgaaacagtcgacttaaacaaccaggaaactgtcaaagtgcaaatacacagcagagcttcaggtgacaatttagtagtttgttcatgaaaatgatagtatttcatttgtagacatgggtgtttaaataattgttactttgggtatttctaattagaattatagtttagcagtatttgcatgtgagtattagtcataaaattatagaacccgaggataaaaggaattttttgggtcatttaattatataagaaattaatcctccttttgaagtaaacatttcatcagatgtcttttgtgtagtcatgcagtaatctaaaaaattgggctccccagaattttctcttttattttaagcaaattatgttgcgatcctggaaaaaagcaaataacccaaattgcaattttctaattatatacactagtagatttagattgttgtcattggagtcacatcagatgtgttttagtgtagaagttgaattaactatagtgagccctgctgtgatagattatgccatgatactagtcagtgttcctttgagaaagagcatgtg

SEQ ID NO: 54652 - DNA, 1253 bp, Homo sapiens
cttgaaagttaaatttttatcctgtttagtttgggcatttcatataaatctgaaatttagatgacatggttgactttatataaatttgaccatcattggaatatggttgaaaattttagatcgcccaggggaaaaaagtatatagggaaatgtcataggatcaagtcccgaggaatccttacgtttacatgtctgaggccaaaaagagcaatagagagggaaaaggagtttcaagagctaaagaggaaaagtaggaaaatgcattacaatagtcctgagaatgtttgttcaagagtgagggcatagttgtctgtggcaaatgttactgagtggggactgaaaagtgtatctggcagcatggaggactcttgatatgctggggccaaatctgatttgaatggattgagctctttatgaaggaatgaaagtgaagctgtaagagggatcaaagaaagaaataacggctaaaggaatgtatgtgttgtcagttaattgaatgactagaaataatcagtattagctttgactccactctaacatttttctctttttaaaattagcccacctttgacacagttttttcttgattgtggaggactagctcgaacagataagaaacctgccatttgtaaaagttatctcaaactaatgacagagctgtggcataaaagcaggtatgtaacttaatatactcttcttctttattaaacttttaaatgaatattataaatatttaaaggttgcaggtccatttatggagccggaaaaaagtagaagagagatagattagagacagctttgtttcaggcatgttacatttgaagctgaatgtaaggtgtcatagaagtttagaagcagatgaaggtgtcatagaagtctacaagtatttggatatagtatatagtgttggaatgttaaagctgctattactggaactttagagttttgcattcaggagcagccattctcacaatgataaaatcagaccctaaatactatatgaatattttcctgcttatgtttatttgttctaaagtttagcattaggatcatagtttgctgtaatatgttaataattttgttttagaactattcaggaaacttgcatttttgaaaagtcatggggtgaagcataatcatttaattgagggaggatagcagtaaaatatcacttaaaatatcaaggataaggtgttctgatgtgcctgtgaaacataatattaggcagttttgaatgatttttttgaaacata

SEQ ID NO: 54653 - DNA, 1204 bp, Homo sapiens
tggtgtgtgcctgtaatcccagctactcgagaggctgaggcaggagaattgtgtaaaccctggaggtggaggttgcaatgagcctaggtcatgccattgcactctagcccaggtgacagtgtgagactccgtcaaaaaaaaaaaaaaaaaaaaaaaagaagagacatttactctgaaacttgaggaatgagtatcggttggttgtttgaaaggatggggagagcattcctagcagaatgctccttgtaagcagccttgggatgggaaagagcttgacacatttgaggaactggaagaaaatctgtgtgacggggtacagtaatcatagggctgaatgacatgggtctaggttatgtagaccacattaaagatgtaggtctttattctcatagtagtacgataccattgaagtgtttgtgtagtagggtagctaataatctctcttatatttttaaaatattactgtggttgctatgtggacagtgaattggagggggaagagagtggaatttgaaagaccagctaggagactatgataatgatttaggcaagaagtagtggtagtttacatcatctagggtggtaggaaaagagtgaaggaattggagataaacacttttaggaggatgattgattgataggatgtgggtagagtaactagagaaagggagaggagattcaaagtttaacagtacaaacctgtgataagagaactgtaggttgatactattgttatttttatacagataagaaaaccagacacagaagtttaaataactttgccgatataaccagctagtaagtactagcagaattctggtttttttttttttttttaagttagagacagggtcttactctgtcacccaggctggagtgtagtggagcgatcatggctcactgaagccttgaactcctgggttcaagggttcttcctgcctcagcctgccaagtagctacgaccacaggtgcatgccagtgctcccagataatgttttaaaatttttgtagagatgggttttcgctatgttgcccaggctggtcttgaactcctgtccttgagtcatgtcctgccttggcctcccaaagtattggaattacaggcatgaccaaccatgcctggcagggacaaaattctgagtctgagatttttacgtgtatgtttgtttttgtagatgttttgtttattactgcacaatactgc

SEQ ID NO: 54654 - DNA, 1844 bp, Homo sapiens
agatgaaaggaggaaatacaatgttgaattgggataagttaagtctaatatttctttgctcaagtttggaaacctgaggcccttcagtggccagccttaatgcagtttttgtaatgcatcgagacaagaccttataatggtcgtagtgtgtgactgtgaaagagaaggagaaaacatgtgaaaaacgaaaaaaaaaaagctcacagcctcaaactgctgcacataccctgtacagttagtttgcagtcagagtagggagccggcctgggtccccgcacctgggcctggctcccgtggccccgcccctggggcgggctcccatcgaggctccgcccccacctcccctatcgccggagacgcctgcggcggccccggagacaccggaaggagccgcggctgctgcgggaagtggccagttcaggaggcggaccccccgagggcagcgctgcggggccgttttccggccctcctgacgcgacactgcccctctccgagagctgagaaggaaaagaggagcttgcggaggtgcggctgcaggccgttgttggtcgagctggcgggtcccgcgggccaggccgtggaggtgagcgcggcgctgctgggaggggcgcggggcccaagggcgtttcgctcgcgtccggggtccggtctctgttctcgcttccgcgcgctggggttgcggccgctgcagcagcctctttttcttggtcctgggtggcggcgggttcgcgggcgggaagaaggccttggcccctcggtgctctgcgttgcagagataatctagtggtcgccctgtcaacggtcggtggaggatgggaaccggtcgttgatttgaggaagggtcctcaggggttcttccctggaagcgggaggtgcaggtgagcccgagaagcgggggctctgctcccttcctcggtctccccactcaggcttgccagtccctctcagtgggtgactgaaagccctgcagcgcgccggctcctgggttctggtttcgcttttcggcgctgttgagggggccggccccgttgtttgttgttgtgaacggaaaaaccgaggtgtcatcgtccctggaatttttcttcgaccaatgtttgatcttgactgagaggttaccccttaccttctgtccatctgcagcctttgtttggatgaaagatccatagtgtgtggtttcccagacctttacttatatttctcgtatacaaaacgctcttcatttgaatatttacagggttttacgttgagctcttggacgatgagattttcctgggtgttttgcactcaagtaccgttggagtttacattctcatagaatcagtattaggcctggaaaattgagccagagggtgaaattctggcaggagcatagacttaaattgaaggtgaattttaccgtaacgatctctaggccttttgcttaataactatgtggatgtagagaatttttaagtttaatcagattatttttcctttaagaaaaacgtgttacaaaaagtaacaaggccgtcctagttccgtttttcctactgtcttatttggaaaggtctgaccaagtcacattatcgtcataggctatttgatttgagcataatacaaatattgttagtgaattcatactattataaataagagagaaaataggaatcttaaagacaatgctagttttatgaaaaaataatagaaatagttacacaatgctaggagctttgtattatttcattactttggcaggattgaaagaaaggtcagggctgggcacggtggctcacgcctgtaatcccagcactctgggaggccgacgatcacgaggtcaggagatcgagaccatcctgggtaatacg

SEQ ID NO: 54655 - DNA, 1057 bp, Homo sapiens
ccacgccagagggaggcctgcaaaggaagcgcggaattgggatgggctcgccactgctctgagccagaggaagggtctggacggccgagctggagggacccccttttctggtgttcttggcaaagaaaaaggaagacagcagaggagagctccgcgaggggctgctgtggggtcgggggagagcgcgctggaggtagggcagctggtgaggtctcaggttcggcttggatgcgggtggttttgagcagggagtggcttttggatgtgaaagattactctgctttgcaggtgctttaagagaataatttagcacgggagtattgtggtgtcaggtccttctgtaaagttgttaaattatctattttccagagggaagactcagcttgtttttgcacaggactttgaaacctttattattgttgttttattgttgttgttattgcagctaaacatgtttgctctgttcaaagtgtcagagttaggttatatagatttgtgcttcacgtcaattttctttttgatacttcagactttccttcctgttggattataaagtcaaagttgcaggatagaattttaagatgtctaagaaactgtttatgacacttatttttaattccccagtagttggaatgtagaggagcaagtaatatcacacaggacaatatttttggttatgttttatagattccgtctataaatttgaataatcatgaaacccccttcatgtttatttttattatgcttctgaaagcaaatgaaatgactagttttttgtttttttttctttagtttttcaatgaataatgattaggtttggaatcaacttcctcagtaatattaaatgaaaaagaatgaggtagttagaatgcaaaaatagaggtttgtcataatattttttcttttttcttttttttttttttttgaggcggagtctggctctgtcgcccaggctggagtgcaatggcgtgatctctgctcactgcaacctccgcccctagggttctagaagttctcctacctcagccttccgagtagctgggattacaggcgcccg

SEQ ID NO: 54656 - DNA, 1019 bp, Homo sapiens
actaatgtcagtcttagaagaatggatagatgagtagaagaggcagaagtataactaatttcaatgcaatgagatttgggtaaggtttagatgtaattcagaaaaggaaatgcctgtattttgttaaatttacagtttaacaaaattgtaaatttaacatagtcaccagtatttttatactggttacaatagaccattcaaataccatcctaatttattaggtgaatattctattcttcatttcagaagcagattttagcagtgttgaaaaaagattatataagattatataaagatttagattttaataatgatgtacatgtaataatttacacaagtgagtgatgcatgttttaaaattagaagctttctgggtgaatatattataaactctgaaatttttacctgaaatttatcattggcgttattgatatttttaatattagtatgtttatttgataggttcaagttgttccagtagcagacagaatttgacattatctttaagttctaccaaagacaaaggatctcaagtttgtaactatgctaatggaggacttttcagtaaatattcaggttctgcacagagtttggcctctgtaagtacagaaaaaatattaatttttaaaatttttgtttatatgtcttctgtgatctattagtttaagtgtcatatacttatagttcttagtatggaaatactcttaagaaatcgtctgaatgtgctttctttaggcaagtaaaatacctttttgctgactattagtcaatttggttctaggtttctttgaataagtgatgtggtctcatggggtcctgtgaaaatagtgttgatgtggaagtattgcttcaaaattagatgttcttgttttcacttatttgtgggagctaaaaattaaaacaattgaacttatggagatagagagtagaatgatggttaccagaggctgggaaaggtaacggggggtggaggggaagtggaatggttaatgggtaaaaaaatataggcagatagaata

SEQ ID NO: 54657 - DNA, 1111 bp, Homo sapiens
tttcctcaattgaaagttgaagcccttgttgactagaagtagataaggtgaatttcatgataatagtgtaacaagtctttagaatcactgtactgtacttgcctaactgaactagtcattcctcttttgttaaatcttacaatttaacaaaaatataaatttaacatagttgccagtatttttatactgattacagtagaacattcaaataccaccctaattaattaggtgaatattttactcttcatttcagaagcagcataatctgtaggctatatgttgtaacttgttgctcctaggctacaaacctgtaccacatgctactgaactgaataatgtaggcaattgaaacacaatggtatttgtgtatctaaacatatctgaacatagaaaaagtacagtaaaaatacaattttgtaatcttacggtagggttgactgttgtatatgtggtccgtcgttgacccagatgttgttatgtcgaaagtgtctgtagttagtttgagatgccagcagaagagccaaatggagtcacctaaaaggcaaatgaaaatgtgggcttagatttctcaaaactgaactggaattaggacagaactggagttaggaatttgagaatcatctgcatagaggtgattgaaatgatttgctcagtggaccttgctaggagagggcatttacaaagatgatagtggcttttttattttaggtatcatttagcagagagtcagcattgtaaaacattctaaaagaaaaataagctagctagcttaaatcacagtaggtatagataaaatttataagtgaatgcttaaaagaataaatgatataaacataactgcctgatttctgatggaaataagtgatttacattcaaaatactactcttcttgtgtatttttgagcaaacaggcttagaatagagtcgtgatttctaagtttgattgattatcatcagaattatttcttcatgtggaaattacatggattgtcttaccactaataggatttataaaaataatttgtaaatatgaaagatcacaacatactatcatgagagagatttgaagtaacttctatccatcttaattttaggtccagagtgtcaattc

SEQ ID NO: 54658 - DNA, 1230 bp, Homo sapiens
aaagtgctgggattacaggcgtgagccacctcacccagccacctttctctcttttttttttttttttttattatactctaagttttagggtacatgtgcacattgtgcaggttagttacatatgtatacatgtgccattctcttataaggacacttttgattagatttagggcccaccagataaagtaggataatctccctgtgttgggattcttaattacatctagaaagatgtaagatgttacctttatttataaggtaacatttacatgttctaggaattaggacctgatatctttgggtgaccattattcagcctactacactatcttaacctaacctgttgactgttatataatgaatctatcagaactcactttactaaatatgttttttctagctatcatttgtattatatccagaaaaaaattttaaatagaaagaggctttctgtgtttcacatctcagtatttcttgacttgaccatgaacatgtctatggagcctcactggagccctgaagaagaaccaaatgaacctgttgttgaatcagaagattcaaatgcttttccctgttctctgttctgtttcaggctatcctccttttagtggaaatgcatactaaataaaaaacaaaaccagtaaacttgatgtggccttggccagtgagcaatgaagggttgatggctctgtgtagaaggactgagtgcctcagaatgcattcctactctctagaatagttagactatctcatctccagtgccatcacagtgggtattcctatggggaaagaaggtctccagagagttaaattcacatatttctagattactctgtgtctaggaaacttaacattcacagcttctgttaatattacaagtttatggctggatatggtgtcatgtacctgtagtcttacctacttgggaggctgaggcaggaggatcacttgaacctaggagttcaaggttacagtgagctaattgtgccactgcactacagcctgggtgacagagcccgttttcttaaaacaacaacaacaacaacaacaacaacaaaaacctcagaatattaaaaattcaaattgaagaaatgtagagtaaaactagagacgccacaggggggtctttgtgttacaggattaagattgcaaggagccctgtggaccacctggtatcatcacccatctgtttcaattctctttataaaattgaagaccttaaaaaaagat

SEQ ID NO: 54659 - DNA, 1036 bp, Homo sapiens
acagcaataagaatgtgctagagtttacacatctgttcacttttgctccaatatgctcttttgacttaatgtcaagctttgggttgatgtgggtagggtagtgtcaaactgctttgagaggaatgggaccagttctgctgcctaagaaggtctgtctggatgtttataggcagcacctctgaagtggcctaaattcaccctgatctgatagttttcctgcttagaaagtgtgccttggccagatcagtatcccacatgggagtgttccctaggttgtagctgtgattgtttccagatgaccagattgtttttctgaaaatgagcatatttttagtcatgtcgattagctgttcttctacatcacattgttactctttctgatgatgattctagggttaacattggaaccatctcaaaataattacaaagttttagatgggtttacaatgtcttctaaacaatgtaatctaaaaataattgagtcagatgctaacgagatactgcaggcataagtgctgtttttctgacaactgattgtgaaaccttaaaacctgcatacctcttcttacagtgaggagtatgcaaaatctggaaagatattctattttttttatataggtagataggatcgccatttatttcctatttagatatactgacattcatccatatgaaaatatgcaggtcattagcttactataatttacttttgacttaatggggcataaataaaactttcatagtacaaaaaaaaaaaaaaaacatttatgcacataaaaaccaattatatcactatctattctcctttctccaagttatgcaactctaatttcttcatccttttctcacactatcccttctatacacttattattttggctgaacatatgaacacaggaataattattttattttattttttttagttttttttggtctctttttttagagatggggtcttacaatgttccccaggttggtcttgtacttctgtgctcaagggatcctcccacttcagcctctcaagtagctggga

SEQ ID NO: 54660 - DNA, 1111 bp, Homo sapiens
acagtcatgagccaccgcgccgggccatcttcagctttactttgttcttctgagaacttataaacccggtagctttttgtaaactggtttcttctatcttcccattagttttccttttaatttacagggatattttgaaacatagttgtgtggctataaaaaatagctattactgtggaacttctgatgaattcattatattcttttagaaaaattctgagcaccatatacatttgtgttatatttttaaagaaatgaaaacatattggccattttgtctctgatttttggttaactggaaccataggctgagaatgtattgggaaactaagattctgtcatgaaatgatgtatgattctttagtgtcaaaattagactgtgacatcagtgataatgtatgaaaacatttcaggccccaataattttattttggcattgattttgctcagttaaaattgttctgttcttaatttttaggtatggaattgtttgaagaggcattgcgtcgatgggaacaagctctgacctttcgcaatagacaggctgaagatgaagcctgtggttccattaaactgggtgcaggagatgccattgctgaagaaaatgtagatgtaagggtgattgatttgagtggtcttcataatattagaagaatcaaactttttttttgtttttttggtagaggtagggtctcactgttgttacccaggctgagtcttgaactcctgggctcaagcgatcttcccgccttgtcctctgagtaattaggactatagggatgcaccaccatgccaggctaattttaaattttttgtaaagatggtgtctcactatgttgcccaggctggtctcgaactcctggcctcaggcagcactttcactttggcctcccagagtgctggggattataggcatgagccaaggtgctgacccaaagtattttttaatgttgattcagtgtatttgctttatgtgcatttaatagaactgtttttttcttcttccttgggacaatgtggggtatttcttattagtctttttctatccaggtagttgttaaatgccagatttaccattcatcaagtttattgactttcccaggatatgcaa

SEQ ID NO: 54661 - DNA, 1113 bp, Homo sapiens
cattatgttcattaaaatcacataaaggtgtagagctagactagtccttattgattatttagttaagctagtggttctcaaacttgagaatgcataagaatcacctagaggacttgttaaaacacagatttggaggccctaccccatgggtttctcattgactaggactggggtggatcctaagaatttgcatttctaccaagttcttgggtgataatgaagctgctggctcaaggaccttactttgagaactgccaatctagtctaactccttaattttataggtaaagaaactgaatcactaagaactaaggtaattttgccaaagacacagctagaacccaggcctcttgacttctgctgctgtactctttccaccatctctcagttgtttttttatattactcactttctttgccttttatttaaaagtgggaaaaatatttagaattttaacattagaatttaatttgttctgtgtactttttctctccttgtaggatattattagtactgaatttatccataaactcgaagctctgctgcaaagagcctatcgtctccaagaggagtttgaagctacccttggggcatctgatcctaattcccttgctgatgatattggtaagatggatatttcatatggcttttatgaaatgtttacttttcttttatatccttggaatcatctgcataagtgtctgtcttatgtaataataggttacttaaaaaaaaataaactagccaagagaaaaaatttttatcatatttcttttttctttcagttttaattttcaaatgaactaatgcccttaagatacaaattcaagtacttatcataggcaggctgtgacattattttaaaatatattgtgggtgaaaaaatctagttaagagtgttggagggagaaaagaataaaaatacacaaatgggacagactcagcacttcagaaatatgcatataatattacttaaaatactttaaagaattatgtatgttgggacccactttaatcgcaggatagctgttgatgtaaatagtcagtacatacatcgttatgggtcattacctttgtttcctactttaaagagaaaagagttttaaagatact

SEQ ID NO: 54662 - DNA, 1086 bp, Homo sapiens
atgaacttggcaacaagaggaaatacctcagcctaacatcttacatcaaatgtcagccccaagttgaagctctgagaccttgtcctctcccattcctgcagaatcattgtggttggaggataaactccctgagggtttatttttagggaatgatatgaattgccagcttaagttgtatactcagacatctaaatatacagagtacacattgtacaacatatgagaaatttggcttagtaatttcctcccatgtgtaaggctcataatcttatttttaaagggtttagtaataacacaaaatgaaatctaactggtattatacaagttaaagtaggttcagagaagaaagcaatataatgaaaattgttggggtcccagaaacatgagaaatttctggtgcttgcctttgcctgttttgtgttgaagttatgtcttaacagcttggatttctatgtccaggaccatcactgcccatataaggcctttatgtgatttagacaaagggccatccatgtaagccccttgggaggggacctttgtgccaagaagaaggtccactttccttcaggaagatgcaggtctagtatttgggctggatttctgccccgacttattcctgtggcaggggacctttgtgtaacatacagaatgaccagttgtacctcgtggccctgctcaagtctctgtaactgcagacctaatcttaatgacttcttgctccagtttgggttaatctagtcacttctttcttctttaaacaaaaggggggagggtgtagaaaatgctgttactcttctaaagtgtttgaatggttcccattccctttccttgtgttactcactttgcattggcagctgtacttcccagttaggaatcacagttgttgtgttggtcaatcatagtatataaaaattttgataaatagggaatgccagagacaactattgtggaaatcttcttttgggtaatatcaggctgttttgtacatacattatttcacatgggtgaaactttatacgtcatcacaaatcaagaactttgacaagttctccttttttctttttttttattattcccaccacctca

SEQ ID NO: 54663 - DNA, 1952 bp, Homo sapiens
agtataagtttagttaatttagggctggctattagaaacataagaaataagccaggtgtggtggctcacagctgtaatcccagcactttgggaggtcaagccgggtggatcacttgaggtcaggagattgagaccagcctggtcaacatggtgaaaccccatctctactgaaaatacagaaattagccaggcgtggtggtgcacacctctaattccggctacttgggaggcggaggcacaagaatcgcttcaacctgggaggtggaggttgcagtgaaccaagatcgctccactgcactccagcctgggcaacagagcgagactctgtttcagaaaaaagaaaaaaaagaaaaaaagaaagaaacgtaagaaatttaacagggttctgaaaacaagttaaagtcataggcaaaatgaaccagagtaagtatatgataggctctctagagattttcatgtcctggggacggtccatttataataataaattttagtttacatgaacaaatatgtaagtgtttgttatgtgttcaataatctcccgagaactgtacgaaccaccaggaaaaacaaaaagggaaaagaaagaaagtaaagtccctccactcaagttatattacaaatgggaatattgaggaacagagaagataagaaacttactcaaggttacacagctaataagtaacagagtcagtattggaattcagctctagaacccatggttttaacgcttttgctatactgccttacataggagcaaaaaatcagataaattttggaggatgtttacaggggataatacttgaactgagtattaaaaaaaatgtgcttatgggtagcatagggcaagggagcagaaggagagtaggatatatgtagagtagaaacaggaggaaccagaggcttgaataaagaatgcgtttggtaatgatagtaatagaaaaaattattttatactcacgatggaccaagtactgtgcctccacaaatctcatttaacttttgcaacaactctaggaaattaatattgctatcctcagtttacgtaggtggtaagtagcaaatcttaggatcaggatccaggtgctggctggctgaatcagaaaccacgcttttacccattacattactgtatgacaagtggggatatggtcaacataccctcagataaagcagtaagtttttttcttttttttaaaataattgatagaaaagaacattggataggtaggataatcagagataatggaaagctttggaaaccaatagaggagccatttgattagaaaatggctttttttcccaagttacaaaaactcaatatacataattaggctattcttctctaatgattacatatgtcaagtaaaatagtctgtgaaagcacttagtattacttggacacgtaatagtgactcaaaaactataagctgaatctgagtcttctaaagaacttgtaagctctttgcactgtagtgaaaatatgaacaacaaatgctctaacagcaatgtccaatagaaatataatgtgagccacaaatgtaattttaaaatttctaatagccacattaaaggctcgaaagaaacagataaaattaattttaataatatattttcttaaacccagtatgttttaataagatgttttctcttttttgttgctaagtcttcagaatctattatgtattttatacttactgcacatctcatttcatgtgtttaatagacacatgtaactaggagctactgtattggacaccagggctccgtagtttatagcatagcatctggtatcagatgacctgagtttgaatactaccattctctttcttagatgtgtaagtatgtagcagctacttggcctctctgttccttagattcctgatacataaaatgagaaaactaatagtatctacctcatcaaagggttattgtggggattgaaaataagg

SEQ ID NO: 54664 - DNA, 1025 bp, Homo sapiens
tggatattttatgttaataatatagttgatttgaatgaacctacaatgaacctacaagttcttctaatttgggcaagaccacttgcaaataaattgctctgtttcaaactagctgtgatatatgctgacttcatcatgtatagtagataatccaactctggttataatgtactaaaaagcccttttaataaaaaattaagcttaattcctttttaaattaaaaatgaatatttgctttgtaacattgtctcccctacttgtcagagtttcagattcagttaaacaatggatacttactgttttctttttgacactagtagtctaaataaagactgggggaaaaatcaaaatcaaactatggaatgtgaaataccacaatgatgtggaatatcactttctgaacttttcaccttttacttttaagataaagatacagatatcaccatgaagggtaatgtggaagactttggcctgcgagacaccttgagcatcgcatccacggattcctttgcttccgcagcagaggtaggacatatgtgttcctaatgaggatttctgtttcttttttggtggaaacaacagtcttgtcattatactgtaattcagtttggtcactatttatttagcacgtaccatgtggtaggtgccaggatacaaaaatgaataaatctaacatgaaaataagctcctacaggagcttacactctctttaaggagatggacctgtaaacacatggtttagatgggcactttcatatactgtagattatgggtgaggcatataaattagtatgttaatggaaagcaatttttcaacttatatcaagagtcttaaagatgttcaatttctttagttcagaaatcatacttctagatttttgttctaagaaggtgatcagattcaaagattatatatatataaatattcactgttggccaggtgcagtggcttacaactgtattcccagtactttaggaggctgaggtggaaggattgcttgagctctggagtttgagaccagctt

SEQ ID NO: 54665 - DNA, 1963 bp, Homo sapiens
tctttttaacaactctattgaagtaaaatcaattcagattttattagctataaaatcctcttgaatggtttttatggtttaatcaaatttattgtattttgatgttagcaaaatcctattttctttcctttatagtttatcttcttatatcagtgtattctgctttttggttttctgggtttttgttttgttttgtttttgaggcaggtctggctttgccagctaggctggagtgcagtgatacaatcacagctcactacaacttcaacctcctgtgctcaagtgatcttcccacctcaatctcctgggtagctaggaccacaggtgcatgcctccacacctgactaatttttttagatttttgtagagacagggtcttaccatgttacccaggctggtttcaaacttctgggttcaaatgatcctcccaaagtgttgcaattacaggcatgagccactgcacctagcctgtattctgttctaacccaccgtgctcttagcttgcagaacacagagaagtacggcatacctacagcctggagtccctttgtcactgcccattttacgaggaagccatgcatttagttgaagaaggaaaaatttactccagagtactgaggtaccatttcagttttgtttatgtttatgaaggatattaaggtgtttgtgtggtacttactaaaaatgtttatgaaaataggagaaaatatgtttttaggtccaagtaaagaaaaaattatttttacatgttctgtcagtattgaaaaaacatgttttatattaaggtcctgaggttaagccttgtttgaatccaaatttatagtaggcttgatcttgaatgtagtttaacaattgtctcccctgtttattacatagaactgaaatgttggagtgcctaggagacagtgattttcttgccaaacttcactgtattcgacaggcttttcaggtatttttttaacattaagtgacttcacccagccactcatccccaccctcatgctgtagagtccagtgcaaataaacaggacagctctgtgctcttgattatccctattcctaatgacaaatataaagtccactaaacttatttttcctccctgctacttgccttcatttgtttccatatttcattatcctctcccatggcttcccaggcccacgacactttgtcaaaacaggatattttgatacttcaggagtgtaaaaatggctgcttaaaataaaaacactctttcttattaattagtgtgtatttgagatttaatttcagtcaattataaaattgattttctaaaaagaaaataacaagaatatatttgttttcttatgttttggggctataggaaatttatttgagactgtaatatgattttgaacagaatttaaattcaaatttaactccctttaatctttttttgactataggtttcaagagttctttttattttagtaaattaggactttctctgtgagctgcctgttgaaatagcaccacatgcaatgcattaactgttttaggattatttgtgctattaagttgaatgtccattcacattcattataggtctcttttttctttggggatgaatattttttcaggtaattctttcagaatcagctaacaggatattcctcgctgagagcggaaggaaaattttatcagctttaattgtgaaagcacgaaaggtaaacttgttctgttggcaagatttttaccatttacaaaagttgtttttaccctttgaactgaagattaagacattaaatttttgatagaagaaaaatttttgtggatagttgaaaagggcattaagttatgctcgggttgaactatgtataaagtccacactatttcaaccaagttgtttctcataaattatttccagtttgccataaactctgtaaatgtcatggtgagaattatcattagatctgctgctataaccatcactgttattat

SEQ ID NO: 54666 - DNA, 1244 bp, Homo sapiens
gcttgtgacattttactgacattctttatcttggcttctgcaaaatgttgcaatagcaaagtagtaaaccagataaatttggcatacctttaaaatgtattttagttcagttacctagtagaattaagatctaccagacttatttgaagagtaactttctttgtagcttgttataaagttgagtttagggttaaaatgtgttttcttcttcagaatccaaagaagtttgaagatgtttttgatgaaatgatctattttttagagcagaccgatcactggggtagtactgaaatggaacttgctgctagaggggtaaattcaaattttttgtgatatttatttttcttagttatttgcatgtaattttatatgagttgagactactgtttcattgtccttgttaaataaagccaattgtatggttgtgggacatctttttttctgacgaagtcataaaccacactccttgtacgttggggcagtagttgtaaattgttttctaagaagccttttttgctgttgttggctccttgcttccttccctcctgtcctccttcccttgttccctctcttccttctctccaaaagtcattggcaggcccctagcaggacaggaatggtggcccatgcaaggacagctttgggtagtacaacagcagcagctcagtagggctggggaattggctgtatacacaagactgaacaaataagtatactgagaaaaatcagagccagcttttccctgtgagagaagggaggtataaaatgctgggattggaattggagctgtcagtgtgagttcacagtttataatatatatgtagatacagatatagaaataaatatcggtccaggcatggtggctcacgcctgtaatcccagcactttgggaggctgaggcgggcggatcacctgaggtcaggagtttgagaccaacctagccaacatggaaaaaccttgtctctactgaaaatacaaaaattagctgggtatagtggctcacgcctgtaatcccaactactcgggaggccaaggaacgagaattgcttgaacctgggaggtggaggcggcagtgagccaagatcgtgccactgtactccagcctgggtgacagaacgagactctgtctcaaaaaatatatagatatagatattggtcaggcatggtggctcacgcctgtaatcccagcactttgggaggctgaggcgggcggatcacctgaggtcaggagttcgagaccaacc

SEQ ID NO: 54667 - DNA, 1054 bp, Homo sapiens
acacagttcataattggatatttgcaggattattttgttgctgttttccccactatactctaggcgtctaatttgcttactctagaagtttgagcacttggtacagcatgtagtatgtagagtgtgtatgtatgaatgaatgaaagagcaagatgttcatgatctggtggggaagacaggcacatataccagtaactaaataacaaggcagaatgagcatcctggatgttataatagaagcgtgaacaaaggactcctagaatagagaggaggagagattattttcacttgagatctaggaaggagcagcgataatgtgaattcgtaatttctagtggcgagctttcatatttatctctccttttattttttatttttgaataagctgattaaaaaaaacccctgctgttataaaaccataaagccctggctcagattttatttcagctctatgtaataataatttctgtttcaactcataatttaatgcaggtgaaaaatctaaatttttatgatgttgttctggattttatattaatggactcctttgaagatttggaaaacccacccacatccatacagaatgtagtaaataatcgatggctaaactcatccttcaaagaaacagtaagtggtggttaacctttctcagccttttaagtttgattaaaaagtgaggctgggcgcagtagctcacgcctgtaatcccagcactttgggaggccaaggcaggcggatcacctgaggtcaggagtttgagaccagcctggccaacatggtgaaaccccatctctactaaaaatacaaaaaaaaaaaaaattagctgggcatggtagcgggcacctgtaatcccagctactcgggaggctgaggcaggagaattgcttgaacctgggaggtgcagtgagctgagattgagccattgcattccagcctgggcaacaaaagcaaaactccgtctcataaacaaacaaacaaacaaaaaagtggttggccaggcgcggttgctcacacctgtaatctcagcactttgggaggctgaggcaagtggatc

SEQ ID NO: 54668 - DNA, 1027 bp, Homo sapiens
gtgagccaagatggtgccactgcactccagcctgggcgacagagtgagactccgtctcagaaaaaaaaaaagaaaagaaaatgaggtttagaagattgtcttggagactgtaaaatagaaaataacccccgccccccaggagacagaatcttaaggtgtagttttctgtagtcagtgctgtataacaaatcccacagtgtgttatttaacaagggaaattcaaaaagttataaatatagagtttcctaaaacacagctatattgactaatacttcacaggaagaggcaattacacaattaaatgcttaaataatatagggttccttaattaaaagttaggattctagtaagagtaatttagcttaatcattttactagtttttttttggtcagttaatataattaagtgattgagttgggcttttaaatagctaaaactttgatagtcttaataatcccataaaacttatacaactaaggaacactgtagcattcttgttgttgcttcgttgcaaagctaatatgattgcccttttttttttgagacagagtcttactttgtcacccaggctggagtacagtggcattatcttggctcactgcaccatccaattcctgggctcaaatgatcctcccacctcagtctcctgagtagctaggactataggtacacaccaccatgcctggctaacttttgtattttttgtagagacaaggtttcaccatgttgcccaggctggtctcgaactcctaagggtcaagtgatccacctgccttggcctcccaaaagtgttgggattataggcatgagccaccatgcctggctggattgcttttttatgaagcatttttatgaggtaaaaacaacttttaagggcggggtgtggcagctcacgcctgtaatcccagcactttgggaggcaaagtagggaggattgcttgagcccaggagttcaagaccagcctgagcaacatagtgagacctgtttctactaaaaatagaaaaaattagccaggaggggtggcg

SEQ ID NO: 54669 - DNA, 1477 bp, Homo sapiens
ttacaggcacttcttatagattatctttttttaaatgtttccccaccttttcatggtatcacataggttatcttttttgatcatcatgtcatccctgagtagtaagtagggtgggtggtattagccctatttcacagaaaaagaaaatgagcccccaaaaaggaaaggttaaatcacttgtgcaaggtcccttttctaatgagatatgaaactagcactggaagtcaggtcttctgagtcctgattcagtgctcattataatattagaagctttctcaatgtaacttaattttggtctaataaatgccaatttatgttcattttccagaatcaagttcttttatttctcaaagacatttttgactttgagaaggtgcgctattcaagtacagagactttagctgaagacctcatgcagttactcattcgccgcactgagcttttaatggcctatcttgaagcagatgccctgaggcatacaagtagttgtctaagcagtcatggtcatgttatgtccactgggctactggaagccaaagtacaataagtaccataagaatcatacaatttgagtgtgctatgaaatattttaaggtaactattgattttgtaacatatattacaaagttaacagaattgatgcatgtggattcagggaggaaaaaaaaatctactaaaaaatgagcaactgtactgtatttatacagaagttctgtcattgaattcctgtgtagtgtagtcatagtggctttttgcattcattaggtaataattgaagtcatgaaatgtatattttacagaaatatcgcttgaattgaagccaatatttgggagttaattggtttgtcttcttgaagctgtcattctcaaaagctctgtttttatgctttgcacctttaaaatgtacactttagccaaggtctttgtggcccacacatgcaagaatatattacttctaatgtcaatatatttaactttgcctagaaacatatttttaattataaagttattcatttgtttaatcaagtttaggcagtaatgatgtttaatatgtactgcatacattattgcttgtgcatttgcttatgtatttgaatcaaagaaattgtaatcactgaatattgttatagaacatttaaatgggccacttgcagtggctcatgcctgtaatacattgggaggctgaggcaggaggacagtttgaggccaggaggttgagactagcctggacaacataaggagatgcctgtctctacaaaaacataaaaataaattagctggtatcaagcagagttccatggaaatattaaaatttttttaaaaaataaaaataggctgggtgtggtggttcatgcctgtaatcctagcactttgggaggccaaggtgggcggatcacctgaggtcaggtgttcgagaccagcctccccaatatggtgaaaccccgtctctactaaaaatacaaaaattagccaggtg

SEQ ID NO: 54670 - DNA, 1047 bp, Homo sapiens
agaactttctttttatacattagagcattttcccctggaatgagtattgattaaaaagataacatttattaattaataaaggcaatttaaaatttagtgttatttgaagactgtcaacatctgaaggtatgaaacttggtacagtgaaataatttctcctttctccttccttttagttattcccacagaaaactcagcccagtgggaatttgtcatattatgcccatgttttaaaaatattcatagtttgaatcttattgacattttaaagaagagttttttcctccctggaatgtaaaacaaaaatattttttaatgatgtggaagtatatatttcatgttcattatgataaatctacaaacaaatgaattgtttttatgggtggagttcttctataagagtatattaaatgctttcagagttgtattaattttgtttctaaataatataccacttatttggagtgactaactcagtatgtaagtagatgagatttgttgattttgcccctaaaacgggctttagtcattttaggagtgagttgcacaaaaggacctaaaatgcattgttttttgccttcttttaagagatggggtctcgctctattgcccaggctggagtgcagtgtgctatcatacatagctcactgcagtctccaactcctcataccagaggcatgtgtcaccatgtcttactcctaaaatgcatttttaaaaagcgaatttttagattaaagtgcctagtttctgattaataaatagaagatgaaaaaagtgggcgggaaaagcataatcttttaagatttgtaattttctgtatgtgccacatttatgtaaattaactataaaatatggaattcaggatcatgctgttttgcatgtactttataggttatatagcatgaaacatacaaattatcactgttctttagtatatagctccttgccttttcttacatagatgcttaatttaacaattacctatttatagttcttattattgacgggaatatgattagaagtaccaaaactaaaaattccattatg

SEQ ID NO: 54671 - DNA, 1069 bp, Homo sapiens
tctttggccttcacacacacatgtgtgcgtgcacgtgcatttcattaccatgtagacaagacagttattgcttatagtaatttacccatttgagggctaagtgttttaagctgtggttttataagcaaagctgtaagtaaatgtaatttattttagaaagatattatttgaaatcaattttgaagaattgcactatttgataatgctgctactacatgagataactctggggaattaattttatgagataagatgaatggctttctagaaggtgttgctttttgttttttctttttcttttttacatttcatcttagaaaaagttgcttatattcagcaggttggtttgtcaaattcagtgtttgagtttgtttctggtcagttcagtagctgctactttagcaagatgtggcctttcacaaaagaggtaagagtgaccaaatagaattttaggacaataagtataggaaatatctctttatcgtaagataagaaacttgaactttttaaaggaaatgtcctcttgaaaagaacatttctgactgcatgcagaagggtacttaagacatatataacaggccaggagcagtggctcacgcctgtaatcccagcactttgggaggcccaagtgggcagataacctgaggtcaggagtttgagaccagcctgaccaacatggtgaaaccccatctctactaaaaatacaaaaattagccaggcatggtggcgcatgcctgtaatcccagctactcgagaggctgaggcaggagaatcgcttgaacccgggaggcggaggttgcagttagccgagatcgtgccattgcactccagcctgggcaacaagagtaaaactctgtctcaaaaaaaaaaaaaaaaaaaaaaaaaaagacatatgtaacggtttccatttgccttaaaattgggttaaatagcaaaagcaatgtctttaaaaatgattagtttagagccttttagggtaaaccctgtttaaacacttaatcatggaattgcccttgccaccatgagctctaccatccacttccatatgtaaattataagagggacttca

SEQ ID NO: 54672 - DNA, 1907 bp, Homo sapiens
atttcattttttgtattttaatttccctacatttttgttcaactaagagtgcttatttcttcttgaaggttaacattatgtttattaagtatcaaaatggaattatcttttaaaaaagaagacaagttttccatactgtcacagtaagctccaaagaactttgtctttctcataaagtaatattctttatttgcatccatttactatgattccgttaatttgttgaattaaatgcctttataaaaatatttacaaatgttttcttgccttaaaatgtaacattttctacttaaatttaatttccaagagagtgattatttgcattacaaaggaattcttaataattcctgtaagcctaggaaataggaatgccaaagtaacatttaatgtacttctctataacttttcataatcagaaattttaaattatgtttatataacccatttacttttattttaatgtgaatatatattcagaaattatttgatgtaaatttcaaaatgattataggaattaagctgaattctaatttttttgcttagatttagaaatatgtatgtgaaatttaagaatttatataatctgtgattagtggaaataagaacatccctactttgttcctaatgagtatattatgttattgttttgtttagtttgtgaacaaccatgtattagctttacttagctgatgtcagtaaatgtttctgtctcctaaatgtaaggactgtactcattaatttgtgtaaaagtaaaacactacagtagcagaaaaaattgcactggctctttagccaaaataagcactgtaacatggatgtattactattactgccaaataaaaaagtgatggtacgtcttgctgatgtattgaatattttaaacaatgttaatatataattatgaagtcacacttgtctcatcagatcctgtatgagaatattcagtctccataagacccatatatatggcatagagaacaggacaactgcagaagcattataatcaaatataaaactttatcattaaaataaaaaataaaaggccgggtgcggtggctcatgcctgtaatcccagcactttaggaggccgaggcgggtggatcatctgaggtcaggagttcgagaccagcctggccaacatggtgaaaccccgtctctactaaaaatacaaaaattatctgggcatggtggtgggcacctgtaatcccagctacttgggaggctgaggcaggagaatcgcttgaacctgggaggcagaggtcgcagtgagccaagagtgcaccattgcactccagcctgggcaacaagagcgaaactctgtctcaaaaaaataaaaaatgaaaacaaagattaaaaatttattgtttctccatgtactgatatggggaaaaagacagttttgtgatgaataaagtgaaaatacttgtattttaatttaagtgtttggatgataatgccatcaagcataatataaacttatattgatatattgatgtatatgcatcattactattcatatatgacctgaacctctcttctcatcaattcttcaaaaggcttcagatatatggccgggtgcagtggctcatgcctgtaatcccagcatgttgggaggccgagcaaggcagatcacttgaggtcaggagtttgagaccagcctggccaacatggcgaaaccctgtccctattaaaaatacaaaaattagccaggcatggtggcgcacacctgtaatcccaggttcttggaaggctgaggcaggagaattgcttgaacccaggaggtggaggttgtagtgagctgagatcacgccactgcactccagcctgggcaacagagtgagactcagtctcaaaaccaaaaaacaaaagggttcagatatatttagtcaaggagaggggtgccacct

SEQ ID NO: 54673 - DNA, 1577 bp, Homo sapiens
gggacctggtgggagataatttgaatcatggggatgggggtggtttcccccatcctgttctcatggtagtgaataagtctcatgagatctgatggttttatcagaggtttccgcttttgcatcttcctcattttctcttgccaccgctacgtaagaagtacctttcacctcccgccatgattctgaggactcctcagccaagtggaactgtaagtccaattaaacctcttttctttcccagtcttgtgtatgtctttatcagcagcatgaaaacagactaatataccagcatttaaaagtattgttattagaagaccagcactttgttaggtactcatggatagtttatatgtgaaattgccttacatctttgtaaaattctctaacttgtaaagaaaaataaggaatgtagacggggtgaggaatgtggatagagcggtaagattgtatatgatacaaatcatctcactattctaccttaaaataggcatattctgcccatgtccttctaggcatctgatgttaaatatttttcctgcagatcttttcaggttagctgccttttttttttttttttttctttgagataggtcttgccctgtcacccaggctggagtccagtggcatgatcttggctcactgcaacttccacctttcaggctcaagcgaacctcctacctcagccttctgaatagctgggactacaggcacttgccaccatgcccagctaatttttgtatttttttgtagagacaggattttgccatgttgcccgggctgatgtcgaagcgatccacccagcttggcctcccaaagtgctgagattacagaggtgagccaccattcccagacggttagctgctttttaataggtttatgttacattaaaatattttaattaggcaacatactgattagttttactttgcacagttagtttcagaaacaaatacgaacttaatcttcagtgatacctgttcagccctttttgctaattcacgctgtattttcctcttttctaacatatcctgctcaattctgcgttttcgttcctcctccgttctcttcctttgttcctcttgtctttgtttctccatttcagcaaatctacccttcacagttcctaaaaatatatgaaaaaaaagtttgatacttggttatgtttctattttgcaatttaatttactatttacccctcaagcttcttacctgttaattttggaacataagccttttctactttagaagatacatcttcctcatcatcagaagcaagcatttctttaatctagatggttaaataaattaatgtgagcacatgtccaaaaattagactaaatcacattatatgcagagtttaaattaggttacaaatacagaaaagtattttagttatagttaatgtgaaatgtggttaatgtgaataaatacaatttaaatgaaaaaatgcaaacaaatattttcacgagaataaagtaaaataaaataacctcctgctttctcctgttccattctctctctctaatatattgttcttttcttctttgtttttcgtctctagatctcctttgatttct

SEQ ID NO: 54674 - DNA, 1022 bp, Homo sapiens
atgttgcccaggctggtcttgaactcctgggttcaagtgatcctcctgcctcctaaagttctggaattacaggcgtgagccgccacaacacctggctaaaaatgttttaatattcaattttatctatagaaatttggcttatttgagaagttttatttaacctgagtacatctttatatggaatttctccaaatttgaatattttatcatagaagacattaaaaaggaaggggatttaggtcaagtatattaagggcattgaaactcctgtgtgatagtggctaattctgtgccttttgattaataattcattcctttttctgatgaacctcaattcttagtaatgaattgtttatttggttaggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtaagacagaagctaactggagaatgctattagaattcacctttgagaatatgttaatagaatcattagactttagagaataccctattatttctggaaactgtgccaagagtagaaatggcaaatatgttttaaagtctcccatggaataacaccagttggttgaaggtatttgcttcaatttagtgttcagaagattctgctttaaattgccatgcttggcacaaaggatggaatattatctcccttctctgggaaggcatgttttccagaactaagtatccaaggaagaagaagaagtagggagtttcctccctcaacttttctttcttcctctccattctttcgccacctccttcccatactccctttctccctccttcattcctttatttccttcctttccttctttcagttttcatcccacctactatatattaaatgacctgagtcatttaatcagaattat

SEQ ID NO: 54675 - DNA, 1033 bp, Homo sapiens
acactggttctactgactcaactaaaacatatgccaaaaaatatattattttagttgtatctttttttgtagagatggggtttcactttgttacccaggctagcctaggactcctggatcatgtgatcctccctccttggcctcccaaagtgctgggattataggcgtgagccaccacgcccagccaaaaaatatttttgaacatttttgctagagtgaaccatttgacattcactataggttttaacactgataaaggtgattttgaaacaatgctagtctttcaaagtctaagatctacatgtgttttgctatttacttcccagattactgtatataccaatgattaattttaagtactaaaacttatttcaaagccaatgttacttctgttaaatttattatcattactgtaccataactatgttaaatataaaggtaatatacctcatgaaaattttcagcttctcgctctttaatttcaaggtcaattgctctccttcttgctcgctcttcttctatttttttctgtatttctttttcagacaactgtccaattttttcaaacttgctttttaggtttttagcttgaatagagccactcctttttaatttgatcagttcttcatattctctgctcaatccaaaggtttcattttcttcctcttccttcaaaaaaaattaataagtttgttgctgctgtttttgagagagtctcactatgttgccaaggctggccttgaattcctgtgtttaagcaatcctcctgcctcagcttcccaaggagctgggactacaggcacatgccaccatgtgtgactcaaaaaaaaaagattgaatatcagcatattagtttgtacaagaaaccatccaaaagatgtgcactatttcttatttgaaaccaaaaatacagtttaacctcttctctaaatgcagggtccaaatttactaactcaaaatggtgctacaaatttaaggcattattgaaaacattctacttaaaatgctattctcattaggaaatatggctaaa

SEQ ID NO: 54676 - DNA, 1865 bp, Homo sapiens
ttactgcataataggcgataaatctgatgcttatttggaaaagaagtaggcattctttagatgagctgtgctttgaagactgttatgaaaaggaataagaagtcagcatagtggcactcctggtttccttttttggccccgccacagaaaagatggatgtagtaagaaagttggagtgaaagagaaagttccagggagaggggaggggagctagtagtcatcagctaaaaaagagaagaagaaaagtgattttaaggaaaaaaaaattaatagaataaaagataaaaagagtgattaattcttactttcaatggtaagaatacaggtactagctgcagatcctttattgttgactgctttacacatatactctcctccatcttctgggaaagtttctggtaagtaaaggcagtaagtttctcccctttcaatatattgatagtcttctccatcctgcagtatttctccttcaaaccaccatgtaatttctggtttgggttctcctgttactttaaccgtaaatctgactggctcactgtctacaactgatgtgtttttaagaggcttcttgaaccatggagctcctgatctggtttgctcttcatcttcagcagtggagccattcatgatgctaccttcttcctcctcctcctcttctcttttctgtattaaaataaatgcattcaggttggcatttatagtattttcagggcagcgatttagtaacaattttgaaatgaaatttttttttttaagtaaagaacatacaagtgtgcctactacaaagtgtacttaacagtacattccagtgacttgaaagaaaaccattaaaacatttttttaacctacctaattataaaactatgggttttaagagggcatctttggaaaataaaggatacataagcctggtaccttttgtagtgctgcatcaatttccctttgttcaaactgcatgcgtagtaacttttgttcttcaattcttctttgttcttcttcttctcttgccttagccatttgttcaaatctagctttcatattcactttgtgagtaaatggagcctcgctttttcttgcaggcctaacatcaacatcatcttcctgcaagaaagtgggccaagattaacaattgcttgccttctaaaaacaaagaagcgttactagttctaaaggtgtttagaagcacaaaatgattaacatgtttataatgcatatttttgctacactgcagacactcagattttttctaactctccagttcaggaaaagtgatagatacatttatgaagcattctcttagttatagactttttctccaaatgtaaagatcacaatatcactgggatcctagcctgtttgtcctaccaactctgcttggttttgatagcacttaactgaaaaaggtcagaatgctatacattctaaataattgttaaaagtactcccttgattcctgtaagtccataccattccctactgcataataaatgttttctcacttaatgattttccttctttacccttcttagaactatgtccctaatgaattccctccaaataatgtattgatggtgaaatggcaggggaagggtgtttacaagtagaaaaacaggtagagacaactgttgaaagaggcaatggctgaaacatggggaaatcactaagtaaaatatgtttgagtcatctgaggggtgaattggaagggcgaaatgctaataagggagtgatttaagagcagagtctcaactgtcaaatagtgtgtctaggaaaataataatttggtaatgataaggtctagagcagttttggtggagtggggttaatgtgggtagttaattcatggtttctaaagtacttcagttgtt

SEQ ID NO: 54677 - DNA, 6460 bp, Homo sapiens
acatacagactatatttaaatttccatagttgtcaggaatatgtcttttgtcgtctgtgtgttttgtttaattcagagtacattcaagattcatgcgttgcatttcattgctatatttctttaatctcttaattcagcaaagtcaccttatttggaaaaagacctgattgtgaaagctgagttttatgtgttttcattgatcttgttctttattccttgtcaggttacttttaataacattgtgttgtaattggaataaattattaatacttttaacatcttattatgtgtgtgtgtacatacactttataggttactaatcaggaaaaagtcttggctaggtcttaatacagtctttaaatcattgcctttaagtgggcttaaagtttttcaaaaatgttctttttgtaattctggaatcgaattaagattatgcctaaatctttaccttccttagctaaagcagtgtggatttggggttgattctgtttttttactaataatgacgctctagaactaaaagttaacgattaattataaggcaaaaagaaaagagcgttctttttttttttctaattgcagagtagtttcctgacactactaaatgaatattttaaataaaacaggagtaattctgaccctctgtgcttttgtcttataacctgtacttacagtggatgtaattttatattaaagtttaggggtttttttttttggtcaacaagggcaaacacaagattattcaaaggcttgggagaaatattacaagaagcaaggtattgtttttattagaaatgagatgttgggcttataattgtggttacagcaacaaagttcttttttttcaaaggtcaggcagttcctgctccgactggggctcctccaggtggtcagccagattatagtgcagcctgggctgagtattatagacaacaagcagcctattatgcccagacaagtccccagggaatgccacagcatcctccagcacctcaggtataatgtaattgctaatttgttgatttctactccagtctgttttctgcatgtttactgtttgtctgtttgggagtgtttgccttttaaatttttatctggcaaagtataataactatttaaatgaagtactacggtgtattgtttgggtttttttgttttttataatgctttccagcatctgagtggtgaatatttctgcaatgcctttgattttaaaaataaattttcttcccccagggatttgcaaatcatgcaagaagccaccaccatttatattaaccactttttctttcttaaaggattcactcctgaattagctccatttcaaggattttctttaactttttgtgtatttcttatgtatctcttctgcacagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcctgtgtcggtaagttggatatgtgggtatttaaaggattcataatttcttagcaatgataaattaagatacatatacacaaatatataagctttccccatgaaatattgagtttttaaacactggcatgtttttccccccttgcagtatagtggtagattggaggatcttttccatttattgtattggctctttcagcacaagtaatcctgatatcttcattttttttccttctgtttgattaaaaactgcatgtgtgtacaatgatcttttggcatacttccattgcattaacagtgaaatttccttttatacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaactctttcaatgtatataatgttagtgtgtttctttctaaatttaggatagaaaagtgaatagtgtgcaaaaagtatagctacattgcatctgccattgaaacataaatggggtatggaaacgttcaagctttttttttttctttatgcagtatagataagctttgttttgtaaatgcacaagtccaatcattgaatcaacttaatttttttatgtacttgaagtcattttattactctttaacactcatgctgaagttctgatattttgttgaaatccattgttttactctttgcatatttgttggctctttgcatattaatatattagactacatgcaaatacagtctgtcttgccattgtctgttgaagtgcaggtttgatccagccagtatagaactagctctgtaggggtgaggaggactgtgctgtgtatcatccttgattgtgttccttcaaggagcattgcactgtaagtacatcagaatgacaaattgatgaactgcaacagtatctttttgtcaatgttccacataatgcaaatgccatacgttgtgtgaatattatgttggaatacagtgctgatatcttggaaaaccataactgcctcttaatttaacatagaataatacatagttctgtattttttttaaagtgagcttaatgggtaagtattttttatatgctttagctatagctaaagaaaactgatacttaacaaagttgaatagtattattcactggtgctcctaaaatattgtttttcagtgtaaaatatgcatatcttctatatttaatatgaaagtcttgaaatgtatcagacagaaggggatttcagtttgcaaataatgagcaatgtagcaattttaacacatttcataaatatatattttgtcattggtggagagcaccatttgttgttttgaatatactttaaaggaagaggtacaaggacataaatgttgagattacctacaggatggaaatagcagtacagttcattgtagatattttgaaatgtttttgattgttttatataacctagagtgacttcccttacccttatttagatctgcatatatagttctagtatgaagtttaatagttaaggagttagctatttgttatctttaagagtagggtattgacgtgaacaattgcagtattttgcatgatactgttttatagatgaccttttaggaaagtggtgcatttattaattgaactgaagaagtagttcagttgaattcagtatcataattcacaaattggaggctgttgattttgattcatttaaggtttaaaatctttattaattgcaaacagtgcaattatttatacttcacagtgccttcccagaccttccaccttaggttctgctgcaaaaagcaccaggtaagcacaacctaaggacatatataaataaatatttcaatacattaatgttgtccctgtgaggtttttgtggttgtgtattcaaaggcaatctgctactgcttccccaaaatgtattttgttattttatgctaccatcttagtggaaagtctgtaagttgttaaagcaactgtttacatttctgggtaatgttttttattttacttttttttttttattaagacaagaaaatgatgagtagattgctgcagtaattgaactacatccaaatctttttgtattttttccccaaatatagaagtgttaatattaagaaaggacaattacacagttttcaagatttaggaaatcacttgtttagaaacttcaacagccttcacaatctgttttatatgatggacagaaaatttctttgccctccaaaattataatttctttatttttttcttattcttaaactataataattcagtaaggatattatgggttagaattttattatgatttttttcttagacaaaagttatatgctgaagaaggaaaaagttataaggcagtatgttttgataaaaggcatgtgcatcagtgaaatgttaactgtatagcaaataacctttcataatctgtagcaatcagtatttttctgatttaataatattttaataactgacgctgcatttaatttttttgccagtttaaaatgtttgtgtgtttttatagatgattttaactggtacatattttgagttaagttgaatgtatgaaagcagcatcttatcagttttgtttattcgatttctaaaatgtgctgatccttttaaaactcctgcttatctctgcaacaaagaaaaatattcaaaaatactgccttcattttcacacacagtgctgaagatgctgcaagcaccaaatcatagctcataaaatcaggtcctgagatagttacccataaagaggaatcctttgagtgtatgccattggtgagccgatgagcatggaccatagaagggctcaatgtagaaggtaaaattggcaaatcataattgagaaatatgaaatgtattcccatacataatatggtatagggtgtaatgtacctgcttttgatcacttttcattttaaagtgctattcacttgatcttaaatgttccatgaactgttaaatttcttaagttacatagttactacaccacatttatgtgtatgttatgttttaatagtcaatgataggtatgtacaattgataatataaaggggctcattgaaacttgagagcctgttgagttttggttagttgtagattgcatttttataaaaaaaaatacagatagattgatgataatagatattggggcattgtttctgtctcatgagaattcttttattcattaccataagccttcactgatactataagcattattttaaatgacgctgatcttaagtctgaaataaatggaaagcagaaaaggtgagccagttgatttgaatgcattggatattagtgttagaaacaatgtatagtttagattgaaactgaactgacttatttagcacttaaacaaaaatttgacaatgtttttagttttttttaagacagcttagtgtggtgatacttagaattctatggtttgatgtttcttttagaaatgagaagtatagttttattttttaatataaaaaatggttttaatactaaaactagtaatttgatactagttgtttataaacattgtaaaatatatcttttaaacaaattatcttggtagttaattcataagggtgggtttgggtaggaatagcagagtactttcagagggaaaggggagtcattcagaagtgatagcattttatttgtttgaatactctgccagtaaaatcagctgtacttagaaagttatctgttgtgtagaataatgatgtagagtttactaatcagtgaggatgtcttgtttttattttctgcaaactctgcctcactttaaaatgcattataacaatacctaattaaagataattttggctctgaaagttaccttattttttgttgagttagtgacttcatttttcttgccacaatataagcttttgagggatttttttaaattggtgcttttaataagcaaataaatcccagggttttattttcttcagtgatacccctatagaaactcttaaatgtatttgcgcatatatatatatatattttcttatgcatgctcgatgcattttcgtcctgagaaaaatgttctctacagaaactacccgtgtgtaaaaagaagattggcttaaaatggctactgtgatgggaacagtgtcttagggagatgcagcttggacttgaggtaaattgaatactttacaactgtggtttagagtttgctttaatgacattgtatgtaaaaggtcacatgattgctgtaattttgtattcattatggtttcctcaataaatgtacattgatgactattataaaggagtgctttgtgttttttatacatatattacatggtaaaattttctacttgactgggtttttttttatgtttactgtgagaaaaaatgattttaaaaagttttaatgataaaagggtaacatctggttgcacaagtcttaaaatacagaaagacttttaaatacagaagttactttatttgggttcacgttgtaaaataaaattgtcttccagaaaattaaaatataaaacaacttaatagaacgtaatagctaattatttacaaactcattttaaagactagaattttaaatcgaaggttgtgccactttttccctaagtctgatacacttagatcttgaagccttcgactatgttga

SEQ ID NO: 54678 - DNA, 1473 bp, Homo sapiens
ctttaggaaccatttggaacctgatactatacttctggacaaatcactatatttcagctgcttttgctcttagtcatttaaaattattacataccacagctagatgtcacaaatgaaagctaaattggtaagcttggttatccttcactagcagaaaaagaacctataggtggtagagttttgtcataagagaacggtctacttgggattttcaatgttttctttgccaaagaatgtttctcattctccacagaaagaaaaatttccagaaaggtgatgattttaatcttctagatgtaaaattacatatacctgatgataaagttgttttgcacaactggtttctttttaaagaaaaattgtttttcctcttagaatggcttcctaggagagtcatgttccgtctctttctgaggctttaacagattatgtttttgtgacctagcttaggcagatctacagtagctacaattcggcaaaaagaaacttttaacttaaaaacagcatactctgattaaggttggttacataatttattttctgaactgggatcctttttagaatgaatagggatgctattaataatcatgccctgacagcattgtggtcaggacctgtaatcaacttaactttaattaaatagcatcaccattttaaaagacttgagcatgagccacgtgcggtggcacacacttgtagtcccagctgcttgggaggctaaggtggaaggattccttgaacacaggagattgaggccagccttggcatcatagtgagacctggtcacgtgtttgggttaaaaatcactaacttcaacttctattttctcaatgggtaatgtcccctagatagggtccctagttattattaagtaggtaaaaataaaggcttgttaatggatttaggtaattatggaggaatgagtttggcttctgtgctttattttaccatattgattatttgtaatatggccattaatacatttactgtttagtcttttttgttttactttttatgttttactcaaaatgagtgggtgggtggaattctaatttttattgttaagggaagacattttaccttgtctttaattttttatttttttttaccatttccctgccagttagagatactatactatactgtcttgaatcctctgtaggaaaacatggcatagaaataattaaataataattagatgttaaataataatgctgtatgactaaagaacctccttaccccaccttttctgttgttgttctgtagtaccacaataatcacttgttaattttatttatttatttatttgagagggagtctcactctcgcccaggctggagtgcggtggcgcaatctcagctcactgcaacctccgcctcccaggttcaagcgattctccggcctcatactcccaagtagctgggattacaggcgcctgctaccacatccggctgattttttgtatatttagta

SEQ ID NO: 54679 - DNA, 1983 bp, Homo sapiens
tgtgttgtggctggagcttgggtgttgaagagatacaaccaaagggagagatgaggctgaaatggaaaggataagccaggggcttcaggctgttaaagatgttgaatgataggctgtacttaagctttgaacatcctgaagattgcagagaatgaagaatttcaagtaggatgacatcaagtttataacattcaatgtgaaataggatgaaatgtggctaatcttttttaagatttttatattttctcttcattgaaaataaggacaaagttcattgttctaaaataattttctttcttatacaggttagtccctagaaatgtttttctttagtcatcttctagatagagctgtttgtgcttgaggcgaaaccaatttagaaaaaaacaagggcacaggatggtttgagacagagcattggatttggagccaaaagacctttattcatatcccagttatgccactcagtagtttttaacctaggaaagtcacttagtctctgagacttggttttctttaataaaagctgatggtgacaacaaaaataatagaaaatttaagttttcatatactttttttaatgttctagttaattttgggggctgtatatttgccagagagctgggcgggggggtggtgtgtgtgtgtgtgagagagaattacagacttcacatgcaaaccttgaactttcatttattttagctaaggcaggaacggatccaaattcagcagcttgggctgcttattacgctcactattatcaacagcaagcacagccaccaccagcagcccctgcaggtgcaccaactacaactcaaactaatggacaaggtaactacagaacttattgtatgtgaaagccaaaagttgtgcttggaattatatatgaagtacatcactgtataatacctaaaatttctgacattatttaattataatttaagcagacttttccttttttaaattgttactttgaaatagtttcaaactttcataaaagttgtaagaagaatacccggagcacccagatagcccagctgttaatgttttattcccttgtttactctgttaccatctatatcatacatgtgtatctgtatttattttaaatatccattataattagttctgaaggaagctaattatatccagcataattagttctgaaagaaatcactgaagactaaactgtagacatgatgtcctgttgggtacttcttcaaaaatacataaccatcatacagccctccaaatcagtaagtcaacattgatatattaagttctttatatcattatggatttctgatttttgcagtaggttatatttttaaagtatttttataattttgataatcagattatcctggatttggccagtcagggagtatattcagggtggtgcctatatccttttgaaatacctgtcattcttttaagcacttccatactgtctggcacagtaagattgttattttgtgctttctgggctccagccctcgagtcagctatttcttcaaggagctcttattccttttagtagagtatggtagttagaaacgagacttgagtatgcttgttgctactgaggtgtaattgcttctagcttctttcaacaggcagaactaggaaatatatttacatacatgcatacctacatacacacaccaaaaaacacataaacatcgatatatgtatatatttttaaaaactatgttcatatcaccacatccgtttcagcattttggggttttcaagccttttccttttttgtacttgtttacaaacgtgagaaacctggtgtcctcagtgtatttccttatttgacatgcatttacttatatgttcaacataaccagtcttcaaacaggttggttttcttttctgtccaccacctctgtacccccagtaccttctatctttggcactgttagggatgccaccaccacatagtacttccctcctaccctcactgtcacattgcag

SEQ ID NO: 54680 - DNA, 1685 bp, Homo sapiens
aggggctgggcactgaggctcacgtctgtaatcccacctattcagaagtctgaggctgaggcttgagaccagcctgggcaatatggcaagacccatctctaaaaaaatttgttttaaattagccgggcagggtggtatgtgcctgtacttgaggctgaggtgggaggattgcttgagcctagaagttctagattgtattgagctgtgggcacaccattgcactcccctgggcaacagaatgggatcccatctcttaaaaaattatgtatatatgtaacagtctatataaatatatatatataacagtccaacagagtgttaagtattggggcattaaacttccaaattgtcaaataagatatctgttctagtactcctcatatgacaacttcatgtgagtaaaaatcaggcctgtatttaataactgcatgctaaagcccaaatacgtttaattattttctatattcagatttatttttatcctattatattctggcatctttccataccctgtagtttgctttccatcttggtcaaagagtcattctttgaaaccaattaacatttatttatgatccttttttctcacctgctacctaccttttaggcctctttcactcgtgtagtttcaaggaaaatatactcaattatggaatactttctacacataatacatttatcccaaaaaaacttgaagtaatttatgtaaatgaaattgcttgattaacttcataggaagtgtgctgtttggaatatgatgacacagcatgacagttaccaagcatgacttgagttgtgctaggatataggtgtgcaaagttggggttgtgttctatagcaaaagaatgcactcccagcgtaagcaacactgatggaaggggctcacagggtacaggatataatactcttaacaactaatttttggagaatgaaagggcttttctttccctcttgttggctgattgggatggtataattaatgggattgaagagtttgagtaggttaaaaggcagattcatattgggtaacttggatctgccaggattgtatttttgagcactactgggtggttagcatgattgaggaaaaatgatgggaataagaagtggaagtggtctttgtatcacaagttgaatttctcacttggagtagtagtgaagtcactactgtaagagctggtcagtgaatgtggttgcagcatggcctttgggcaagaagtaacccatttaactaaaaccagctggttggccccactcagatttatcaaagggttactgggtccctgggggtggatattgcttatattagacttagaatagcatactgttttaatattatatgaactaaaatgtttctttaaaaaaagagtggtctgttaatggatttatgtagtggtcaagaatttagacttcagagtcaaataaacctatatcagtcctagtcctacagtttactaattgtgagatgtcaagcaagtttttgaactcctctaagcctctgttttcttatctataaattaataaatgaatgaatcgggttgagtgaatatttagtaaattcttagtacatactagttatttgtaactgtgagactggttttttggtatggttttcacatttgggagtagaaataccacttcctaaagtctgttttatctcaaattctctatccaggcatagtgta

SEQ ID NO: 54681 - DNA, 1060 bp, Homo sapiens
tttgtgctattaaacatcatgatacatgaaaggccaaaaaggatataaattattgatctgaatgggattttagtgacagaaataggttgtgaggtggattttagtttcatagtgaaacaactagctattaacgttatcagtgaaatgttcagaagacgatgatacaggacccaagcggtttgggaatatattgtcaagacggttgtctcatgttaggcaagtagatatagagagaagagctgaagataaggacctgatttctgtgagtaagatggaaaaagatagtaaaagtaagaatgataaaaggaaagggaactactgctgtccgcaaacaagctaaaggaaatttaattgctaatttaaatttaatttaatttaaattgcatttaattgctactgctattgattttagtgaattttacatgtctcattattatggcagatgaaatagtttttgcaaaatgaatgaggaaaggaaggaaaacctaaaatttgttatttgtgactataagagggtagaaatggatgattatttggccgtagagttgtttaaccattactgtgtttttctgatttttctatgtcatccttttttttgtagggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcagtaagtattgggtttagttctgggctttccccaaagattctagttttgggactgttttttatgctgatttttcttttcagtggtcctccagccccatatgctccccagggatggggaaatgcatatccacactggcagcagcaggctcctcctgatccaggtagaagatgcttattatttgtgtgttatctgtattattttccactcctgttacattattaaattttctagtgttgattctacatttgtatgcatcaccttcactcactttactctttcaacagtgttaggcactgcctctacccca

SEQ ID NO: 54682 - DNA, 1588 bp, Homo sapiens
caggacctccagaccgatgtcaacatgctgcagaaattattacagaccttcttcgaagtgttcaggtttgatagaaagttaacattttcattttttgtttttatggaaaagtattttccttcatgaaatctgaagttacctctatatcagagtctgcttgatgatgctttattaatggagaaagtttaaattgctttaaggtaaagatcttggagcaggaagaactactaccttaagtgctaccttatttactcttgtattttaaaaaatgttattacttattagggccagttcatctctacatttctgattcaggtatatgagagctgggaaaaataaacttaataattttatcatgaaacaaaagtatttctgtgctgactcttcgttcttgtctttccctctctataggctggtaatcctggtggacctggacctggtggtcgaggaagaggtagaggtcaaggcaactggaacatgggaccacctggtggactacaggaatttaattttattgtgccaactgggaaaactggattaataataggaaaaggcaatgtattttaaactcttaatgttttaacacattattcatttttctggacactttctgttgctgtcgtaaacaagtggcaatgctttttctctgaccgtattttagtagaaaagaattcttatgttaatatgtaacaagtaaaacataaatgagggatctcatgtatatttagagaaagagcaggattttaatcttactagcttctagagaaagcgaactaagagataattattagcataagaaatgtcttttgacccaaaaagtggtttgagtgtttttgtttgtgcattttggtttttcccgactcatattttaaaaatttgaatgtttataagtgtattagtttatatttacactgcttttaaaagcagttaattcaaatattttattataatcacattaagtttatgtttaaacatactaagtaaatgtaaatgtattttaagagaagcatgaaatgcttcctaaaatttgattttcagtgtagaatattaaatgaaaaatcttaatacaatattgtcaattaggatactgaccaaaccatatttttaatggcccatttaattgtgaccattttcttctaaatagctcctagtacacccttgaaacctttagagaaattactgtcttttgattttaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtgtgagtatactttaaacttttaatttttagtgtagacccttagactgtagttaaattaagacgtttattcaaatacatcaaaggaaaatgtatcattactagtcagcatttatagatttcatgatatgtataatagatacaacgtgaagattttccagcaatgaaaataacctaattaaatgtgtagttacaggttttgagaacaaccttacatttgggtgtggctagata

SEQ ID NO: 54683 - DNA, 1423 bp, Homo sapiens
attgtagcatatgagtaagcaaaatggtagtttaaaaatgtaaataaatcatttagttcttggaagaatcagtttaattctgagataactttagcattagagttctttcttggaaattttggactattcttaaaaataaaaattgtatatctagaaaatttttttgcataatctctcaatctttgacccttgatggcattttctttcagttaaaagtaaaagcattgttaaagttagcatcaaggcacctaatcctgaactgggataggaggagtacttggttatattgttttatatttctctatttgaataagcttgggtatgctacagcttactatttaaatattaatttgttaacaggtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggtattgttatttttgtgaaatggctacttttgatctgttttgatgcccatttttgtccacttcttttgttaatatatattatttctatgattgtaacaggaacgggctggagttaaaatggttatgattcaagacgggccgcagaacactggtgctgacaaacctcttaggattacaggagacccatataaagttcaagtaaacttaactttatactttataaagaaagagtgggttgaatggggttgggcaaaatatgcatgaataattaaaatgttttgagacatgctttctaaattagctaactttttctgctttagcaagccaaggaaatggtgttagagttaattcgtgatcaaggcggtttcagagaagttcggaatgagtatgggtcaagaataggaggaaatgaagggatagatgtaagtaaaaatacccattcagaaatggttgtatgctaattcataaatataatagtgttttctgttttgtgttaagtagctctaacattgttatccttttatttcacctttatactttagaatacagaattctatatatcttgttaccctatttactataaatatagaattatatgtacttttatgatttgaggcagattttcaggaaatggcgcttttttaaaatacttttttttactttaaaccctgagaagctagctttcttaatacttagtcttttttacataaggtccccattccaagatttgctgttggcattgtaataggaagaaatggagagatgatcaaaaaaatacaaaatgatgctggtgttcgcattcagtttaagccaggtgagtacatataataatcttgtaagtgttggcagcagtgagttttgacatacatttattgtttaattaattttgtttctttgttt

SEQ ID NO: 54684 - DNA, 4122 bp, Homo sapiens
ttgaactataattttaatttttcaagtaaattttcttatgtgatactaaatatttcacatatacatgtatcaggaagtaaatgggggtaatttagtaatgaatagtatataatagtttatgatggtatttttcttttttttttttagattgcagcaaaaattggaggtgatgcagggacatcactgaattcaaatgactatggttatgggggacaaaaaagacctttagaagatggaggtaagttatactctaagtattttaaattgtttttcagagtgtttagttgaagtgattctcggtatttttctgttattttattgagatattaacttttattataaggttgttaaaattgtaagctgtatattggcctaaaaggggggaaagaaaactagacaaggtaagtaaaatttgaaagaaattttttaaaaaattttttaaaaaaggaagttttgtcttaatagaaaacaatttattttccctcttttaggattgtgccagattgaaagtttgcacagacgtcttgttaataatattaaaaaacatataaattgcttagaagacacttcactggttttactcatacgtgaatggattttaatatgctgtattttcgtcatttttctatttccaattgcaccttaaaggttgaaattcctatagtttgctactctagtgtgttgcaggttataccattttttttttaatgttctttactttcagtacttttgtgtttcacgtttagctttaaacctgtggattaaaacagtggatttacagtgctatgtatttttaaaaatcgtaatcgttgaagcttctgaacttagaagtctgcatgtattttttgttttaggtttgatatatgagttttgatacattttctttttacccttttttttaaagggaggattctcactgaggctatagaatgtatttgtagcttttgaccaggagaacttggtttccttttatttaagtgtctttcatatttatagtgaggtttttaatgtagaaaaaaaatgagctaatgatgcttcagatgttgtatgtaatgtattctttttattttatgtgtagatggctcttggacaagtccgagcagtacaacacactgggagggaatgccctctccttttaaaggcaggaatttttatttattacctgtgttcagtatgtaaacgtgaaataaaccagtggattcttaaatggacacaaatatttcttggattatgtgtctgcgcatattttatttttgctgcacaacattctgatgtttaatcatttaagtttgaaggggggaggagaatgtagtactttgagctataggttgtctgttccaaggtatgcattgtattcatctgtgtaatggatttaggtgaaggtagtcatgtagttgctttgagattttatttttttgctaaagttttatgcagtgaaatgtttgtttataaataatagaacagtttaggttgagattgccttgtaatgttgtggggggtttttttgtttttttttttttgggcatagctttgtggtcactgtcagatacactttaatatgtcagatttttgtagtttgataggcttttctccccccagtcttcagttcctgaggtggaagcatcattagcctttagcatgtgatattttgctagtaatggacctaaagtacgttgtcttgtgtcattctaatgtgcttaacatacattaaggtcagtgatttcttaagaatcagataactattttaatgtctgtgcatcttttgaacgtgaagagaatgaagtatcgtttcttttttagattactgagttggggttgaattttggcagttttggttcaaatgataaaccataccttcagatatttcaataaatgtttatattgttatttattcttgtttgggaggggagaagctttgtacttaattggcaaaaaattaaaagacacttaattttgcagatcaaccagatgctaagaaagttgctcctcaaaatgactgtaagtattccttttaaactgggtcaaaagctaaagtaacaatttcaatgttaagattttgttcatattattgggtatctttgaagttagttggtttatgagtattttggatcagctagcctgaatttctttgtaaatatatacctttttctcctattttacaatctgtcccattaattgtggccgggtatatgtaaagattggttgctgaattattttacatatttaacaactccaattcttgatctatacttgtacaacttgaaaaaggaaattattttgttctgtgccattgctaatataatgtcttccctttcattggctctcttgcccctgtcaatgccaatataaatattgtgtaaaaaatttgactctcttcaaggtgttgtctgtgcattagggagagatttttgaatgtttgatgtgattgtgttgttaaatatataagtaaatttaaattttgaatttttgttttatttttatttaattttttgatagcttttggaacacagttaccaccgatgcatcagcagcaaaggtatagtcacaagattttcaaaaagtactctgcaagttttggttgagctgtatgtaaaaacacaaccacattggtgtatattgaatatgtgtctgtgtattttttggtgtacctagttcatatcactccccttgggaaggtaccataaagtgatgatttttcttttgagtgagaaaaatttgtgatttggagagataggtggaattaaccacattttagaagaacaggggtgaattagagtaactgttaagatgacattctctaaactccacttcaacttctttacagttaatgccttcagactgttccattcatcatcccttcttcacttgatgtgtcatcttaaatttcttaatttaactactcaagtaataagatcatattttttgacatgagtctgagcctagaaccttagtttaagccattgggagacattagacttccatttttattaatagattatcttttatttgtaaacaaagtatctttcattgaaggaaaatggtgctttctgttatttcttagcagatctgtaatgacagaagaatacaaagttccagatggaatggttggattcagtaagtaacttgatttttaaagttttgaaaacatgatcaaaacatactttagaatctttcaaccaaaaaaaaaatttttttttttctaactagtaattggcagaggaggtgaacagatctcacgcatacaacaggaatctggatgcaaaatacagatagctcctggtaatgttacattctcatggtattttcagtgtgactagaaaactagcttttttttttttttaagccttctagtaacaataatgctacttttaatcttttgacctgaagttatctgtttgttttaaattgtagacagtggtggccttccagaaaggtcctgtatgttaactggaacacctgaatctgtccagtaagtttgaaaaatcttaaaaatctacttaagtaacaacagcagaactctttgaattttgtctcttctctttgttactgctttattttacactgtggtttcgctgccaccttccctcaaagtcctccaactcctttgaagtttatgcctcatgcctttctcaggtggggttcatcatctgaatcattaaacacagaaaatggttaaaacaactccatatctactccagtctctacttgtaaagccacgtgtagcctggagaagaatgcacagtcaggtcgactggtgacacttaaaactcagacattaagctcaagtggactgttgtgttgcctgcatttccctagttccattcacttttccactcctctcccaggctctttaatactgtatttccccacctccaaatcttcagcatctaaccccacgctctcccacttaagcttatttactgagaaaatggaagcaaatgataagaagcttttctttttccctaccactaaacctaccagccttcatttttcctctgttcacatagtactcaggtaattgctttccttttgtgttcgagtgcctaaagccagccctttcttcctactgaaggttcagcttgcagttgtactttcttctgcattgttagttctccctcatta

SEQ ID NO: 54685 - DNA, 1154 bp, Homo sapiens
aacacttttctctaatgtctttgtaacagttctcagtttttgaaatgctgttactgtttctttagtgtgaactgtcaactttcattttttcttttcttttcttttcttttctttttttcttttttgagacagagtctcgctctgtcacccagactggagtgcagtggtgcgatcttggctcactgcgacctctgcctcccgggttcaagtgattctcctgcctgagcctcccgagtagctggaattacaggtgcgcaccactgtgcctggctaattttttttttttttttttgtatttttagtagaggtggtgtttcaccatgtcagtcaggctggtcttgaactcctgaactcatgatcccccccgccctgcctcggcctcccaaagtgctgggattacaggcatgagccaccacgcctggcctcagctttcattttcatttggttagtttttgaactattcagtgggtaaagttgtataaataagtgtcttttctctgtatagaagtgtcttggagttcaaggagtgctgctttgcaaactcatagagtatttataaaagctaactgcagaaggtattcataggctaaaccgtttcctattcttggtagcaccattttctctggcctgaaatactttccttctactattagtgcctgtcgatacccagcagtgtatttactttcctgaggaacaattcaaatgctaagtgctttaagacctaagggtggaaaagcagtgttttcaggcattattaggaaaataagatttaaattagacacccagaaacaaaaacaggtttgtaattggtaaagtgaaagatggttaaagaaggttagattgaccaaagcgagaatttaccttttttttttttttttttttgagacagagtctcatgccgttgcccaggctggagtgcagtggcgtgatcttggctcaccgtaacctccacttcctgggttcaagcagttctcccacctgagcctcccgagtagctgggtgacatgcgccaccacgctcagctaatttctttgtatttttagtagagactgggtttctccatgttggtcaggctggtctcgaactcctgacctcagtgatctgcccgccttggcctcccaaaatgctgggattacaggcatgagccactgtgt

SEQ ID NO: 54686 - DNA, 1821 bp, Homo sapiens
ctggcgccctccgggcggcagcgctctcgagacactgttgcttcgccgtcacgcccgtcgttgtcacgcccttccccgcggacaccgagaatgacccatagcggaaaattctaccgcactacctccctgaggcagcgaccggtaagaaacaaccttttcttcaggcttcccaccacccaaacacagtcgcagtcaactggccactatcacccaccaccctgcaggaacaattacccagcctcaccccaagaacgcgcggagaggaggtgccaaaagaaattctgttctcgcgaagtcttaaacttaatcctcgcgacgtctctgttcctgtcgttctttctcagccctaacccacaccagcgcgttgcctcggaaacatcgcgagattttgttccttcagtctccgcccctttacggcacgatggtcgcgcaagaatgtaatagagcttcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcaggtaagtgtggaccgcgcggcggaatcccgaaagctcacggtaattggccgctgactgagtaggccgctacccttaagcgcatgaggaagaggaaagaggtgttcttccgggctgaaatgtgaagagacacgtttccccatgttggtaataacgattagagaccagaacccagttttgtgttcttggtgcctaatccacttagaaccccgacgcgtgctacgcaaagaaggcctgaagtctttctcccgcttctgcggcactcgcgtgtctccagtgagctagtttagataaagatcctcttccaggggataaagcgcagttagtttcacacaatttaatggaaggttctggtaatgagtttgggaaagaactagggtctgtcctggagccatagcaagggaagggatttatcattaaagtagcctttacagctcatttccgttctctctcgcaattaaaaccgctttcagtaccattcaccgtcacacctctacaaggaagggacttgaaagcagcctttttctgggcgggatttacgtgtcagtctgttccaccagtccgccccccttatttctcaaaatggcctcaggcccattataccagaggtttcaatttgaatctgcctctcagttcagagtcgtaaactgaccagacctctttgtattacgtagtgcgtgcatttgccctgaaggcaccactttcccagacgaaagctgttaaaatagtgcgtgtattccaggaaaataaaagataccttaatttgaactttacattcttagatagtcccctaatatatttaacatttcaaaatgtatggtgttggtatagatttgcatgtaagcaaaagaatcctattctctgtgacactatgcatattgtactaggtgctgggcattttttactagttttaagctaatgataattagaaaccagtgttgtgctgtgttttcgttgcattaggagttcacttagttaactttttaccgggacagttgaaggaacattgagtcaaaattagaattcataaaatccgttgtaacacatctaatgtgaacgcattataaacatgtacctgtacttttttataaccagaaatactaggagtagtcaacaaaaggtcatcattaatattagttctgcggttttttccacgtaatttaagaaattc

SEQ ID NO: 54687 - DNA, 1053 bp, Homo sapiens
aagttgaattctttattccacttatcattttcctacaaagctacatatgattatgaatgtggagggcctttgaggccagatggcactgaagggtagtttcacacaaacttttcttagaatatcagtcttggaaagaccttgaaggtaatctcgcccatttgtttcattttatattggaggaaaccataacacagattgctgagtgccttctacaaagtgccaagattaattgcagagccaagactagatttctaatccagtgctctttattttgtgaactgtcttctatatgaagcatcggtgtttgggttggaggttttctgcttcttaggtacaagaggaagaagaatctgtacagaaccaaaaacatcttaatttttgtaatcaggatgtctacctttactgacaacatttactgacaacatttccttctgaaaataggttattgaaagatcaaggatctttgccagtgaaatccttaactggaagtgggtgggtacaagatagaaaactcatttggtataacaattttgttgttttttagtggaaccttgcttctctgttctgacatttccatgtctctatttatagtagtgatctctttggaatttgccttctgattccatttgttcctttatgttgcttcatattaactgatattctcacttcatttaaaaaaaatttgaagggacatgtacttaagaaaaaggaattaatttttttataagaaatatctggaggtactatttttctatggtttatcataatcattgtttatgccaggttatctaattgtagcaataatataaatactattttttcaagcaagaatgttagttttaaaaaatttatgtgcatattaagctttagacaccttttatccaggacagatattacctttagattcttaacaaccttgctccttaactatgcactttgatataaatgaagattgagaggttttagttagagcttttaagtggtaaacggtcaagggcaggagctatcttatttacctttgagatgacaataatgcctggcatctagtaggtc

SEQ ID NO: 54688 - DNA, 1103 bp, Homo sapiens
agatgaaggggttattaataaggttacaggaatgttcacagtagaacttgtctttacacttaaaaagtactcttcttatattctatactttcattagtagcacaactgtgcacacctttgtcaatccagaaatgggcagtctgaaatccttcctcttctctacatccagctgatgggcaaattatacagatgctatttcttactacttaatcctacctgttggtctggttatatcatagtcatcctactttaggttcttgttatttctcatctctttgtgattcattcattcagtaaaagtttattgaacagcaatatattgtaaacgccttgttctagaaataaaacaggaccccgctggttacaatccagtggatgaggcataaacacacagatggttatgtaaggtgatgtgtaatacagtggagatatggggggaagtgtaggagctcaaggtccggggaatctaacccaagtttgggcttcacagaagcccatctacagggtgagtctcaaagcagaagtaagctaggtgaagggctcctggagtagggaagagggaaatacacctacacacatgccctatttgctttatatataacaaatatcccttcaaaggtattaactttggtgcctgtgtactcattaatgttaccgttgttcaaaaacaattttttaactgattatggttaatgcagaagattctcagtaatgatattattatacagttgattctcattatttgtcagttctgtatttatgaatttgcctactcaccgaaatgtatttgtaaccccaaaagcaatacttgaaatgctttcaaggtcatttttagacatacgcatgttcagagtggcaaaatatttaagaactagctgagctttgcacagaggctcacatctgtaatcccaccaccttgggaggctgaggcagaaggattgcttgaggccaggagttcaagaccagcctgggcaacatagtgcaacccctcccaccatctctacacacacaaaaaatgaactagctgaggttgaacaagtcagtggtctgccctcatgtttcagctctcatacttttaaacaagtctccttttcatggtccat

SEQ ID NO: 54689 - DNA, 1130 bp, Homo sapiens
ttaacatagggtgtttaatgactgtgatgattttcacctagtatggagtacataaatatatagttgtgacattctgtgttgaaatattggcatgttaacccatttgtcctgtttaattaggaaataaagacggtagagctagtcggaaaatgaatagttaatcgtggaggaggagaaaacatagctcagtactttgactagaggcagctgggaaagtgacgtcctgtagcatttgctgttctagaaagtacagagacacgtagtgaaaatgggaggatctagaaggaggctgtctcctgtgtagtgtatatttatctgtaagtgagccgttggggaaggattgaatacagagacgctgtctgcttgctgccttaagacagctagctgaattgctgattaacttttaaaatacccagcttggtttatttttcttagaatctgttgctaagactggggacgctgttttcttttacaaagggaaatctaagttaatttcaaggcattcgaaatggggaaagactattattgcattttgggaattgagaaaggagcttcagatgaagatattaaaaaggcttaccgaaaacaagccctcaaatttcatccggacaagaacaaatctcctcaggcagaggaaaaatttaaagaggtcgcagaagcttatgaagtattgagtgatcctaaaaagagagaaatatatgatcagtttggggaggaaggtaagtattctctgtatatctttctgtctcttcagctctgtctcttttttttttttctctctctctgccagcctttttcccctctctctcagcttgttaaggttatccttaaattggattctcagtcatatcaaaagtagaaggacaaatgtataataacaaggtttcatctctgatcatatgaatgagtattgcagagccatgaatgaaatgtccttgtttgccttttttattttagcattttgtattatacatattttatcattagacttacaatgttaacaatgtatattttaaaataaaccttgaattcccatacctattagtaaattgtgtcaaaagtcttatgaaacctgtttcgttttctaatgaattttctgccagaaccaataaagagtctttagtcattta

SEQ ID NO: 54690 - DNA, 1066 bp, Homo sapiens
tgttgggattacaggcatgagcctctgcgcccggccttattttatttttcttacttacccgtggaacaaagaatcaggaataaatattagagatgctgatttggccggaagcagtggctcacacttgtaatttcagcactttgggaggccaaggcaggcagatcacctgaggttgggagttcgagaccagcctgaccaacatgaagaaacctcgtctctactaaaaatacaaaattagccgggcgtggtggcacatgcctgtaatcccagctactcgggaggctgaggcaggagaattgtttgaacctgggaggcggaggttgcggtgagccaagattgcgccattgcactccagcctgggcaaacaagagcgaaactctgtctcaaaaacacaaacaaacaaaaatgctgatttggaggaagaatttgaaaacttaacaatttaacttaggatgtaatcatcaagagttttatagctgttctgtatttagtaaagtggcatttctggccaatattaatacattttaatgtaagttagccaaaatttattagcaatacagtttttgaaagtttaacttttaagagttgcaagcttttttctaatcatgcttatctcttcaattagggttgaaaggaggagcaggaggtactgatggacaaggaggtaccttccggtacacctttcatggcgatcctcatgctacatttgctgcatttttcggagggtccaacccctttgaaattttctttggaagacgaatgggtggtggtagagattctgaagaaatggaaatagatggtgatccttttagtgcctttggtttcagcatgaatggatatccaagagacaggaattctgtggggccatcccgcctcaaacaagatcctccagttattcatgaacttagagtatcacttgaagagatatatagtggttgtaccaaacggatgaagatttctcgaaaaaggctaaacgctgatggaaggagttacagatctgaggacaaaattcttaccattgagattaaaaaagggtggaaagaaggcaccaaaattacttttccaa

SEQ ID NO: 54691 - DNA, 1025 bp, Homo sapiens
aaggccagagggaatggagtctctgctgatatggcccaggctgcagatgcctccaggagagaggagagggttggaggttggatctagagatgtaaatagaaacggtggcatatcagcccacctagtctctcatttttctgagttcctaatacacatctattgtaaaaaactttatttacaacaaagttttgtttgtatatatactgacttttttcatatacggtaaattatgaaatccagcaagataagtccttgatgatagaaaccatgttccatattcctctttggtatcctgtccagattctcccatagtattatatatataatagatatcagtaaatataattggataacattgattaacctttgttactacttaagataaattaaaaacaattaattaaaagtattaggtcttcaatttatatctaggcttagagttcaacccacattatcaatctacaatatttccactcagcatttggtattcccaacaaccttaaagtatcaactataaagtcaagtatgagtcattaaaaattctatgattgtctgccaaaagcaatattatttataagacattgtcttgtttataagaaattgtcttgtttataagaagctataaatgaatcataagataaatttactaacttgtttttcccagcaaatatagcctctaattacaacatgtaacattaggagttctgaagaaacacacactgatcacctccctctatgccccactctccattatgtatgtatccagtaagcaaatacttgggagaaaataaacacaggatttgttaaaccatatgcagttttcccagggactaaagatagcatgttttatagttgcatggcaacaatgaacaactgaaggtggcaaatgggggaggaaataactcttagctgaaattcaaataaattttattatgagtaattggaaatacagaaatggaaaatggaaagaggaaaaggaggtggggtgatagagggggaagaataaatttaataataagaatatg

SEQ ID NO: 54692 - DNA, 1040 bp, Homo sapiens
gggctctgttacctcttcagaatcgttgttccttctgctccagccagactggtctccttgaatgctggagccttaagacttttgcattggtttttgcctccgccagaacctcttcctacagaatgcccttccttaagtctgttcaaatgtcatcttcttggtgaggctagcactgatcatctctaggtgcaacactccctgttcccttctctgcttaatttttctccgtagcatactatcctatgtatatttaacttattttgtttatggtctgcccccttgccccaatagaagctccacaaaggcaaggatttttgtctttgtttactgatgtggccctcaagggcctagactttgcctgaaacatattatagttggagtttaaaaaatagttgttgaataaaaggatcctcaccaattcagtagttaaaacctagtgtctttagcataaagctttagtattgattacaatactaatatcttatgtaggtgttaattttttttatgttctgctatgaggaaagagactagcctttaggtgggggtagtgaggaacatcactcatatctttaaaattttttgaaaataaatgtatatatttaaggtatacaacacgatgttttgatataaatagtgaaataattattacagtcaagctaattaatatatccatcttagaaactatgaaatttgaggctctgtttgcaagcatagtcacttcctaaatgagttacagcatatgaggagctgcttcctgaggcttcccagaagctgcttccttttctcaacttgctgacactagcactgagctcttttgaaagtcaatattctgtatttatgtggtacttctagaagacatgaaatgttctgcagactttatcatttcccagcagtgcaaataactggcaagtggaactgttatctttctggttcacaaatgggaaactaggacgaatagagaaaatagggttttactgatttgcatatagcaccccctgccctggaaaaacaagttacaaaaatctacaaaaaatgaaaga

SEQ ID NO: 54693 - DNA, 1051 bp, Homo sapiens
cactgagagtgataaaaggaccaaaaacagagcagtgaggggaacatcagcatttaaggggcagaaagagaaggaggagccagcactgaggaatggccagacatggaggacctggccttctgggtagcctttatccaagtactcaagatcaagtcacttgtcccacgagcagatgttccattgcactttcccaagttggctgtggggctctgagggaggaataaaggccattagaaaatgtaccctcagaatcttctgtgctggtcagaatttaaattactgtttttcaaccagtaggtttcaaccagtgtgtttagaacacaaagtagaatagagttgaaaatattgtgctttgtacattgcaaatattgtttcagttacaaataaatatgtgtatttcagttttattatctttgtgtatatttatgggtcatgatataacgtatgtattttttactgtgggtcacagaaaaaaacatttgaaagccactggcttaaatgactcccttgttgaaagtttgtagttgaatgggaaatctttcccatacttaacatggttccccctggtcagctggttactgattcaaattttccttgttctagccatgagctgatggcagcattcccagtccttatcaagtatcggctggaatgtctgtagtggtattttttagggcatggctcacttcctttctccttttgccaatgaaaaggagcatggctttacaatgagctcaaccttgcagagtttgccctgtaaacctagattttcccaaggccatgaaaatccctcttccatttaaatgactctaagaccagacaagaccaactcatttgttttcctataaggtcttttaaatgcagaaaaagaacaaatccataaagctttgatttggttttacttaaatgagtctcgacttcatttatcctgcaaatttccaatttgtgattcttgcgtgccctttatggaaagaggtttgaggaaggaggcctgaaatatttctgtaagagttttcaaaagcaggaagaaaattggaagaagaaacttacc

SEQ ID NO: 54694 - DNA, 1067 bp, Homo sapiens
aagttatctgttattattactattattataaaggtgtatccttttctttaaggaataattttagaaacaagataaacccactgaaacaggaaaagcaatgtggatgaattggtgatcaacaagtatttgttgagaactctggcactgtttggattctggaaagacagatggcaatatcacatctcatatcaactaaggaaatatgtcagtacatcataatagtagctgccattcgcttttcctaggactttctaagtaggaaatcatttagtccttacaaccaacctaaaaggtgaagcagtttgcccaaggttacagctagtgagcgagggaggcacacttctaaaccaagcagtcagcctccagagccagctctctaacagctgttacagtgagtcaacatgcttgctgtcctcagggaacttacagtttacataaagaggcagatacattaagaatcaagtaattctactaacaataatagctaccatttgttgaatgaaatatagtatagcagtgaagagcatagactgtgagctcagttacttaggtttgattcctatctttgctgcttttaaactgtgtgatttggggtgttatttaacccctctataagcctgtttacttacccataaagtattttgaggatgaaatgagttaatgtatgtatgtgcttagaacagtgttatgtaattgcaacccattgtgactaggactactgctattatggcctgacttaataatcctcatgccattcctatgagggtttttcagctaggtaaactgaggcttgggcagttaattcattaagactgcccagtggcaggcgtaagtgtgggcatagcactccagtcctgtttgctctcgaggcttgtgctctgaacattatgtgttactgcttcttcagaacataatgcagaccatgatgcatgctatagtgcagatttaaagagtgaagtttatctgagcgctgacttgtccatgattgggaggggttctaaggcttagagagtgatagggattgagaggtagtaagattggaaagaaactccctcaacaaagaaagc

SEQ ID NO: 54695 - DNA, 1047 bp, Homo sapiens
gataaaaaaggaattattagactacaaaggagttggcattagtgttcttgaaatgagtcacaggccatcagattttgccaagattattaacgatacagagaatcttgtgcgggaattgctagccgttccagacagctgtaaggtgatttttgtgcaaggaagtgggtctggccagttcggtgctgtccccttaaacctgattggcttgaaagcaggaagatgtgcggactatgtggtgacagggacttggtcagctaaggccgcagaagaagccaagaagtttgggactataaatatcattcaccctaaacttgggagttatacaaaaattccagatccaagcacctggaacctcaacccggatgcctcctatgtgtattattgcgcaaatgaggtggtgcatggtgtggagtttgactttataccctatgtcaagggagcagtactggtttgtgacatgtcctcaaacttcctgtccaagccagtggatgtccaagtttggtgtgatttttgctggtgcccagacgaatgttggctttgctggggtcactgtggtgattgtctgtgatgacctgctggggtttgccctctgagagtgccccttggtcctagaatacgaggtacaggctggaaacagctccttgtacaacacgcctccatgtttcagcatctatgtcatgggcttggtcctggagtggattaaaaacaatggaggtgccgcggccatggagaagcttagctccatcaaatctcaaatgatttatgagattattgataattctcaaggattctacgtatgtccggtggagccccaaaatagaagcaagatgaatattccattctgcatttgcaatgccaaaggagatgatgctttagaaaaaagactttttgataaagctcttgaacttaatatgttgcccttgaaagggtataggtctgtgggaggcatccgggcctctctgtataatgctgtcactattgaagatgttcagaagctggccgccttcatgaaaaattttttggagatgcatcagctatgaacacatc

SEQ ID NO: 54696 - DNA, 1035 bp, Homo sapiens
ccaataaagttttatacagaatcataaaagttacaacagataacactggagccactctgctccaagtgggtgtggtaagagatagaggaaatcctctctcctcatggacttcttttcattttgtatcctggcatggctctttagaaaactccagggttttgaaagagtgtgaaaatcactaaattagaacattctgtaggtattttaagattttatttagattattatgtggatcataaattaaggtgatcacagcagcattgttttaagaatggaaacttaaaggtgtatgcaagagaaatctgtttctacagattttccttatgtatgtgtatacagatgtaacacataaggttgatagcagaagtagggtattaacagtttttatgaaatttagacattaccccttttagaccaatttattttacatttaaaattgtactgaattgtgcatgaaatattctatgtatttccatgtctttattttatttgataaatatgaatgccattagctccaatctcagaaacaaatcactgctcttttaagcctccgtcttttttgtcttctatgtaacactttacaataataggctaatcattctcaactcctttggtatttattgcaaagacattaattctgatgtgctcatttagtattaatgtgaatgtcataagtacttcagtaggaataggatctctactggaattcagcattaattagccaggtcattacttcaaagtgttactctttccttttaaaacagctccacttcagcatactccttcctgcaaagtacatccaggctctttctattagaaggggtacttacaagtatttgaatctattgagataaagttgtgaaagtgaacaggatacaatagacaaggtgtggtaattactagacaactgattaatagaaagctgatgttttaattgagcttctgtggttcctacaataacttgaattgaataagggacttgattgtattttaaatctctctggagcataaagaagcaatagcattaaataaaag

SEQ ID NO: 54697 - DNA, 1035 bp, Homo sapiens
cgtgagtcccaaattcttgaatgattaaggatttgagtcagtggacattctgcacttggagtgagcaagataaactccaggctgatgatgtcaactaatttgggaatgagtgagtgacatttcaaaaaacagaaggttgagaaggtgttcaagaatttccaggtcttgaaggctagaaaaagccaacagatttctgccttgcagtccaaagctcattacaaggttgtatgttggagtgctttgctttaggcaactttcaagtaaatcaagaaatgagccctctcccatgtttgctgcactttctagttctcactaaattttacttttgacctctgagacatttgcaacggcaccaggatgtggttacaaattggattagtattaccaagcagatccttttgacatgctggaagacctaatccatcagttacctactgaagccaaatggatgacgtttgtaactccttggggtaggttttgagatacacaacaggaggacaaaacagaaacttttgaaaatatggaaaagaaactattcaaaacaaaggaaaggaagaatgctcgaataaatgctgggagacctagattctggctctgcaaccacaaaatagttttggaagccttacaaagttacttgacctttttcagtttcagatttctcacctgcagatgtcttctgtagcttatcacctgcaaatggtctcctagtaactactgacatgccaaatagttgggatcaattctctccctcaaattgcacacaagattgaagtcaccatattcttcaatactctcattagataaatacatttcagagaatactataaataagcaatcctcctggaatctggcaccattgagaagaacctagccaccagtggttttaggagagagctaagggagaaagcataacatgtaaacaagatcacgggatgagaaattcacacaacctgtagagggcactaaggtactttttagagaaagaatcagactaatgggcatgagaggtacctgttaccccaagtgagaagcaaa

SEQ ID NO: 54698 - DNA, 1072 bp, Homo sapiens
gcctctatttttaaaatagagactaaacacacaattttgcacatatgtgttgggaattcaacacatctttttctgttgaatagaactgatgagaataagaaaattgtggaaatacactcttaaaactttagaatcttattattgttcaaatcaagatgtgttagataagtgcctcatcagtgaggatgatcgtggtgaagaaggaagagaaagaaatggaggaggagggggagcgggccgcagaagaggcaaagacaaaacactggtcattcgggaatcagtaaaagttaatcctcacaatggtctgcaagtccctaaatggtctatctgcaccacggcccggtcctccagacacattcttctctgacctgtcccccttcactccccttttgcttcctccattccagtcatttttgccttcttgctgttccttgaatgcaccagacacaatcccgccttagagatttcagtgaagctattctttctgcctcaaatatttttcctccagatgtttattgggatgatttcctcacctcttttgagtttttgctcaaaggtcatgttctcagcttaagacctaccattacctcctctctaacaccattacccttcctccacagcacacactctcaacatccttacgctgctctactctttcttttctacttggctcatttcaccttctaacacatatattcattatgcttattatttattgtctctctccgtttatctgagctgccctcccccactagaatttaagctcaagatagtgggattttagtgattttgttcaccgatataactcccagacctggaacagtgcatgacctataataggtgctaaatacatattactgtaagatttctcttttttatatattattttctctcgctataatttttttctttcaattttttgttttgttttgttttgttctgtttttttttgttgttgttgtttttgttttttttttttcagagggagtcttgctcagccacccaggctggagtgcagtggtgcgatcttgtctcactgcaaccacaatctcccgggttcaagcgattctcc

SEQ ID NO: 54699 - DNA, 1258 bp, Homo sapiens
aaaaagaacccaagagttacttgtatcaagtgggcttaggtttaatttacaagaattagtagataaaacacacttgtatatgagccaggtgtggtggatcacatctgtaatcctgacactttgagaggccaagatgggtggatcacttgaagccaggagttcgagaccagcctgggcaacatggtgaaacccagtctctacttaaaatacaaaaattagccaggtgtggtggcacgcagctgtaactctagctacttgggtggctaaggcacgagaatcacttgaacccaggaggcagaggttgtagtgagccatgattgcaccactgcactctaacctgggtgacagagcgagaactctgcctcaaaaaaaaaaaaaaatcacttgtacatgtatttgcttacttatttagttctcctctccatcccgcctcctctttctcaatgtaaacctctcaagagagcagagggctttggtgatctcttctcagagtcttgaccagagcctgagatctcgaagccacctttccaggtgctcaatagtaattttaaatttccaaaaagagaataaaaggaggaagagaaggaagggtgaaggaatagaacagagaaatgggcaagtaatattggggagaagaatgaggaatgggtgcatagaaggaaagtcagctaatgaaagaattcttagtctcaaacaggcaatggagaagagtagcagagttgggcttttccaagtatgttttttggaacactggccctgagagatgctatgaagaaaaacataggggctaaatgagatgagtaagggatacttaaacctctttctcttaaatatccacaatcagcatgagcatattaaagactctgagaggcatttctaaagaacacacacacaagcctagttaattttgtttcatccaatatttcccaaacttatttgagtatagtgctctttttccctgtgatgtttattaatgagatctaaagactttagcaaagtataacagatatggacatgaaactagcaaagaaaatacctgtgctttcattatgctgtgaagctggttctggagcgagagtctcaccttcccttcccggatgcctcatgcatggagagcatctgcagctgggttctgaggcagtcagggcaacagctctcaggctgattctaccctctgacccacccttcacccagagaaaggaagatggactgaacagtgaaccttcctgaagcagaaacactgagagataactaggag

SEQ ID NO: 54700 - DNA, 1052 bp, Homo sapiens
ccaattcaaattcaacaaagagtttacctagtcaatgtgtacttgttagttagacaaaaaaaaaaaagcataccttttaaagtatgctttcttaggcccacaaactggacattcactaggtgtatggtacgctgaattttaagttaatatgttcataattacttcagaaatgtgtatgattaatctcttaaatcttgccacagaaaaaattttcagttttccatgtattgaaacatgtgtggactgattatatacagtgcattcaaacagaaatgtctgtttcttcaaaattccacgcaattgtctaaaaataattatttctaagaatataaaacaatattttacaaacaataagttcaaaagatcagttgaaatgagcaatcatttaaaatattaaatatttattccccaccccctttgatacattcgttatttttgagaagaacatctagaaatctagaaatccttttctttagtagcttcagcagaagctccttctgaacatttcagttgtttttcagctgtgctaagtggaagaaagggcccttggaaccaggtcaacatggtttcgaatcctctttctactacctactagccgtggaagctgggtcaaattatttcacttctcaatattctcttcagaaattgaagattataattcctacctggaaggcttttgtgaagattaaaggaataactattcctttacctcacaggtatacaagctcctatgaaaagcactttgcaggatatctgacctggaaatgtgcttagggttggaataccatcctattccttttgggtcagtgcagtgcttcccaacttgaaaaacaacaagcccggtgcagtggttcatgcctgtaatcccagcactttgggaggctgaggcgggtggatcacttgaggtcaggagttcgagaccaaccaatcaaactggccaacatggtgaaaccccaaatctactaaaaattcaaaaattagccagatgtggtggcatgtgcctataatcccagctactcgggaggttgaggcaggagaattgcttgaaccag

SEQ ID NO: 54701 - DNA, 1039 bp, Homo sapiens
gaagcagagacactatttagggacccatggctctgactttgtctgctcttccccatcctgcctgcaggaggttttcttctttgtgccaatttggttctacaagtgggagagcctatatgtgcaaacatttccttgcatggaagtgcctaggccgtgaaatataaatgcttccagagtaacaagtttgagtttttaaaattgtgtctttcaatgctggcagtagtgtccctggcaattgtgtgacccagaggaaccagaggaaaagaaaaatcaagccaagatatgctttatctgcatgcacctgcttctgatacccatggtcacctggatccaagttctatatccttggctaaatacactgggaaatcgcaggtgtgtatgtgatatcttcctcccatctgtaaccaacctgaaatgctatcagtcctgtgataacaaggaaattctgatgtagagatgttggttggcttaaggtgcgtaacagtaaaagaagtatttaaagctgcatttttgaaactccttttaaagcctagattctgtttagctacagatctcatttcaacctttttttttagctgaaaaaccttttcctctaaaaacagttctacatattaatgaggaacaagtatatctgcactgattaaagcaagatagggggcagaattaaacttcagctacacccttgtcactacggcaggtcctgcagcacctccacaaagctcaatgttgtagtcttaagagtagagatgggaaaacattgacctacaaaatgctgccaccctcagacccactccatgttattcaccttggtaaataattccttcaacaaacatactgtgtagctattgagtgccagactctaggaatacaaagataaataaatataaatagtgtctggcatcaagcagctcatagacagagggaggaggaaaagagaaaataaataaataagtaaaacaaaaacagccactgatatttagcttttctgtatcaatgctcacaactgtaagagatagaaatatttaaccctttaacaaat

SEQ ID NO: 54702 - DNA, 1918 bp, Homo sapiens
aaagcgcagccagatgtggtcgggccgccgccgggactggctacgattgggagcggcggggctgctgctgccagggcggcctcgtgggtcgggagggtgcaggggccggggacccggcgggccacggggagggcagagagcctcccggagccgcagtgagagggcagcagcgggccgcgttgggcctgcgggagaagttacggagtgtatgctgctggagtggctgtggggcagggagcctcgggagcttggtttgtgggatgggggtgccactggggagtggcgacgagagaaaggcgtgggaggagcgcgagggaaggggagacccccgcgctgcccgagcgtgggctccttgattggctggggcgaccctcaggcagagggggcgagggcgagccaaaccatggaagcgccccagcagtgtggaggtgcgcctgcgagacttctgcgcttgggacccgtaaagtttgttcctttcgccagactgcggggtgggggtgaggggagaatactggaagctttacttaatgctaaagtgtcgctgagtggaggctttttttccccccctccaatcctctgttcactctgtgctctcaaagaatagttgggagggacaagtcctgcggtatctatcatagcctttctctttttagggactcctcctcctcatcttttctccctctccccgccctccattccgttcttcccgatacaaactgttgtctcagattccgaccgagggaatgttttcctcctgtttcttgaaaggtgtcaggctgcttagcagcttctcccaagcagcctgggagcgtctgagctgcagctaccaaccatatggttcccgttacaaaggccaggttctaaggcactctcttccccaccccgccctcaattctttgattttattctgcattctttcagtacgtgcacttctcttcccctttccagaggcatagatttaacggacgtagttgattcattcatttctctgtcactatttatgtgtggaacgggtcccaccgagtttgctctttgctcaacgaagttgcacaatgaagaaagtcacatcctttggtaaataattacctgttaggttgtctcttgctaagtcaggtttgatcttgggcaaaccttagaaaataggcactaaagaggcaatatgcatccagagcagaaaaatagaatagttttggtactcatctgtggcaacattccaacttgtgatgggactgttttgacctaactaagggtactttgtaactttaaattttgtatcttcgtaatacttgagaaaccctttaaaagaaaatttacttctgtccaggtgtgttatggaacgttttgttgtctctccctccacccttccataaatttatgcataatagaaagaatactacagaacaaatgttctgttgtttagtttcttcagacattccgattctctccttttgttgtttgcctctaaaagaggtgccatttcacatcattctgcacaaattgtttgaattaatgcaagtgtgaattcttaccgtttgaaggggactattagcatatcaaaggtttcttagctttagctcaattgagaaaacttcagcctgtcttccttttgcttccaagcggaggcccaaagggcaatgagaattgtaaagggtaaaaatagggaggtggattcaggctgtgtttctgaacttttactgttttgtagttatgtgggccaaaaacattgtctattgctgtggagcccttgcaaatggcaagacaattattttctattgataaatggtttgttcctagaaaaagagtgaccttttgttttatgatagtcactgttgcctgtcttttggggtcccttcagtgtaagagagagtgagaaagcctttccttctaacttaatgcttttttaggaactacactttgt

SEQ ID NO: 54703 - DNA, 2615 bp, Homo sapiens
atgtcatgaaggtcaagaggtaactagaaatctacaaaccatagtaataaaatgttattgctttattttctatcaaaatatttatttgacctcacttttgtgaatattcaaataacactcagtttattgacagttgtaggtggaattctaagatgtaggttaaacatacttgtacctacctaaaagaaatctgttttcattttaacaatccataccgcttgcccaatgctgatatttaagaacatagattaagggttacttagattaagaatgaaagatagctttggaaatggaggaatttagtttcacataaggtgctatttttacaaaagtttcttcaaagactgtagcacttttgcctcttactgtttcaccatatctgattttgagtcttgaagggagagatgcgcatttgatgtctgtctgcttttctgcagaaaagatttatgtaaaaaataagtgcaattatttttaaggtaatatattttgcaaataaaatgcatcgttacaaaaaaatggttcttcaagattatttgcaaaaatgcctagctaaaaacttttcaaattgatagatttcgataaagcattaaaaatagcaagtttagctactaagagctgaaaaggagttgaagttctgtgaatgttttggtcatatcagttcctatggattaaatatgagttaatgtaacctaaatggataacttttgttgctatttttaacaaagattagaatatttatatttccaagatagattaaaatcataggctagtttacttctgtcttacataagactaattattctatagccccacccaaatattcatctcttcaaataattcttgattgaaggttgaaaggttgaaaagtatttaatcactcagattattgtaattaggcttgatgctgtcacaaaaataaattgagactattctctaaaatctttttgctgcctaagatgctctcaaagattggccaggtagtgattatattttttaatgctttaagaaaaagcttaaggaaatagtttctttaacacagagatgaacagttaattattggaattagggaattataatccttgacttagtgtggtaatttctaaaggagtaacaagggtctgtcaaccctaaattttactcaggactttaatttggtattttgagtgtagtatataggttttgttaagcatgttaagtatagaaattttcttaatgttttgattgttttgatgtaagtatttttgtgtgtgtgtgtgagtcacggtgtcatgagaaaagggagatcctaatcaaaaatatttaacatttttttcctgagatcatatatctgctgcactaagtaggcaataatttgtagatattttttgatatattcttatccaacagttttttaaaagcttattttattattattatttttttacaaaaaacctcctatatttgacaaataaacattatctaaaggaaaaaaaaagtagatggaataaaggaaccaagcgcttaacatctgcaagtaaagtgcagcttatagcaaaatactattgattggtttggaagtagaaagcaagtttaaatacaatttgtttaattacaacgaaaatgcagttttatgaagtaatatagtttgtcttcacagataattttatgcattgtctggtagtaagtaaaatcccatcacacttatataagtttgttcaattaccagaatgactaaaagaaaaaaaatcaatttaggttgaaaaacaacagaaattagattaccttggtttgtaggaactcgccagcagtgtctacattgcttaataatatcaaaagttaccatgttcacagtgtaaggatattggcgccagttttgatatgcatacatttgttttcttggtgacttttgttagatgcagagttttttctttctgcttttcatttttgttttgtttttatgaaagctattgcatgacatacgagaaactacttccactggcatattctcatttattttagaggtttgtttttaagtagttgcttttccatattccttggatttattatcagttgatattttagattagtgaaatatcaggtgtaatcttaagaatcaaaagaaacctactccattataagatataaataggttattatcagcgaccaaaatacattttggcaattcttactactgattctagaattacattgaattctaaatcccaaattcctgtggcaataaagtagcatgggattcatcgtagcagatagctgggcacctgttttattaccaccttgattaattctggcacccagatttacggaagtgcaggaacaagcacaaccgctactcaaagccaccggctgtttttaggtcatgaagtcaacttcctggaatttctagggaaaatagttgaaaggggaggacaaatgtcactttaaatagagatgtttaaatcagatttctgcctgagggtaaagtttaggtctgttttagcccagatgtaatgtctccctctacagagcacagcattaatcacgacctgacaagaaaacgtatgctgagcaaaacgtggcccctgttggttttgtcattgatttttccaatctgtgaggagtacattataatcattaaa

SEQ ID NO: 54704 - DNA, 1111 bp, Homo sapiens
tacttgtggaaaggaatatggcagaagagcacattgtgtaaacaaatctaaaacaaattctgaaaacatattacagaagggtaaagagcattttgcaacccagatcagtttttttttaattgaaatgaaaatagatttttcataaatactctccaggtgtaaattttagaattattcagaataagaagaaaatacagttagcactgcattcatttaaaattgatcttttatctttgattttaaattgatcctaagatgctacctttgtttactttgtgttcagaaaatgaatcagataaatgagccgggcagctttttttttttggagtggtctatcatttcaggctggtgctgtgtaagcaaggtaatgttttctttttccttgaaatacactgtctgagtatgtcttgggtgactttgtgaaaagtttgtgtatcctgtctgctcaagttgccatcttaaccaggatggagggcaagaataatcatgttgaaccacagattttcaagagcaattattttaatcaggtaattggtaaggaagagagaaaaatgctggatagtagagtagtatttctataaaatggtgacttgcatttttactaaggtaactgcccacgtttcaaatatttttgctaaaccttgttattacctgcagagggagcttttatatgcgatgaaataatcaaagcagtataaattgacatttccctttgaaagttatgttttattaaaatattttttatttttgtttgaaaaaattgttctaaagaaagtaaggcattttgagatgagccaaattatagtgcaacttaatgtactaaaggccttgtgtttatcatttcctttattcatagattacaaatgtgccttatcatttcctttattcacagattacaaatgtgccttattatatttttgattaaaaataacttaaaatataataaagataccagatccattttgagattataattttttatttatgattgtctaaagctcagggagaatgactgcagaactgtcttgtttaaatgcatagtagttgttacaagagagatcccagctttttaggtaattttccagatatgtaacatattattaaatgacca

SEQ ID NO: 54705 - DNA, 1045 bp, Homo sapiens
ttgtactgaaaagttaatcaaattaattgttctcataaaagtattattggtattttattagggatgtttatgacaaggaaatagattggtaactggttttcggtttaaagtaaccatgatcttggtaaattatcaaagaaaattttatcacatattcttgaattaataataaaaaaatacgaatttatgataaaacattctctgctcctttgtatatacattatttaagcatagatgtgtatatattaattgttcttgcatctgtgtgagcagactggtttttaaaataataagctattatgaatagtatatattatgaagaatagtccttcaagtgagagtattatgtattaagagggtagatttgaaataatattttaaatataaattttataagaatgggagtcaaatatttgaacatgttaaacattttaagtggaagttaccaaagaatatgataaaccctaaataagattagaaaatttatatatgtgtatgaagagtctagaatgcaaaattataaacctgcatgttttaataactgtattggaaaaaaatattttaaattgctcttgttattcccaggatttagaaattaatatttttattttaggaacaaaaataaacaatattagtgtcattttgcctgttgtatgtttcaaagccatttcttttgcctatttaataaagattttctcaaattgaaatcttaacaaaggtataaaaaatactttttattatctacactgaatgtagtagattttgtggtgttcaggtaatgttgttaattcaaagctgtgctaaagagaaatgttaaaatcttagaatatcaagtttgttattttaaaatgagaataaatcataaaattttatacattttcttcaaaaatttaaacacagtagcattacctttatttaaaaataaacacaacatctaaggaaatccctaaaattcagaacaaaaacactcatgctttctactcatgggtaactttgtctctaatatttgtgtgttatacattttaataggaatatgattgctaaa

SEQ ID NO: 54706 - DNA, 1073 bp, Homo sapiens
acagaaaagcggctcttgttagtaaattctgtctcataatgattataattttatgatgcaaataagatctgagactgattttgtaaagctaacttcagttttcatttagagttgacatgtatttagtacatagaatttaggcttacctaaaacattaatgtttcattttacacagcattagtgcataataacaaggatgggtgactttggtagttctcatgcttagctggctcttttcttttcctgttctcttcatgttataactgttttgggcttaatagccagtgtttgcagtagttcactgtccatgagtagaaaccaaaaataaagctttagatagaactccttatggtggctttgctcctggtggaatatcaacattagttaaccagttttagaaaattgtagtttaattttcttttgcccttattaatttgaaatgtgttatactctctttcagtgatgcttattaataaacattttattttttctacatttgttaaataagcctcatcacataataaggctaggtgtgatttcctggtaatgtaatgtaaatatgtgacttaaaattagttagcggtgttgtccttttaagtaattttgcggacagttttaggcgcgggatatttaatgcagctaataaatggaagcaggttactgtctgaaagactgcagctgactgtacattgcacgtagtgtataaaacgttgagggctgttgggatatacacagctgaagcatattcctggaagttactgctcagctttggaaggtttgatagtaatgatgcattaacggactttttacatgacagggtaataggatacttagatcaaaaaaaatgacagaggtttggtagacaatggtttgtggtttataggaacaagattaggatgaaattgtttgaatcttatttgaaggataaggaaaaagcagaggtgggagtaggttgtacgttagaagtggtttggatttttgaaagtcatagtcatttatagtttaagtagaaatctgttgtatcttgttttactaagaaatgaactattacgtagcaagcattaccaggagct

SEQ ID NO: 54707 - DNA, 1045 bp, Homo sapiens
ggctaatgtttgctgtgattcctcacacgacctcagaaagaagtaaaacacttggacagaacccagcaaatgacctggtctcatgtgatcctagaagccgagaaatactaagtcatactcctgaagtttttgtacactctgcagtttggagaactggatccataggggctatgaatacctagcagtcagggaaataagtttgatttggtgattaggaatgtggcattttcagaatccctttgtatatggcattattttgccatgtacaaattttggcaatttgactgtcaaaaaggcagtcaacctttttgggcttttgactgttttcagaatgtaagattcagatatccagtgtataggagcagcttccatagtggacatagaatcaaaatatgttttatattcaggagagagagagaggaacggagagagagaattgttttgttatgtagaaagaccatagagtaagtgatggatttgtttgtttttcagatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtaagatccagtttacattttgttttttaaatccaggagaacttgaactatacaatcttcttaatatggaagtgcctagaatatttgtttattattttaaaaataggtgttaaaattatttcctgaatattgaattgtttattaggtggttgagttcttttgataacacagatatgatatagaaagtgctagatatgtgaatttatattttacgtgcatttatgaaatataaccattctaaataatcccgagggaactaaatgaaagctctgttttggtatacattttacatttattcactacatttattttagtaaagtggaaagtattttgtggaaattttcatctttagttacatttgcttaagtgtgtgcataatt

SEQ ID NO: 54708 - DNA, 1073 bp, Homo sapiens
tgttaggtttgaatgtttttatacatttaaaaaagattccaggtgtggaccaatggctcattagtccacataatgaaaaaatttctaatcaagttagagatcactttgcttgcacagtagcttaactcagtggggggctagcaaacagagagttttttcatgagatactgcagctttattttcagtgtcatctatcaggtcaggattcatatctgctgttaggagaaatttcatttttggctcatcaggccagggggtattgcttctgaagcacttccctcctacgggtaaaaagaacctgggacgaacccatactgctaactgctaattgtaagagtatacatagttaatacacactgttagaacattgatctagtattgcatgggtttgtcttagaaagtcttacatgacatcatagtcctttattgccagaaagcagataatgctctgtgaacatctatagagaaagccaatcaacattaggtaagaaggcataggaaggcagatatgaatttaaccttcagctattgagtttcttttgggcccttacatgattgtaaccttttaacatcttacacagtttagttctttttatacttctttttataccagtttctaggttcttgcaggtaaactcagataagttttcctgagtgatttcttccctttttcctcatttattgagtgattaaattgagctgcatgcttagggttcaaaaatacacaaggaaaaataatgcataaggcacggttctttttttgtttattttattttttattttcccgtaagttatttgggcacaggtggtatttgattacataagttctttagtggtgatttttgagattctggtgcacccatcacccgagcagtatacactgcaccatatatgttgtcttttatcccttgtcccactcctactgttccccccaagtccccagaatccattgtgttattcttatgcctttgtgtcctcatagcttagctcctacatatcagtgagaacatgggatgtttggttttctcttcctgagttacttcacttagaataatagtctccagtctcatcca

SEQ ID NO: 54709 - DNA, 1029 bp, Homo sapiens
gcaaaagctaattatacaaaggtttaattgttatatctatctatctctattttgaatcaagtcttacccattaaaatttacctgtttgtgtaagaatcaagtcttacccattaaagtttacctgtttctgtaaaataggattaatattttacatattctctaagcctttcctacaacgtattttggggaaaattatatttagaatttccaaataaaaatgattttatacagaccaaacttgcaaaatattttgtaaatatttcttataattgattttatttctagagaactaatctcagattcttgaaaagtcagttttatcgagagactggtatgctttgattcttttggccagtttttataagcatagtacccactgtggaatcatgtatcagtaagtagaaagtaaattgaatttttgtgtcctagagaattaaattatgctgtataatggagccttggcaagcataagttagacacatgaaggcttgctcaagtgacaagttacaaataatagtacttcttcagcaaattcagtaatgcagatttcaggttgaatcctttatgcagtgaatatgtaattagattttattagtcaaaattttacttaattacctcaaattatattgttgcttatccttatttcaaagaaaaatgttctgccaggtataaatatgagacatgccagaaacagctttatgtatttattttatataaatcaagaaaatataacagttgtagaaatagtttcttgccagtttttactgtacttttaagttccctaagtacattttataatgacttgagttaatgttctctctctaaaaagtgtgtgtctgtagggtcttttcagtatttgggtagaagaaaaaaaggcagatttaggggttaaatatgaaatagtgaaaactgtttctggcatatagatatttccttcagaatggtctgaatttggtggaatgattagtaactttattctccaaggttaaatttaagaaagattaatgtaattcagactactgtgttcat

SEQ ID NO: 54710 - DNA, 1017 bp, Homo sapiens
gccataattcttgctttgagggcttatttttcttaaaagtgttttttttcttctgattttgaatgtatatatcttcatgagaaaagagaaaattaaaaaaattaagataaaacttttagaaggttcataattctgtgactttcttatgcggcagcacatttcttttctgtttttccacctatacacatacttcatatggataaagccaaattatgtataaatacaaaattaggttattcatctacatatactcttatattcatattttcacttttaattatcagaaacagtattactatgccattacatatttagataatgaatgctaacagatgcatagtaatttatttaattatacaaatttaatacaaattatttaatcctccttttctacttgccagccatttgtacttaatttctttcaagtataagtaaaatacatatctatataattatttttccttcacaactggttatttcccgaggatagaattctataattctgataattgtactggagatatagacatctttcaaattggcttttttgaagagttaaacctatgtgcacacattgatgaccagtatataaatccatgcactttaccagcaatgatctgaaattttaaaaagatttaacactttgatttgtaaaaaagggtatctgattataaattaaatttgtaatttgggggatacttctggggacaaaaacattttttgtagatttatttattggttagttgtcattttgatatgaactttttgtacactgcttttgccagcttttctgtttgtattgctaatacttttcttatttttttttttacaatttattgataatccccttttttcatttttattataaaaacctatttttgccttttagtttaatttacactgtttaaaatttttaatgaaaacttcaaatagaagagagaaattcgtagtataacactaatcgcaggtttaacaattgtcaagatattgttacatttgcattattgcactctttct

SEQ ID NO: 54711 - DNA, 1030 bp, Homo sapiens
tgaatccgtcaggaattaacgtttttataaggggaaatctaaggtctttgatcacttaatttaaaatcaagtgaactaacattaaaccaaccagtaagaattaaattttaaccaacacagtagttgaagtttggaacatagccaaattaaaaatggatgatggatgatagttgaaaaaacaaaaaagaaaaagaatagaagtaaacactgtttatatctacatagattgaattgtgaatgaaagtgtgactgttctgaatccagtaatatatcagtgttcttctctccttaaatgatttttgtatcccatgtatttaataaagtttatttttaagagtttttatgttgttaaacagccgagagaagcaaaagcatgactgtagagatagattaaaatgtcccaccatgaagatgaagttctacattttaggaattttggagtttcaagaaacataaagaatttcctggaaaaaaaagaagggattcgtatgaagcctggttaagttttgcacagggatttaatctaaaaaaaggatccaagtaaaattcttattttgttgcatatttacagggtgcgtcttactattcctgtacccatctctttgtatctaattgttgtgtgtttgtgtgtatgtattaatcattaattagttctcttttcccttactgattcttctttttctctttgtagtactaaaatctaagccaggtgttagatatgcctatatgaagttcaagctttggttagagacaatatagtaggttaatacaagtcagagacttccttattttagttacacattacaatagaaagcctgttggattttaagaggctacttttatatggtagaatgctgtgatgaggcgatgttgacaggctttttaaaaagttggtaagtaaagtgaaggagacaggtgctgtaggttgagtttatttccttgtttaaggaaagtgttttgttgtttttttttttttacagttttcttgtttggttgcttttggtagatatgttgaatacctgaacatttc

SEQ ID NO: 54712 - DNA, 1032 bp, Homo sapiens
gtgagtgatgaatgtcaggagtcaaggtggatcaagaattcaccaagataagaaatacaagataaatggatttgatggctaatttgtgagcttagtttaatgaagttactgccattaacaatataattaatactagtaatatgccaaaacttagccatgcttatttgtagggcatacttaattacagaattaaaaaaaaaattagggccttaatattccatgatttataacaagcatttaatgtgaggcttgctttgatcattaaataataaacatgtttaatcattaaataataaacatgagtaaagtttgggaaacttttgttatagatacatagaaataactagattttaatgtctctctcattttgtacttttaatttaaatctaaaaacaatgactgcacttgtcagtcctttactggatattaatcactgtagtaggtgctttttattcattgtcctggataatgtttccaacagctctgtgaggtttatgttgttttgttacattttagccaaggaaacttatgcacagttaggtgacttaggcagggttaaatgaataatgaagtgatgagattgattcattcccaggtatgcctgacacagaattcatgatgctttcaatttgcataataatggaaatccatttttatttttagatttgggatatttctagatgtatatactgtggtatttgtggtttaatcatgcataattttagcaacgcatatatatgtaaaaaggaaatgactttaaaggtttataaatgtataagcactgttcacacttgagctaggtctactgcagacagccaattgagaaagtggaagatgttccattcaacatatgcttttgtctttgatgccggacatcttacttaactctctattataattgcgttgactagatattttggcattgcgtagtcacctcagtagaaaagcctttatcagcccacagacggttctttttggtggcaactttcacatatcagcttcttctctcaaatcagcatccattgacagctt

SEQ ID NO: 54713 - DNA, 1049 bp, Homo sapiens
ctgtcttgcaagcttttgaggcacccaaaccacagccattgttggaacttggttgcttggttgtggcatttctctgttgcctcctaaatactgcataatattgcccaaggaatgtcaggctttatgatggtcccagaaaggatcctttttcagaaacagaaaaaaactctctaaaattatagttggcaatctctttgctccattatcctacacccctaacttgaggactctttgccctaaatagcagtggctccctcctgtgattattcttaagttgctgagagtgggttgtagtgagctgatgaaaagatggcagatgatgggaaaccttaggatcttgctgctatttaaatttgatttagtataaagtgagatttaagtgttttatggctaattaaggggtgaactcaagaaaccaggtatcatatattgagtgcaagctacagaataaaagagcatgttttctcacaaagatacgtagttgatttgtacatatttagctgcagaaagagattaaagtcaatacatctgacccaaacttactgaattatgtgtcaccagttttacaacaccctagatagactcttgtaattccttagtaccaagagttgaattaatctgaagagcagtagatactttctttttcagcaattttaagtgtttattggaacaacattaaaaataattacaattttctgatattaagtggtaatctattgtggaggaagagctaaaaatcctagaatttaatttttcttcacggacactaaaattatgaaaaccacgttaaaattttagcatttcaggtattttaattttatactttattatggatatatttagcatagatatgggccaacaatcttatggcaacagtcataactgttctagtaagtttcaatatatttcatggcttaattctgtatatccatctattataagagactcagtgtgagcctcagaattgtcaagcaagaagttttttttaaatggggaattaagtgccaagtcatgtgtctgaagtcagcatatatatcagttggcaaata

SEQ ID NO: 54714 - DNA, 2033 bp, Homo sapiens
aacattgaaatcagtcagacttggagatgggagaagtgatgtcaaggattgcttactcttcggtttctggtttgtgcaacctggatgaatgttggtgttgttgactgagatagaagaggaccaaattattgttaagatatacttataaatcacttgggtccttttcgaggtcttttttttctttccttttcaccttcgaagtttctttttagttattttcaaagactgtcgagaatataaaaatttagacctattacctgatcaaagttctgattttaaaaaacacgcttaaaaaaagagactggaaggcccttgctacgttactttaaactacagtataaagatacacagatcagtttattttcttaatggaggctgtaatcttgctgttcctttcttcaggaaatccacttaatattggccacctgttagtattagatcaccatgtataatgacttccagccattgtaaacataactaagtagacacataaaaacatcatgataggaaagtactaatatatgtgtatagtttgaatactttagtctcttcacagtttataaataattacagtttctcactgttctgaaaatgaaaggtgaatgtcagtcacattgatcatcaaaactgttgattaaatgtatgtaaaaaaaaaatataatttgtgactcagaattgagtaatatacattatatgttcagatgcatactttatttaggtagacgtgttaagttttttttaattaaaattttttagatttaagttgagtcttcaatgcggccaagtgtaattttgaattcctttgtattcacttaagtattcagatctctttatgagaatttgttagctatttgatctacattgtaaaatatgtttaatggctgtgcatcttaaacagtagtgctatatatcatgtcaaaatttaaaaagtaggaaatgcacattttccttacaaaacaacaataacaaaataacacttaaagacttagcttgttactgccaattattcgggttaagtttgtacatattagcgtatgtatctgcagataaaacttacacattttcatgagagtttttacaaaaggagaataaagtgtcattattttattataattttttgataatctaacttttgttgaaatagatgatttgcaaacaaaacaccttttatttactcctaattacataaattgaaatacctgattctctaaattttatttcccacatctacagtcccgacacccagaacgaccagtgatcctcctccgttcatacatttaaatgttctaaaatcaaaactaaatattcctgtttattctttcttggagcattttgatacatgggaaaaaaatatgaaacttaataaggtcacacttgaaattgcaaggatcaattttaaaataaaaccaaggtagatatggaaacttttagtcagtttcacattaaaacttcacattttgagtaatacccatagtgataatctaattctgacatagttgaaaatgatgggcctaggaagttattttcaaaatacaggaatatacactacattctaagttgtcagagcttaaaatgaaattattttttgcagacaaaaagtattatgaaactaccaagcttttgttttttgttggcactaatagtgttgaaataaaatgaattttacctgtattttattcatttatgtgttagcatagttaaaacaaccaaaaacatatttatttttcatggttctctatttttctgttcatgaaaattttagtgtttatagtggttggtattatttgtataaaactactttttgaaaactttgtactctttacctaaagcatttgtagatgttaatctttcctttttttttttgaagattttttttttctttttttattattatactttaagttctagggtacatgtgcacaatgtgcaggtttgttacatatgtatacatgtgccatgttggtgtgctgcacccattacctcgtcatttacattaggtatgtctcctaatgctatccctcccccctcccccc

SEQ ID NO: 54715 - DNA, 1097 bp, Homo sapiens
tctttctgtctgtcttgtcttgtcttgtttgtcttgtcttgtcttgtcttgtcttgtcctgtcctgtcctgtcctgtcctgtcctgtcctgtcatgtcttgcctcttcgcttctcttctcttctctttttctttttttttctgagatggagtcttgctctgtaccccaggctagagtacagtggcaccatctcagcttactgcaacctctgcctcctgggttcaagtgattctcctgcttcagcctctctagtagctgtgattataggcacacaccactgtgcccggctaatttttgcatttttattagagattggggtctcaccacattggccaggctggtctcaaacttctggtcttaggtgatccacccacctcagcctcccaatgtgctgggattactggtatgagccatcgaacctgaccttcttttttaagttttaatttgcttgtgctgccagaggaaaaatggctggattgcctgtgttttaaactcttaacttctataggctgcacactctttctccccaaaatccctgcagcaagtgaccttgtcaaacaaaagtgtggaataatgggaggcagcccagtgatggtgggtcgtttataagtagctgtttgctactgtcagaacaaaggcaaatcagagttgcattaaagggatatgacagagtgaacaactgctggcccacttccctaataatacttgtcttctagtgttggattgaaaactgagtggctggagtagttattcgtatgggtttgggatgaaaaatatataggaaaataaagatctatttctgtcatttaacaaaatacagaatttaggaagcaaaatttgattaaagcagctttataatgcttttgagtgacagaaacattatgagtatgttatgttctattacattgttaatagcattgttcattgttatataggatttttaactgtgatatatttgaatctgtttaatattgcaccatattgtgaccagattcttgatgtacttgtgtaaatttggaacaacaattaaatcttactctttaaaatactagttaagtgtagcactcttcttacatgtccataatggaaaaacactt

SEQ ID NO: 54716 - DNA, 1020 bp, Homo sapiens
agtgaccagctctagaggaacctgatacgaatgtgaccccatactgagtttaagtaaataaaacagaaataatgaatatatagaatcatgacccttcctgctgatgaagaaaatcattttgatttttgatatagagtgatagaatgaaaactatattggtaatattgcttatattatatagtagttgaagtgagtagagataaattcataattgagtgatctgtaaaagagtgttccagaataacatatggcaaaatgaactgaaggaggacttttgaaaacaaatagaattatgttggaaaacaagtgtctttaatggattagttaaggaagtaaaaataattaatataaagcaagggaaacagtgtatggagttagagacataaaattgccaatttatttattgattttgttttataatagttattatttgaaaaacgaccaatacgaataaatagaagtaaggaggggaaagtgaaggaaaactgtttttagctggtatcatctatttggcaatgtctttactgttatgcttataatacttgatttataaatgttaactgtaacatattcatgtaaatatttgtgtttattttatatatgactcttttaacctgatgtttcatctctattttcagaggaatttaaaaaaaatgtttaactttagacattagcgattactggttcagaaacaagtcttctaatgataaattaattcattagtaaaaacttcccataaacacagctgctaaggcctgccaaattggcaccttggttccacgtcttatccagggcttgacaagaatatactactgcttacttagttaattactgctcacagatagaaaaggaaaggcctttaattcagcatttgtatcgtcgcatggccctgttcagtcaagctgagtgcatgttacatgattgcctgagaggaacagaaaagctagtttctcagtctctaaccagaatgcatgataaggcttggtgtcaaaaagggcaagatggggatcacagcaatta

SEQ ID NO: 54717 - DNA, 1407 bp, Homo sapiens
ttttatagaaaatttatttttggaaaaacagttcatccatctacctttcagcatgtcaaggttaactcaacagccaagtgccagccgtgggagatactgggaagaaacttggactaagttgggggtcggggagaatttggaacaaacagcaagaaggtaattaagagttgggagaggtggggattaggaaaaatgtatgcaatatataggaatattttgcttgagcaaaatatctcttattgaatcaatgtgttggggcacacatcacgcaggggaaatgtatcttagctgtgataagggaactgtggtgtagggtgcagagatacacggcagtctttgaaaaaactggcccatctccatgttcacctaggtctacagtctggtagctctgaaccagtaagattatagaaatcttgatatcttctctttggttctcagggtgagaaattgtatatttttagattgttcccacaaaggggacagaatttctgttattctcctgggccgagtgcctttttgttcatctactcaccttaacccaagtcccgtttcttggtacctcagggttggcagccatcttcattagctctcttattactgaacctagttggtttagatgaactggtcactgttagtccaaaaagggtttccagttcttgtttttgttttttatttccccccatgcatgtatatagaagtataattttagtcttttacatacttttctgggaacccattcccaaatcactaaatattattatagtattatttctaatatttatttttactgtatttatattatttaacgttatattgttttttattctattacattgttttatgatgttttgcatcatattccattttgtcaatatagttttaaaatacttctttactttggaccttcagtttgtctcaacatttttattcataaattttatctaaatcttagtcaagttttttggttattgttagagtatgttgttcttgcaaatgggatttggtaaagctcttctcagaaagactgtaccgcctcataatttcagaaatatatgatgctgtctgttttaaaacagccatacaaacaaatccttggtaatttgataggagaaaatgtcaccatattttaaatttttgatgcctttttgtccttgccaattaaattgagcattacatgtttatttcctacttaaatttatttcattttccctttccatttcttacctactttgaaattgatactctttatttgtaagcacttttatgtagagtatttaaccttgagttactcgtttagacagctgatctttttttgctccactacacggcttttcaatatagaatgcttcagtttgaggtagatcgatttatctgtcttttggtggtttttatttcatgaatccgaat

SEQ ID NO: 54718 - DNA, 1050 bp, Homo sapiens
ttaaagtaccaaggaaggggctattagagtagtgcaccagggcatggcaacaatggctctcaagcaggattcctatgagccttttttcctgcaactccttgtaatttgtcagaatctgtgtatccagaagttggaactgctctgtttcctctgcattgttggtacctgtagggaacaagtatgaaagactacaatgggctgtagtgtgtaggggcagagcttataccattggttctgctaccgtgctgttccttagttcccttgatgttcagcttgcagttaaatacaagaaaggatataattttaactctgcagaaaagtagtattacttcttttttaaggtaacattttgtaactttacaatgttaaaataaactccctgctttcccctttccccaaatgttgtgttgacaagattggaaaatagtttgtgttctttaataaaaaccttatcatttcattaaaaattgaacaaacctcaatagcaaacacaaaaatggtaacactgaaaccaaccacgaaatcaaagtcattacattgtcatttaaggaatgactttataaccttcatacgaattttgggaattggtttctgtccaactcatagtatcacagttaatagactacttctgtaagtcagctctttgcttcaggaagagcttttacaactggatggactttctgtagtttctggaagtggtagagttgtctccaacttgtattgttagtttcttttggttattccagcattgtctaaaggaggaattcaaatgtgttaaggacacagatacataatgaatgaagcaataaattagtgctattttctgtttggtggtgttttttttaaattattttcagtttgcatctattgtgttttgaggtagagttcacagagtgggttccttgctgcattttgttttatttattcttctattttgcaatttttaattggtccaagagcattcattgagaaaagtaatagcacaatagtcacagcattcactagagtatttttgtttcttttgtgtgtatcatattacccacttgatta

SEQ ID NO: 54719 - DNA, 1040 bp, Homo sapiens
gttatatgatcttaaattgttggaacactttcttttgcaacagtttcatatttctgtaagcatttgttgggtatttcatgctcaccccacttatatacaaattacaacattttctaggccagtgtgcttattctggaaaatgacattgcattcttttattttctgaattatttgcataagaacaatttcaaaggtgacagtagtaggtcttttttactttccacgtgtcgtagtttaggtttgtaacataatacagacaggtgaaaggaattacgtataagtaagcacaaaaaagtagatgttttagggtttgattgataaaggcatttctaaagtggatctaattaagtaattaaaacaaaaggatcttctacaaatttacacgaaataggtttttaacattctgccttgtggtataaaaaagccttattacgcatccttgattttaaaaattgtgcttagttggctccatgaatatgcagagatgagtgaaaaagttggactatcagtgacaacttatcttttaggtttacttttaacactattttcatctaagttaagatgaaattgaaataagctttctggatgcttctaaatttcacttcagcctggttgaaatcatgtcccctcctccttaagtatttttctcatttccattttaggaagaaattttgctaacatatataaacaggagtaataaagagatttcatatgccagcactggtaatagactatggcttgagttaatgtttcagcacggcgtagagtcacagcctcactctcatagaggtccctgataatcaaaaagcatggtgcttcctgggaccctcaaacagcatgagcagtagcaaacatgacagtatttagttcaaagtaattaagaaaaacagtacaagaaaagttgaattctttatagtacagcgtagtaagaacacttttatgggaatgtgtgattttacagaaatgttttaaggaacagagttaatggagactttgttagaaaagcaaatgttcctcaacaagcacttaaagtttatcac

SEQ ID NO: 54720 - DNA, 1056 bp, Homo sapiens
atgactggaaaccattctgaaacttaacagggaaatcttggaaatgaagaaaccataaactttctgtgcattcttaactaactgggaagctaaacacatgtacagaggagacatgagaggacttggcagcaagtaaataactgagtctgacttgtaaactacttgaacttttaatactctttctaacatacaatcacatcagcaaagagtggagacttaataatgggcctatggtttttgtgcaaagtctctgcccagtcattggctgaccactaagccatgcagacagaggtgatatctaggagccgaggctaaaaaataaaaataagaattcaagcgaattaaaataaaacagtgagcaaaggtataagcagccacacactgtgagggcagagattctgcatattaaatacagctgaggtattaaaaagaaaccacgacagcagcagcaattctcaggggaaagaaatctgaaaccggagttgctaatggtgtattatttaaaatgtatagttttcaacaacaaaacatttataagatacataaagaaacagaaaagttgatccataaaatagaaattgcctcagatgtggacccagtgttagatttagcatataaggattttaaaccagctattacaaatacgttcaaaaatcaaagtaaaactatcttggagaattaagaggaaatatgatgacaatgacaacaaatacgtagtcagagaaaaaaaaactatttttcaaaggccttagagacattctttgcacatcttagttattataccagtgtgctataagtaaattaatattttgttgtacaaattacagatagtgtagcttcatctgacccagagattgtgattcagtaggtctgggatagagcttcaagatttgtctttataaaaagtttactaggtgattctgatgtaaccatatttgggaatcaattatgtagacttggcaaaggattaaaacatatatatatatatttttttttttgatgatttcttcccgtgagtcagtattctagatcattaatgtgatacaaataaaggaa

SEQ ID NO: 54721 - DNA, 1127 bp, Homo sapiens
caattaatatgtatacattaaataagaaagtaaggccagtgggtgtagcagagccttcattccattgcacaaatgaaaattctttcttgattagtagttatattttctgtttgtaaaacttgtcaccgtttataaaatccatgattaaatttgtcattattatttggatttactaaaaaagccatttagtttctgattatacagaaagtaatttgttagggtattttgtaaagatgaagagtccaaataaagatgaataaaaaataattttctgacatattgtagagaaccaaaaaattatttaataaatgcctgaattttatgacatctcttgacgatagacatgaatcatattacttgaaaatgctttactaaaataatttatcttataaatgagttacagtttaattttctttcttttttattttaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtaaatattcatgtgttaatgtcccatttgagctattgtatccaaattagaaaaattattacagttattccaaagcgaatggatatagaccacatcccagcctatttattaaactgagttgggtttttacctactaatgttgatatctacactttatattttcatcaacattcaaatatgtaaatcattctaatatagctgacatgtatcagaatatgtaatacgtatctttttgtgttatataaacatgaaataaaaagcaagaataattgaaatgtaatcttagtttttaaggcttcgaaaatttgaaatactttttgtaacatcaagaatgttgaagtgcctgggtctttggcattagttgctacttaactttttttttttaaattaataaactttgttttttagagcagttttaggttcttattaaaatcaagtagaaagtacagagatttctcatatgatccatatccacacacaga

SEQ ID NO: 54722 - DNA, 1024 bp, Homo sapiens
ctattaagtgtgtattgctgtcttattgatgttgtaatttgtaattccctaatgacatgaaatgtttaacatttttgatatacttattgtatacttaactgtcatctgtacatcttttttttctttcttttttttttttttaagacagagtctcactctgttgcccaggctggagtacagcggcgtgatctctgctcactgcagtctttgtctcctgggttcaagcaattctcatgcctcaacctcctgagtagctgggattacaggtgcaagccaccaagcccggctaattttttgtatttttagtagagacagggttttaccatgttggccaggctggtctcaaactcccaacctcaggaaatccacctgcctcagcctctcaaagtgctaggattacagatgtgagttgccatgcatggccttgtatatcttttttgtatctgtttaatcttagcccatttttaaaattgaggggtttttttttagtatttagttttaagagttctttgtatattttgggataacagtccttcatcatatatctctttctcaaatattttctcccagtttttggcttgttttttcattccttccagttaagagttatcatttatatagttaagacttaaaacatagaaacaggcaaacagaattaaataacaagttcaacttaagaaagcataaaactaagtatagaattccttgtatccttcaacgaattataggtaaaatatctttttaccagattaaacactttctggcttttcttcctagcagatttggctttactcagtaggttagagaagtcatagagaaggctgtcaatatgacagatgtgttaagccaagatgcaaagtatgtttttgaatattaagtgagaatttctgccatcttcaaatagtatacagatagttaaggtaaacatattctgattaggttctattctttctagttcaaaccattgcttgtttttttttttaccttatatgttgcccaagatggttataaggaagagaccagt

SEQ ID NO: 54723 - DNA, 1617 bp, Homo sapiens
tcattcttttttattcccttctacacaaaatatcctatgagtttgtttataaatgacatcaaatattttactgccaaaatattttagaagttgcaagaggaagaaaaattactttaaaattaaagtaataattagaaatgtttatttgactgaaaattaagtttagtgaagaaatacagtatgtgaacatgaaagttgggaaagatccataattcgttttgtgtaatgaatagcagtgttttcttccctcttgattaaaaaaaaaaaaaaagtaagcacttacagaacatagagtcattttaataaaaaatgggaaatgtttctgagtcagttaaatactttgacaaagatgcgttttttaaagccacacttccaaagtcttgttattttatttctatactttcagtttgatttgtataggaagttctgtcggcatttgttgccatgctgtaatcaaaatgaggtctgtaaaagtggaaattatattagttatcaattcaaatagaaaatcgtttgttgtatattcagagatttataatactgactaaatgacatttcatcaaacatctcaggagtcagaaaaaaaatctttatggcataattttcttcttttcaaaatgatatctaaaccaagggcgtaatctttaaggtgaatttaaaatagccgcaacacaaatctagtttactcaattctgccctctaaaactccttttagttgcaggttcttttgcattatttcaaactctaatcctctgagcgggtaattaacagaccagaaaagccatttgtggaaaagaagagccataagggtgaaaatatttcttcactgaatgatctttaagaagtaaataattacaaacggaaaggatttgggatgaccaatctaaaactgaggataattagaaggaatagagtatgaaaatcgaaatgcttggcatgtacaacaattctcatatcacaacaagactaattaaatatttagaaaccaaaatcccctcacaattcgaagaaaaataacccacgacaaaagggtctgtaactttgcagataattggcaagggttataggaaggaaaaacatcacagattggctccaaggctctgcaaggtcatgtcttattacgctgtgtcttttatatagtctggtaacaagtttcttgctaatttaatctaactagggcatcccatagcgatttcccatttcccttgttaaaaatgtgatagtttctgcaagtgcaaactgcagtaggttaacgtttttataaataattgctcttaagtgatacaggttgtaatattttttgaattattaaaagtgaaggctttgaaaatttagacacagaagcattatttttttaagtattacaaaattttatggtttttattcccatttaaatttttttgtttcattaagtagttagacctgatgaccctgtgaatgaaacagtctcagtggcatgctttgtaaataaatacttcttattttgctaataaaagcaagcacatttatgttgaatgtgcatttctgcaaacaacagattttgtactggattaataaggctctgagtgagtcaagcctaatttgcattaaactgaccccaaggtccggtaaaaactg

SEQ ID NO: 54724 - DNA, 1757 bp, Homo sapiens
tctagactacacaaattattaaataaataatgagcaatagctatgtgacaaatgggaacattgttacagaacacctcttttttgccacatgaattacacaccgtttagcttcctaatgttatgtttacctagcaattagttaagctcacaaatcatcattaataaatatttaaagaaagcaagacccactttccctagctgtatagaatagaaatttagatgataaaatagcatttcattataaaataaaaaaaactttttgaaaagatttgatttaacattcaactccatttttctcttgcatttgtgaggatgattgtaaccttgtatcttgaagcataattctttgtattccctctccattcacttgattattttgcctgagcaaatctatttgcattggtgcctacctatttatgttctaaagttatatgctgtgtgtataaaattttgttctaaatttggactaaaaaagacagtggctagagtactaagtcagttggaatttgctagtgtatatggagaagtgattagtagctaaatacttatcccgccttccttttaaataggtaatctatttcataagggtttgttattggcattgatgatacaagactatatccaaattgacagggttctctgagaatcaggtacggctgattgaggcataattggatgtctggtgtttattttctattaaccatgtttatttatgagcagaaatagccagataatcattaatcattatttaattttttcaaaaacaccagattcttatgtgctaggcatataatcacctccaataagaatttgtaagttggcagcttcttttttcttttattattttctcttaaactcccactttctagtagtttctaaatttttaaaacttgtgtacctgaacagaatgtaatttacttattaacatataatttatttttacttagttattgaggctcaagaatgcatgtaattcctattctattaattaaagaacagattcatattgcaatagttcgtctgtagatattctgtttgtttagcatatacaattcacctaaggatgtggtttaagctcttccaggaaatcctgtgtatgttttgtttatacttggcactatgaaaaggagtgtcattacatgataccttggtaccttggaagcattgatttcacctccaaaaagtgagcacttttaactgagacagacagaaagtaactcaggaaaaaaaaaaagtcttaccattgctagtattttgtaattgaagtttaatgaataaatagccactaaaatatttaaattgatgaagcaatcttcatcgaagatgcagactcaataaaggattgaactaattctttaattagtaattgtataatttcaaatttaagcaaactttaattttttagtttctgtcatgatatactgagcttttctgttgaatgctggaatatttgttcaaggcggtagattttgcatttttaatcttccttagaactgtggtgaataatggcccctggcaggagataatgaaattttcttaatttatattttcaagaagaagcttcaattgaaaatggcatcctgtggcctggagacatagctctagtgcaagtttcaggggagctgcaataataatgcagtgccatcggtgacggggaacgatgggacagtgaagaagtaatttaaggaagaaaagaaaatgcaccaaagctttattgtagcatatctaatgatctgctgaagattcccaatggtttt

SEQ ID NO: 54725 - DNA, 1062 bp, Homo sapiens
gataaacagtatgctatattatttttcgatacaatttattctgagagtataagtaatgtgtgcattgtgctctctttcacatagagttttaaaagattaaggaaagggaacatattaatagtttgttttcattaatatttcattagtaatgaggcactatgtctcaaaaataaaaagataatctttcttgaaaatactgctgttaatctgtgcatgatatttttaagtaatttccatatactagtatgtaaattaatgataatacacttttataaaatgcctttttatgctttacacatttttttgagaacatttatcttaatttcaaaaaatactgtggatgccttaaaagttaatattgagacctgagaacattgattacatctggaagataaaatatactgtttgtaatactttcaccttcttgccatttgcaaattgggatggttaagtgatgcattagctatttcttaaaatcttttttgaaatatatgttgtgcacaagcctgggcaatatcaccaactttaaatacttactctaatttttgtaatcagcaaatatattggtaggaagtaaattaataaactattaatcttcaaaattatttgttacacttcagcttttacagatgcatatttggcttcattccagaattgaaccattgaaaccctcacccccacacctgtagggtagaaagactacagggatgagtttttaaaccatgagtaaaattcagtgttttgggccagacacggtggctcatgcctgtaatccctgcactttgggaggccaaggcgggtggatcacctgaggtcaggagtttgaaaccagcctgcccaacatgatgagacctcgtctctactggaaaaaaaataaaaataaaaaaataaaaattagccaggcggcgtggcacattcctgtagtcccagctactcaggaggctgaggcaggagaattgcttgaccccgggaggccaaggttgcagtgagccaagatcgtgccactgcactctagcctgggcaacagagcgaggctttgtctcaaaaaaaccaaaaaacaaa

SEQ ID NO: 54726 - DNA, 1977 bp, Homo sapiens
caaaatgtaatggaaaccagaatgcttatatacttcctgcagaacataccatgacattgagaaacatacagtaaaagatctctaagcctgtactagttatattcattcatccaattacttctggtggaaaaaatctgggcaattttcaatgtattctttatttttgaaaaattatatatatatataaatggccaaatcctttgagttactttctccttcaccttaatagcaaagtctttcatgttcatgttcttggtccatttcaactttgagtacaattccctctctctcccaccagttgctagtttgttgatatgagaggagccttttgtgagaagggaaggttgataaactaaatgaagagtttactcacactagaaattgttatttggaggagtttttgtaatcatatttaaataccattcaaaacctaacagtttggttgagtagttataaaatgtatactgtgggagtatctgaaagggatatctaacacacagttgtttatctttcttcatttctgagaggtgtaagggtgtgataaaaggaagatcactgtaggtatgaataaatacaaagaaggaaatgaaaggacttttgtttttaatgggaccaagttagtgatttgaggatttctggcagatcaagaaactaaaaaatcagtgaactgtcttgttgctgcaaaagtttaaaaaagaagaaaaatgaaacatcagaattatatttattagttgggaacattagttattgacctattgagaaactgtaaacctacctcttgtcttgaattttaggatgtgaaataggttctgtgattcatgttaaaataattcgtttacactaagtggtgaaccactggtaaatttcttcagatgagtgaaccaaattaagagaaatacagaataatgacaggaaaacatatgttacagaagattgtgacactataccatttacattatttacgttcttgaaaattacagtatatggtatatttctaaaaaaacactgctatactctattataatcatgataaaagttacttatactttatttaggtcttgtttgaagttcattgtagtatactttgaattataaaatttacctatttaatcctgtagttttcaggctttgctgctcttcaaagagaaagtctagttttgagttgaaatggcaccaaagtatacgactgttcctacccatctttaacatgattcaccttctactgccctttagttagtggtgctagaaactgggatgcttttcaaaattctttatagtgctattttatacttcagtattttatgtactatcgaatatgtggtattccaactgttacataaatgttataatgttcttgttctgcttgatttgccttcttaatgtatgtgctatcagaaaatacaataaaaaccctgaaaacattccattcattaggttataatcaaatcaaattataaaagaaatagttcttgcctttacaaaagttatgaaaagaccttttggacaaattcatagaatgtacatatcattttatctggaattctaacctatttctaatattcttggtgaattactgacattgcaaaaacaagaaaataattccttataacaataattagaacattctaggcatcatgttagtacaacattctttttaatgttatattttagggagtactggtgttgaaccgaggtacatagtcatctcattaattatataggcacattgatctatgaatagaaagagtaacaataatgcttagacattacatatgtgccaaagcatttttctaaatcctttaaatgcactttatcatttatgtggaccatagcatataaggtgagctctactagcttagtttctggtattccagaaagtatgtacaatgaagaaattcacacccaactggatttagaggataaaattaaaatcctggctccttgttttgtgttgtcaaaaacttcctgctgagaaat

SEQ ID NO: 54727 - DNA, 1031 bp, Homo sapiens
gtcatgttagttcatgggcgtttgaattatatgttttttatcagcaattttgctgatttgagacagtttttgtacactttcctcctttaaaaaaaaaggatttgccaaataatgaaactgctctttccagaacctcaaaagctaggtcattagttctgacagatttatatgttcaaactatcaatatttctaaaaccaaagggccaaattctgatagatctgctgtgtccgatatggtagtaatacattctgacacatgctgtgaaggcactctccatcttttctctgacacagttttgacaaattggctttttgtgttatcagttaaaggccaaacacagattatcttttcatccctgctctgtgttcatgtgttactgtgaaatggatgctttttatgttttcagtattttctgtaccatttgtaggattggaagcctactgagtacactgatctttatatcatttctcctgtgtagtgttggtggcttacgtaatcattctcctgtgccactagaggaacattgtattcttttgacctaaccaaaattttgttccataaagtcactttcacttgaatttagcatggtttctgtcttcaaattagagaagaaatacagcatccattcccaaacagtggaatcagtcagagctgccaagaattatctttctggagccagttcctgtaacctagtctatagaccaagaacagtgttaagcaaatattattttcagactcataagctatttcttgtgctgtttaagaaaggaaaatgtggatatcttctggaacatctaacttgcaaaattttactttttcagttccccagaagtattgtacgttgtgcactaaacttgcaaatagctatactcagagaagtatttgttccttttagtttttgtcttttaatttaaaaaaatcagtaattaatttgctgttacctttctagacatttgcacgaggcagaaataagtctatgggttttttttaatcactctttgctaaagaataaaagtaattataattccta

SEQ ID NO: 54728 - DNA, 1032 bp, Homo sapiens
cattgtattcattccttatactttcttttagtttaagcctttagctttcactttctccttgatttagtagtgtttttatgttttgtaacatttgcatacctcttttacacgttacttagttgataaaattgtcaccatcagataacatttattatgtgttttttaccacttggctttataccaatttctatccccagtaaatcctccaggatcttatatattccaattaagtcctattataaagcaatttaagaaggttttcaagacttctgaaaattttaaaagaaatttgctcaacagagaacattagaaatgctgttactttgtttactttagtatgtttataaacaggcgcatgcattatatgtgatgcttgtactttcccagttaatatccatgtcaaaagtgtacatatacagggtatccattgtcattgccagactgttaggaattgcatatatttatatttgaaagaagtcataaagatcttggaggataaagcagagtaatcagattggaattttgcatcctgcaagcaggatttggttttgatttttgtaccttatatttcaaagtatcattgtaaaactactataatattagccacaaattttatttagtatgaaaaatagccattattgattaaatcattattaatgaataaacatgtttattcaatgaaatagtgtgtcacttcacatacagagtatgtaggctgtgtagttagtttgggttaatttcttgtcttgcatatccatgtagtcctccactgatgttcgtgggtcatatacttgtatgtttggtctaaagaaaagtaaatgtattgttaattcatacggctcttaagacaagttgtagtatatatttggcatgtgatagagaatactgattatattaattttattgtatttttgtactcttctactgatagaattttggctggtttcacagatgtctgtccttttgattttcataaatataataacgtagggacttttttgttgtaaagagcaatgttttccttatgtgatt

SEQ ID NO: 54729 - DNA, 1004 bp, Homo sapiens
cttcaaaatcactactggtgatggggggatattgatatattcctaaagaggaggcttttttaatggttaaaattaatttatctaggaatagaaaataatagaaaaacaattgaaacatactgggatgcataattatatatttcttcttagtaaatatctatgaaaaacatgtaaccacatcagaattaaatttgatctaaactccaaaattaagttgtgatttttataaatgtatttttctattgttatgcttatctaaagttagtttaataattgagttcacataagataaatggggatgatatacctatgcatgcatttatgtctatagcatacatataggaagtaaaacttggtaagaatgctgagtgactttggaaaggcaagagtatgtataccatgcattagtgaagagtttcattatttattcaggtacactaagtgaagcaacatgccaacatatttgtattgcctccttaatctcctaaaatgattgatccatgttcttttatgtaactttagaatctttctcctgctaggttttcctgttgtgtgtttctctttatccaaagtagtacagctcttaattcttcctatatttagcatctgttacgaattcagtcttagactaatagtcaatttattttaatcttttttcttttttccttgcaccttttttatttttcttcctgatgcttaaaatagaagtggagcaaaaaggtaaataacatacagtctgaaccccagctccctgttatgtgccttatggatgttaacctcctccctcccctctccccacaacactcctgtattaaaataatcagcaggatctcataaatgccacctcataaggaagtcaactgtttacaatgaaattgtatgactgctaaacctggtgatggggtaaaaattctgaagtcggcgagggggatctgccctttctctgtttcttttttaccctttatctctttttctgacacccttggatattttcttataattaa

SEQ ID NO: 54730 - DNA, 1512 bp, Homo sapiens
tgttcctcaaattgaagcacctttgttttcagtctaacttatgtaaaagttctaaataagtcttcacattcggttttctgttttatttgccttatttcatggttttgcttttaggggctcataggtgaagtagggggttgaaaggtataatgtttgtaataaaatgaaatatatactgttgtgcaaaagctcaaacttttaaaacatgggttaacagattataagatgaaaacatagcaaaaatttaaattgtcagaccacttataaatgatcttaaacttaggcttttgttagtgaaaataaacataaacttcagttactttgtaccctgatacactgattatgctaactttagaaaagaagggtagtatttgtatgaagtatacattttggtaaaattgaatgctaataatatgaatttttcccttttgatttgtgatcactgaaacttgtttgcctgtgtaattttttaacttggcttaatttttgtctttctctgtaactgttagtttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaaggtaagcgtgtttacttgctaatgcttatgtcattttgtgaaaagcatttttctttttaaagacttcttaatttttttttcctattttcttccccttttcatagttaaaggacaaaggacaatgttgtggtacattttagccttattatggttcgttttctttttctcaatttcttcattttaatgttggcttcaagaaattg

SEQ ID NO: 54731 - DNA, 1119 bp, Homo sapiens
gccattttgtttatatatagcatagaattcatacttccggaaataccttttcactgataaagaatgctgtataaaagatgatcagtgtttttagacagtgaacaggggcaagttgaataggtgctcgtttttgctttaccaagctacagaaactctagagttcatttcgtgaacagtgggtgagggtgaattcttggacctcagtgaggagaatattacccttagcataaatgtctgttgtcttcaaaccctttcatggaggaaaaccctggtaatcaatagaagttcttagtacataaccagagtaaactgaaccattctgtatgtgttagttaaaatcttcatgggtacttattaagcatgtttattagcatcatttcttaggtattttgtttctactcaaatgataaatggtaggtagaatcctaagtcagtgcatgagtgcatgatacggcatccggataaatagagctctataaaaaagggtttggattagagtcataattctattgtgagttgtgttttctattattatttataggatattcttgagttttgaaccttttgccatgtttcattatggaacttctcattgtttgttattctagtcttatgctttctttccaaattgttattcttttagagatttacacagaacaccatgtcagttaaatgttcccagataactgcaaggttacttgttggataccgtatttttctagagtctatgaaaatctgtaactaggcaagtaagatcatagcatttaagagtatgggaaagtgaccttaaacaaattacttatcttcatcgttcagtttccttatctgtaaaaggaagataattatagtacctacttcatggagttgtggtaaggattaaataagatgatctgattatccatgaatggtgattggcatagcacctagcacataaatgctaaatcaacgtacacttttatcattaccagatgccctatttgggccatttccacctgtggaaataaataataatttttagaaatatatctgcatttctagccttcacatgaggaaaaaaagttgcttttcttctggtattgctaaacttaaaccttccaaaattccagaaattctatgtgt

SEQ ID NO: 54732 - DNA, 1028 bp, Homo sapiens
atacctacctttttcaaggtaacgatgccgaagcctgagatgtttccttaataaaacagcgcaagcatgccaagcttatcttctgtttggatctaatcaggcatgctgatcatgctcaggcaagaacggctgctgggtggaaagatgtcacagtatttattttcttgcaatatgtaaagtgggtgactttaaatttttttatcatcctaattacatataatcatcacagttttgttaatgctttgaatttgattgcttatagaatgtgagtttatacaatagaatttttctaaattaaactgtcccacatttcctgttaaacagtatgtgatgaaattatacttaaactgtactatcacatatttcattgagaaataaacttaagagtcatacagcaaacactatagtaaagcctaaactacctactttctcttagccatcagtataaataaattggaacagatgaaaagatgtattcttacgagcgatattgtcagtaattctcatttccttggtttgtgggcagacagatgggtagggttttgtgtgtgtgtgtgcatgcacacattccatgtgtgcatgactgtatgtgagtgcaagtgtgtgtttgagattaatatactcatcttttttccatagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggtattttctataaactaccatgcatacatttttcaatttagtaagtaggttctgtattacagtgaagtgattttattcaaagaaagcgatgttta

SEQ ID NO: 54733 - DNA, 1081 bp, Homo sapiens
ctttaaaaggcattagtaattttaatattgcagtgtaatgcaatgccattttttctcctccttcatctacctttatgacgaataaacatcagataataaccctcagtatcatgctgattacatactgacttaaattctggatcattggaataaataagactttaaaataacaattttaaatggtagcagtgaaatgagagaactggctgaaatttttgagaaaggattttttttcctttttatttcttttaaatgcctggttcagaattgtgtgtgtgtgtgtgttgataatctaagagccttgaaacttctaagacgaagggaaagtcatcagtctcaattagttggagaatttaacattcgcaaatttttttcaccacaataaagatactcaaggagaactagaagctgtaaacagaaaaaaaaatttaaatgagataatacaaattgttttttcagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggtagagagaactcttctgttattttgaattagacacttggtatggcagctctttcttgtcttatagcagttgagagccaaatctttggccccgggacatatacttagaagcaaaatttctaatttggttcatttttccaaggaagaattacagttgagaaaagagcaatgtgccctgccctcccaaaagagtgtaaatgatgttaattacctgagagagatcttagttggtggcaaactttatctatctgattgtggtcaatactgtaagtttataatgcattatctgcacttggagagattatatgttatacagttgatatactttatatgctaatacatggaactcttatagttgcagcaaaattttgacacatataggaatattagccactgacatatttctttcaatggcagcttttggaagaaggacaagt

SEQ ID NO: 54734 - DNA, 1172 bp, Homo sapiens
gatcattgttgatgaattaaagtatatgctcaagtgttttttagctggacagagaattggaagagtgaaaatgttcacagataaattatgaactttaatgccaccttgttttttttttatttcaaatgattataagtagacagtgtctataaggaataattttggttactattttagttgagatttcaaaaaataatatagtttaattttcaagcatacatattaatctattccaaagacatcagtatttttggtttagaatattcaagttttgagatcataaataggatgactttagtagttttgactctacctgtaagagtaatgtctcagattaagagctgacacaggtggttgtcaactatcaacaattgaggtgtgattaaataaatagaaacaatccaccttctacacttactgtttgtaatcaaatagcagtctgttaatcttcagtcagtcctgttttaaaatggtccagttatattttaaaatggaccagatatatgttgtctaggtgttcttccatcttgaagtaagagtaaatcatcatgacagataaatattacaattgtcactcatcagctactgaaaatcactttggttctaaaagcggtcaaaactaatgatagttttctaatggatacaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattggtaagtgaatctactgtcaagtttaattttgatttaggatattcatatgtaagaggatgatgtttccattctgtatctgttatttcccagtgctgtacttctttttttgtcaaattatttttgtctgttaccaagagaaattattgaccacacttactaaaattcatgcaaaagccaaactctatcctgtgttttacaagttggttttatgtgtgtgtgtttttccagttgaaaaatcattaacaaaaaagtgtaagagtgcctaaataccagaatgtagattttttaagtaatgaaagtacttgctatgaaactgtggcaaatgcttaatcgttttatata

SEQ ID NO: 54735 - DNA, 1045 bp, Homo sapiens
tcatttgcctccttagttaactcttaaagaatccttttttccccacctcctttatcttttccctcatccagtcctggaagttgccgtactcagtacagaaggacagatccaagactttaaatttcctctgggcatcaaaggagcaggcagctcaatccaactgtccgcaaataccgtcaaacagaacagcaggaatggtaaggtggaagtcttttaaaaattgacagtttttgttgttgttcaaaaacctattaattctaaaatgtatttgagtccttatataacaaaaaaacggcttaccatttaaaagcagatataaaacagtgccttaggacttcatcattttattcttattttatcttagtttattaacaagcatgttttttgtacatcatgtgactatttttaccttcctagggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatgtaagttaatgtatgctaatgaagtaatggaaggttataaaagcagaaagaaaggaaagcaaaactgaggtgctggggatggggagagaactggggagatgggagggaggaaagacaagacctttccatttgaattttaaatgttggactaggtcagagacacaagtttatttaagtctgtgaacataaaattaaatgagcttggttcagtgattattagaacttaagtgtattcttaatgaaagctaattcagtaatcaacaggaaaatgtaaatgactctaatttgttttcaaatgaaaattaacccttaccttacttagcagcaggatagctgagtattaactcttaggactctgcctttctgtgtggcaaaatttttttcattagtttactgatcacgtttgacacagctgttaccaa

SEQ ID NO: 54736 - DNA, 1048 bp, Homo sapiens
aagcattagtttactctgaataatgtatttttgaaataatagtgatttctcttagtgagtattttataattttggagtgggctatttttattcatgagttttcttttgtgttttttgttcttttcccccgtagattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcgtaagtaattgcaagcgacctgagtgtttttcaagtgaataattttttaaagcctgttagctgtcagtgagggtccctgacagattaaaatagcatctgaaagctttattggtaagagaatgggcataccgtgcacaaattacaatcaagtcttttgcaattttctgggttcagaggatttgtactctggcaaggcagattccaaattatggactttctttttaacacaaaagattgacctgaaacaaattgaaaaagtaaataactttttggccttagaaagatattaagtaaaaattcttctgaacttaaagcttctgacaggtttaactactcagtgttaagctaatgcttcattagctctctttgtgcagctgaccctctatagctaactctcattctgaattgtgacagtagcacattccatcccatatgttttactttgataatattgtatcaggcagtttgaaaggattaaaataagtcactgtctttcgttcataaaagtatagatatttacagaaagtgacagaaggtagacatagtcatgtttctaaggattttatttgctagaggcatgaatttgccttccaattctgtttatttttttcctttgataaaattagttatataaagattctttggactaaagaaagctttttgactgtacagatgatgaaagacaaaagaaatt

SEQ ID NO: 54737 - DNA, 1023 bp, Homo sapiens
cttttttagtattttggtttcaatgtcttcttaaacatttcttcagtgtttctttatatgtgaacgtccttttttgtggagagttatttaagaagtgtgtcataatcgtcttatagcctaaggccatatagcacaatgctcatagcaggcactcaataaacatatattgaataatcagtgatctccactctttaaagaaagacaataaagtaacatgtttttaagagtggaggattaaatgccccttagttgcttagtaaataaacaatagatattgttagttttagaccagaaaaaacacacattctttaaaaggccaccagataatcctacataggttgtttagggtaaatccttgtatgtctttaataaggtaagtttggggaaactaacaaaacatatttgtcttgctgttttgtattaatagagtcgtataagaagaatgtggaatgatactgtgagaaaacaatcagaatcttcttttatctcaggtgacatcaatagcacttcaacacttaatcaaggtcagttatcaggaaaatttgagttactaccatttattaaagtacatataagttccttttattcaataatgtaatgtaagaaatataattttaaactgcattaacaggatgcggctcgaaggtaattattgaaaatataccttgccacagattaaaaatattatcctagggagtacagatttatcctttctgaccaagacatttatgaaggttttcttcataaaacattaataaaattagaatagttactattcacatgaaacagtaccatggaaattatgaacttttttaacctttctttcaaaaagtaaaaaataaatgctaaaaacatgtgtagtaaatcttcataaacaaaaatacatgaaagtttataaagtaattatttctatattgtttgatgtgtctacagtggcatctttaaatttatcagataaatcagtatagttcttaaaatatgctaggaaatgaagtaatttagaaaagagtatatgcacacaca

SEQ ID NO: 54738 - DNA, 1075 bp, Homo sapiens
gctatagaaaaccacattcagcctatcaatatatccaaactatagtatagtgcagctttatggtagttttcttttttcttaagaaaaatttcagaataaagttaatattagttagcttatacctatagtttttaattgggggagggggaaagattgtcactaacccatccatatattactatgttgtttaatagcttattttaaataaaagtatatatatatttaatattaacagaattttcaagattttggtaaagttttcacataattactgctagcatataatctttatttgtgatgaatatttgccactaaattaaacacagaacttggtttccatttttttcttaaaattattttttaatgtaactgcagcttctcttttcattctcttgttttttttcactttccttatgctttcctctagcaacctacagagagacaagtatgggagtaaaacttaactttgcctatcaaatgtaaattttttcagcatgatttttaacgggcacaattaaaacataactagcagtcatgaagtagactcagcgggcaagtggttcacaatttgcaactaaaatattaacaaattcaaacagtacatccatctgtactgccttttgtcagtaatggaggtctgtagcaaatgctgtccatacttaagtatacgcaatgctgaaataatttgctctataaagcctgaagtactgtcaaccaaaatgcttaataattgacttatcatttctgcattcccacagtaatcttgctacaggctgtggaaaatcttcaagtgaattacctgaacttgggcagaaaaagataacctcttcaaaaccagtcaaagatggcttaaatctgcagtatatcatagaaaagaccttttggattatatccagtgtatagtgttgtatttaccaagcaatgataaaacaaaagaaaatctttgaaaacagtgaacctctacagaggaaacaaatgctagcaagtgagccatgtgtcactcatacctttaagtgcgaaatggttttttttttaataatcttataaagattatagcacataacatgaatttatg

SEQ ID NO: 54739 - DNA, 1649 bp, Homo sapiens
aaggctgccacccttctcccattccatagttaatatttattcttggtttaatttctgtgacccatacttaagaaatctctaacatttctgcgtttgacctccatggccatggtgtctgtgggcctatcttgtacagtggactctgctggttcattcggtgctgtcactgtgactgatgcagactgcagggctgcaggcaaactttgaccactagaagcctggggccattgctattagagagattattagtaccaaatactcaaaataataaatattaaatgaaaaataaaaggctgctattgctggtaatctaatttgttgaacccttgctctgactaagttgctgagaagcttagaaattcttcatcatgttacaataaatcattttactttcttttatatatcagctactcttaggccagatagcctgagcagacagacatgatgtgagttgtccaaagtgagtcattccacctgctgtctatcgtgatgttggatggtgcttgtgggcccctggtccagtcagtatgagagatggctgtctttgtttaacatgacttctttgtatctgtccatgttttcattcttttttttacttcatctccagaaaaaggaaatgttagaatgttgtttaaaaagttgcttgccagttatgtgggtttatgttgtacatttgcctttcagttttgtattgtgacttactcctttttaatttagtgttgtttaggacaaattctgttaattttatttttataaaccatagtcttgtactttaaaatgtaaatgtcactaatgaattgctttgcattaactatgcaagggcatggagtgaagtcttctttgtgtcagagatttgaccaaaatcaattaatcagtactgtctcctgaaattgataaagtattactctgtatgccattttctctccctggaaaacagtattatttttaacactttttcctgttatctaaggggttgcaactatttacagttgggaatgcaggaaagcctggcacttttcaagtgttagctttcaaatacaactttgtcctgaacgacattaaaaagttttgtacaaaagaaatagagtttctgtggaaaggaacagagacagtaatgataactccccctcttctgtttcaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatct

SEQ ID NO: 54740 - DNA, 1204 bp, Homo sapiens
agcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaata

SEQ ID NO: 54741 - DNA, 1081 bp, Homo sapiens
aagaagtccctagtgccatcccacccctgctttcccccctcgccgactctttgggagctacaggtagtgctgtgggtaaggttggctcttctccctccatcacttgggtccgacccaaccttatcacaaggcgggggctgctagtctggctctacgcaagtgaggctaatcctgagtggacaaccctgccttagagatccttcatctcttcagattaggaatggaaaacataatgagacccaacagcaactttatccattagagaaaaaagccaggcaggtttgccttttctctagacattcaaggatctgctaccaatgcctgtaaaacttaaaggtcattcggagttgaagtgcttccagaacacggttaatttcttctgagagcggaaggtgcgggtactccacactttacatcaaacagtaaaaaatcatgaaaatggaatttctgtatggcgataaggtgtgtgtgtgtctgtgtgtttgtgtgtgcatgtatacacatgcatatatatgtgtgtatatatgtgtcagaatggttgtgaaataaaagttggtttgcctttgtaaagttcatatatttttataattcagaatgtccaaataacagatggtatttgttatatcaccaggagtgaatgacatgttagcacttaaagtgggcctggtgattttagtttgtgtaaatattacttgtaatgttttcatggttgtaacataagaattaggctaattttataactttgcatgaagaaaatagcttttttctgtattaataaagtagaattcatttagaaggatttagtcattcattttgtttaacataaatatatcagattatgtggtttatgtttcatcagtaaggttttggtattcattttcaggagcttcagaaaagtttgatgagctattatataagccaagaacacacagcatgttatacggagatttaaagaagccaatgtagaggtagaatgtatgttattttattattattttttgagatggagtttcgttcttgtcgcccaggctggagtgcaatggtgcaatcttggctcactgcaacctctgcctcccaggtt

SEQ ID NO: 54742 - DNA, 2710 bp, Homo sapiens
aatatttactgaaaacagaatggaaactttaaatgtttatctgaacatatttaaattatttctatggataaattcttttctatgttttaagtgttaatgacaatctagttcttaagtatgttagtcagctttttgtgtaactttatttatggaaactgaaggtcattatagtagtttaaaaagctgttgtgaagtgaccaaaaaaaatagcatgttatgtgtcatagggaaaattatttgaaatgtcacgtgttgattaatgtttgtaatttcatttggagcagtgttatcaggtatatgttgctgttctgtagtgaacaaagaaattgtattttaaacttaatgaaagaactcatcattacgtacctaaatgttctgtgtattttttaaagaattattcttgaaaatttgtttttcaaaacttttagaaatatatgatgttagagatcagcctgtacaatcattccctttcaaagatcctgacctccgaagaagctggagttgagatcatactgttagtaataacagagtaaggaatagagtctgatgcctggactccattcagcatcaataaataatcagttaatatgtttattttcaaaatattcaccaaatgttttagtttcaattaaagactataagtaaaagctgaaaaatgttactgtctaatgggaaagaaaatatgtatatataagagttacctgaaaggcaaaaatacaagtgctaacattatggaaagtggaattagaactctgaaaattgctgtatgaaaatgtttgatttgaaaagttgattaaaaatatcaagtcagttaagatttcaggttcagttagcaccaagcttcagaaaggcaggtgattccagagcttatttctaaaaatattccagaagaatgaagttaggcataaagataatttagaagggtcttggttaactttaactatctggtgcctgtattgtactctactgaaccttttccctctattagaattaacattttctggggtaagacctaaaagctaggtgagattccatcttcatctccacaggttttggagataacattaacttaggtacctgttgttctgctgtagtgaattaggaaattgtattgatgtatctcaaaacttaatgaaagaataactggtactattacatacctaactgctctgtgtgtgtttttaaaattactcttgaagatatattccttttaaaatttgggcgtagttatttaaacgtcagctaatacagagaaacataaacttttagaaatatgataaaattctcagagaagttttaaactcttgtcagttaagtttgttttacttatccagtctcttccttttacaccagccccagtcaccaacacaccaaaaaaacacgctacttcttttaacctgggaggggtttttatttatttcattttaaaaaaatactatacctccaggttgcctatggggctttgtgttatacattcattgcaaaaatgttgaggcccatgggtgaaaagtgttggtagaggtttgaatgtagattctttcatgactgcaagtcgtaaagttaccatgtgacctagtgttcgcatatgatctttgaatgttttccagagtatctctctgtcctgtggatttgaaagtcagtaggaattaatcaaagaaagccaccagtagactaggttcaacaaaaatgcaagtttcttaacaactaacattttttgaggactaatacgtgccaggttctctaatgctttccgtgtataaacttttacttactcttttaaactgtaaagcacttgagttattccttcatttatggatgaggaaatgaaggctcagagagcctaagtgacttgcttaaggttgcatagctagtaagtcaagaagcaacatttaagttgaggcaactgtaacctcagaacctgaaattctaaccactttgctgaacagcctctgtatccaatagaatagccgatgctaagacacacagaatagcttagacaattatagcacatttcagttttcaaacatgactttatttggtatattaaaatcttaagtgaaaaagattatttttttcttgtaccattctctggatttttatcatcattatcttttcagattcaatatagtagaatttcaaattaaaccacataaaactaattttatgtacttaaagccttaattactacagtacttatatttattttttcccatttgtaaatgtatacttttcccttcttgcccaatagttgataaaaaaaattattatttgaacttgtattaccattttaaaagtattggcaaattctcatttcaccatgattagagtagcgctgtccagtcaaacattctgtgataatggaagtgatctccacctatgctgtccactgtagtagctactagccacatgtctgttgagcactggaaatgtgactagtaccactgagaaactgaatctttaacttacatgtggctaattagtgtttggtatattggacaacacaggtttagaacatagttgtttttgcatttaatagaaatgccaacccatctttctgtcatcttggttatttgtggatccttacaagtgagtgtagatgaacggaatgctggatttattttttctcatttaagaattaacttatttcctcagaataagcatttataaacttagtgagcaaattattatagttcaataatttgtgtttaat

SEQ ID NO: 54743 - DNA, 1219 bp, Homo sapiens
aagtgtgaaatttatgaaaggtaaatatgcttaggtcactatcattttgggtatttaatcttacttttaaatgtattccttcaagaatgtcctgtatagttctttgttcattgcttcattcattcctttattcagtacacataattgagctcctaaaatgtgacagactctacacaagactatgggaataaagattgaataggacagagtacctgctcagggtgcccatattccagaagggggaagatagacatgtcagcaaacacatgaaacctgccacaaatcctttcattaaagttcagctggggaaccaagggaaagaatggtcatttccactgggatggggaggaagaggttcaaaaaggacttcaaagaggagttgaaccatgacttgagcattgaaaatgataaatgttcatcagatggattataggaggaagggtgttctgagtagaccgagcattgataagtgaagatgcagaggagtgaaaccatgtaacatattcaggataaggaagtaagttgcccattatgattaaatgatggaatgtggggttggtgataggaagaggggacattgtataatgatagatgaaactgaagaaatggacagagggccacataatggagagagtttgaattttatcttttagacactagggagccatcgtgcacttggaaataagagagaaacatgatacaatttgggtttaaaagaggttactttggtggtgatgtgaagataaatcattatggagcaagtggaatagaggcaagatcaattataagactcctatgataatttgggtgagggattttgagggtctgaaccaaggtggtagaggttgggatggagaaaaggatctgaaatgggagaaatttgaaaaattgagcagaatgtattgtactgattgcatgtgggaaatgaggaaaaggaggattggggatgacacgttaagtttaagcttcaatgccatggtagatgggttgtaacgccagtaatagagtcaggaaatgaatacagagggcaggagtacattgggggttggggtggggacttactgaactcgggatacccgtggcatttctgataaatgatagctgattggttattgtatgtgtggattgtcttttatctcccagccatgggggaaaatgcccttggatggtcaagggaccttttctacattttatcctcattttactcttttcaaagaca

SEQ ID NO: 54744 - DNA, 1054 bp, Homo sapiens
tttttcttttttttcttagtggtacatgatataatggtgatttttataattgatagtcatagattcagtgaaatagggtggtgatatctaccactcccacctccaccttctggttcccagatacttgttttttatggttgaagaaacaccaggtaatggtccctgagaagtttcttttgtgtatgagctacaagatttcaagacttttcaaatcttgatcttaggtaatttttgaagtaacaataatcactaatagtttgtctttaatgttcttgtactagctatcacgagttttatgtatctttgttattgttactattttgtgtcaattgccaagagacttaaacatcttttctaacatgttcatattctcttgattaattacattatgaaacaacatgcctattcattatttttatttggaatttttccttttttcatgatttagtgtatttgttacaaaaaataacttgaattcacttttctatataggaacatttttattgattttatgtctcctctttataatctctttcatatttcattatgtttcttctaaatttatcttgtttttttaatacataaatttgaagatgaaaaaggaggtactcctcatatacattcatgtattatacatatatattcatatacatatatatgtacacattcaaatcacaagtctgtcatttttaactttttaattgaaaaatccccaaacttcttgccaatcgtagctaaaactgtacattacccctaaactttcccttattcagatctctaaaatgcctggtgccactccattagcacctgacataatggaaagtgtgaagaaggggaagttggagagaaaagagacagcaatctcaaccaattgctattaaaatatcttacttttgcaagtcttacaaaagcatgtgtccttgtgaacacaatgctagaatctctcccagggtattagaagggttgcctgcacttgagaggtcctgaaatttaatctctgttagcttcacagtaaacctgctgtggccctcagatttcagttctctttgtgaga

SEQ ID NO: 54745 - DNA, 1073 bp, Homo sapiens
tatggattgaaagactcaatatggttaagatgtcatttcttccaataagcataatccaaataaaatcccagcaagattatatttgtagacatagataaactgatcttaaaatttatatggaaaggtgaagaaactgtagtagccaaaacaacttcgaaaaaaaggaaaaagggccgggcactgtggcttacgcctgtaatcccaacactttgggaggctgaggtgggcggatcacgaggtcaggagattgagaccatcctggctaacacggtgaaactttgtctctactaaaaataattaaaaaattagttgggtgtggtggcatgcatctgtagtcccagctacttgggaggctgaggcaggagaatagcttgaacccaggaggcggaggttgcagtgagtcgaaatgacaccactgcactccagcctgggcgacagactgagactccgtctcaagaaaaaaaggaaaaaaaaatagaagatttacactatcagatttcagacttactagaaagctatggtaatcaagacagtatagtattggtgaaagaattgacacatatataggtcagtgaaagagaatagagagtccagaaatagactcacacaaatatggtcaattgatttttgacaaaggtgcaaatgcaattcaacagtaaatggatatataaattgtggtaattccatacaatagaatttagccatataaatgagtgaatattaagatacacaacatagataaatcacaattgccatactatactaaatgaaagaagccaatctgaaaatgttgcatagtctataagtccacttatatataacattctggaaaaagcaacactattaccctaaaacctttatttgaatagcaggagttatagtcatgtcatttgtcctctacatggagcacatacatcatttacacattaaatatgttttcatgtttttcttttatttaacctttaaactctaaagtacatagttctgcttggccccaagatgattgtaagaaacatggacaatgaaattttatggctataggtgaccgtcttaattaaaaccttctcatagca

SEQ ID NO: 54746 - DNA, 1036 bp, Homo sapiens
acaaaacaaaattgacctatgtaggagaaattttatagatatagatagagaattcttacccagtaattgaagaatacataggaatatgtagaacacttacaaaattaataatatgactaaatgtattcaacaaatttcaaatgattgatatacaggctacagtatatcaattcttaattacttaactaccacaaggcaattaagttcaatcagtaataaaaagctttaaaaaaatcacacaaatgtatacatttggagatttaaacattttaaataacttaccaaataattaactcgtaaatttaaggtgtaactatgtatcagaacttgtggggtgcagcaaaagtggatatagagttaaattttaagtgctcaaattaggaaaaagaaagacattcatgatataagaaaacaagtttaaaaagccacatggttaatcaaaagaagaaagaaactgataaagacgagcaaagatcagtgggtggaatagaaaataaagatacatgagaatcaaaggttagtttatgggaaaatattttaaagtactaaatagaactatacctgttttaaaaattgaatcacagaatctttatgcagaacttaacaaaattaggactggagagttttacatacaagttttaggaaaccttcaaagaacaaaaacttcaatcttgtatggaattttccagagcattgaaaaagagaaaatactcttaaatgcatttactgattctagaatagttttacaagtcaagtataggaaaagaaaattagatacattttctctgaagttgggaataggaaaaggatgtccactgccattgtttctgtacatcattgtactgttagtcataacctgagcagtaaaacaagaaaaacgtggagagaaccaaattgtcattattcacaaatgatttgtgattggttacatagaagactcaagtgaatctaccaatgtgatttcagaattgataacagaatctggcaagattgccagatattaaaaaaatcaatatataaacatcgactatgttct

SEQ ID NO: 54747 - DNA, 1052 bp, Homo sapiens
agtagaagaaagattaatacagtaaaagaaagataaataagtagaagaaagatttataaactcttaatacaaaatatgaatgatattcttttaagaattggataatggtatactgtgactaacaacatactctttttatcataagcagtaacctagtttatcttacacagcagtcaaaaatatctaataaatacatttgttaaatgttaatagtgaaacattcttatagtggaattacctgaattatatgggatgaagttatgctgtgcctgaattttcagtcagttttcctaatgtttaaaataaactttaaaatctgatttttaaactatgttctatgtataaatacattgaaaaatttgaggggggataagaagtaagttgtgtttttatgaacttgtgaaaatgcataaaaattgtctctcttttttttttcatctcttgaatgtgggtgaatgttcctgcaaacaaatcttgggtgaacatgtagattcctttggtatgctcatttcctttagaatgcaatgtgatagactatttaaatcatacaaacagaaaaaatatataattgaaaatgtatacttttgggaataaattaattttttgtgtgtcctcttttttgtagtatctactttgttcaattatttaccagtagagaataaaatgtgtttcagaaaaatcattctttgaaggatttttttcttaagaagagttactaatcactgttagatgctttggagataggtacctatggtcacacagctaggaagtattagagctaatattctaactcagatgttccaagctctgaaaccatcataataatttaagtggttaaatgtagatatggcttatatattagaacacaataagtaaactaaataattgagaacttcaaactatatgctttatagggaattctgggttgaatgtggagcagtatttgaatctggctgtctctgtcacatcttattttattaattatctgccaacactttatttcagtggatagaaattttttaaataaccagagaagagaaaggcatttagaa

SEQ ID NO: 54748 - DNA, 1068 bp, Homo sapiens
atacataaaagaactagctgggtgcggtggctgactcctgtaatcccagcactttgggaggctgaggcgggtggatcatttgaggtcaggtattcgagaccagcctggccaacatggtgaaaccccgtctctactgaaaatacaaaaattagccgggcatggtggtgggcgcttgtaatcccagctactcaggaagctgaggcagaagaatcgcttgaacccaggaggcggagtttgcagtgagccaagattgtgccactgcactccagcctgggcaacagagcaagactgtgtctcaaaaaaaaaaaaaaagaactgtacgtatttacactaacatagagattatacttatgtctgtgaatctatgtaaacaagcatagtaaaagatttggaaattctgatgccaagattgtatctatggtttctgaataggtttatgagtattcattattcttcatcaatattttatgatatttttccataacgagcgtatgtcatttttgtaacaggaactattacaaaatgggtaaaatggcattaatctgcagataaatgcagctaaagagcttctacatagggaaattctataaacacttgaaatttgtgagaaaagtagatggagcctgttaactatagcagtggccccgatagacactccatttggcacatttgctttccaattattctcaagatcagacataattagaaagacatcaatatatttaaatatgggcaataatgattcacaatgagctaactattttaggtttatatttttcctcaacatatgcttccccataaatttatcagagcgttatttgaacaaaatatagagatttaataaatatttgaaaagtaacaaggttctttacatactttttaaaaaaatactttttgttcccaaagtacctctacttcatattagtttttatgcataatctactaattagaatgtattaactcatttttacagaaaatcaatggttttatttctttgcagtgagccccatgcacggttctatgcagctcagatagtgctaacattcgagtacctccattcactagacc

SEQ ID NO: 54749 - DNA, 1021 bp, Homo sapiens
ctaggcatgctgtggaaaatctgtttcataagattatggacctagagtgggccttaagaagtaatgtggtctaactgccttcctgttattgagcaagaactaaattataccagtgaaataaagaaaatttcattgtctataatattcttaataattttaggaagaagatttaatactctttcctaatatccaatttcagtatctggaaatcctctcctttgtttaatttaaatctgacctgatacatttggttcatttttaaattctgtcctgaatagctgctcagcaattgctttaaaaaaatttttatatgcttccagatcattttgaaattatctttgacttcattctcttttgagtaacttaagtaacaattgacattggtgttggtttatctcagggctacaataaggcagtggattggtgggcattaggagtgctaatctatgaaatggcagctggctatcccccattctttgcagaccaaccaattcagatttatgaaaagattgtttctggaaaggtaagtaaaacattttattattcctctcttattactgtatatgaattttaagcttcatgaattgaaactatattgtgtcataattattattctacattgggaaaaatatagaaaaatctacagttgctgctcttactatcataagaattgaatcatttcagtctcttaagaaaaaaagggcagttttataaagaaattaacaaaacagtaaagcaatttctgtatttagtatttttatcacaaagaacaggatcatagccataattctcgatattccttcaaataaataaaaatagtttattatttcatgtgtctatcttcatggagaaaagttttaggggctgttttatatgcccttccattttcaggagagacttcttgttttaattatgtccaatactataacattggaagtaaaagtaaatataaaatgaataagcctttttcagatggaaatttatagaattgattttaacagaattgttcatatagattgtg

SEQ ID NO: 54750 - DNA, 1061 bp, Homo sapiens
ttttaactcaagctggtatttttaaatgcacacaaagatgatcaatcaacttgttagattctctcctacacatattttgcctttaaaaaaacagaggaggtggtatttaaatgtcacattattcatgcaatgttaaggtttgagtctacaaattcatagttgaaagaaaagatttatgattcctgcattaactatgcctcatcctaacaatacatatgctgagtttctgtatgtagtctttaaatttcatgtctcagtgtcatgtactccatgacaagaatcagttatggtctctatagcacctttgtctggctgcgttacccatggaaatatagaaagtttatattgcagtcaaaaattatacttgcaaataaggtactcaagtaacagctactatggaaaccataactttagagcccttggcttatgtaatttaaaaaaattcttagcttcaacatatctaatgtaaatattgttccactcctaatgagtaacaatatataaggagacatgcaacatagagaagtataaacataagtatatactgaatgatcaaagagttggttaatttttcctgaagggaaattcaatatttacatgaagggtaattgattatcagcccaattgctattcctttctgtctcaggagtccccaagactgtctccaggtttgatgattcaccaggaggactcaacaagattcagcatacagtggtacttgaggctaagatttattacaacaaaagggtacaaagtgaagatagcaaaagtccagaagacaccaggcacaagctttcaagagtcctctcccagggcattcacaagggatgcacataattccttcagcaacaagctgtgacaagcgtgaaattttatctaccagcaacactcattaaatactcaatgcccaaagttttcattgggggttggtcacatatgcaccctctgcctagcacatgccaaaatcccagcctcccagaacaaaagtagttgttcagaataaactatgttgtttgtaccaacagtgtaggcacagtgagccactctaatcctttagggaa

SEQ ID NO: 54751 - DNA, 1101 bp, Homo sapiens
tactgtgaaaggcagtgtgggtttttacaaccatttttagacttcctttttgatagatctcttttcaaaatgtacatactgatttccttcatatgctggttcttctatttatattacaaagttaaatttatgtatctttgagacacaggtttgtaatgtatgatccaaagagattgctcttaaagataggtgaactttctgatattttgcaaaagttctgtaggtgtgcacatttttctggagactgctccatgttcttaaagacatcataaccaaagcaaggccctaagagaacaggtttagttcattcacccaagtaattctcttctttatggctactgtggggactgtaacatgtagttaaaagtatgtgaaggtcatcgctccatatttttgtttatataatggcttgttgccttgaaaaaaaaactttatgaaatcaaaacagaaatatcatgagtcttagaatgtgtgttttaccaaatggtgtgtttgtgtaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggtgagactttcttttttaatttaaaagcttttttaaagttggtgtttaaattatatgtggtggagatattttcaacttaacacatagttttaatttttttaccttttgaattaatcttgtgcaggatctaaagtactttacagcccataacttaaaaatgagtttccccctagaattttttttttttttttttgaggtggagtctcactctgtagtccacgctggagtgcagtggcacaatctctgctcactgcaacctccgccacctcagttcaagtgattctcctgcttcagcctctcgagtagctgggactatgggtgcatgccatcacatctggatgatttttttgtatttttagtagagacagggtttcactatgttggctaggctggtcttgaactcctgacctcaagtgatctgcccacctcggcctcc

SEQ ID NO: 54752 - DNA, 1047 bp, Homo sapiens
attctttttcaataccttatttgtgtgtgtatcttataatagtatagtcatacatctaaataaattgtaagtaaataactatatatatgttgattatgtgtactagaaaatgttttaatgaaagggatataaattaaaaacccttggagagctctgggccagaagtggagaatcatgaatatgaaacctgctttagccgcttatcagtcatgtgaatttggtcaatcgactcttttataatctgtaaaatgggagtaagaacaccagtccttccttcctcacagtgttgtactgagaacagaataaagcaactgtaattgtttgtaaattctataaaggctgtgcagattatgattttttttttttagcttttaaaatcttttcctcaaatgtattcagtacccacatttaatctttatagaagaccatattcgaagtagtgggaagacattttacttttaggatcaaaggagaaaaatgtttaaggtttaacaattctctaattctaaaagagttatatttctttccaaactctcagaaagttttgatggccagatattttaaacaaaataaacttgggaattaaaaaaggaaagcaattaaaagtaagtctgagatttagctgtaacttgaggagaaaagaatttttacaagagggataggaaaagataaggtcttaaaaacaaggaactaaaaattaagactgaagttttgtaaccttaggagccaggattttgatgccaacagttaattatcccagaaatttctttttttttttattattatactttacgttttagggtacatgtgcacaatgtgcaggttagttacatatgtatacatgtgccatgctggtgcgctgcacccactaactcgtcatctagcattaggtatatctcccaatgctatccctcccccctccccccaccccgtaacagtccccagagtatgatgttccccttcctgtgtccatgtgttctcattgttcagttcccacctatgagtgagaatatgcagtgtttggttttttgttcttgcgatagttta

SEQ ID NO: 54753 - DNA, 1452 bp, Homo sapiens
gggaactccctgaccccttgcgcttcctgagtgaggcaatgccttgccctgcttcggctcgcacacggtgcgtgcacccactgacctgcgcccactgtctggcactccctagtgagatgaacctggtacctcagatggaaatgcagaaatcacccgtcttctgtgtccctcacgctgggagctgtagaccgtacctgttcctattcggccatcttggcttctcctcttatcccagaaatttcttaagtattttgttgacctgcatacttccttgaatcaaaatgttgaggttaatagctaacctactgcttgctgcttcttctagcactattatattttaggaacctaatggcatctaaggatttcaccgtgtaataacagtgggaatttatttttcttggtgtttggaaactctcaggaatttttttttcctttttcttatttttctctccctctcaattataggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtatt

SEQ ID NO: 54754 - DNA, 1088 bp, Homo sapiens
gccaggctttagcatttcggagattaaaaacaaacagcggcgacacttaatgttcacgcggtggaaacagcagcagcggaaggtacgcgagaggcgggggctgccgggcgcttgcgcgttgttcctgacgcttagggcggtcgcggggcgcacatctgtggttgtctgctggtctcaaaagtgttctctgtggctccgtgggaagggtggcgtcgcggcccacgtgttctggtcccctcgccctagtttggagactctaggttcagccttttgcctgagcgtcaaggtggaagattatcttgataggctctttcctgggacgctagattcacaaggaaagctgtaaggccagttggcttagtagtgaaaactacgccctcctggcccagaaggcaaaagtctcagccctttggtccgtctaggtagcgttggttaatttgcagaatctgaaatggaggcaatacgtaataaatccaaaatactgcttctctgattcctgcaggagctccttaccgaaattagtactgtaaagtttctggtaattgtatttgttcttttcagctttatccttatacgtttctggtaggtaaacaaactgaaacgtaaagaggtttaaacgacttgtcaaggtcgcagtgctcatttctggttaaattgcaattggaagaaaacgtttgcttattcttgcacatcgtagaagttcacacaatattattattatgtgtctgcctcctcttactggcccttctgaggcccgggactggttcttactcatgttcagtgtcaaggtgctgtttcaatacatacaaggggcgtttaactcattctggtatgcacgtattggggagggatgtcctggaagacttattggagctatgatttctaatctgaaacctggtggattgaggatcagtaggtgctggggaaaaaagaatattttttattttgtcaagcattctatctagaaatctccagaagaatatatagattgacaatacaaatacagataatcttaagccaccttgcaagctcttactaaattttagaagtatattttgattataaaatatgtgaataactggtgatgg

SEQ ID NO: 54755 - DNA, 1819 bp, Homo sapiens
atctttattgaaaaaattttttaaactactaaatgctcatacattattgcatagctaagttatttttattttcagtgtatttatagttactcctaggttgtgatttatttttgcaaaattttgaaaacattcatgtctccgcctcccattcaagtaagttaccaaataagggtgtttgaggaagggaaaaaaatgtaaagacagtatacaaactaaacactctactatttcatacattctttgaatagtattaggttaaaccatagaaaattgtcaatagtagactgttttgacctgcagtatcctagtatgtcaagcatgttagtctctttttaattcttttgtaatcagtctattacagcaaattaatgttatgatcaccatttgaaaacaccaccattcttgttttttgagatgaaagataacttcttaaaattgcctcctttaaaaaatgcttaaaatgtaatatttgtttcatagagtaataaatgctagtttcagtttgtattttcttcatagctctgctagtgtacatatattttgaattagttttaatgtactcttacaattctgtgttctacttcttagcaattcatttacaccatttcttggtctaagctgagtatgcatgattgctgatcctaacagtattccataatgttgatgtactgtagtatgtttagtcattaccttgttgaacatttgccctgtttgctgtttatttgcattataaatagggatactatgtatttcttcgttcaaatttctcccccatttacattcctgaacataaataccccaaagtaaaattactaggtcaatggataacaactagacttttgttaaatatttctgagtagcttcctgaaagtattggaacaaagtcatgtacggatgtcgctttgttatttttttcttttatttttctcctgtttgatgtgtttccccctagtagataactatcttgatctctatttcttctccttgttacttctgcacagttttaagccttttcattcagtgttggccattcttctagtatgtgtgtgtctctgcccagattgtttaaaaaaaaaaaaaagcctcttattcaatattgttattagaattgatgtagcaatagaagtggattgatatgaggaacagattgagtttggggttatttgtagctttctgttatttttctccaacagtaatataattaatgtaaaatccttctaaaatgtaatcccttctcttttacttaggctccaccaaagcctgtacccaagaccattgacaaccagcgagtgtatgatgaaaccacagtagaccctaatgatgaagaggtaatgttagaagtcttaaattagtttgaatgatcacatataattgataaattatatgtttttttgttgatatttaaagtgctggctggccaagttgcataatggactgattcagctaaaatgttggcatattatcttattatttggtgaagactatttcataattgaatttcccaataatgctatagaaaaattctataaaaattctaggtaaacttttacatttgtcatataatccctgaatggtattttggagggttttgtttttgtttttgtttttgattttgttgagacagagtcttgctctgtcgcccatgctggagtgcagtggtgtgatctcggctcactgcaccctctgcctcccaggttcaagcaattcttctgcctcagcctcctgagtagatgggattacaggcacctgccaccacgcctggctaatttttgtatttttagtagagatggggtttcaccacgttggccaggctggtctc

SEQ ID NO: 54756 - DNA, 1050 bp, Homo sapiens
aatgtccacttttcgttcctaatattattttattttggctttttctcttttttaaatcagtttttaccaagatatctattctcttagtcttttctgagtactttcttctttgatcctgttgaatctttgttttctaattcatttatatctccttttatctttattattttcttctgcttcctttgagtttattctgtatttattgatttgctcaatatatattttttctaatatgagcaggtatagccataaaactctttcagactaccacttttggtatattccacaaattttaaaaggtactactttcattaatgtttaaatctgagtgtctctcaatggaagatttgtcttctcgtaatttcattagttttttttggttctttttttgtttgtttgttttgttttttttgtggttattgtttttactaaccaagttgatgagggaaatgaaagtagttcaagagtaaacacatctcagtttctgccctgaagtgatttctgacaattttattcagttttgtacttgtattttacacaggagaaatccactcatccattctcttcacgtgtccattaatgtcagtccttcctagtctgtctttaaagcccctatcagctagatactcagtgtccaacagtcctgctgatgctacttttagaattctggcccagtagagtatttctttgatgtaaaattattcctcttctctgttctcaggtcgcttatgatgaagctacagatgaatttgcttcttacttcaacaaacagacttctcccaagattctcatcacaacatcagatagacctcatggggtaaacacattgattaatttagttcttgaattcttaattttcttattacttctatttaaagtactctgttcagaagagttaaaccattagttaattgccttaaagaatgcctgtgactaagtaaataaaacgtagctctggtaatatgatgtaggtttactaaacatgattcttcaagataggatttctcaacctcaacattgttaacattttagctggagaattctttgtta

SEQ ID NO: 54757 - DNA, 1037 bp, Homo sapiens
gctgacctagttggggatctgcatatggtttgttgtggctagattttacattgccagaggtggtatcacaggattaagtttttgaggtagagacttgggcccatgttatgtgtgtgttccagtctaaaactttttctgtgagtctcagacctgagatgaatgtgtcacctgaacccaaggtatttcttcctgttgagataagagatttgataaaggatatctaggtttgttattattgttgctgttttatttatttatttattgaatgatggctatgagttcagtaaccttaaagatgaccaattgaatgagtcatctttatgatttttaatttcattaaaataaaattataaagaatttacaaaatagggacaagactttctgtgctgccagaataacattttatttctaatatcagtgaacactctattagtggtttaaaaggctgtttttaaaaaatctaacttttatgactttaattgttatcaatataacttactttatccacttgtactagtagctttccagaaactactataacaagctttgtaatgtgttttgttggccatattataatttggcttaactggattaatgtaccaaaatatctaaaatctcttgaatacttaactactccagaaaaaaattatttttaaggtagttgctgcctctttttctttttttaaactgcctccacaaagtggcaaggtctgttttcctctttttatttttggcagttaaaaaacaactgtcatcactttgaggccactagtaactctgctaagaagcaggcattcatcaattcaataaatgttctatccctgttttatccagggtgttttatatagtcacacaaatttcacttataccatctattgcctttaaaaagtttacattttctggccggatgcggtggctcacacctgtagtcccagcactttgggaggcctaggccagcagattgcttgaggtcaggagtttgagaccagcctagccaacacagcaaaatcccatctctactaaaaatacaaaaatta

SEQ ID NO: 54758 - DNA, 1012 bp, Homo sapiens
tacctaagttttaacagattagttgggaagaaaggtgttttcctaactcaaaaagtgatgagtgctgtggtagcagaactgagaagatttagatcttaattctgactacataaaaaggtgacatttgaagtagaccataatagatgagtaaaacgttgcaggtattcaaaatagcagaagcaaaaaatgcatgctaggattcacatatatagtacataagactgtgagtacctaccagttaggaaacaggcttgatgtgggcatagggtaaataggttgaaaaggtaatttgtggccacattatgagtctgatactaatgtcttttttctgtagatgagtctgtgatgagagtagtatgaaattagctacagctgtcaagactgtgaaggtatctagtttgtttttcacttagcatgtgagaaactatggtacagatataatgaaacagctgagtcccatagctggttacttatagaaccaaggcctaagtccagacttgattttacaatctgcattaggagatgtacttgagatggtgagaaaaaggtcagaccaaccacaatactaccttaataatctaggtggaaaatcttgaggacctcactaagacagtaagggtaaagaggatgctaagtgagaacttctgaaggtaaaagcagttaagatttggtgggagagggagaagctgaagataccatagcttctaatctggaggaatgagtgttgatgccattgtaaaaagatggcaacatctgctttgaaagatacatattaaatgcagatagacttgaaaccatctgattctggcctatttaagttgttgaatcagatgaaatgtgtttgaaaatttctcctaaactagaaaagcataatacaaagtgaaagccctgtccattgtcattaatatgcctgcttgtaatgccattaagcaatagccaagaattactcatgaaaagtaaaggtgtttcaagtgaaggtcagattgtgccacaaacttgaagaatattatat

SEQ ID NO: 54759 - DNA, 1102 bp, Homo sapiens
ctccacctattctgtacctacacctgagcagctgaacatggctagagaaaaaaaatgtataccatcgtaagtaccattctcactttaaattcatgaccatgaatttcaagtggaatctttttctggtgggcagtcttactatctgccactcattaattcagtctttcactcttctaaacaagtatgtcataccatctcagacccccaataccttctctctattttctcttaaaccaactgcggtcaagatttcacctccattattccaccaaaactattctcattaaattcacctttcattactaaatctgttggttaattcttatcctaaacattcttgatctatgtgtgcacaacagttgacaccattaatcactttctcttccttgacataggcttcgctaggcttctagcatacatattatgtttgttttcttcttacctccctggttgttcattctcagtcatctttactgggccttcatcttcctcctgacctcttaattttggcatacatcagggttcagctctttgttctcttctctacctgcgctcattccttggtgatctcatctagtctaacagatttaaataccaactttatgccaaggatttccaaatttatagcctcatctcagtcctctttcccaaattccagattcacgtaggcctatattcaactgactaactgacatcgccacttggatggccaatagatatctcatcttaatatgtctgaaactggatttttttcccttccctaaaacttgcactacccatgacttttgccatctcaggtgatgtcaaatctatcctttaagtatctgaggccaaatgccttggagttatacttgattcttcttgcatacttgagtcttctacttgactcttctttcaaactccacttccaatagattgactctgactcttctacttgactcttaaactccacttccaagggattgactccagcttttaaatatatacaaaatctgactactttttaataacctttactgctagcacgtgagtcaccattgtctcagactgtaattattccagtagcttcataacaagttctcttttcttgcctcttatagtc

SEQ ID NO: 54760 - DNA, 1062 bp, Homo sapiens
gaattctgattcaataggtttcatgtggtgtgggacccaggaatctgtattttaaaagctccgcaagtgattcagatgtacgccttggctaataatcactggctaagggcaaggaaagaatcttaggacatgaaaaggagctcaagtagaatctattaggaggctcgtttctgtaatctttgccattgttaaaagtgccataagcaataatacctagaaagtacagatgttccttgatttatgattgtattgtgtcctaataaacccataaacatatgataagttgaaaatgaacgaaataccctgataaatccatcgtaaagtctaaaaattgtaagttgaaccattgtaagtcagggaccatttgtatcaaatatagaaccatggaattatagaataggaaagtgttatgccctaaaatttttatttcattgtatcctttttgaataattggatttaggaaacttttttccctcttactgtactgtatacttcttttatttttccctttcctgtggtgctgaattgtactaaatactttaaaatctccattttaatttatttatataggatcctgctggccactttcatcaagtatggtatgataaccctcagagtatttctttaaaggcaacatatatacaaaactatcgcttacggggcattggcatgtggaatgcaaactgtcttgactactctggagatgctgtagccaaacagcaaactgaagaaatgtgggaagtcttaaagccaaagctgttacagagatgaacatcttttgtcaaaccattaagagttagaaagatgatctgtatcaacagatctagtttcttgcatttttattatgttgctatatacttttgttatccgtatactaaaaaaaaagaataaataaatgttttgattgtttgaatttgaaaaatacacacgaatgtcctcagtatccaggaacataaaggcaagaagcaagtcaacttacctattaaatattcctctattagatgtttcaacactataatttaattgggaaaaattgctttcagaattttattatgccatatt

SEQ ID NO: 54761 - DNA, 1031 bp, Homo sapiens
ggtcacagaattaaagagctacaaataaatgccttgaagagttctttctacaccctcatttttatagatgggaaaaattcagatgctttaattgacttagcagtgatacagacctaactataagatagctgacactagcacccaagtcttttgctttcttgtctaatataataatagtaccatctcaaaaatatgagattaactgtgagagaaaatcctggtgaaaacactcttacaaaatggattggaaatttacttgcttagaggtagtcatttatttttctctattactataatatacctctcattttgtaataagaggcagtgataaaataggaacaaatatgtaataattttatttcataacttattttgttggaaaactactgagcaaagcttataattataaagtgctaatattcacggaattataaagggaactttgaagaagtcctaaaaagagttttgctagaataaattgttcaaagtataaaaatgttacctaaagtatctcagtttttaaaataatcagtgtttattgagtgcctaattaaggggggaaaacaacctttaatgaagttttagaacatttgtacatgtataaaataaggctaattaatatttggttaaggcaataaacataaagagacacattcttgttgaaggctggctcactattcaaaatgaaagataaggctgggtgtggtggctcacgcctgtaagcactttgggaggctgagatcggcagatcagctgaggtcaggagtttgagaccagcctgggcaacatggcaaaaccctgtctctactaaaaatacaaaaaaattagctgggcgtggtggcgcatgcctgtaatcccagctatgtgggaggctgaggcaggagaatcacttgaacccaggaggcagaggttgcagtgagctgagattgcgccactgcactccaccctgggtgacagagcaagactccatcccccccaaaaaagaaagataatactcaacatttatttgaatatttccgtaaaataagatc

SEQ ID NO: 54762 - DNA, 1684 bp, Homo sapiens
tttaatccttttcccactgcagctgaaaatatttttctaaaatgcataccttccccttttaaaaatgcttttattctctccctttacctcaggataaacaaggtagtactaacttctcaacagagcttatgaggcctttcatgatttaatccatgcctactactctctggtccttcactaatgctctctccccaaattctagacgtcggccatactaaatatttagttacgcaaccaccatgttgtctctgcctccaggccttggcacttgccactcttccttcctggcccatccttcccctctttcccagcctggctaattacccctgccaccaattatcttgggacccctatgtcttatgcacttgtactctcactgccaccatagtgtttggtgtatggtgatgtttgatgaacggtattttggacggtcagcataatattcttggtttaaatgatggtgctcatctttgttctggcaggtctttgtgtttgatgttggacagaaaacttggaaatcttatgattggtcacagattacaactgtggcaacatttggaaaatatgactcagaacttatgtgctacgctcattcaaaaggagccagagtagtacttaaaggtatgttgtttccagatctatgtgtgcagcaattgggaaatttatctgtatcacttgctatagtcccgactttccaaaaaagtccttttatgtttatctgtttttgttaggatcctataattaatcttagatactgtgtaattcatttcacaaacacagatctttttaaaagaattaaaccactgtatggttttgagcaaaatgttaactgccaaattagccttatgacctttacttaatcatagtccacaatttctgtttctaacttcagaacaattttactaatgatttataatggttattttggagattcatgagtaatggctttctgttactttggtatattctttctccattggaaaacttcagttaagggcttagtcttccaaaataatgaaatgtttttgcatacatgttcaaaagatatatacttcttccacaggagatgtatccttaaaggatatcattgatcctgctttcagagcatcctggatagctcaaaaacttaatttggccaaaacacaatatatggatggaattaatatagatatagagcaagaagttaattgtttatcacctgaatatgatgcattaactgctttagtcaaagaaactacagactctttccatcgtgaaattgagggatcacaggtaaaaactcatttattttttggaaacctcatattttccatatcagaatatactcatgagggtataactaatataatctttgttttatagtaatgcaatgggaaagagtttcagcacttatttcctaaaaaatttttctggagcctttggtgttcttatttaaggaattttaaagccctaaatctattctctattcacagcaaaatacaacactgggattacccccactacttgccttgtagcacagttagaagtgttaggcaatgggagaacaaaaatcaaggggggcgcctaaccagcttttaccaatgcaggacagaaacaacccaggagtagaggtagttctggggaagtgtatcacttgctctacagtctctgaattacttgcacccaaggcccagtaaagcttaaa

SEQ ID NO: 54763 - DNA, 1075 bp, Homo sapiens
tacaaggagagtattttgctaggctctaaggagataaagattaatgagagagaccaggtccagtaaggagttaactacttaattacaatggtattaaggactgtaggggttacagggggccacgccagcatataaaggggacctgctagccagatggtgcacgaaaacttttctgaggactacacactttcggagtgggctgaaatcagcagaatgatggaagagatatacctatggacaaaagattgcattctcaactgagggaagggaaagcccaaaggtcgctacacctcaggagaattctgagattctggaactgaaaaaggtcaatgtaggtagagcacagaaatcctgcaagtatgtggaactggataaaacctttaaagtcggtagtggaaagattaagtaggacttccaagaccactgaagatgttgtattttatcttgggatcagtgggaatcaattagagttttaattcaggggatatgcattacaaaagagatcactgggtccttgtgaggggaatgaatgagggagagacagtggggatagcagctgtaaaagttaaaccaggcatttcttaattttttttaattttttttaacttttcagaattaattatgcataactcattttttctgctaagcaattgcctactgaaataataaaaattcataatgtgaaattaagtggcccattgttttctgactcatatttctatcaaaacttctattttagttctgataattaagattctatttgtttaaaaaatactaagagcctgtgatataacagatatccttaaaaaaaaaaaaagctgggtgaactaattgaaaatataaggggaaaatgccatgtagtctagtttttgtgtttgaaaaacatagaaaacgccagtagagaaaaagaccatttaccatgaagatacaaataagcataattttgcttctttgaatagttggttttcaaagtgcccacagatattgcctaacccactaagtattgggtactacagtaaatctttcaggttttttttttttctcttttttgagacatagtcttgctctgtcgccc

SEQ ID NO: 54764 - DNA, 1031 bp, Homo sapiens
ttcctcttttcaataaccagtgaggtaaggtaattttcctagggccatatagctgttaaagacttgacctggagtataattcaagtattttgattctgtccgaaattaaaggtactgaaagtgcagtaccaataccaatggaattgtaggatgataaagatcaatacactaagaaccagaaatgttatttgcagacatgttatctctctgtaaaattaagtctgattaattgacctaacccctgccttatgaggatatatgtttctggctgcagaaacatgtggagcacattgaagcctggcagttcttttaggccatcattatactattgtgcacattactgaaatgcagttcttaattgccactaccatgactgtcctcaccacagttggcatcaccatcaacttcactatcatcatagtctatatggcaattaaagcaaaattctaatattttaaaatcaaccagaatacaggacagtcctgttcctgactccccagagtcttgagccctgtggaagaaactgacattccaaggtggctggtgcatggatactcttatgggttgaatcgtgtgtcccctgtccccctccaaattcatatcttgaagtcctaacctgtagtacctgagaacatcaccttatttggagatatggtattttttttttttctttgagatggagtcttgctcttgttgcccaggctggagtgcaatggtacaatcttggctcactgcaacctccacctctcaggttcaagcaattctcctgactcagcctcctgagtagctgggattacagacacgtgccaccacgcccagctaatttttgtatttttagtagagacaggatttcaccacgttggccaggctggtcttgaactcctgacctcatgatccgcctgccttggcctcccaaagtgctgggattacaggcatcagccactgtgcccggctggagatatgctctttatcaaattaaaatgaagtcattagggtgggttctattccaatgtgactggtatccttataga

SEQ ID NO: 54765 - DNA, 1037 bp, Homo sapiens
ttatatttttggcctagatttttagaattaaaaggaacttattttttttgaagagtgccacattatgaggttaaagtacaaaagaaggagaggatagtcactaagatctgcctttcttttcccaacagttcaatcaatgtactgaatataactgctgaagaaattaaaccaaatcaggttggaggagaatgtacaaatcaaaaatggagtgtggcatcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaataacttaagatggtctgagttgtttgtttggacttccctgtcttcccccaaagagttgaaatcttaaatctatttaaaaggatataaaagctttggatatgtatttttagtaacagaagcatctggttctgtgaataaaggaatgtatagatgtttggatggaaacaaaagcactagactgagtttcctcttataggtattaaaaatagcacttttaggaaactgattattgtaaatgtttaattttgtctcaaatatagttggcattggaagtttagcctttacttgaatgtatactgtagatttttaacaaagcgagttctatatttattatgtttagtgtggtttgaaattacctctttcatatgttttaaataaagtgaaatttatgtatgttttgtacatagatacacatgattatgttaagaggctttaagatttaaaagtttcacacaaccataagtatagtatttcatgccagtaaaatttttttagtggtattctgtttacagatgtattaggaccattgatgcattacatttaagaattctctttaatacatctgggcaataaatattgaaaggtattccatgaagctgagttctttagataatcaacactactaacattacatttttgagat

SEQ ID NO: 54766 - DNA, 1065 bp, Homo sapiens
taacttttaatgtatttcaagttttcttgtttatcagttcattgattccctgctatgaaagataaggaattctgtgtccttattgtacctcctacctacacccttcctcattcacatctcatgtcttcataatattgttcctcttgttcgtctgcttgccttttttttgctttaaggaaataataaaaagcttccatttcatgtttgttcaacttcagtcagtatcagttcatccctgcagtgaaagctgaggactttcttgttgttactcttgttctacctctcttgctgtactactttgcaatttttgtgatattatttttcattgttatcacattcatagtttgtcctctaatacaatccaggtataagtactttgtctaaacttgagacttaaaagttggaaaaccaggaaagaaaattgataatactacaattatgtaaatgttattctataaccaaatatgtttggacacagaaaatattctgtattattaagactttgccacccagagagatatatcactatctagtgaattctttttctctgtagcttcctttgtgatttcctgaatcagatttcagctgccatgttgctcatatctcatgttactgtctttcttgggtttctgttcaattcgctatattagtaattgagtaattactaattcttgagtaattttttttttataaatagtgcatgagctgtaaacattctgaattctggaatagtcaaaaatatattcatacttgattggtttggctgtgtatagaatttagattccagttttttttccttcaaaactttgaattattccatttctcctagtgtttagttttactgatgagaagcctgattgtaatatacctgtgttactttgtagataactgtgttttgttttctatctccctctgtggaagctttggtattttcttaaagtttggaaattttaccaggatacttctagagagttcctttcatcctaaagattctgtatttctttaatttagggaaattttcttctttattttttccttctttgacttctctgtgttctggaactt

SEQ ID NO: 54767 - DNA, 1244 bp, Homo sapiens
ttcttcagacttagctccaaatcacttttgcttctttttcaaagccaagtatactctcgaaggatgatgacattgctgtacttgaggagatcttcaaaagtgtggtatagaagtgttaaaaagtattaaaaataaactttaaaaatattcaggggcagcatcatggagtgatgctctttccagggatccattttgaagcacttttgtatatgtgtacaaaatttgatatgtagattaaaatttgatgtgtaagtttaaatgttattttatagtgtgctttgtaataattcctttaaataaacatttcatgtgccactaacatttgattttgactaataaacactaggatgtataacttcttgttactgatattttaaggattcagttattctaaatcctttattaattttaagcaaaattgcttataaatgttttaggaacaactggaaacctccaggagggaaatgattgggcttcaggaaagagacagacagttacaatgtaagaacaggaatttgcatcagctactaaagaatgagaaagatgaggtgagttgtcagttattgcagatgaagtttaagtgaatttttgttttctttgtaatatgagatgaccataagagccactttacttgaaaaaagaaagaaccatttattcatctttccccaaattgatatggtggacctttgtgtaatagtatttaactggaagctcaggaaccctctccactacagaccccgcccccagtggatccatttggcttagatattagttcatagctggtaacagccagtgtcctggactgcccttcctggactcatgttcactgtcactttttcttaggcacaagagtgctttaaatgcagatcttttattctctgctgtacctgtacgtgatagctgaggtgccccttcttgcatgcactgtcttaaatattgacattgttcgtctagtcaaccagtttcttcattaaatgggcacagaagcagttcacattaaaaatctaatttctgacacaaaagatacaattctgatttctgctttagtggttacttagcagaattctaatttctactttagtggttacttggacctatagcactaatgcatttcaaaatatattttttaatttgtgtagaaagaaactattatgtttttattgctctaaagtatgacccctgaccatgtaataactataaaaatataatacttagtttcagtgttttatatgttgttttaacta

SEQ ID NO: 54768 - DNA, 1039 bp, Homo sapiens
gattggatgactgttacagatccaggtctgtcttcaggtaattaagtctaaataattgtaaacaaaagcagaaactgtaaaggtgaatttttcaatgaaaatataaaataattactgcagatgttgaagatgtgactaaagagagacaaatcgttgtaaaatacttattttcatgtctactgagaacaccactgtatttgtatctttttggaaaaaaaagtatatcattttcataaagaggctttgccctaatttgaaaataccttaaaatatgtatgtatatattatatctatgtttatatgtatatatgtaattcaaagtctttagtaatggcgattatgttagctttacatacgtttttctaaattatttatatagatgccttttattctttcagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggtaacatgtttttgtaaaaaacagtagcataaatcatgttatataatagaatgtatcaaaattatgagaaaaacatttgtcaaacacaagtttgttgtttatgtagtgcccctgagacttagattttcagagaaccttggtgattatctcatctagagatagcaagtctaacttttttgtgtggagcaccttggcctcctcattgtcccaggggctcctccactgagagtccagccatcactttatggatgcagaaacccaagtgccttgctccatgtcacagatttatagcagagactaaaagagccccgtcctcttaactctttgtcctttgggatattgaccattttcttaactatttcaagatagttttctatttttctaagaaaagatttctatcttttgattttttttttactaagttgcccagtaaccaaccttttaaaataattcacatttatttttaatttt

SEQ ID NO: 54769 - DNA, 1162 bp, Homo sapiens
aaaagacacttaaggcactattgtcttacttacaaataccttaacaagaacacaaattggaaaggtgcctattactgttttcttctgaccttgttttttccccccaaccagttgattatgaaattagctcactgcttactgtgtttttataaagatatctgtctctagatcatttaagaatatgtgttcaacctttattaagagcagcggtacattttgttataggttttagaagcctgtcatttataccaaatagccctgtgtctagataataatgatgatgatgattaatattagcttatgtgtgtcttctatgccaagcagtgtgctaaatactttatgacttatctcttgggataagtacattataccttatctcttgggaaacttaggaggtatgcttcattgttacggtaatttatcagagaggtatggctcagagaggttaaggaatttacccaaagcagagttctattagaataggtttattgtcccttggattctgttttacttatagtgattatctcagaaagctagaagtaaaatcagtgtctttcttagttggtacagtctttatccttctcatcctgttgctaatacccatttaaggacagtgggaagaacaaaatagttcaaggtgcccttccttaccaagcacatgagtagaaaagtggcaaaagaccattgccagactgaattacctcctgtgtctgtgtgtgtgtgtaacatcataacatgtaatatgacatgtaacatcatctgtcttagtatatattatatgcttctctacaacttagaaatcatccttgatttcttttttgcccacatttcaatccatctttgagttctgaaggttctgtctccagaacacatccctaattcatctgcctgtttctgcttccactgttagaactgtagtttaacactggtcatcttgcctgaactattgtagtagcctcctgatttcttccagcttctacaattgcctacctatagtctactcacagagtagccacagtaatctttcttaaagcataaaagagaacatgctactttcctacctacaagaaacacatcaatagattttcattgcagtttagaggaaatccgacttcctacgctgtagccttgcttactgtgcttcaaatatactggccttctc

SEQ ID NO: 54770 - DNA, 1349 bp, Homo sapiens
gagatcagcgtgggcaatgtagtgagaccccgcctcttaaaaaataaaataaaagctagggacagaagaatggactaaaattgaggaaggctgtgaatggaggctaaagatgaacataaagattcatctctgcaaagattggtttttgtgccccctgtctggtgaccatgacagatgacacctgctatcccagtgctgcttcctgcagagcacggctgtggtcactcttcaacaaagcagtccaacaaccagcacacatttgattctcctttgagtttttgacagagcctctagcctgagcatcagaacacctgggttttcattttggacactgccattaaccaagtgtgtcctgtgacctctcctaaacctcttagatggaccagatgacctctgaaacctcttccagttctaaagcgatgtggttctttggagagagatgcttggttgaacagatgcagagttaacctttaccttcctctattgcagtgaaggaggaaaattggctgttctagtaatttataaggccttgttagcgaagggacacagagattctttttttttttccagaaacaaaccaatgtatttattgagtaaaacctaaatgtaacatatatttttctttttttttttttaattttactttaaattctgggatacatgtgctgaacgtgcaggttacataggtacacatgcgccatggtggtttgctgcacctatcaacgcatcatctaggttcagctctgcatgcattaagtatttgtcctaatgctctccctcccctttccccctaccccccaacatttccccgtgtgcgatgttcccctccctgggggcatggaggttcttaagagacaggtgactcctcacagtgtttccaaaagcatctgctcaaacctcaaacagtgtacattgcctttatttatttatttacttattttttctgaatgttggtaaataatcagaataccttgcctgtcttaatttttcttcctcttctatgtttcactcaacatgtctataatctacgggcctagaatatagagtattcctattgctcctcaaagatgttaaagtattgtatctttcctcttttcttctttccctttctgttacaggaaaagaagtgatgatcacttgatacctattagctaaagttctgctaaagatgattaaagttcaggcatccttatccagcggctgagcagaggaaccccaaatgacttggacaagcagttccaaaatgactctcttatttaattgtggagtgggaaagaggactcacagttagccagctgaccatgactgaagttccagctttactttttataaacttgaatgataaagaa

SEQ ID NO: 54771 - DNA, 1042 bp, Homo sapiens
ctttctttaaaaaaggttttgctggctagcctataataattgtatcccacttcttatactacagtgttaaagtagaactctgaccttacaggagatagtttaaagataaatatgtatttacattgaatatcacctgaattaaacataattctttaagggaggaaagaaatgcaaagagtatgtggcttcagactttaattttacagatcaggaactagaaggtcagaaagtttgtcacagaaatgaggcttgaatctagaactctaatttgtgagtgccctttgccttcctagtgcacagcagcaagtcacttaccctgtttatcaaagtgaatgtctctatcccaagggaacctgccaggatcagaggtggggagggaggggagttatggcttcactcctgccctggctggcattcccattttctgtttctcattttggttgaagtacttgcagctatacaatgtctccgttgggaatcatgcttatgagaacaaaggtaccaagcaatctgctatggcaatctgtcagcacttctacaagcgaggaaacatctaccctggaaatgatacctttgacatcgatccagaaattgaaactggtgatgttcttctataacctagaacctcaatttttaacacctcaatttatatttaaaattagtaatttcatctttgaaaacattgatttggtctgtgatattaggacatagtaagaatgatatacgagttattatgtgtcaggtactgttctgagccctttactataactcaagaatcctcaaggaaacccagcaagtcaaggattattattatccccttttatagaagactaaattatggctcagagagttaaatgatctgccaaagatggagctagaagaggcagtgctgaaattgggctcaggctgtttgtgttcttagctatcgtattccaccatctcttgtgcaggatatgccagtgaagtattaatagatagatataatgtttgtaaaacattatgcttgcaaactcttggtatatataaaactctcctgccccaa

SEQ ID NO: 54772 - DNA, 1039 bp, Homo sapiens
taggactttcttttccttcctagttagtttcctgggaatttctctcttcagaaacttaaagggttcctgctacaggcaaattcttagattctcacaaccctgtgatcatgagaaccatgcaatggaagaatgtgaagttaactaacagaagaggagtggcaggagctagtgaaacacaggacctctttttagttcaaagggagcttttaaatcacatttccttggctgcttttaatatttttttgggggaaagggggaaccatattttgtgattcttaatatatactggttgtgatttattcttatgaaaatatgttttcctgttggtcaaattatctcttgctaaaagcaaagggcaaaatagaagcagattttagtgagaaaaatagatgtgataggtttatttttattattacttactcttcctaagttggtgaaaaatgcctaagtaaataaacaattggtattgaaggagagattaaaaaaaacaggatattactaattttaactgcttattgagaacaaacacttatgattgttagggaaccaaggcaatttttacaatcatatgaagttggtagaattcttgcttgtttctaatgctaggtgttgtatcaagggaaacaaacatttagtgactaccctgttccagtacattatttcatttaattctaacattcttactggctcattttacagaagaggaaactgatgtttgtagagctcttttaaagtcacatggcttggccaggcagggtggctcatgcctgtaattccagcactttgggatgctgaggtgggtggattgcttgagctcaagagttccagaccagcctgggtaacatggtgaaaacctgtttctgtaaaacatacaaaaataagccaggtgtggtgatcacaccactgcactccagcctgggtgacagagcgacaccttgtctcaaaaaaaaaaaaaaagtcacatggctagtcagtggcaatatcaagactttgaaggcaggcattctctctattatattaccctgaaaatggatgttca

SEQ ID NO: 54773 - DNA, 1003 bp, Homo sapiens
aagaaagaaaagctggtgttatataaaaaccctacaacaaagagaagtaagacttcctgtgggcataattttgttgttatatgatcatagctagcttgagttgtacttaatgaacagcatggtgaatttccctcagataataacaaaatcttctttatttgtctttttaaaaatttgtttaaagactggaccgctccttcagtcatgctgtgcaccaaaaaggtacacctcaggccactggtccctgactcggcccggagttttctacatcggccgagaagatggatacattgatatctgggaccttctggagaaaacccatgaaccagcccagtctcaaaacatttgcataactatgatcacctacatcaaaccctggatcttttcttgtatgttaattctaactaaataagctaagtcattttgggtaactcgggaacatcttgacattcatctgaaaagcctccaatgtttatttcttagttttttgtttttcttcctgctcatcccttcttatcccttcccttctcttcctttccttttcattcttctctcttccctttccttcccatctttcctcttccttttccttctctcttggtctcaaactttggacacaacctgagctcttctcactgttgcctcatcaagaatgatttctgagacacgtgtcaggcagaggctggttttgaactgcacgatgggaacatccttctcttctccgggtcagacaggatgacccggatctttgttatcttttgctgattttttttcccagatagaataaattttgtttctttaattttcattacaaatcatatttttaaatattatatcacttttgtggttctcccctggctaatatcaagcaattctcttcataagataaaatgattatctggagttatatatgtatttaagctttaacctttgaaccaactatgaggaaaaactactatataacaaaacaagcataaattcaatgatgtgtctatagaaacat

SEQ ID NO: 54774 - DNA, 1844 bp, Homo sapiens
gtaatctttaatagctatgtgtcagcattttaaattgtctattttatatacagaatagccttaaatattttgttcaacacacaagagtaaaccttggtttgtaatgaagtaatgtgtgtctctgtggtaatcgtctatatggctagcacaatgcatactctcagaataaactagtcttaatgtggaaaatgttatttgggattgttaaatacctaaccagaatgagaaaataaaatatctgtactatttccaggcaataaatgaagatagtagataatgctgtataatcaaactcaggtaacaaagtggtcaaatctagtatttgtacattttatcaaagtgaaatttgatctgcttagtaaactatgactctgatgctaatagaattgcagaaaagcccacaagggtcggaacttactaggctgatcactttagatgcctttgcctcatttagatgtttgcagacaaaggaacttcttgttatattttgtttgtacaccaatatgccttgcctgctttttgctgtagcttttaatttaggagaagctaccagcttagctattgtttgaattatagctagataataataaagttgcatagaaaattaatcgacattggaaatgtgatttgtttggggacgttatgatgtagcatgaattagcaccatggaacgttatactgcttctatccttaatctagattatttctggtaataaaaaataattatggaatgctttcttttgacagagtgcatgtttttgttttaatgcatgtttgtagttgatgattaaatggcttatctttagctctgttttttttttaagttcagttggattactgtcactaaagcaaaattattgtttgtttctagtgcagcgtttaactgtcaaaaaatcaacagacaatttattcccagagcagaagtcttctctgaattatctgaggcagaagaaagaacgacctcatatgttaaatttgagtggtactgattcatcaggagtacttaggccaaggcaaaaccgattagacagtccacttagcaatcgttatgcaggagactggagcagctgtggggaaaactactttttaaatacaaaagaaaatttaaatgatgtggattatgatgatgtcccttcagaagatagaaaaatcggagaaaattatagcaaaatggatgggccagaagtaatgattgaacagccaattcccatgtccaaagagtgtacatttcagacatatttgacaatgcagacagttgagtctacagtggatcgaaaaaacaatctcaaagatctacaagaaagtattgatactttgattggaaatctggaacgtgagctcaacaaaaacaagcttaatatgagtttttgagattgagggtttttttttgtaatgtcttaaagtttcaaatctgtttttgttttattttcttataccacccacagcgatgttttcatttttttactcttgaaatctttaattaatttttaataagtttatctgattcaattaaaaacactattcattaatacaatttttacttatctcactagaaaacttttctggggatcaataaaacttggacttcttgggatattttactaaatcttgccaactctatggagataactttcaaatgcacttaagaaggttcacataagttattagcccctcaaggtttttctgctttatgggaaccactcttctgtagctgagacagatgtccttttttttgttgttttttgagacagagtctcactctgtcgcccaggctggagtgcactggtgcgatctcaggtcactgcaacctccacctccctggttcaagtgattctcctgccaca

SEQ ID NO: 54775 - DNA, 1033 bp, Homo sapiens
aaacaactattcctagtgtacagcaccttattccaaagatttgtgttggtggttttaaaaataactgctcctttttctataacctgttatttttctttagttgtagtacctcagacaaaaaacagggcagaaagttgagaagaaacaacagttttaccctgtcaatcacctgctgttgaattcaagaaaaggcagaaatcaagtagacgaggtgcatttacttggcctgagaaagttgatggtgacatagagaatgtggcaaagactagtaggccacagcatattaactcagtgaatgcctatcctatctccatgcattcaatagaaggttttagctttccttgatatgcatatcttatttttccatttggaaattctccaactccagagttaaaaagagtcgcccccttattttttattttctaaactttttgttttgtttcatgttattttttgttttttatttttgggcaagaagataatttgctttgagatttatatttgaaaaatcctgtcttcaaagtaattggttagaacttcagcgtatcagcattagaaggtaaaagtcgtcctgccaatacttttttagattgtcttctactaagctctagggttctttggaagcagcttagaagccagatcagcaagggatgggggaacaaaatggaaacacacttcccgttgaccagaacagccttcttttttatctgttttatgtattgagttttcacaaaaatgtttcttttagatattcattttctgttttaagaatactgaaaataatactcctggcccccctatcactttaaagatggataaatcaatttagagagagtataattcctagatccttgctataccacattttctttctttttttttttttttttgagatggagtctcactgtgtcgcccaggttggagtgcactggcgcaatcttgactcactgaaacctttgcctctcaggttcaagcagttctcctacctcagcctcttgagtggctgggattacaggcgtgtaccactgcgccc

SEQ ID NO: 54776 - DNA, 1051 bp, Homo sapiens
ggatcatttgaaattggtggcttcctatcatgaagtgaataagatgacgtgccagaatttggctgtgtgctttggaccagtattattaagtcagaggcaagagccttccacccataacaacagagtctttactgattcagaagaacttgcaagtgctttggattttaaaaaacacattgaagttcttcattacttactccaactctggccaggtaaatgattctatggaaatgtttttcactttcaatgatagggtatttgaattaactaatcattaaatatgctcatatatgattgaagaaactcttctagattttgctttttcaaaatgttgtgaattgatacctgccctttagatttttttcatttaaatgttttctgcctttgctgatgacattgtaggcatgtagattaatgtgcacatgttagacttggtcagatctagatttaaatcctggttgtaccacttattagcaatctgaccttgggttggtttcttaacgtcttagagccttgtatcatcttttgtcatatggatttaataatatgtttatagatttttattaggatttttaaaaattgtgtatgtaatgtgctcagtgtagctcttgacatgtaatagagactcaataaacactaatttatttactcttctcatttttagttcaaccggtataaagcagaattcatttttccccttaaatcaattcttctttacgtctttaactgcattcatggtcattagtcaaattatctcagcttaaattgggaattacccttgacctttccatctttcttatccaatccttatttcaatcaataactaaagactgacaaatattttcctaattatctctgatgtaatttcagagttaaaagaaatatgtgtttaatttgacattctataaaggacactgcatttaaatttcaaaattttcttagattttagtaacccctgctactctcaccccacactgcatgggaccaagtgtgaagtactttggtgtttagtgtagagcacactagtaaccgtgcttggccccggggtcag

SEQ ID NO: 54777 - DNA, 1033 bp, Homo sapiens
caaaatttgtgtaattggaataattcataattaacataaatatgccttgctttcttaacttctgtttcacatgcatttagagaagctttttatagggggcagaatcaataagggtatatgtatcaagaatagcttactttatgattaacaaacctaacgtgtggtaactgaaaattatgtgtacatttttagcatgctttcaaaacaagtcaattaccaaggcaacttaaaagaatacaaaatgctagtattttataattctttttatgttgttgcctttattgttttcaaaatgttgaaagttggctataatacttaaattttaaaaaattgaccatagttctttatttcactctgcagtccaatcaccaactgtctgcggtttgttttttaaaggtgttcttaaggattatttaagagaactcccttctcctctgataacaaagcagctttatgaggctgtattagatgcaatggcaaaaagtcctttgaaaatgtcatcaaatggttgtgagaatgacccaggtgactctaagtacactgttgacctgctggattgtctgccagagattgagaaggtaagcattaccagtatacatttttcctgaaagccagttaatgaactgtatacctacctccagagctacaaataattttagatatttgacatttgtggcactcatggatttaaaagctctgccattactgcctttaaacagcctaagtctgtaaaagcttcttaaacagaataaatctagaaaacagttttatcttttctatatgtgattttagcccaagcatgaatactcactgaagtttttttaattgtattgttaaaatattattacaataatatttgttcattatagaaatattgaaaagatacagaaaagaagaatataaaattgcaatcatcaatatccagaggcagctataattaacattttggtgtgtctccttttagtattttttagatacaacaactgtgttggtgtacatggcttaactttaagacaaacaaaagcccctcccc

SEQ ID NO: 54778 - DNA, 1090 bp, Homo sapiens
aggaaggttcatcttgtacgtatttaagagaattttgttggtgaaaatccttaaagcttacttttaggattgaggctttctgaataattgagcttcccaccctttgagtgctgaatgactgtattttcatcaagtatttaatatataactcttggataatcaaaactttgattccaagcattttagtaagataaaacaaactgtcacttttttcttacatattttaacaaatcagaaataatggttccttttaatttttatataggaagaggcatatttctacaaaaaattgagatacctgaagaatgttctttccttgttaatgtgtaattaacaaaatcagcaaaagactcattttatgaatccatgaaagagaagttttataaatacaaatttccagcaagtacactctataaataaaaatagatttggtcttggtgaagctttgtcttataaataaaaattatgttaaacatgtataattttaaaatatgaagtgaagaaagggttcctagttttggaaattggcagcatatgcagaagatatgaacaataggtcaatgaatattggatttacagcattctttcctaaaattgagagtttctgtaatttataaattggatatttcttggctcaattctttgtactattccatttgggtaaagctgtttttcagaagaatttagaactatttttttcttgataaaaaggcaatgaaatgatttaagatttgtctgcaaaataattgcatgacacaaggttttcatggctaaaaataaagggtattgttgatttgaggagttagccagtgacagtgatgcttaatgtgtttgttcctcatgaactcacatttctgagtaaactttgaaatatgattaatagttcagtaggtctaaaaaatgagaaattaatgaaatgagtgacagattttgttcacagtttaatgtgtttttagtagttggtttgtctggagcatggaatgaaatactccagacgaaccagtttttttttaaatcaagtgcaaaattttaggtataaaatccattcgtaattcttttttgtttgtttgctttttgagaaagagtctca

SEQ ID NO: 54779 - DNA, 1029 bp, Homo sapiens
atttgttgttttttaaaatgaataaacactttttctcattttaattgtgaaatgttgtgttacatacattagcttttgatgtgaggttattagatctttctctataaggaataaagtatgaaaaattaaattaaattttaaataattgggataatgcagtattctgcttgaatatcatgatggaagttgacctgaacttctaatgaaatctccccattgagatgaaataagagaagaatttctgcctatgtgaaagcctgtttagttgatggtttataaaataagaataaaagaaatcaaaacatattgctttataacgtatttttctttctttcttttaaggttctgggatcctggctgctacaaatagtactgaattgggaattatggaaccatcttctccaaatcctagccctgtgaaaaaaggcagttcaattaattggtcattgccagataaaataaaatctccacgaactgtgaggaaactttccatgaaaatgaaaaagttgccagaatttagccgaaagctaagcgttaagggaacattgaattatataaacagtccagataatactccttctttgtctaaatataactgccgagaagttcatcatactgatattctgccctctgggaacacaaccaccgctgctaagaggaatgttataagccgataccatcttgataccagtgtatcctcccagcagagctaccagaagaaaaactctatgagttctaagtattcctgcaaaggtggttaccttagtgatggagactcacctgaacttacaactaaagctagcaaacatggatctgaaaacaaatttggaaaaggaaaagaaataatttcaaatagttgtagcaagaatgaaatagacattgatgcttttaggcattatagcttttctgatcaacctaagtgttcacagtacatatctgggctcatgagtgtacatttctatggtgctgaggatttaaaaccacctcggatagattcaaaagacgtcttttgtgcaattcaggtagatt

SEQ ID NO: 54780 - DNA, 1077 bp, Homo sapiens
ttctaaataatataaatcatatttatatgtaaaattcaaattttttctagttcaattttagtctctgaatgtgattgttgttactttttgtttaaaaaaatttttttaaataactggtctgaagtgacatgtctttctgatataccagccattatattctaccttctattctatctttgcaacagatttatttgaaaatgcctatgggtcttcaatgaagggaagagaacttgaagagctgaaggataatattgaattcagaggtcataagccacttaacagcatcactgtttcaaagaaacgcaattggctatatcagagtactctgaggcctcttaatctggaagaagaaaataagaaatgccaagatagaagtcatttatccatctcacctgtgtctctacctaaacatcagctatcacagtctttcctcaaatcatctaaagagtactgtacatatgtggtatgtaacgctacaaactcttcattatcgaaaaactgtgctttagattttaatgaggaaaatgatgcagatgatgaaggagaaatatggtacaatcccattcctgaggatgatgaccttggtatatcaagtgccttgagttttggtgaggccgactctgctgttctgaagctccctgctgtcaatttgagcatgttgtctggcagtgacctgatgaaagcagagcggcatactgaagactcactgtgctcttccgaacatgcaggtgatattcagaccacacggtcaaatggaatgaatcctatacatcctgcccattccacagaatttgtgcagcagtacaagcaaaagctaggacacaagacacaagaaggtataatggtggaggacagtcccatgttgaaatctccttttgcaggtaaaaatgatcatatatgtgtctttctttcttcttccatttttgaattatttgataatagctaaaactaaatataaaagatgtttgttatattcatgtactttttcttgtgaagtgaatatattttcatgaaaataaaactcaaaaagttttataaacattttaacgtacacgctggtttaattattactatcac

SEQ ID NO: 54781 - DNA, 1083 bp, Homo sapiens
ctgctaaaagcctaaaacaaaacagaacaacaacaacaaataaggcaggttggacaagcttgctgagtatttgggagcctttttcaaaagtctgatttgggggaagtaaagtcacttattttaagctaccttagtatagcacctaaagagttactttgtgaattttgtatggctgcaattgaaaaaaaaaattgctcactttcacttgcatttaaaaatcagagctctaaaagttaattcttgttttttattgggaaactctgagagaaacattaattgatgagggtaataattttggtataaagccagtgaaattttaatgcttaacatgttgggttttttaaaattactgattgaaactcttccttttctatttaaagatgatgaaaaagatgagcatacttctaaaaagcgcaaagtagagccaggagaaccagcaaagaagaaaaagtagaaacaaatgaccagaatttctgtactgctaaacttgttgaaatgtttctttggacagattaagttgatattgtgggttattatgccacatctccatgaaaatgcatacgttaatgaactaataagtattgcctcaagaactttccactatagaattctttttttatttaaaacatgtatgtatttaaaactcaactggtgacttgtgattgtgaaattgataacacttggatgcattcttgctctcacagaattggtgacatgctttgagagttttgtcacatgttgacatgccaatgttcttataaaccttttataaaggaatatatttttaaagtaaatatattgtaatgtactgtgaacttgtagggtgcttttcaacagtctttgtacagtgtaaatagatcatggaaataaaattacttattcaatattactattactgtataacattaacatttgaatgtttgtctgtgacaagtaccctatttgtcgtgtgacattttaagttgtaataagaagtattaccatttaaagagtgcctcctgtgttccaggtgctttgtgcatatattttctctgatccttaaacaacctagcgcaaggtattattagtattctcattttataa

SEQ ID NO: 54782 - DNA, 1055 bp, Homo sapiens
aatttttgtatttttagtggagatggggtttcagcatgttggccagggtggtctcgatctcctgacctcgtgatccgcccgcttcagcctcccaaagtgctgggattacaggtgtgagccaccgcaccctgccacttctggttttagtggttgtaaaatgtaggtaagcaaagcttagttattagttgtagctttattgacatgtataataattaattgtaaaagcataattaatatagtgatttttagtttacactttttagaatttagaaagtttgtctattgataagttaaacttacttgagtgatttgagttccataataaaaaaattgtttccttaccagtacatctatactatatgagaccgagtaaaaaagctcagtaaaattgataaatgaacattgctcagattttttcctactctagtttataaagcaatgccttgtcatgacactagatggcatagcacttctgctcaaatcactgatagccagttactttttaacttcagtagtttgtggttttgttattcagttaatttacttgtaataagtggcaaattaaaagcaaaaatatctcagtatcatctaaatgtatgctaatgcatagtgaatattatagtaaacttagtactttccatttttatattatcactactgaaaatctcaaaagaggagcttagtgataattaactcgttaaaaagcaaaaggtgccgggtgcggtggctcacgcctgtaatcccagcactttgggaggccgaggtgggtggatcacgaggtcaggagatagagaccatcctggttaacaccgtgaaaccccgtctctactaaaaatacaaaaaattagctgggtgtgatggcaggcacctgtagtcccagctgcttgggaggctgaggcaggagaatggcgtgaacctgggaggtggagattacaatgagctgagatggtgccactgcactccatcctgggcaacagagcaagactccatctcaaaaaaaaaaaaaagcaaaacgtttggcttgttttggtggtataccatgttatttggtttgt

SEQ ID NO: 54783 - DNA, 1051 bp, Homo sapiens
aagcctagatgtacaaatcaaattgattctccacttctgaggatggtaaaacataatccttcttttcttccttttccttgattcccactgtaggtttatgagaaactgaaggaccatatgctgatccccgtgagcatgtctgaactggaaaaggtggatgggctgctcacctgctgctcagttttaattaacaagaaagtagactcctgagctgcagagtcccccccggttgccggcaagaccgcacaggcaaggccgatgactctgtgcccactcctgttgttttccttgacaatctactgtgccactgtgctactaactcttgtttacaaaatttgattctaagttgaattgcttcattcaacacccccaccctccctcccctcgaggtggtacctaagctgtggatttgctaaatgaattaagcaacctagaagatacagagctaatgaattatcaaaatgtgattaatcccagtaaggaaacactcatttagtgtctgtatttttggtgtgaaaattatttagttgccagtatattctgaagaatgtcttcttgatcagtcagataagcttgctttttttttttttttttttcatgaatcatgtttggttcctgtgaaagtccctggtccagggatcctcctcctttctcttttacttctgaattctgaaattcagttagttacttttgcctttcgctcttctatcacagccaccttgaccttgggtaaaacccaaggtctttccttctggctaccttcctgcaggtccaccctgtctgccattggtctcctctgcctctgactacatctgccaccaacaaccctcccctcacccctgccaggggcagacaggcttctcagcagaactgtgactgaaatcagagctgctgtctggggcagtgttaactacacagaggcacatcctgacagggtttgccccagagatctaaattccagaaggagggcaccacacctaggaaggtaaatccagtatcagaaggttgctaaaagattaaagatcaagaagcttggaaacatcccatgggt

SEQ ID NO: 54784 - DNA, 1759 bp, Homo sapiens
atcattatgctcctttgcacttggcccacagtgggcccttcataaatgtctgatgaagggatggataaatgaatgagagaggtggtattatctccattttgcagatgagaaaactagatcaagtgactcaccccaggtcatagtgctaataataaatggtgggtcaggactgcagccccttcctcttagctggtcctgcacacgagcatgcatgacttattaaagggccaaagccagaagttcctcttagtcatagacagcaaatctgtgggccctgaggctctttcaggtctcttctcttctacctcagtgccaagtgtggtggtttggctgggaagcaatcgtttccttgagctaaatttcctctctgtattatctgccactctttgagctagctcacctggcctttcttccacctcttcccaaacggtatctttgattctgtttctaaggcttttattaattgttgctgaacaatctgtctcagaatttgatttgtatcatggtggcttttgttcgtttactttagagaatgtcttttgttctgctccatctggaagttcatgtcaacttcttgcatataaaaaaagctggtgtcttgaaagaaaacatttgataaatggtgtcactcaggaggtctaggaagattatttttctccttagggactgtggtatctatccgtggtacctaggctggtctgcatatgtctgagatcgattataagatgagagggtttaagctggtctataccatgcatttgtgtgtattagcagaaagaacttcttctgggtggaccaactagaaaaagtggccccttctgccattctgggtagatcaggtccctaactcaaatcatttggtccctacctcaataggtctgtaactcaaatagtctagagagactaacacataacaaaataaaaggtaatcaaatatgactaattagcactacgttatatgatataggccctaactgctcttcaaagttcagaggaaaagggggcgttccctgaggcctagatattcagagaaagctttgtagagaaaaatgagactagatgtgagtcttgaaggatggatggcatttgacagggtagaattcaatgagagaaaattacaggtggggacatggcataagcaaagactgagcaaagtacattgatgagatgtgagcaaaccagctcaactcgtagagtttctagtgggtttccaggggtacaggtggaaggggcaggtgagatctgaagaagtaggaacttaacagtgaggaagacaagattatcaccgtgagggagcaatctgggtctttgaggagaaagccctgcattgtttcagagatgttggaccaacattggaaaaggaagaccctgcagtcagaaaagaggaccactgatgacctaggaaaaaaaccccaagccctaagtcctattgcatggcttggcaactcacccctatttctctcttcatctttcccttcccatggtcaaattctctcagaccacatctgttaagggcatcctatgaagactttatagtcctcctccctgtagagttcattcgagttagtgttaataatgatgttccttttctacttgtcagaacctataaataatcctcactagctagaaaggcattcgttggagattgcattttccatcagcaaatgtactgcctaaaccacaggcctgtggatttggtgaatgcccacctgccatgtttctagcatcaaaaatgtcatgttaccttgtagtgaaaata

SEQ ID NO: 54785 - DNA, 1040 bp, Homo sapiens
taggtgatttttctacttttgatctaagttgatgtgtgtagctgtagttcattttcaatgttgtgtagttctctgtgataagaatacaccataatgtatgtattaattttactactgatgtgtttttggatgttttccagtttttgtggattatcttctgtgtttctatgtacattcttgtgtgtgtctcctgggaacatatacaagagtttctctaaagtaaacacctggaaatgaatttcaggtgatagagtaaactctttttcttgtcactgaaatgattatatgattttctttaatctgttgatgtagttaatttcattaattcattttctgatatttgaccagtcttgcaaccccagcatgaaatcaaatttgatcatgatgtattctctttttaacacagtgttgaatttagttcgataacattttgttatgactattatttttgtggcctataatttatatttcttgttatccttgtctggttttgataaaagagttacattagcctcgtagaatgtattagggaatatttcctctttttctattctctagaatcaatactatttgaattatatattccttaaactttggaaacaggctcttgtgccttctttatggagaaatttaaaactgatttagttgattaatgattatgtgacaatttagattttcctgagtcagttttgatgcgttccattttctaagattttatctgttttaagttttcaatatgttgggtataaagttacttatatttcctaatatctgtttaagcttcacagcaactatagctatattatcttttcattggtaatgttaatttatgccttctttctttgtttgccagaggtttgttaattttattaatctttcctaaggaccaactattggcttggttgaactctttctcttgaatgtttcttttctgtttctgtatttccttccttcacatttctttctttttactctgttctctttttttctacatctcaagttggaattttatctcattaattttagcctttcatcttctc

SEQ ID NO: 54786 - DNA, 1037 bp, Homo sapiens
tgcttagtacctactttgaagataggtcaaaactactgggcttgagatgctagggaaagacctttgaccaaaagaagagactcctagtgtaagttgcactttcacactgaggagattttagggggtctttctggctcagctgctaaaataaatggttgtgaacatagcttggttaagccatatttcaaatgttaacagtacctgcttacaataagttattcattgcatggctatgttctgataaaaaagagttatattgtaaggaagtgtgatttacacatctaacttttcacaaaagcctattttgttagataaacagactgttgttctgtactgtcaaaaagaatgaaagtgccatcaacgggagacacaaagaatattctaaggggaacttactaggcagattcaaagaatgcctgagtctgcttgggcacacccagagataagaatgcagcgtaggccttcttgactccttgttctgtgttcttagggttcaatgggcatgcaaaccaaaccccagagatggaccactgcatgagacagtggcagcacaggtgcagtacacaactccagggcatactattcacacaatccctaagaagaatggcgcccccagagctggcaacgtggtggccccacccatagcgacagtatgtgacacttagcaaagaactgcttaaatgtcacagaataaacactattccttcttcaggaacattaattatgtccaaagtaagtaatgcaaaacattattttgatattaaaacaaaaatggctatatcttgactatacatatatatgagattcaatataaaattcacatcagccaaaatattagacttccaagaagcttcacgctttcagtgggccacttggggccacattcccaagtccctgaggaccagcctttgctgtcagggctacattggtgaaatgtattctctgacatgtctgggaaaataaattctcactataaattaaaattactattgattatcttgctcatcagtataaccagaatgaatttggggacccag

SEQ ID NO: 54787 - DNA, 1049 bp, Homo sapiens
gagtgcaggagtttgagaccagcctggacaacgtggtgaaaccccatctctacaaaaaaatcgttaaaaattagctgggcatggtagtgtgcgcctgtagtcccagctacttgggaggctgagatgggaggattgcttgggcccaggagatcaaggtgacagtgaaccttggtcatgcgactgtactccagcatgggcaatagagtgaaaccctcctcaaaaaaaaaaaaaaaaagaaagaaaaaagaaaaaagaaaagctgcgtctcttaaaatccaaggtaaaattatatttcatcctcattacaactctttttcctaaaagtaaatataaaccatgctcttctttatgtgctatttagcctatctttatctgatgtatttagtcattctctactgctccaaggaagtgaataaatccaggtaaaaagaagataccaataatgaaagatttcacttttcatgaatgttttcatagtaggccctcttcattttaggactgtaacctgttggaaaaaaggatcgattcctgtaattgtattgctagactgtgtcaaggcagtgtattatgaaagctacatttgagcagcacgaagatcgccttttaatgatgagagatagtgttagtctgctgtactcaaaagtgttcactctttagcccaatgttctcgtattatataaagctttagaaaccctggacatttgcctacaatgtctttgaagaaggcaatcacattgtgggcatggatcatatctctctgcttacatttttatggttttcatttatgtaccattgtactgcagaagggatagaaggcagcttggaaggatatatataataaaggtagaaccaatcaaaagatggatataggaataagataaaatgattaccattaggtggccaggaacacaatgtatggtctacacactgttacagatgggtcacaaattccactgaaagctttctaaccaccagcataaagaagtgaacctggtgggtattttagtctatgagggcctaaagatacaggcaggtcagattctgagaag

SEQ ID NO: 54788 - DNA, 1020 bp, Homo sapiens
gtgccctggttgcttctaacagcctatgctcatatgcaggagcaaataaatgacttaaagctggaacttatatttaaaagggaagcagagagtaagagtttggaaaatttgcaacctggccatgtggctgctgagcaaccacttgctagagaaatttgcataactaaaaataaggcaagtgctggtagccaagacagtggggaaaagtcctcaaaggcatttcagagaccttcatggcagcccctcccatcacaggccctgaggcctaggaggcttccctcctaggtttcctgggacagacccagggagtgtgctgccctgcacagcctcgggacactgctccctgcatcccagtcgaaccccatctagccatagctcagaggagcccaggtcgaaccgcagctcagaccacagctccagagggttgatagtttgcaaccttgataaaatgtgatgaaaatggcactttacccctgtgattctctccaaaaaatgataagcccagactaattgttatttttaaaaaatcaaggaaatgcaacttgagggacattctacaaaaataaaataaaataaaatcagctctcctgaaaactctcaaggtcttaaaaaataagtctgaaaaattgttatagccaagagaagcctagggaggcatgaggattcaaatgcaatgttggatcctagatgggatcccaatataggaaaaggacattaggtgaaccaatatatggtaacaaatgcatcatactaacgtaagaaggcaataataggggaatgcatttgcaggtccatataggaactttttgtactagtttcacaatttttctttaaatctaaaactgtcccaaagagaaagtttatttttaaaatatgttacccagacttttttttttttttttttttaagatggagtttcactcttgtcgtccaggctggaatgcaatggtgtgatcttggctaactgcaacctctgtctcccggtttcaagtgattctcctgtctcagcctcccgaatag

SEQ ID NO: 54789 - DNA, 1027 bp, Homo sapiens
agggagtgggagttgtggggaaaggaatacaaattcggatcaataaaaaaaaatatttgaagaaaactgagtaaaattactagcttgcagagatgaacaagtgaaaatctagaaagaaaaataaaaaaagaagtgatggattgtctttgaaaagtgcaagtctaaaactacagtcctgaagtgagattttggtttcaacatgaaagaactgcagtgtgaaatgtaatgcctaacttcatctggtagttaatgtgacatgacagctcacatgaaaatgaactgcaaataaatgcttaattttaaaagatactgtatgatctcaataattgaaacattgaaggcttcttaacagagcataagtaaatgtttcaataaaaaaaagggatactcttttctacagacagccaacgacaatagactggatgactgtgatcattctcattattgtttatataactaattcttatctcttcctatgtgtttatatttgcttcctttttttacactgatacattagaaaggaaagccaaaggtcattttctctttattgtataacttttttatgattatagaactaataaatatatactcattggagagaatttggaaaattaaaaaaaattaaatttaataacacagcacttagaaatttcattaaggtggtatatatgcctatgataaatccttagggaactcaggaaaattgactggtgtttttctaattatatagccctgtgaactaaaaaggaaggagataatggtatctatttttacatttgagaaaatggagatactagttaagggggaaaaatagttttttaaaaagcatgctcaccagactatctctgtatctacaaagatcttcttttctttacttatatagtgtgtggacagatatcaccttagttcatatttgtgctgaaaaatataggtatttgaagataatcaggttgcataattcattctgtatgttagtctcacattccctatactgccttgatctcagtgcaattaataacttaaaaag

SEQ ID NO: 54790 - DNA, 1024 bp, Homo sapiens
acttgaggtcaggagttcaagaccagcctgggcagcatagcaaaaccctgactctactaaaaatataaaacttagctgggcatggtggcacatgcctgtagtcccagctaccctggacctgggaggcagaggttgcagtgagccaagatcatgccactgcactccagcctgggtgacagagagagacaccctgtctcaaaaaaaaaacaaaacacacatacaatatgatactttaataattaaagtggtactagtgtaagaatagacataaaaattaaagaaatgtcatagtcatggaacagactcaagtgtacataaaaatctggtaaggaggcatcacaagtcaatggggctaggcaactgattaatcatttttaaaaattggggcatcatgtgacacatcaaaattcaagatggatcaaaatgttaaatgtaataactaaaatataataactataaagtaataataaaacaatgagaaacaggtgattttaagatgtgctgttaggatagggggtgagggaaacagtgtaagtggaacaaggaaatcacaataggaaaaatcaatcactttgattacattttacatcctgatatggtatcttaaatgtattttaatttttaattaataaatactgtacaaaaaatgttaaattatttttttgaatcctacatttgatctaagtaacataaataattacctgaagatttaaatgtgtttcttttctacaaaatcaaatatcaagaacatttaacatatgtagattttgaatgagctaaatcagaaataatacaatattttatttgtatcttaagtttaaagtttccttagtattactcttcatagttaacatagcttaggctacaaataacataactagattatgttgcatggctgttagcttgttgttgacattattgtttttatgaaagaacatgactattttaatgatgtccttatgaaggaatagaaaaatacacaagcttgagatttttaaaaagttgctcaatttttttccagctt

SEQ ID NO: 54791 - DNA, 1381 bp, Homo sapiens
ttctctcttaaccattcttaattttccaatcctgctttttgttggcttcaaatgtgctcaccagaatcctgccagctttagttggaagaaatacatttccgagcttagttggacatcagttttttttgggccctgcccagacttttgacagagaaggtagtgttaagggggttgatggtgtctagacagtaaaatcagaaactttgtaatttatgttgtattacagacgtccacttcccggattggaaaaaggaaactgacttttatctaaggaagttacattaaaaaccaaagcccctgggtatttctgacccatgaaaagttaaagcttgagtaattttacataacattctccagccccttcaaagactggaattattgagagtagtcctgtatagggtcagggatgaaaaataaacttccaagtctcagaagataattcatagacccatataacagtctttcccggctactcacctctgattagacccctgtgagctcacaatgtgagtgggtcttgcacatcagtttcagagggattttggaaagttgtagaggagagaggctaatagcaaaagagcatggaggtgtttggaattccaaagaagattgaagatctgactcagggctcaccccgctaaaaaaatcagacttttccttaagggaaaaagcatgttgttgatttggaaaaagtataacaaaaattaaaagtaccttaattatgcaatgatattttgtttttctttttatgctgtttaatgctcataaatatcagatacatcctcaatattcattattgtggaaaataatagaaaaaaatcttaataagctaggcaaaatttatgtaaaactaaaggcttttaaagcccatgtcagcttttgttttgttttgacctggatcatcatccaggtttccaagtagaattctgagttcctttcagaaaagtatgaacttctttatgtagaactatgacacatcatatcaaaggctactatctgaactgttttagaacacatgtatttaaaatgctgtagtcttattagcattatgaattaattctttgcttttctatcagtctgaaaaattttaaatatcttaaagtaggaaaattagtaaaaactccattcattacggaaaaattgtcttgttattcttacaagatgctaggtcactctccctgagttaaatttcactttgacagtttccagctgattgtgcctgggtcctaatagacacacaataagtgttagctgaactgtatgttgaattctttctaaattttacatcgaaagcacttttcaatgtgtagtaactagatgattaaaatttgtcttgaagagcagatagtttaagaaaacagatataagaaacaagagaaga

SEQ ID NO: 54792 - DNA, 1061 bp, Homo sapiens
ttttccattttcctttttcctgaaagcccaccagtagacaattgatatggttaggccttatgtccctaccaaaatctcatcttaaattgtaatcctcataatccccacatggcaagggagagaccaggtagaggtaattgaatcacgggggtggttttccccatgctgttctcatgatagtcagtgagttctcatgagatctgatggtttataaggggctcttccccctttactcggcacttttcctgccttcttgtgaagaagttgcctggcttccctttcagcttctgccatgatcgtaagtttcctgaggcctccctagccatgttgaacagtgagtcaattaaacctcttacttttataaattacccaatctcaggcaattcatagcagtatgaaagcagactaatacaacaagtccatgagcaattgctggggcggtacagctcacagcatgaatgtctcaacttctgacatgccacagtcagacatgcaccagaaaataagtgtctggctgttcctgatgtccttactggactgtaatattttgaatttgccattctaacaagtggtcagaattgcagatggcatttaactattgggattgcttcatttggctttaaaatgtaacatgaagtcaagtgtgatggcttatgtctataatcccagtattttgggaggccaaggagggagaatagcttgaggccaggtgattgagaccagcctaggcaacatgaagagaccctgtctcttaaaaaaaaattatctgggaattgtggtacacacttatggtcccagctattcaggaggctgaggcaggatgattgggcttaggagatcaaggcttcaatgagccatgtttgcaccactgcactgcagcctgggcaacagagcaagaccctgtctcaaaaataaataagtaggtaagtaaattaatccaatgtaacatgatattttcattgagcatataccctttaggaaggacagaaggacctcattattctttcacatatcttcacttgctttttacgttaaccgtctgtcctaaattgatgccatat

SEQ ID NO: 54793 - DNA, 1021 bp, Homo sapiens
ccaaaggagagcaacagagggatactcacttgtaaacaaaggggggtggtacaaggaggaaatgaatacttcatagaactctaaaataaaccaaccagattttcagaacctctcactcttaataattcctgccattccttatctcttagagcagagatgattgagagaattaaagagtaggcttagtaatggtgaaaacacaaattctgattggtaatccaggataacaacttcaaagtaatagaccttggtgttctaacataggggtgtccgatctttcggcttccctgggccacattggaagaagaagaattgtcttgggccacacataaaatactctaacacaatagctgatgagcttaaaaaaatcacaaaaaaatctcctaatgttttaagaaactttacaaatttgtgttgggccgcattcaaagccgtcctaggccacatgtggcccatgggccatgggttggacaagtttgttctaacaagaaaggatgatgaagatgctggctcctgactacaatgggtggatatttactgctgaacacacagcactgtatagggtctccaaggcctccatgtcatccttgggttaattaaaataagggatgaatttagggatgcagccggctcctctttctgatgattcagcgtgaaggaagagggtagttttgcagagaagaaatccttccagtgtttctgtcaaggattagcctgttgatgaggaaattcagacatcaaaggtcagtgtagcttttggttaacattttgcataattcagactgactaaacttacaattcctggtaactccatttgaatctttggcaagccttggaagtaaacgggagctacctccaggctcagactagcaatcatattactaggtcaatgattttacattctagtcagattcctttaggttgcaaataactgaaacatattcctgcaagaaggaggaggaagattgtaaggatagactcaaatagaaaccacagaatcattagggacatgaagtctctc

SEQ ID NO: 54794 - DNA, 1050 bp, Homo sapiens
ttcaataactgtctattatgtccaggctgaatgtttggtgctggggagatacagatgaattagacacttccactgcccctgaggatgtcacagtccagagagggaggcagatcagtgacagacacttgcagaacacgggggcagattttatgacagacctcagcccagtgccatggaagctcaagaagatgtgtctcacccacaccaaggcttcccagaaggagcgattattgagtgagaattaaccaggggaaggcagagaagagcaaccttccagatacagagaacaggatgagataagatgggggtaatagtccagtgaagattaattttattaatgttgagaagatgtagaattgagaaaaactcacccgtgccctctcagatcttttgaaatttcagatccaattccaagttcaccaaaagaaacaggtacagaactgtattactttgttttgggtctagagggatttggccactttgcacacttcatttctaagtgtacttccctcttactcttatccacatgctccataatggtctggaaccccttctaggattcctgactggcacagtttgggaacaatgtagcccactctggagttgactaaagtctactttaagtctgaaacttaaacatttcctgagtttgccatttagattctggtaaggcacttttttggtggtggagggtgggggggtcctgtaagttatcagtatattctttgctgggggttttcccccttgacccataatttgttacatgagggtgtatcaggaaaacctgtcatcttgtagtatgtagttatatacagatgctcctcaacttataatggaattacatccggataaacgtatcttaagttggcaatatcataaattgaaaatacacttaatacttgtaacctaccgcacgttgtagctcacgctacactaccttaaacatgctcagaacatttacattagcctatagttagacaaaatcatctaacacaaagcctactttaaaataaagtattgaatatctcatgtaatttattgaatactgta

SEQ ID NO: 54795 - DNA, 1056 bp, Homo sapiens
caggccttttaaagcacatttgtgaaatgatcgtaccatactagggtttggggatacaaagatgacagatgtggtccctgactttgaggatgacacagtctagaggagagcttgcataaatagtgtgtatataatgagtgacttcataaaggtgcagtatacatgagctgctttaggagccctgcctgaacactgccccacactggggtgaagtcttcttgtcacactggatggtgctgctcttgagacttccagagcttcctccataaagcttggaagggcaagctgtgtttttctctgcttggatataatttattatgctttggacatagtatcagcaaagacttgaggatcctttaataaggatcctttaattatgaactctcattcataaggaattgcatatttttattttaaatgtctttgcacttccctttggtaagcaatctagggttcctaatgtgcatagccttttgggtaaacgtgtgtttctggtgttctaatgatagctagtgaatgtgtgaattatattcttggccttacttgaaatgatgcgaggtttctgttgtatagtgttaaaggtgagcctgattatttgaagcccttccctaggcagtgggcacagtggataagaagggagagcatattgggtaaaatgacagtgctccaggattccattacatttagtggcattttgggatattgttttatttgattccactgtcgttcatgatatgccatctgtctttatttcctttcctttgtttgctttgggtttaattttctcttatttgtctagtttcttaatatggaagctgaggtcactggttgaaaacattttctctctattataagcacttaatgctataaatttccctctactcctgcttcagctgcatcccacatattttgacatgtttttatttttaatctgtttaaaagactttctaatttcctttttgattttttttgactcaggttatttagaagtgtgttatttaggatatttggatattttccaggtatgattctgttatttatttctagcttcatttt

SEQ ID NO: 54796 - DNA, 1800 bp, Homo sapiens
caccagcttgttggcgtcttcgtcgccgcgctcgccccgggctactcctgcgcgccacaatgagctcccgcatcgccagggcgctcgccttagtcgtcacccttctccacttgaccaggctggtgagttggactctccttttgccacctattccccgtccgctctccagccccttcccctggtcccagattgcccacggcaggaaaagttaaaaagttcgcgatcgtttgcgggtagccgtttctttaagcactctccccctccccccgaagacgtgtcgggacctcttggtgggagcagccttccgaggtggccgggctggacgagatcagaggctccccgtcgatagggtcggagacccccgtccctcactgcggcagccgcggcgcccctcctgcgcaccgcgccgagtctcacgcgtatcttctcccccttccaggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagaggtaagatgcttgtggtttggcccctttaaaaaaaatactagtccccatagtccagaagtttagtaattctgagaccatgtatggtgatgctttgttgttggtagcttggcagaaaggcacatgatttcagcagtctggaatgcaattcagtgtgtctgggcccaacgaaagcgcatacggaaaagtgattcctgactaacttattgttctggtctggagtctccggggaattgtagggaactttaccataaattgaatttaacagcagaaaatatgtatgagtttcaggcggtggtttggaatcttaactttatccccttctacctttctcttttggtgatctttgcagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctggtaagtggagactgagcacttcagacactgtactgagatgcatttctggtctaaatctttgtagaaatgagtgcttgagcctgtttgtgtcggtatgcctctgagaagtcttccctcttatatgtctctagtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaagtaagttccttcagggacgtgtagactgttgcctggcaggtgggtgggatgtgaacatctttttgaagaaagagaaatatcacccctaactttccttctct

SEQ ID NO: 54797 - DNA, 1040 bp, Homo sapiens
ggggagaacggatgcagtgggccaaagaacagtattattctggtaaaacagagcctgtggtgccatgagacacatcatttgcctccccctctcctgctggacacagcacaggcagcatgtggtgttgggaaaggcccttctggaagggtgaaccacaggaatgcagccctgcatgttggctgatgagccaatcagagcactgacgattggccccacacggatgtacagattggttctgctatgtaacagctcatatctggaaatagatattcctgtctgtgccaggctagggatggggtgaggctggggactcatgtgaaggtctgggatttcaaattcataagcaggccaccaggttggacagcgtgtgcaacttcgctctgttggtattttgttcctgccccatgtgttatgacttctttcccaaactgatattttctcctgagtcttagggcacaagaaagcaaacaaacagacggaatacattagccacatcttttttcttagaccctttgctgatattggttaaagctgctttgctctttacttggaagtagttttgactctacttttaaagtaacatttgccaagagaatgcaaaccagtgctttgtcatgattcctcatgtttggggaatttgagatttgagttctgggctgagtggatgaggcctcaaaaagcaagtcttattgagctgtggccacagagacactgatcagaatgggaaggctgtgctccttcccccctcctcactctgatgtaactttacacaaacctcagctccgggctgctggttttcatcattagatacatctggagatgaattttggatacatgtggactctttaaggcatttacaaagcactttatagaaattcaaaggttgtgagggcaagactgagagaaggtgggtatgacatgtaagacctcatgccagctgggctcatccacagctgcaagggccttcacctatccaaagatgttgttaaggatcaactgaaggtcagcgacgtgggtgaatctcataggtgtaaggatga

SEQ ID NO: 54798 - DNA, 1085 bp, Homo sapiens
aaacaaaacaaaaaaacctttcaagctatgtactgcagtggacaaagattacaccgtgtttgtgttgcaatgttgctatggaaatgcatatggtggaaatttgcagagaagtcgaaggaagtcatatgtatgcatgacaaacatgaagttcgagagtgcctgagtgcctctcagcctggctgggtgtgcctgcgccctaaggagggaggcaaaggtgttagagtcaaaaagtggagggtttaattcagttctgccacccagtagctgtgtggccttgggcaagttactgggccactgctgagctttactcttctctgaaacggggaatgacaacccctactgtgcatcattgttgtcaagatggaaacaagatggcaggtcttgagcactgtacacagtaagtgcttaataaatgtttctggcgtgatggcagcagtcccaattatgcgccaagaatttagggtcattcatcgaatggtctaaaaatgttcagaaaggtccttcagaaaggtgctctggcctgaccagaggacaacactgccaagatttggctgcagtttgggctttgagacttggagcactgtggggaagctgagtgtgttcagtgctggccagacttggttgtgtagacagttgtcatcacactggacgatacagaaaaatacagacactcagttgtcaagggaactgcaggtgatccactccaaaaaatgggaatgcggagtcaatgagatgaagttgcatggcaagttggtaatatatgtcaggtgcagtgctgtggcctctcagcttcaggctccgtgatcctcccactccatgtggctggcagcgggctagccttcccatgctccagcacctttaggagaacagaagatcatgtttaaagtgcttacactccagatgaatacttttggaagactggataattattataattgtaacaatttaattttcaagttaatttatgaaaccaaccagggaggtactctgcacacacctttgtgcattttggcttgcattttgaaagatctacagacctgttggagtgcttgctgtctgtgcaccccaccccccagccccaatat

SEQ ID NO: 54799 - DNA, 1089 bp, Homo sapiens
ctgtttctctgctgagcagccccctttcccttctatggggaaatcactcctggacaggctctagagtcggaagtgggatctagacaggataggtgacctcttcaagctttggatccctcacgtggtaagcaagaataaatttattattaatagtatcatattcatattaatattatgactatataatagtataataatcctgcctttggggtttgtgaggaggcagtgttatagagagctgctcagagcacctggcaccgagtgagtactaccgaaatggtaggttttcttatcaccacttggctgtccaacctcctatccactacctcagtgggccatcagatacctcagcacaatttcagcgaggaagcagccaaggggcatttctggtgataataagtttcactggattcatgacagtgaaacaaagaatgacatttccccaatgaaattcctcctcaccttcagctagtgagggctggaccttttactataggatcaggggcaagcccctgcacaatcccagttgcctagttgcttgagaatttcttcatgtcagtggatctccatttgtcaggaatatgaagcctttaaaagctggggctctgggaagagggagaatcagaggggagaaccagggaccacagacagacaaacccaccttcctgcatcagccagggaaaggaatgcctcccaagctagcccgtccggaagctgcacccagggactgcccgggaaggaagcataacaccggcttcagataagtgatcctgggcagagatagttccacagtgcccttggggcgaggagccacgggaagtagagtgaaacaaaatctttaaaaagtgctggattctaatccctgcactctcccttcccagcctgtgggcgtgggccaggtgctggccttcgttaggctggagggttgcatttgtaaaatgtgtctgacagcaataccgcctggagggtcgccgggagggtaatctggggcccgcggccgggcgtgcccaggaggcccgcggcgatggcaggggtgggacttaccagcgtcccctcgctggagcgaccgggccgagaggggcaccccat

SEQ ID NO: 54800 - DNA, 1040 bp, Homo sapiens
tgactacctcctagaatgttgtgaggattattgtgagataatataaggaaaagcagatagcacagtgcatactacatgataggcactcaataaatgcctactttctttcttctttaactttttaccaccaactcatccataaattcctttagggatggggccatgctgtatatgaagacatgccttatctcccacagaacctagcattaatttgtgattgatattttgactgattcattgattaaattaatatgttaattagattgtggttttgggacttaggtttgtgttgcagtgtacttcttaaagtacttttacattgattagctcaatttatcagcacatcaatccttagagggaggtagggcagatgcctggctttagtgataaatgtgaattctactgaggtaggaatagatcagtgctaggaaaagagtgagtatgaactacgtgcaactggatagaaagaacaagaggagaagcccccaaacgtgggagtctgggaaatctcaaggaggtagtggcagaagaccaggcttttgttctgactgatctcttcagttccaaccctgtcatcagccaactgagagaacttggaaaaagtcttcagtttctctgagtcttagctgcctcatcattcaggcatcacttcatgcttggatgtgggtctccatgtccatcacactttatcatcagttttccacattagactatgacctccctgagagcaaacgttccgtatttacttgttgtaactccagcatttagcacatgcttgagttatagaaggagcacaatatctattgcataaatgatgaatgaataatttagataaaaagagaaaagagccgggcgtggtgtctcacgcctgtaatcccagcactttgggaggctgaggcgggtagatcacgaggtcaggagatcaagaccatactggctaacatggtgaaaccctgtctctactaaaaatacaaaaaaaattagccgggtgtggtggcaggtgcctgtagtcccagctactcgggaggctgaggcaggag

SEQ ID NO: 54801 - DNA, 1044 bp, Homo sapiens
ggaggttgtcctggaaggcttccctggcccacatggaaatcaacccatacaggagttagaattacgcatttgattgtttttgttggctctgcacatcttaccttgaatgcctcctccttttgtccatgtatatttaatttgctgtcctgtcacagctgaatccagattcctctctgtctaatgaacttaataattgtgccgtgggtgtctacagacggtaatcagagcctctttggttcattgaaacgtcataccaccaccaagttcctgcttttcatgctgtcttgtttggacagaaagtcgacttatttgtttatttgtattctactttgtttcaaaacacataatatgtccaatacactattttttaagaaaagaaaatggggataagagaaaaatagggtatagaaataagattaagccagtaatgaggttaacacacaagatatatgctacctaaagttttatgtacttagtacattaagggtagtccacaaatttggttctgagtttcctagtgaccaatgcaaagtgcgttattaggtacaagtgtaaagtaacattcttagttttttgggttttgtgttttgtttttgagacagactctcacttcgtcacccaggctggagtatagtggcgtgatcttggctcactgcaacctccacctcccaggttcaagcgattcttgtgcctcagcctcccaggtagcgggaactactactattgctactaattttttgtatttttagtagagacagggtttcgccatgttggccaggctggtctcgaactcctggactcaagtaatccacccacagcctcctaaggtaggaattacagtcgtgaacaaccatgcctggccacattcttggttttcttgaggaatgaaaggagagaaattgcagtgggtctgaatatatatattcagctgagaaaacaacaacaacaacaactatcctactgtaatctaatggacttgagaactgaatcctgactaatatcaggtgtcagacaattttccaatacattccaaagacagtagtt

SEQ ID NO: 54802 - DNA, 1001 bp, Homo sapiens
ggagttcaagaccagcctggccaacatagtgaaactatgtttctactaaaaatacaaaaaataattagccaggcctggtggcaggcacctataatcccagctacttgggaggctgaggcaggagaatcacttgaactcgggaggcagaggttgcagtgagctgagatcacgccactgcactccagcctgggtgacacagtgagactctatcccaaaaaaaaaaaacaaaaaaaaacttcagaacttggttgatccttgaatcatttatctgtaggtgacctgtcatctgaaagtgtggcagagtttttcagcagcctattaatgtgcttctggtatatgtccttcttcgtcttctttctccctggtacctagggcacttcagatgggaacagaaataaagactcaaagtacaatctttccatatccaatgactgtataatttagccctagggtaaggaagacagccaggagaggggcaagtaggaccagagaggactgggtagagggagtggggtccttaaatctgccatgaggaataaggaatagagtagaagggactcagtcagggctgggctgtctttaaaggtaagctccaccttaccaccatcaccaccccataccctgtgcagtcctgggtccagtggccctgcatatctctaagcccttgaaataaaggtgggcaacttacctggacaatttatatgaggatatgggtatgatgaggaatacctctgcctccaaataagatggaactaattagagctagttgggaatctttctacaagctgggccaaatgatggatccaccaggaaggctgtctcagttattaaccttcttaaatgtagggactggttgttgttgaagactataaaaagctgcaatagaagagaaaaattaatgtagtggtccgtggaatacagaagtcacagtttttgaggcaaaatattccggagtttcttcatttaaaatatgtaagtccagtgttgatatccctctctgt

SEQ ID NO: 54803 - DNA, 1052 bp, Homo sapiens
tttgctcgtattttgtagtcattctggaatgctcttctctcatttgcaacaacaacaaagtttcccacgtgatatagatgatgtgaggaaattcaaatgagcacctcttttaagtggtcttttcatgttttccaaagtcctgtcttctataattgaaatctgcagaaccacaggatctgtagacttttagaaccaaaagaaccataaagatcaattagtcagggcctcgcaatgtgcgtcaggagacaggcaaattgatttttaggtgtttcattaacattttttattttaataaacattattattatgagtcctagaagaatataactagtatttcacatcaaacctgtgaagtcacaggttttgactttcattgaaaggatcaaacctgtgaaggcgcaggtaatgtttttattgaaaagaatattaaagcttaaagagataaatggcttttttagggattgcccagttggtgaatgaagggtgaggatattaaatatggaatcttgtaactggaagggaccctagagatcatgaagtcacctccccacccttccacgacttcagtgtcacaattctctccaaagcatctctctcaagtggttatccagcctctacttcaatacccgcagtgatgggaaacttatcatttgaggcagtacattccattctggcagttctgatagttagaaaagtttccccttatactgagttccttgaaatttcttttcatttgtttctagttcttcccactgaagccactcctcaccttcaaatgtgtcaagacagttactctaccctctccacctctccctacagaaacacacacacacgcacacagacatacagtctattttcatggactcggttttttttttttgtttgattggtttttgttgttgtttgttgttgttttgagacaatgtctcactctgttgcccaagctggagagcagtggcacgatcttggctcactgcaacctccgccccccaggttcaagcgattcccctgcctcggcctcccgagaagctggaactacaggtgtgcaccac

SEQ ID NO: 54804 - DNA, 1058 bp, Homo sapiens
actccggttcccattttgcagatttagggaaaaaacactaaaaggcagaatgatttgcagttacattgattcagcaaacatactctaaattgtgaggatagatacagagaagaaaggtcgagtttctgtcctccaggaactctcagtttagtgagtgagtcatagttagtcttgcttgctctaagcaagacaggggtgtcagaggagctccatttctattcttctttcctgtgaaaggaaggagatggcgattagctagtcttctgtcactccacattcactcaacatatactgaccctcaattaagtttaaaaaaaaatcatggaaaaaatttattctaaccacaagtggctggccaggataatagtgatctattcagtggcatgaatatggatcataaccacattgtgaagtgaccattcctaagtcttccacagagtcaggaaggatgttacctcacaaaatataattgccactttcagacatcatttctctatttattgtggccagaattgtatatcctagctgcctgggacatgacgcggtttgtgtgtccctgtgagcagtgcttttgctgtacatcagaaggagggagagaagagggacagagcaacctaaacagaaaaatataaacacttgactgtatgtttacttatttttttctagtgaagagtgaatctaccaagaacgttggcaatgaaaattgagcattttttctggaagaagaaagtgaaaacttccagacaactgcagcagactctgcattgatgggctgttggctgattggggtattgtcaatgggtgattggaattttttctttgtatgaaaaataagcttaactcttttaaaaaatgtattttataacctcttgaattaattgacttgtaagacccatttattcatattaagaactctcctttgcacttgatcagcatagtacttattaggccctggctttttaatatgcttaattgcttaattccataaactgaaaactttttttttcttttttctttctttttttgagatggggtcttggagtgcaagtggtatgagc

SEQ ID NO: 54805 - DNA, 1065 bp, Homo sapiens
atctaagtatttttcaactttttttttattattgcctcccaaggagctttctgccgtgatattttgataccatagatacactgtatatctgttgcatacagtagccctttgtagggccacaagcattaaaatagcaagattttgttggcccttcagagaaccagtttttgccctctttggggccatgctgccctcattgagaatgcatgtgtgtattgatatttagaggaggagagggaaacagctttgctatgcatgaatagttacttgggtttcataggactcagaagaggttagtgtttctgttgctttgtcagattgtccagaagggaacataaggattaagttgccacaattactccaccagtcttatcacccaactctaaacatggtatcttggagtccctaagttacctagaatatactaggtatagtaataccatttttgagaacgttgatatgccaagggtatagtgacattattgtagttgaaggcattttgttgaatttagggaacagtagctctaatgcattaggagtaattgtaaatgttcaaacctttatccttgtggttctcaaacagtgatgattctgcttccaggggacatttgcaatttctgggagcatttttggtggccacaactgggtgtatgagtgttcctagtggaacactcatctagagggtggagtcctaggatgctgctaaacgtcctgcagtgcaaaggaccaagtcctttgcaaagaattatctagtccaaaatatcagcactgctgagattgagaaaccctgctctgtcttagtgattgtacttcttggaatctagctttagaaagtaatccaagtaatgttgctaggattttgatgtatgtatatttttttaagtgggacatatatttgtatatataattataaaaaaatgagaaacaagcttaattctttcagtcttaagaagaacacatgtcaggacttacagtaatttcagcaatactgaagaattggaaaccattttagagaaaattaactcacccatttcagcaattttttttttttttttctgtgacgga

SEQ ID NO: 54806 - DNA, 1049 bp, Homo sapiens
gagctgagactacaggcttgcaccaccacgctctgctaatttatatatttttagtagagctgggatttcaccgtgttggccaggctcctggcctcaggtgatccgcctgcctcggcctcccaaagtgctgggattacaggcgtgagccagtgtacccagcctatctgttagatacacctctctaaaacttgttctcaccataatggtcagctacttagaatcctttaagcttctgtgcccacaaaagtcattagctcagagatatctcaattggccagaggcagcattgccagtagatgaaatttgtcatctcatttttgagtcttgtactgtctgtactccattccgtagcctgaggttaactccttcttatccccctctcatttgaagttgctacttcccagacagttggaaatataattcatttcaagtattcctcattaaacaaaacagagtaagtcatcttcgttgtatttgctttttaaaggaggaatcacaatatagttaatatttcttgaatgtttattttttattaaacataacaaattttatttaatctttgagaggaagttttcttggcaagttacttatttccctgtgcctattgccttatctgtaagatggagacagtaatagtaccagttttatgactagtggttttcagtttatagtgcatgccagaattaactgtgaggcaatttcaaaatgcagaatagatacccgggcttgaccagcagaacttgtttttttgagatggagtctcggtctgtcacccaggctggagtgcagtggcacgatctcggctcactgcaccctccacctcctgggttcaagtgattcttctgcctcagcctcctgagtagctaggattacaggcaagccccaccacgcctggctaatttttgtatttttagtagagatggggtttcaccatgttggccaggctggtctcgacttcctgacctcaagtgatccgctcgcctcagcctcccaaagtgctgggattacaggtgtgagctaccccgcccagccaaggacatctttacttc

SEQ ID NO: 54807 - DNA, 1041 bp, Homo sapiens
acttgttcagctatattgtccaagtcactttccctcctcagttgtctaattaatcatatttttagtctatgcactgtttgttttttagtttatttttccctggaacctctgtttctttcccaaatctttctcatcttttagacagaattgtattacttactcactcacgttgtaagcttcctttttttcttcagtaatttagaacacttctcatctgtgtaaataatcccagtatctgaagttgtgtaagtctggtactgctgtctgcttggactcttttgtgtggactaaccacccatttcctcagaaatggacccaatttttgaccttcttatccccacatttgtctccaaatgatattggccctcagttcttaacaatccagttcttctgcttaccattcttctaccactaacagcttagaactgaaagtccttaacttttcaatttattcttttgaactagggttctttagctctgtgtttgtgtgtctgtcttttacttacagtatgaagataatagaggtgcgcctattactaaacaacttaatatttaagagcttcaatctgttttagaagcaagccactaggtgtccctcttgtaaagaaataacaaagcttttatgaattcaaaaaattactttttgttctttggataaaattacatcatccttattatattgcagtaatatacctatttacccctgtattaatgtcagtagcacttttttccttaaacagttatgtggtaatgtacttctaaaagcacaggactttttttttttttttaacatggtatcctataaatataagtagtataggtttgtactttgctgcaaattggctttagaaaagagtaaaggaaaatgaaatgatgggtttagcagttgtggtcatgaggagacaagtggattttgctgtgagctttgggggattatataataggtgcccagtacagacttgtcaactgattgacagctctgtggtttctctgccataatagctttgatatggtttgatggaagaatttcagaacaacagc

SEQ ID NO: 54808 - DNA, 1324 bp, Homo sapiens
gacctgtgtttttgtttgtttaatctccattaaattcttctttggctcacagaacatatggttagaaacacaagctctggaattagacagaccagggtttgaatacaggttctatctctctgggatagctgtatgatgttgggatctcactaatttttattgctaaaatggagatgatagtacctattctcatagtatcatggtgaagattacatgagattactgcttagagctgttgtaacacttaggttctcagtaaatcttaactattattgaacattgttttactcactttttaaatttaaggaatttaaaaattaatttgtctgtttggtttttgttgttagatgtactttatgaaaaatcgtgcccggaggcaaggtattaacttaaaacttctacccaatggattcaccaagaggaaggagaattcaaccttttttgataagaagtaagtttctaactttttagtatatcaggtattctgatttgatcaggatcattctttaaggtttggttgctatagagcattgctaccccaagtgtggttctgtaaactgtttgttattggtccatgacaagataactgtagtaattgtatgtcatgtaactctaataaaaatttgggtttgcagtgtgtgcgtgtgtgtgtgtgtgtgtgtgtgtcttcatatcatttgagaagcttctcaaacattaatgtgcataccagtcacctaggcatcttgttaagtatgcttgttgtgatttttcagtaggcctgggttggagtttgatattgggcatttctaacaagctcctcaatgatgctcattgtttgagaaacatattttgagtagcagcgccctggaacactctcatacattagaaataaactgtttctttgagaactaagataccaagaaagtatttcaggggcttccaggacaaaacgagtaaaaacaggacgcctgtactgttttaatcaaggcagctctgcttttattttctttctccactgggtttccaaataagatttcaattaaaagctgtcaatgtagaagaaggggactttgaactcttgagtacagataatataacagagattagtttgctgctgtctgaaaatgttgggttgaaaaggccccaagagtacagaagagaacaggatcccaaagttctttaagtagccaactaaattatcagataatacctttcagaagtcaagattttggatttagaatttttaaaaacttgagggagtccctcccttttcagcctcttagtaactgtggggccttgaacaaatcaacttcctttctctgggccccagttgtatgatgtg

SEQ ID NO: 54809 - DNA, 1061 bp, Homo sapiens
ataattacattacacatatctgaaagaaaattattcatatagcaactcttatttttcctcaaacttaattaggcataattaaaattctacttaaagataaattactttacaatttttttttaaattgtgaaatatagcaagtatattttctaaacatcacaaaatggaaatacacagtataatgaataattataaaatgaatattcatttaactaccaccccaatctagaattagaacattactggcttcccagaagttccatgccacccttttatgcccttccctgatcttttctcatttctttatatttttttctatcttaggactgtaccacaatttgtttacgcatttttttaatggattttggattttctgtaagaataaaaaacagtttagaaacaatgccactacttttgtctatgaattatagtatgtgtgtgaacatgtgtttctagggtttatacctgggaatagaattgctttgttgtgtggtatgcatatcttcaatttgcctagatgttaccaaaacattttccaaagtgattgtactagtttacactctcaccaatagtgtatgaatgtacctattgtcatattctcgccaatacttagtttggtaagactttaaaaatttttgtcaatctgttggctttgtaattttattgtggttttaaatgtgcagttctttaattcctgatgagattgaaccacctttcaaatactttattggccatttggatttcctcttttatgcagtgcctgttcaagtcttttgctcatcttttcattggtcagctttatttttcttactggtttgtgagaattcttggtatttcttggatgctagtgcaagttggttgtatgttataaataccttcttctagtctttgtcttgtcttttcattttatagtgtcttgtggtgaatggatgttcttagttttaatgtagtcaaatttatcatttgtttcctttatagttagtaggtttatatgtttataaagaaatccatctctaccttgaagttaggaagttattcttttatagttattgcctaaaagc

SEQ ID NO: 54810 - DNA, 1028 bp, Homo sapiens
ttcatagagaagaattttcaaatgatgttcaacagctatcaaatattttatcagttacttgtcactgagtttataaattgattgggaattctaagtttataaataaatacaattaatatttgataatttaatgttacatgtgggcttttgtaggtgtgagacttgtggtacagaagaagcaaagtacagatgtccacgttgtatgcgatattcctgcaggtatacatgtaacttcctaccttttaacctgtatctgtacctttcttaccctaaaatataaaagtacttcccctttgtcttttcagtttgccctgtgtaaagaaacacaaagcagaactgacatgtaatggagttcgagataaaactgcatacatttcaatacaacagtttactgaaatgaatctcctaagtggtaagccactttatgcatagcaaattgaggcttcctggccattggtatatgtcacttgtttattcttctgttttgaaatttttagattatcgatttttggaagatgtggcaagaacagcggaccatatttctagagatgcttttttgaagagaccaataagcaataaatatgtaagattttttcctaatttcttccagttagaagtccttcaaatcaattagattctttttttttttttaacttaccaaatatattaagtggctaccatgatgtagagctattctgattacttaaggatatggctgtgacccaaacaaagtccgtcccctcgtggagttgtatttagtgggagatataggagataagtagaggaacaaatgtaatttcagatagagttaagttcatatagaaaataaagaaggctcaagagattaaagagagaatgaaaatggtctttgttggggagagattgtcagggtactattttcgatacagtggtcaggagaagcttctcaaagagatgatgtgtaagcagtgatctgagtgctgagaaagaggctgtcatgtgaacatttggaggcagattatcccaggtagggacaaaagtaaaaggaa

SEQ ID NO: 54811 - DNA, 1097 bp, Homo sapiens
cataaaagaggaattgatgcatggagagtgtgtaaaagaagagaaggatttcctgaagaaagaaatcgtggatgatacaaaggtgaaagaagagcctccgataaatcacccggtgggctgcaagcggaaactggccatgtcaaggtagggcatgggggattccatttaggggaataaagctgtggagtcctcatgtctagagtgaaggaaaccacactatcaggagaaggtggaataatgaaaaatgagcacaagtttgggtttctggagtcagacggcgttcgcgggggtgggttgggaagtggagggtgttgtacatgacaacacaacaaattcagtgaaaatacatgaaattagtagtgtccaatgggtaatggtcaagttaggaaagtggaaattctggggaccaaaagatcagttggaactggatctggcttgacttaatatgctctttactcggtattcctttgagagagaatagagatgagaaagtctaataaaactaacaatgacaaagtagattaagttaaaactaggcaaaaatacacttgacctcaattatcaagcttcttcatgggtgctgtgaatatttattgcttttgattgaatttccttagtgtgtggatcatgtgacaaaggaaataagagtagtcagattcttgagaatattcccgtctagaacacagtgggctaaatagaagtaactgtagtttggttgtcagtatcccaggagcatagaagagcagttgaggacagatgatgggttacatggcatttctagattatttcgatgctcattctagattaggcgtggagttcaggaaaaagggtgctactactactctctaaatttcacttggccttatattctttgtctggtgtgtgctttaaaaatatctaaacatagctcatgaattggacttctggatacacacacatacaatcattaccacatttccaggaatcacaagttaaaatatcagtgaataatctcattccctgattatagtagaaaaagaagtcaaaagcgagatgggttttaaaaattttaatacattttcctgagttacatatcactaacaacattggaaatgtag

SEQ ID NO: 54812 - DNA, 1085 bp, Homo sapiens
cttccctaaagggaagggaggggcacacatagcatgtttataaataaggtaaatatctcttggagacaaaaatagttgtaacatcaagcaatagtaggaactttaggcctggaaatagccagaggttgcaagaacttctatgttctcaaagtaaagaaaactgaaagcttcccaacaaaaatggacccaccatgaaagaaggctggaaaagaagctctgtgtgtgtgtgtgtgtgtgtgtgtgtgtgtgtgtgtgtgtgtgtgtgtgtcttttataatgtgaataaatttatctcttatttgcatgatatttttatgaaaccaataaggaaaagtgaattttttaagtaagtagattcctgaaggcactacagaaagggaaaggaagaacaaatccctttagatgaggtttaaaggatgagagaaaggattagaagaaatggatcttaaaagtcctaattttagacgaagttgtcttgacatttaaacaattaaagggtgtcagaaagaatctgctcttatgctatgaagtttataaagggacagcaattatgcccttttggacacaggtatctcacccttgagttcagtgttaccaccatcttctcatgagattgctattgcctttgtaatgtgttaaattattctcttgtagggacctccaggcactgagggagagtctggtctgcaaggtgaaccaggtgcaaaggtaaccttctaaaaaataaaggagaatctctaaactttcaccattgaaccccctacatttgctaccattgaatcccctatatttgctaacttgaaagcaggtggaagcccccagataaaaacaggaaatgttttggaactcctattccttatgacagcagtccccaacctatttggctggcaccagggacaagtttcatggaagacagtttttccacagatggaagcagagcaggggatggtttcaggatgaaactgtcctacctcggatcatcaagcattagattctcataaggactgagcaacccagatccctcgaatgcacagttgacaatagggttcgtgtttctatgagaatctaatgctgccactgatctg

SEQ ID NO: 54813 - DNA, 1209 bp, Homo sapiens
ttttcctcaaccagtgtaatatgaagaattctttttattttttaagagattctaagaaaatgttcacattatcaaaactagaattctatcaacttttaagacatttaattattttggaataaaatgtgaatttttagacagaaaatggcaaaaactagtatgaaaatatatcatgttacatgtgaaattatgacagttgttaacctattaagttaatcatgttaaatatgtaataatttggggctaaatgaatgtatattataaattatatcagtgaagatcaaccatgtgtgtgctttaattattaattttaaagagtgagctctaagaatgaacacatcagatgtgagtattattttaaaaaatcaaaaagaattatctagttattgtatatatgtttttaatattatgactctggtcctttggaatgaatgctattattgcttatctgtatttttttccttttttctttagaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaatttattttctctaagtagtagatttttattatgagtctaaaatgtgattgggtaaaaaaataaatatactaccagttacattttatgatttatgagtggtagtattagaggtttttatgtaaagatttttgaaacataatttatctaactgaaactttaaaataggatagttgttactattcctgtttgctggataattcttatttatctttggtttaatttcttttaaaattaaattggttgttagaatatttttctcacacatagacatggaagtcagattcattctttgtgatgtttgtagccaccattcaagtgaatttgtagtaagtcttggtcaatatgattttaaataatatatataattgttttatattatgatatataaatgtaaaatattctgaattttaatttttaataatggtgtaattacatactttctaaagctactaaatgtctcaatatactacacttaatattgtttcaagtatatgctgagttgccattataatttctgttaggttttaagtatacaattttaaatcatcgctattaagtaccaactgctaatgacagatgaaaacgtggtcatgcatt

SEQ ID NO: 54814 - DNA, 2320 bp, Homo sapiens
tcaacaaactttttgaaaactaaagtctaccccactttttagttatacattcttatttaacagagtttaatatttattcagttgtgttcttatttaaagccattatacctaaaatacttacgttataagcatatctagtatttaagataataaaaatattaatgctgaatgtgtgatcttgcacttatttccctactgccacaactcagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccaggtgtccagccgtccttctgagttttgctagatgcgttaaaagaatgctttggaatgatttcaccagttgagggcactcatgtcagggcttgatttttaaattcccatctacttagttcgtaaaacatcattttcatgcagatactataatacagttttgcaagctattcttttagtattttatggtgaaaaattggtaattaaaattcttattttagtttattcatgcaaatctatagacatttgaagacatggtaatagaatgagagaaggagcaaagttatacttacatatatgttccttgatgtaaggataaggtaaattattgaaacttacattacaaaaattgaatttattttaattagaattgtacgtcaagttttttgggatatttttcagtctgtttctttttcctgttttactttttataccatcagaatatggatcatgtgtatcctgttagtagccacatagccttctcctagctcaatgcctagcacatagtaagcactcaatatttttttaattaatgaaattttttttaaaggagcagtccaaagatggtgacaagtcttttttcttttactttcaaggcagttttaggaagcattccctgtctatcttccaaatatgatctggattttaattttgcaaaaaaaaatactgcattttctcacttaaaaagtaggagctaaatgatgagaacacgtggacacatggagaagaacaacacacagtggggcctttcagagggtggagagtgggaagagggagaggatcagaaaaaataactaacaggtactaggcttaatacttgattgatgaaataatctgtacaacaaacccccatgacacaagctgacctgtgtaacaaacctgcatttgtacccctgaacttaaaagttagataaaaatatgcagacaaaattttagtttaaattcctgagaagagatttttctagtaaaatgtcaaacgacatagattagcctaaattactaattgaaattatgagaaaaaaattttttccttgaatcaaagcttcttacattatttagagcagattttgaagcagtgggaagaatattctgtcttggcatgggtgagtgtgtctttggttgatttgttcactttgcttctcaaaaaaatatgtattttatttacagtttcgacttcacagatactcaattattaatcagtatttttaggtgaaacagaaaaccataagagaaaccctaggtatccaaaaataggagattaatactgcttaaaattttcctatttcaacttaacaaaataaatatctttcttcaataaggtgttgttcaaagtgttttaatagccatcatcctgaattttttttagttggttattttccaatacaggcaacataacttctttaaatttaaccaggaatttaaaacttccattttaacaatataacattttcttggtgtctttctgtgtaagagtagtaacatttataccttctcgttgcttgtggttgttctaacaataaattatatggatttctttggaagttgattgtgaagaaaatgactaagaaaacttttttttttcttttaggttgatggaaatcacaatcttctgacaaagctttctctggaagaggaaaactgtcttattcagctgaagtgtgaaaaccttcaacagtaagtattaaattacttaacattgctgctgcatatttctctgcacattaacattttaaaatatatgttttctgtaaaaagaaaattagaacagatggacgcagaaaataaagagcttgagaagaagctggcaaaccaagaagaatgtcttaagcacagcaatcttaagtttaaagagaaatctgcagagtatacagcattggccagacaactggaagctgctttagaagaaggaagacaaaaggtatgcatggcctttatttagaaactttttaattcatt

SEQ ID NO: 54815 - DNA, 1053 bp, Homo sapiens
ttaagtataatttttgtgtatttttcttttccagtaacctctgtattctattgatttttcatatctaggcacatttccaagtttttttgtcagtaaatttagaaagttttaaaaataatatgtcctgtgtaaatcttaataaggatgttcataattattagtcactagctttgtgaaattcctaaattttagatggtattgcatgaaataaaaaataattattttatcaactttgttaatacatgagttatgtttttataataattctgtagcactggagtataaatgtattctaatgacttataaaatctatatcttttttgctagactacacttgctgctttgaaggatgaagttgtatctgttgaaaatgaactctcagaattgcaagaagtagaaaaaaaacagaaaacccttattgaaatgtataaaactcaggtgactactgcatttattttagtgtttactaaaattggtagacaatttaaaacactatttctttgtaatctaaataaatagaactgaagagaggtggggctatcattgtgggttataatatggtgtgtctcaaatatttcttaaggtcccacacatctttataaatagatgattctgctgattcctgattcaaacactgcatatggatatactggatattcctaaaagtagatttaaaatgaattacatcggtataatgtgacccttaatgtattcttgttaatcttggttatatttgtttgtcatcatgtgtatttaatggtattgatttagattaatgactcccttctagggtcattaaagttcattatgcctcctttctcaagaaataaagtataattcagattattcacatgaaagaccaagaaaagaacatatgacaatatatatgaaatagaccatgtgttcaatggtaatttatagaaaacctttatttttttggaaatgtagtattcaagaaaaaacttcataagatgggacttatgcaggtccttgcatgatggttaacacactggtcagagagagtttgaattaaagaataatgaactggctggg

SEQ ID NO: 54816 - DNA, 1049 bp, Homo sapiens
ccctatgactttattcagtaattaacctaatttaatctctgtaatacatttaaaaccatgtgctgacataaacacaccaagtaaaatatatctttggtatagtacaaatttgaaaatggccttagtgctttgttgtttttgataaattattatatttattcaattactaattaataatttttttaaaaaagtctcactgatatcctgcctcttaagaacttatgttaaggcttatagaattattagaggcttttagaaatgaaaacagacttgtataaaaagtttatggcaaacaaagtagtattttgttaaccttgtgacttgggataaggaacttaacctcttcaatttcctcatgtataaaatagggcatcataatactccctatctcatgtgtttgtagggagagataaatgagaaaatatatttttgcattgtcctcctttctgttgctgtaatgcatgaagtttttttctttgttttgttgtttttcttgtttgttgttgcatctggctttaatattcttccctggctcacaatagctctttctttttttaatcattcaggtatcttttcaattgacatctcttcagagaggcctttcttgaccatttcttttgaagtagttctaaaacaatcatatcaatgtcttaatttttttcatagcattcactataatctgaaactatatcatttattttttcatttatcactgctgttgtgttttgttttatttttaactgtttccttctacttgagtataagtctcagaaggcaggagcttgctatcctattcacctaaggtaagggtaccattatttaaaacagtaccttaagtctaaaatatgaacagttcagcaataagagctaaataatagtttaacaaaatgttatcacatatctacacaatgcgtaaattttgccaaggactacagagacagatcaaggacaaggaggatttgtaaacgtctgtggtctttggtaattagaaggtcactagttactaattcacatgcagtttcaatgcagtggaaggaaaggtgaaaagg

SEQ ID NO: 54817 - DNA, 2163 bp, Homo sapiens
cacttttggatttaaggcattaagtgattaaggggttcagaatttagttctttttgagttaggtttgacagtggtttttttttgtttcgtttttgtgttgttttttttttgagtatgaatccaatgaactcaatttggcaacatcaatctcaactttttagtgttgagtaatttgttgtattgagtcttttaaaaatttacattataaacctctgggaacatcccacagatgccttccaccaatttttctttctagatctttgttatgtagcaattagaattagaacgttttcttattttcagaagagactgagaatgattgtctgtataaaatgtgacatgtatacagacattgctttggagatagaaaaagaagataatcagctttatgtgttcattcatttggcaaatgagaggttatttttaaattataaaaataatttgtcatttcagtatactccttgatagtgtataagtgtgggatttgataaatctggtgagaagatcgtgtctggaactatgttcaaaaagaaaatttagtttctatgtttagaagttttttaacctaagaaagcaactattcatggtgtgatgatgacaccgtgtggacttttagaggaatgacaacagtgtttcctgtgggatgttcctttgtcttatgtcgacttactgtactgctgtttttccccagctacttatgttttatgggattttgttttttaaaaacaatttaagaatgtattgctccttctcttagtttacttagtcactcttcaaaaaaatcaaatctaaatcttaatatatacttcttaatctcaattttagtggcagttaagaagcttagattttgatgattgtagagttaagttgaaaagtcctaggtttagcttgtactgtgactcctttgcaatttttaaaaattaaaatggctttctaaggaatgggagactaaaacttattctgtgataatttcacattcatttcagtattacacaggttttgaaaatgtaaaaacattaaaatcataagtctttaatagatacttaatactcaaatactttaagtacacagtcttaaaataatttgaaataaaagcatctgagttaccacattaaatcacatccctcatctacccagcctaatattccgtctctcatcatgtcaccaagaggtatgccaaagagatagtcatgccaattagttacaatcacattcaatgatagaaacatgtcctcaataatacttatcttatgactcttatagtcattaatttatctaaacctgtgtttggtcttggaataatgacttccatacatttactttattggataaagcagtattttattatctttaatgtaactctagtgtcagggcgtgccccctaaatctagtaaattaaaatttggtaaaaaaatctgtttatctcgtctatagccttcttaaagattataatcatatctttaagattttgtctttcaaagtgaagagtcctaatatatttggggagctaccaattcctttgaacattggtacatatttggattgtttctagctcaattatgtttttttaaactagtttttaaaactagtatgatgtataatattctagatgtgaactaaaaaaactatctgagttaatcacagaagttttaaggaagttagtgtttgtaccataatcactatagtatctttgataatggtagcattagtttgatataggattatatgttttaaatttgcatcctttaacaggttatagagaagcattggtccccaatgtgtagaggattattgtattaggccattttaacattgttataaatgcctgagactgcatagtttataaagaaaagaagtttaattggcccacagttccacaggctgtataggaagcatgattctggcatctgctcagcttctggggaggcctcaggaaacttacaattatggtggaagacaagtggggagtgaggcatctcacatggtgggagcaaaaggaagagagagcaagtagggaggtgctgcacacttttaaacaacctgatttcgcaagaactcactcactatcaggagaacagcaccaagaggatgctgtaaaccattcataagaaacaacccccatgatccaaccacctcccaccaggccccagctccaacactggg

SEQ ID NO: 54818 - DNA, 1065 bp, Homo sapiens
tgaaattctagattatttggatattttacaggttttacctatcaaatataacatcttaattttattaagtttttttagggtttttatggtgtttgtcaggatacttggcataaatcacttcatataggaactgttttaaatttgtattgtgtttcagttggggaacaaattaaggaattttagtgtttgtaggagcattttaggtatacccatacctttatttagaaagatagatgggaattttaaaaaagaaagccattaaataaaaaatgttgggggataaaacttagccctggttgggcatgaaatacatttgtaataggggcggcagtttatgtaaagtagtgctttgctttttatcagctgtttagattgtgcctaaatcagggtaaaattaaagatattgggctggggatacagcaaataatatggatttttttggttttctctttctctttgttacaggcaaatactttgaaagcaaaccgtttttcccaatcagtaaaagtagtacatgaacgactacagatccaaattcataaaagggaagccgagaacgataagttgaaagaatatgtaaaggttatatataaatatatatccatttttatagcttaagtgataaaattaatgaaaggccataaagccttccttagttctagaatttggtggttttaaaatacacagttgttgacatgggaaatacatatttaaggtaaatcttaatatttgtggcctaactaaaggtttgggtacaaatttcaacataaaaatgctgtctctgtttaataccaatctaggaaggatttatggaattgaattactttaaaaatcatttccactttatagttaatttatatttactgtggaaaatttatagaaaataaatttaaatataccaaaatcattgttaacattttggtgtacattatttcaatcttttttctccatctatacatatatacatacatactttcacacgtttaacagtcaatacgatgtttattttttgttactaatcgtaataattttaaaatcagcccaactttgatgttcacaaaatta

SEQ ID NO: 54819 - DNA, 1033 bp, Homo sapiens
ttttggatgtttgaattacccggagttgaactagaaaatcagcttttcttaagagtgaattttaaactaaaatcttctgagagatgaaatatatctgtttctatagtattatttggagtagataactatttttaaatttcagcatattaaagtttaaattagggacaaacagtagattatcttctataacttttatttgaataaaagcctaaaatgcttttagaatctaagctcttattttgatttcattttattttaatgtactgtataacagatccaatttactattgacaaatttcgtagcatttattattactatgcacaaaagaatgattttgtttagtaggaaaaaatattgtttgataatatattttagagggttttatttaatgctgtgtcttaaaatgtgtatgtggttcttataatttgtcaggcgaatctttctgcattgaatttgaagatttctgaacagaaggaaatattaataaaagaattagacaccttcaaaagtgtaaaactagctttagaacatcttcttagaaagagagactacaaacaagtaaggcatcaacactaagcactcattttaatagtgatatttctcatttgaaggatacattatttttaaactgtagaaattattggtatatttgaaatggaaataatgctttgaattttgtcagtcattaatccccacctttagtgtttcataagtagttgtatatgaacaccacgtttttatagaaaatgtatttttatttttcatctcaaaaactttgtcatacttaattgagctgattctaataaaatatacactttttgagtttaagatctttgtacattatatttatacatatctatatattcttcatctggtaaaagctttattgaaatagaattcacataccatacagttcttccatttaaattataaaattcagtggttttcattgtattcacagagttgtgcagccatcaccacagtcaattttaaagcatttttatcactccaaaaagaaagcttatcccttta

SEQ ID NO: 54820 - DNA, 1024 bp, Homo sapiens
aggttaaggatgctgctaaacatgccacaatgtgcaggatagccctccacaacaaaggattgtctggctcaaaatcttaataatgccaaggttgagaaaccctgatttaatcatgcaccattctgccccacaggcttaatagtttcctcttgaaaccaatgcttttgcacaagccaggtatgttattacaaattacttaccattctcaatccagccaggtatgtacagtgctccactctgctggggtatcactctccgtctggctgcgttaactcctcccagagcccgcacttttacactgtatctaccattcgtgtcataagttgtgaaataccttgagtagacaccgtcatccttagtagcatcagcaccttgataaagaatgaaggaattaataaataggtaacggggagggtatttgtatatttccaactcatatgtaggctatgaattttcaaagcaacaagaaattcagcattagctccaagagaccttaagattttggtgtgttgagggtaaggcttacttcttttatcactgtgtgtggttttatgtatacattctgtcttcttgaattgttgactttctttttgaaatctaagatggtatcgtttctgtgttacacccaatgtagcacaaggtaactactcaataagtatctgttgaactaaattaaactgctatatgcaaatgtggaagaaaaaaatgttgtatgattatttaataaaattcatcacttctccccagggtagatttaggtgggaaattcattcacaggattcattctattaaggttacttgcttcacagtaagcagacatgttttttttttttttttaaactgtagaattctctttctctctctccctgatagacttcttaaagacaagaataatgggcagaattttcacttttggggcaagctaatatagagtctgcatagatacaggaatcatataggactgtgcttgaatctatctctgctgctttctaaatgtgaaagcctcagtgaagatattataaaa

SEQ ID NO: 54821 - DNA, 1052 bp, Homo sapiens
aaatacgatagatattttttctatagtagcttttttgtggttaatggtttaaatcatttcaggtggtgatttttttttttcttttcaaacagagaacgagctgggtaaggtggcttacacttgtagtcacagcattttgggaagctgaggtgggagaatcacttgaggccaggagtttgagaccagcctggggcaacatagcaagatccctgtctctgttatttaaaaaaaaaaaagatagaaaagtggtaagaatttaaagcatctaaagccacttttgggattctgattcaaagtctcactaggttctcaaaccatctagcccacagtgacaaagattagcaagatgtcagttctcctgatttaagaatctattcagcagtaaaacagaacaacaaaacaaaaaactccaactaactagacaactatgttatgttaaattagcaaatttgattgacacacattatccaatgttaaaacagaaaaacaaaacagacaagcaagctaggccatttaactacatactttaagttagtaaatttgatggacgcacagtcataaaaattccaaagtcaatagctatgttgagaatagtcccttgtaatagttcttccctgaatccataggaatttccccttatttcctggttagtggaaatatagataaggaaggcacacaggacattgaattaaatacaaaatatttcctgcatatgggaccttgactacacaataaaaaattagatctataatgaaagcatttaaaattcctttctgaaaagtaaaatgcaagaaaaaaatggctaatgttagatgttcatcagataaactaaaatgttcctgaagttacttgtactattactctagaaatatttacggattatcttgtctgggtcaattgctttagttctacctgcctgcaaatagagctcactaacacagtatgaccttactcaacttgttgaaccactctttgcctcagcttcctgatttgtaaatatggataataatgttattgacctagggtttctgtgaagaaaaatgagataatat

SEQ ID NO: 54822 - DNA, 1057 bp, Homo sapiens
cttcagttatcctctgtatgctgacgatgaccaactacacatccagctcagacttctgaacagcagcactaggtgcaagaagtggtagaataaattttcaaagtgtttaaagaaaaaaattaaacagtgtttttaattatcacttacatattttcatgaagtggatactaagactcagaccacctaacacacatgttaaaagcactgttggaggaaattatccggttagaagcaaataagatataggaaataaatatcagtaaataatttagtaaaatttcttgtctaaacaagtaatgaatgacaacaaaagtctatcaatgtttaaacttagaaaacaacaacatgagtcaggttggtgttggagtccagagagaccaaagagcttactaaggcatttctgttgaaagtgaaggggataaggaaaatatagctactgacaagctttagaattctattactgtaggaaataaatcagtgaatactaaatataagaacagaagttgagaaaaataccagaagactaaaatcatgtgtaattttcaaaccagcagagtaaaactcagtctatccaatagatgttaggaaaggagggaaacagaagaaacaaaaaggaaatacagaaaatggaagagataaatgcaagaaataaataataaacgtttgtgaattaaactcacttttagtaagagagagactctcagtatagatttttaaatgatgcaatagtataaggttcatagagaaatacttaaaatgataatgtaacaattcccaaattacctacgtgtaaaagaaaatgtatgaaaggatatttgtaacaggtaaagaaaaagaaaaaaacagttgaccctagaatattttattctgcctcattataactttgctcaatagttcactagctcaaagattgccaactctgttctacagaactctttgtctctatcttgattgctctcaatatgtcctgcaacacagtctaagtaaaaacatgattcacacctgttgctgcttttcacaatcgttatctattgcctataggatagaagtccaagat

SEQ ID NO: 54823 - DNA, 1232 bp, Homo sapiens
tttgtactgaggattttccttccaattctcaggaattaatatagatacatttttgaaaaaaaatcttttttctgtggcttcaaacaggtacgtagaagctgtagtcaccatatcctgtcattaaaggaaaaaatatgtgaggatggtgaagttagagtgaactaaattagcagggttttgtgacaggcatttcccaacttaagagtggacagaaaagcaacagactgatgagtagggtctctgtctcattattctaactctgccacctgtcaaccccaaaccatcacttattcctgcacgttgaaagcctcctcagtcttctataatcctgccttaaaaggcaaatgcttgtatttggcattaagaggaattgattaataggaatatgtacatggactttggagtcatttacgtgattctaatactaatgttagtatcttctggatgacagatcttggttgatttatgcaatgctccgaatctcagtttcctcatccttcaatggactattactatctatcagtatggttggcatagagatggaatcagatataaagtcctctacaaacaggcaatcttaaaactgtttgatatcattactatttataagaaatcttcgtagaaaacaggcttagttgatgcaaactgaggaggacactctatagaaatgggtcattgaagaggtttctcatcccaaccttaggagaagcagctaggttgggagactgtgtgggtgggaggtgtgatgaaaaaaaacccatagtagagacaaaactttgattacagaactgttgctctaccacctatatgaaaataatatcaccttatattcagaactataaactcacatacaaggacaaataagaaaaatagttcctcccagaagaaagcaaactacttggaaaacatatttcagcatatcatctatgaaaacttccccaaacctgctaggaggccaacagtcaaatttaggaaatacagagaactcctgcaagactttacacaagaagatcatccccaagacacaatcatcagattttccaaggttgaaatgaaaaaaaaaaaaagagtgttaaaggcagctagagaggaaagggcagatcacctacaaagggaaccccatcaggctaacagtggacctctcagctgaaaccttacaagccagaagagattggaagctgatatggtttcactgtgtccccatccaaatcttatcttgaattgtagttccc

SEQ ID NO: 54824 - DNA, 1695 bp, Homo sapiens
atgggttttttcgttacaaaattcaacaacctaaaaggttaataaaataaaaaataattttaatataccatgcatttaaaaatcaaactacaaacctgaaaaatttaaaagtcttctgcagatatgttgtttgttgaatgaaatatcatttactgagcatcaatattacaataaggtagatttaccataataagaattatggtaacgtaataatagataacactagatagcactagttcagcaaatactatgtgttagccagtgttcaaagaactctatatcaatatatataatcctcaggtcacctgaacagatactttaaaaacatgacaatatgtcatttgattataaattctggaagcaattatcagcatacttacagaatcaatactttgcataaacattatggatgctttttctgtttgtactttatcaggaaagaattgacaatcttttccatacagttttgttgtagaatcaattctgcatgctctactaagacagctgcctccttgacacttataaactctatttctaccagagatacctgcggaacacctgaaaatatatgacagttaatctttgaggcaactgaatcattagcacttacagaaatcttaagtggttctattcatgatgaactttatatcaagatgtttattcttctatggtaccatgtacttcctatcctggctatagggtttaagggttccaatcaaaataattatctattttttaagaaattctagagggaaattttaagtggggcctccagataaacacaatggttgagttctctcctctaatgagttctctccttgtattaaagcttagacatctctcctgctggacttttggtggtaaatatgctatagggacctggataagagaatttttgagacaatttactctgagtaccactttagcttgaagttctttgtagatttccttccaaagaagatattcccaaaaaatagtacatgggatagacacaaatgttcttattactcaaagagcatttttatccaaagggaaatgtgattggaagcgaagatgaggtgctgccaagaatcccatggtagaataaaaaatgatggagacattttagacctatgttttatggaatgtaattgaccacaggtggcagtgattacaacaaatatgctgagatgtgaacatattttgtcttttcaataggctttcagttcaaattcaggaaatgatgaatagtttctattcagctatttagagagtcttataaatatgtcgatgcttctattgcttccaaactaggtggacatgatgaaactatctatgtggaaaatcatgctgaatattctgcagcagcagttgtacatctaaggggaatatgacataaacaaatgcaataaatgtaatactctctaaaagatgtgcctgaaaattggtgcaatggggcagaggaaggaccttgattgaaatcatatacctttcagttctcacattagtgtcaagtcccacgccccagcaggacatctacattgatgaggtgatagcaccaattttaattttaaattgattcttcccaactattttgctcttttgatcacagaatcaaaaggagagtttattattaactgtgatgctagacggcattataaaataacctttataaatctccaagaagttcctgcttggctccttgaagctgcttga

SEQ ID NO: 54825 - DNA, 1036 bp, Homo sapiens
agcaagcatatatttagtaccattagaagccaattcaacataatttatactcatgtcataaattatatattctctactatgtttaagaaggtattggaaacacgtaatccattttcatcacatctgtgtgtctgaaataacagctaccatagttaatgtttatataaaaacttcattgttatttagatcttttcagtctgagcttctgttaatcacatacacccaccccacaacttatgctctggtctcatggggttttcaccattccctccatgcgccttgcattgtcaccccaacgtgatgttttttgctcatgacttgatcatcttttcttaccccctttttcttcccagagaaattcaccacctgttcaaagcccagctcagaattcagctagttttgcatgcttcctttccctggctctatacaactctagtaaaactaatggcttcctctgctcacatagaactttatttttctatattcctcctgttatgtaggaatgctatctgattatgttatttcatcaacagttttatttgtctctccagccaactggactccaagtgccacgagaacagagattgggtctggtccccagcttcagtgcctccaaggcagaaactcaagagacgttgttgaactgtcagcctttacatttatgcattactattgaaggcctggaataaatggatcgtgttttacctgttatcttgctcatctctattactgcttcatcagcagctcttcccaaagcaataaaatgaacaatggccccactttgtttcacttcatcaatacaagaacttgcagtgttatcctccccatcagtcagcagcagtacttcggatccatcgagttgggaatgtagctctccaatcacctgcaaacataatgcagagcacagttaccaacagatgttcctagatcaaatagacaaatgggaaatgagaaaaaatttacagagaaaataaacaaagttatgcagaatagaagagataacctctattttaaaataaagaattttcaatcaaca

SEQ ID NO: 54826 - DNA, 1143 bp, Homo sapiens
tgtccttattaattcatatacagaatattacatatagtactcttacaatttctccaccactgggttgctttcagcttgctttctctaaacacactatgtcatctctctgtttaaatcaaaagggtccctactaaggaaaaatcctttctttgtgtaggatttaattctcacaacagtcaactaaaattactaaatctggagatttttagaggtacacatttcccagacttcctagggaaaggtcccagcattctgtgttcttacaaaccctcgagatgattcctttgcatactaaagtttgtctgcagactaaagacatttgcagactaaagaatgtctgctctatgtcattgttaatcactaataccatctcaggtaaaggcattccaaattagcaaatttccccaattacctaaatggtcatctagcaaaatgttgagaagggaaacatggtgcatataagttttaatgtagtagagatttgcagaaagggaaaaaagaggcaagggatagttgtggaaatattgatatatctgaagaaggcattgaggtacacaaaagaacaatttcaccttctcagtttttctcaggggcaactctagttgaagatatgattataaaatgattgaataagttacattgcaaaatatactgatagaaaattttgttaattcgggtgcctatcaatatagttatttccttgctcattaacctcttaacagaagcttccgttcctagaacaatccagaatctagggaaagggtctttaggcatcacccatctgtgcagaccagggagacagataatggccaacgttgcatcttgattcctaccagccagacctggtatctgatgccccagtgatgaatcttcctcttttgtggcagtgctagctgcctctgggccccagttctcaggactatatttatactttgttccagctgtcgaggattactcctgctttcttttcctgccagagacccaagctctatcacttaatcacatttagtttgcttgtgcttcaccctctctctagccaggctttcttgatgctgtcctcagcctcctgaatgagacctttctaattggtgacagacattggttgcctggatgataaacaacaatgatgacaaaaaattacat

SEQ ID NO: 54827 - DNA, 1097 bp, Homo sapiens
tttatttattctcaaaaatgtctagttatgcaaagcagatagatcaaaagccttactcattttttaataaaagctgaattctggtcttaagctctgcaaattgctaccttctttgtatgaaaagtaggaccacgttaaaatgtgtcatttgattgattaaaaaatatcagattataaaattaacactttgctaggctgtcaatataaaaccattctccccccacccacccttacacccctgtttttgcaattagcaccttttacttaagtcaaaatcacatgacacttcatccttaccttttccaacatcaaaattatctcctggtgctgtccatgtaagaataatcttatcctcatgaactgtggcatcaaggtctgtgatttgacttggtgggtattggtcaggcaagggaaggcttgggacttgtgataccacaaatgcacctccggatgctgttcggctgaaatcctccaaggtggtctgagtatcctcatcaatttcaggtcttggcgggtttgcttcaatttcccctgcattaaacatttcctggtttataatgggcaaaactactggtatttattataattcagtgaatcaccttcttcacttgtcttttccttctaaaaaaatatatacagtcacatttttactaagttttgtgacaatcataagcgcccaactggtgagagaattctttctttggtaggatattgtaggacagaatcagaaaacaaattgctttagaattaagcctacactgggtgacagaaatattatataattcaatgtgtgcctttttaaaaaaggaattgctttacctcttgaattatctgcactctgggaatatacctggggaaatcattgccagttctcctccacccacttgtgctaggtccctccctccatgctgcaagtgctaaggaataattcttctgattgtattccaattgctagtagaaagcccctaaaagtcacaagggaccagatgaaagaaagctagcaaagaatgcattcttaattcttacatcactttactgcacacactgtttttctttttgacttattaaaattctaaataagtgtttactctacagca

SEQ ID NO: 54828 - DNA, 1399 bp, Homo sapiens
gagaagagagacagagagacctacgtaagtggaacacaaggtttttgtgaagagtagtagaacggattgataaggcctatttaaaaggaaactaaatgttaagcagaggatctgaattatttttaaaaatacactaaaagttattcaccacacacttgaaataccttcaatatttcatggaaaagttaaaaataaagtccttactccaaaaaaaatctggtgttttatttttcatcacatttcagaatgtgagaatatatttctacatgaatggtagatatcaaaaagcagtgtagaaagaaacatttatgttggcatcttcttttcctttcttgataaaataacagccaatatttcaaacatttattaatttaccatttattaaattgtagtgaacatgtttcatgcattatcatctatgattcttaccactagaatagtaggcactcaataaatatttgttgaatgatttgaataactgaatccctattttaacagataaaaaactagagataaggaaacttaagtcggggtgcggtggctcatgcctgtaatcccagcactttgggaggccgaggtgggcgggtcacaaggtcaggagatcgagaccatcctggccaaaatggtgaaaccccttctctactgaaaaaaaaaaaaaaattaactgggcatggtggcgcatgcctgtaatcccagctactcgagaggctgaggcaggagaatcacttgaaccagggagtcagaggttgcagtgagctgagatggcaccactgcactccagcctggcgacagagcaagactctgtctcaaaaaagaaaagaaaagaaaaaaaaaagaaaagatatcttaaataaatttctttttatgacacagctagcaagtagtaaaattagggtgctactcaaggtttgtctaggtccttaacacatatttacttttattttttattttcatatttttaaatttttaatttttgtgggtacatagtaggtgtatatatttatagggtacatgagattttgatccaggcatgcaatgtgaaataatcacatcatggagaatggggtatccatcccctcaagcatttatcctttatgttacaaacaacccaactacactcctttagttatttttaaatgtataattaagttatttttgactattgactatagtcactctgttgtgctgtcaaatagtaggtcttattcattctttctaactgtttttttgtgcccattaaccatccccaccttctcctacccagtcccccactacccttcccagcctctaggaaccattcttctactctgtatgtccatgagtttaattgttttgatttttagatcccacaaataagtgagaacttgcgatgtttgtctttctgcttagcacgtgttta

SEQ ID NO: 54829 - DNA, 1062 bp, Homo sapiens
aagatatattatcttaattcttaactcttccatggaaatgttctcattaattttgagaattaaacaattagtctttgtaaactgtccatagataaattttaagccattcaagtatgaatttgacattgctattttgtatattcatctaccatgaccaaaatatgagaggtttgtaacccatagtatttacaaaattaatatcttctgctcttagatttagacatttataacaaaaatttttaaaacaagatatattgaactataacttatcacatgccaatcactgtagtagcattttctgtatatttttctatttaatctttacttcagcatagcaaggtagacattgtattataaccccaattaactgggacctgagcctcagagatgtgaaataccttgcccaagttcagactgaagctagtaaatggtgatgctgagatacaaaccaagatctaattccaaattgtatgctctttccactaccatcctaatctcttccgctaaccaacatcatttatttatctcataaatgaaatcccaagttccacgtgccgtgaatgttgacaagactattgttattaaaacatctttatgttttaatacacaggaaggggaacatcacacactggggcctgttgtggggtgggaggaggggggagggatagcattaggagatatacctaatgtaaatgatgagttaatgggtgcagcacaccaacatggcacatatatacatatgtaacaaacctgcacactgtgcacttgtaccctaaaacttaaagtataattaaaaaacaaataaataaaaaataaaaaataaaaaatctttatgttttcaaaatagggagttacttttatttaaaatgtttttataaataattttgataggttatactacctcttttagagcctttaggaacagctatttaacttttttaaaccctagttttcaaaaggaggttaataatactatttatctcacaaaacttttattaatgaagacacttttaattactatcataacttactaatggagattaaatgagataaaacatataa

SEQ ID NO: 54830 - DNA, 1871 bp, Homo sapiens
ttttatatatgtgaggaagcagccttactgaggttaagaaacttgcacaactagtaaataaccaggtgctgtctgacctagtactcccagctgctttttcttccgggataagcattccagatttaagatagctagaataatagaatgctgtggcctagagagaccttaaaaatcatctggttcaatctgagcatttccatatcaacaagcaagtaacactttagagatggtaaattccttctagcttttgatttctaagttctaaaatctgcatggtgagtaataagctagctgccttaacccttttcttcccttccttccctaaaatatgatatattgtagacgttgagcctttatagttaaaataatgttttgatttaaattcactagcttctaatagttcaaagacaaggtgcaagaagaatgagtgattgagggtgtgaaatgaattttgatgtgtgagacacttgtacacttttaacattgactgcaatagaggactagagcccttggtatttttgtttgtcctagtgctcattacctataattctagatgcttatgaggatttgacactgtataatgctactcttttaaatacagttaaatatgtttcagacgtataactcacaccccttaaagaggacacatttactagaatttagtctgatttaaattgtggatagactcaatttaaaaaattaaatctagcaaagctctcaaaatgtgtacttcccaaagaattttaattccttgtttcaaattctttaggaaaaagttttaaattttatgctaatctgttagccatcaaataattttcttttcagttttaaatatttaagtgtctactgcatgtctgatgtctgcttgtggctactgtggacactggtgatacagcagtgaataaaatcagcaaagtgtctgccctcctgaagcttacattgtagcggaagataagcttgtaaatacatcaggtggtgataaaaatcatggccagaagaatagaataacgcagagatggtggttgttaatatctttattagtattttctaacattagtatcgtgtatagataggatggtcagggcaagtctttctaataggatgaaattcaagagacctcaaggaagtgacagacctagttttttttggaataaaagtatttcaggcagcaggaagaagtacaaagactgaagtttcaggggcattaaggagaccaatgaaggagctgtggccataatacacgtaaaaggcgattgtaacttagattacagtggtagcagtgaaggttccaaattatccagtattggctgttggattggctgtgaggtatgagagaaagatgagttaaggatgactccaaggttttggcttgagccgtttattaagggaaaaattttaggagaaacagacttctttaatgtgtctgtaattgttagagatacatactgaaatgtttatggataaacttatatcatatctgagatttggtttttacagggtatttttttttttttttttttttgagatggagtttggctcttgttgcccaggctggagtgcaatggcgcgatctcagctcattgcaaccttcgcctccccgattcaagccaatctcctgcctccgtctttcaagtaactggaattacaggcaggctccaccacgcccagctaattttgcatttttagtagagatggggtttcaccatgttggtcaggctggtcttgaactcctgacctcaggatccacctgcttcggcctcccaaagtgctgggattacaggtgtgagccaccacaccagttgagattagcgtttgaatatttcaaaagaaaaaaacagaagtcgctgaaacaacagcaacggaatgttgat

SEQ ID NO: 54831 - DNA, 1701 bp, Homo sapiens
aatgaggttgcatagtttatccagctggccttgggatcagggtttgcttttgctcagtgcccagtcctccagctacactgcaagtttatgggcttaggcaatagctttgtaactgctatttttggttctacccactaggtcaggggctggctatagaccattctcaaaaagacccaaggctttacaaaagctatttaagctgttatttctagcccctaaacaggagcctcagtggagattgtaaccagaagtctaagaatagaattctagaggatccttcagcttaaggtgttgataataacctgaaagtattaaaccaagaagaaggatgctgaaagaaacaataaaactcagaaaatagagtagcaaacgagatttttgagaaacgaaaggagagaaaggcaaggtgaacactgttttgtcagccagaagtgagtcattactgagcacagaattaatgctagtgatatacctgtgttaagatgggaggaagccacatattctagaggaaaatgatgcatgataaacagcttgagtcatcacctctaatgtttaattaaaagtatccagaaggctgtagatctacacagaatctttttactgctttattattatataggcagtgctaccttttctcaaataccagtatattcaataataaaaattgattcattgagtacgtttaaccacattttatgacctttaaaagatgtcttcatagtatgaataggatatgttccaaaagttagtctataaataaattgctggaacatatcctcagcagcttaaatgacaggttttatggtatgttctgggaaactatttatctaactaggtgtgattaaagtgctaataagacataaaccacaataaacattaacagctctttcaaaacttaataattacaaggcaccaaacaaagtgatttgcatacacaatcatacttaatcccccaaacactataaaatatgtattgtctctcttttataatagagggtactaaagaaaaaatattcaatacattgctcagctcacacagcaaggaacaaagttaagatttgaattcagattcaactgactcaaagctcttactctttaccgttatcctagtctacctaggataggtagttgaaatagttgcatgctttatataccaagaagtatacttaggttttctgtagaattcacaccatacattttagcagaactaagggtatgtgatgactgtaaggtagggtcatccacaaaagaagtatggataaattaccataggagcaaaaaaaagtattcataagcaatggcttacaaagctggagcatggttatttgtatgtttaggattgtttagctttgaatttgctttttacttattgatatggttccctaaaatttatttgcagtatatttaatttttgttttacaatcaataacagttcacagaagaaaagcttggccaggctgagaagacagaattggatgctcacttagagaacctccttagcaaagctgaatgtaccaaaatatggacagaaaaaataatgaaacaaactgaagtgttattgcagccaaatccaagtaagaaactctacctcttgtgtaccttaagtactattagtgggtttttaaatgttaaaaaaaaaagttttaatggccatctgaaaacataggatttttttattgtagcttcaaggtcagtgggttt

SEQ ID NO: 54832 - DNA, 1385 bp, Homo sapiens
ccttaaactcctgggctcaaacgatcctcctccctcagctttggagtagctgggactgcagacatatgccaccactgtgcctggctcctcagccatccttttttttttttttctgaatgtttttgatcgtggttggttgaatccatggatgcagaacccatagatacagagggccgactgtgaccgtaaatattttggggtatatttgccctctttagtcccattggtagaattggtacaattatctatgctacaataggaagttcatctttgtctccttcatttagacacatactcttaaatttacttttaaaataaaactaccttaattacagttaattctatttggttttactttagcaagcaagttacagctaacttttaaacagaccaaattgctgatttatctttacatgattttattttctggtattaccagacaatgatttttaaaaacatttttcctttgcaggtaatgcccttattaaatgtggagaaacccaaaaaagaattggaacagcagacagagaactgattcaaacgtcagccttaaattttcttactcctttaagaaactttatagaaggagattacaaaacaattgctgtgagttgaaaaatgtcccctttatttagtaaaatcatttagatatatatactttttaatgaataatttggcctcttaatgactgtgtagatgtagtggattacaaaattaaataatctaggtcagtgcatgttcaccagaacacaaaattaaaccaaaataaaagactactgaacatttactccatttgtgtgtcctacagtgttattgagatgcctttatcccttttcattcattaccaacgctaaaatctatagagaggttcctggaatgattatgaaaatatggtctaaaatatcaccatagtatatataccgtgtagctcttcattttttaggattttaacttattttcttagtgatagagaatgaaaattttctaagagttttacaaagctgctcttataaatacttcaaactttaatttgcagatttcctattacaatatattatagaaactttgaatatgttcacaatggatttgtctctgtataaacaaatatttggcctgagacagaagaactatcaagttaaagtatgatttaaaagatattagcagccgggcgtgatggctaacgcctgtaatcctagcactttgggaggtcaaggtgggtggatcacttgaggtcaggagtttgaaaccagcctggccaacatggtgaaaccccgtctctactaaaaatacaaaaaaattagctgggcatggtggcaggtgcctgtaattccagctacttgggaagctgaggtaggagaattgcttgaaccctggaggcggaggtt

SEQ ID NO: 54833 - DNA, 1026 bp, Homo sapiens
acgttttgggctgcacaattccttgtaaagatagactgtcttgtggaatgtttggcaacatttctggcttctggctagcagactccaataacatccctccaccaattgtgacaaccaaaaaggtattgccaaatgttcccgaggcagggacaggatcataaaatattaaaactgatattcctttgtttccatcattgcctgccatctttcccagacacttacaatgtttcaattatttattttaaaatttaaaacagtaacaagggggtgggggggggcagatacatgaatggtaactttatagccaattttgtagtcatagatctttatcaagtgatacatatgtttactagggaataatactttaaatgtgtatgctcttaacagaattttagcatctttagcccttattttttcttttctatatttatagaaagaaaggaaactattgcaaaataagagactggatttggatgctgcaaaaacgagactaaaaaaggcaaaagctgcagaaactagaaattcagtaagtaaatagaaaaatatttttgattaataactttaagatttgtaaaatattttgctaataaaccatgaaagatacagactattaactttagagtcttgtttttgtgctttctaaacaaatttatcagaacttaatacatccaaatcactgcaaagtagtcatatcaaaaaggtgatattcatggccaggcacagtggcgcatgcctgctatcccagcactttaggaggctgaggcaggcagatggcttgagcccaggagtttgagaccagcctgggcaacatggcacagccccgtctctctacagaaagtacaaaaatgaacgggcatggtggcacccacctgtagtcccagctactcaggaggctgagatgggagaatctcttgagtgtgggaggtggaggttgcagtgagccaagtttgcgccactgcactccagcctgggcaacagagccagaccctgtctttaaaaaaaaaaaaaaaaaaatatatatatata

SEQ ID NO: 54834 - DNA, 1070 bp, Homo sapiens
aatgatctttgaataggaaaatttggggttaggtaggactttcttagtgaaaatttaataaaaattgtaggtaactggcagttttaaaaatgatacattttccctaaatgattctcatttaaagtcaagcatcaacatattttgttttgaaaatttgaattttggggaaaaaaatgaataggcaccactatatgcagtttcacagaacaataaatgtagtgggggttttttaatagaaaaaaatatttgattggctcttttacttgtttaatgtgttatttattgtgaagaagtaatttgtttcactgtgttcattggtataatgtgttctttgtctcttactatgcacttaagcaactaaactcagctcgccttgaaggagataacattatggtaaatttctcttacatgctcaacttcctgcatgtaaaatggctgaaggtttgttggcctactgtgttttctacatcttgaataaagtgccttctcttgctattagccgcttgtaaaattttgaaataattggaaccatgtattcatttatctttaacaacaaaaatataaggaaaaaatactagctgaagtaatactggaactttaaaagaaattgtatgttctgattgccaaatatagtgtttatgccaaatacagattttagaatatgaatttatacataaatatatagtgcctttttgcactgactaaaaggtgctaatttaagctggcatttatattttcacttttggcaaagaaaattaacaaaatatacttaaagaaaggtgtaaggtaaacacattgcctttgctgctcagtagcttcaagatttaccttattttcacccaaactcaacatagaattaattttttctgccatttcaggccaagacagaccccattaggttaggtactcctgtaatggccaggcttattttccacccagtgctaactcacttaagaaagttttggtggaatggtgatagccttgggaaagaatagagaatgcagattgttttatggtatccaatgtatatgttgagcttagtttgagaaaatttttgagctattagaagt

SEQ ID NO: 54835 - DNA, 1024 bp, Homo sapiens
atctgcagtacagctaatacattggcaattaattggctgctttcattcactagcattaaaccaaaagcaggaaagtaataggaaagattattgtacagaatatataaaatgcatttttgtttttgtttttttttaaatggtaattactgaagccctggctgaattagggcttaccttagatagcaagagaatgcattaatgtgtttccattgtcctatctataggtaaatgaaaagcgtgaggatatttcagtcattgctaatttaaaatataaagcatagcttttctttttgtctgaggtaaaaacataattctaaacaattaacaggactttgtttcattaatcatttgtgtttactattaatgtaatcttatagtaatatatatttacagctggtcattttatatttattatatctccagcttattgtttctctccaaaaagactgtttcagcagccattaatccttgctttgcttcatttcctaaaatgttagaatttatacctaaatgagaaatttgaaatcatttagtccaaatctctaattttccagatgagaatactggagctaagaaaggttaggtgttctcaatttgggaaaactgtagatttaacataagattttaaaattgatagcaatgatacatataaaagtcatactttcacagtatgttaagctgtaccgatttagttactactgtgtttaatctataaatatgattctgaaaaagagtatgccatttaaacaaatatttatatttttctatactaagttgtagaaaataaattccaactttcatgctttatatttttctctaatttttaatgctggctagatttgggcagaggaggtgacaaaagtaagtaaattattaaatacagaactatgaaacaagaatttagttgacgttgattcagtaaatatgtattgggcaacaacccatgggtccagtcacagtctgtgttagtataccttataaaatctgaaaatgagggatatgttcaggtctctttagctaatag

SEQ ID NO: 54836 - DNA, 1057 bp, Homo sapiens
tggcaactaaacgcaaggtgaaaatcctatggcttcactctaaagtcttttgcatttgagactgaagactctttaacttcaaagtaaaaactgtagtaataattgagaatttttgcagcaatattactttatacttgtaaaactggtcatcttaaaattttgtaaaatagtaaaatttagcaaaattgatactagaaaatttatgaaaatatcttggctttctcttagtagtttttgtaggctcttaagagtgtatcattaagctttagcgtaacagattcttttcaatcaagtactggaatcagttgtccaggtggagtaatacagaaaagctaaggtctagaaaccaggggaccattttagatacaaagcagaattgcggaattgccagattataacttgaggtttgttcgggggattttttttaaccatctaaaataaatgtatataagatggactgagtcttctaaagagattctaaaactatattcttacttaagtctgaacaggaattaagaataactcaaagtgaatttgatcgtcaagcagagattaccagacttctgctagagggaatcagcagtacacatgtgagtattcattcattggaaattcatttggaacaagactttggtagtcctaaggcaattttgggaggaaaaactgaacttttcagtcattcatcaaggaaatttaaattgttctactttccaatatatccgaataaatattttaaattgttgtttacatcttatcaccgagttctcccaccctcattaaatatacatgttgttgtttattggctaagcagagtttgctagtgtactattcacgaaggccaatcttaataagccttgtagtaaaatgttagatactggtgagtctacctcagtacaatattgtggtctgtctcccccttgcatttgccatttaagttgactatacagctaagaactaactataattttccttcacaggcccatcaccttcgctgtctgaatgactttgtagaagcccagatgacttactatgcacagtgttaccagtatatgttgga

SEQ ID NO: 54837 - DNA, 1062 bp, Homo sapiens
tcaaagcaaaatgacagtatgtaaaacacaaagctcaatcactcattcatcacgtatttattgactatctgccatgtgccaagcactgttacatattgtggggtaatatcagcaaacaaaacaggcaaagatgcttgcctttatggagctcacattataaggtgacactgaaaataaaataatgtttagggcaaacatggtctctgctctcacaacacttagcctaggtagaaatacaaagcaagccgttggtagacaggccatgtggtaggcagaaaagcagaaggtgcctggtattgtgaaggcatctaactgtgactgaggtacatctagcagagtttcccaggtgaagttatcttggtaggaataatctagatgaagaaagggacagggatgaatattctaagcaaggaagaatatgtttataaaaaagccagaagaaagagagtagggaaagttcggggaactgatagtagtccattcaggctggagcatagtgttcaagaatggaatggtagatgaatctagaggagttaagcagggtcataccatgaatggcttttaaagtaagttgttgtaaggagtttggaatttatatattgaggaaccattaaagcaggggagcgatatgtagcatttgaaggatgaatatcaaaaaatcgtttcaaggaataaggtaaataaagtcactttggtgtttgtttctgcacattaacacttcaaaacttggcctagaataaaattgagcacgtccatgaaaccaattttgaacctcaaaaatgaatggtagcctaatcattagttattttaatagaatatacaggagcatttacataactatatatttgaggttttattagtggtgttaatatctcaaggcagaacagcactttatcttcacatcattataactattttaagcccaagaagccttagtacttttttccactttatcctgaaactctggaagtgcggcataggggttgcttatactcgcattctacttaaagccacactatgcttaggacttggccatttaaacaaaatccagttgttgcgtta

SEQ ID NO: 54838 - DNA, 1642 bp, Homo sapiens
actgggtgtggaggtgcatgtctgtagtcccagctactcaggaagctgaggcgagagaattgcttgcttaagcccaggaagcagaggttgcagtgagccaagattgaaccactgcactacagcctgggcaaaaggaatgaactcctgtatcaaaaaaaaaaaaaggagttcctgattgttcttttttcctctcagttaaaaggaagcaagctcatcaactgagtgtaatggttatggggagaactgctgaaattttgaggatgggcaagagggtatgaaatagtcatcaggggaatgaaagtgaaagtgaatggagtagagaaatgtagtatcattgccaggtggcatgtggacccacttgaggttcctagtcataaattgaatgtaaaacaaagcttttctgtgtttctcctgttaaagtagatgcatggatactgaataggtaaataggtttttaccaaatcagtacaatgaagtgagtggcataagaaatgagagcatatctaagagttattataataattaactatggacatgaagaaggtgttggtaggatcatagaccctggtaggcttgttgatgtgagagcacttgaaagaaaaaggcgatggtcaaagaatgggatagtagaaactattattattggaagggttgtggttactggaattggtaagatctagatgtgactgtgggaataggtggctgaactaggatcaggtatgaagtcactagaagagaagagttcgaggatctaagaggctaaagggttggaagaattgtccatttggatattaaagtcaccaagaattaagtaagagataatgtcagtgagccaggtgataaaatcttctagaaatgaaagtaagggaatgaggcatctgtaggtgattgcagtaagagatactgggtatctctttttttaaagagttgggaatgatacaatagatggagaaaatgtaatatgggaaggaaagataatatgataaaatgtaatatgataaaatatgataatgtgggaggaaaagatgatgtgctatagttgaataacatgaagttgaaggattggctagaattgtttagggaaaagagtctaaaaacagtgatgaagaacataagactcctccattgacctctaggttcagtgataaaagaggagtatgggagataaacgctagcactggaggatgaagggaaggtttagagaagaggttaaggatacagggaattttgctgatgactgaaatgatttccagatggtatagtgctcgtgaagagaaaagaggacttttctagtttaatgaatttattaaaactttgaatttttgtagatcattttttagcttagaaatggttgaattagaatgatgtcagaccagctattttgtactgttttatatttggtattattggggaaactagccttaaaataaactgaaaattctaattatcttcaaattatttatgagcacattaatcacaaaaatcactaatttctaatagaaaatttttctaaaaaatagcacaaatgaacttgtaaaatttgtcctattctaccattgagtcttcaatttcattgagataattagcagtcatattatttgaatgtctaccttctcactatgtgtatgtccttaagggaata

SEQ ID NO: 54839 - DNA, 1850 bp, Homo sapiens
ttcatttgagagtatcatgtgggcattacatacttgttaatttcaataataagctcaaatccccaataaactgtcttgctactaatagatatttttctctttaaaagtaaagtaatttcacttgcttctagtcccagggaggctgaggtgggaggatcacttgaaatcgggaggtggaggttgcagtgagctgagattgtgccactacactgcagcctgggtgacagagcaagaccctttctcatgaatgaatgaatgaatgaatgagtgatttttttaattctcctttttttccgaaatcctgtaaaactcttctccttaaagatttcctttaagacttgtttattgtcatgtctaaaagcctttttttaattactaaatttaaactggattgaattgctttgtcttagatgaggctgagaaggttgtttctgaacagaaagtaatgatgacgtccctcttttttgtagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaatctatctgaatttggaattcttctggtttgttctttcatgtttaaaaatgatgtttttcaatgcatttttttcatgtaagccctttttttagccaaaatgtaaaaatggctgtaatatttaaaacttataacatcttattgttggtaatagtgctttatatttgtctgattttatttttcaaagttttttcatttatgaacacattttcattggtatattatttaaggaatatctcttgatatagaatttttatattaaaaatgatttttctttgcttaaccttctgtgtggttcaaagtgacttcttcataagatcaaattggtctaatattctattatgtcggctttacctcaggataaattcttcataatctagaaacttcgctgttgattttgaattaaattattttaatgaaggatagttggaaatctataaaggcagctctatcagagaatgtttataaagtatgtacgtatgtatgtatgtatttatttatt

SEQ ID NO: 54840 - DNA, 1181 bp, Homo sapiens
gagttctttataatgagattttactgcttttcttataatatctccacatagtactttctataacgattgttttaattttaaaactttgatcacttaatattaaaagccaccagaaagaatttttattaagtaactatcttggatagatgatatatacctatattcagtttatcaccctaaaaaaaaggtaggaaacctttaatattttgtagcgcttcctaggacatcttacctatttaaagtttattgtcaaatctccttatctccttcggtctttttggctaggtttaagaataattgaagtaggttggaagtttctctaccatttattatacttgggcctccatcttctcttccattagactggaactacatggtcctgtctggctaaccagctttgacatttctttgatctatatatctgctaactgtaatgtttatactgtgaaaatttatatttattttataagtacatttttaatttataccagttttttaaattcctgtttttccttttgtagctgtatgcaggagctattcttgaagtttgtggatgaaaattgggaaggttccctcaagtccaaggtatataaaatttactccagtaaactgttcagtcatttaaaatcaacattttatgtgaatcgttttcactatatattcccaggaataagaatttttaggattatactttcttaacaatatatgcttttttttcaatttgttttcatggaagtggtttgttaaagtaattggtgaatgctatgttactttaaaaaaaacacaatatatgaaatttagaggccaggcgtggtgggtcacactcagctcatgcctgtaatcccagcactttgggaggccaaggtgggtggatcacgaggtcaggagttcgagaccagcctggccaagatggtgaaaccccatctctactaaaaatacaaaaattagctgggcgcggtggcgggtgcctataatcccagctactcgggaggcggaggcgggagaatcacttgaacccgggaggcagaggttgcagtgagccgagatcacgccactgcactccagcctgggcgacagaacgagactctgtctcaaaaaaaaaaaaaagaaattcagatttaaaatacaacacatgaaggggttattttcttaaaagaagagcctttcctttgccgggtggg

SEQ ID NO: 54841 - DNA, 1038 bp, Homo sapiens
ttccccagcctcagcctcctgagtagctgggactaccggtgtgcaccaccacgcccggctatttttttttttttttttttgtattttagtagagatggggtttcaccatgttggccaggatggtctagacgatctcctgacttcgtgatccacccaccttggcctcccaaagtgctgggattacaggcgtgagccaccataccctagccgagagtttaattttcatctcagcttcttactgactttgtgattgagctagcacattactccaggatcttcaattttgtcataattacattaccttacattagtgtttattttacactggttatacgctaagtgttttacctacattatctatttaatcctcacaacaaccctataatgtaaatactattatccctatttaatagaagaggaaactagggtataatctgcctaccgttaactggcgattagatgccaaaacctggttttatctcaggtctatttgattctagagcccccaggtttttaaacctctgtgctattttaccttttattttgaaaatgttaatagtaagacctgcttcggagttactttaagaagttgaatgagttcaatataaaacactgggctgtctttctgaaggccccttttgccatttgtacttaacaatattaataatagaatttcgttactagtttttatttaaaattaccaaatccttatttctcagtttaccacagactttaatggctcctgtcacttggtgtttttcaagaatatgttcccaaattgggctttatttaaggcccagccagataatattttatataaatcatgtaatttttcttaattcggtaaaagagcatcaaaacatttagttgttttcaatttgcgtggctattgtgtagccagttgcagttactcataagtcagcttaaacagcattatttaagacaatggcaaattttaggcttcaggctgtcagaaagagaatgctactgatgtgtaaaacatagaaggatgaaatggaggttaagctaactgcgtga

SEQ ID NO: 54842 - DNA, 1073 bp, Homo sapiens
ggcacctgccaacacacccggctagtttttgtatttttagtagagatggggtttcaccatgttggacaggctggtctcaaactactgacctcaggtgttccactcccctcggcctcccaaagtgctgggattacaggcgtgagccaccgcgcctggcctatatcccactatttctttagttagtaccttttcttttttagatcttggtttcccaaggtccttgtagtttctttcttcctccttcaaaatattttgatataattggttttagcatttttagtcttttgcatttacacttgccttatttctgaactactattctgaaggtcaagctggtaccaaaccagagcacctctggagataagaattcacttagctgaattgcttatctgtgtgaaataataaacaaattatttcagcctaatttattgttcagttttgattaaaaacaaagaagtttagactaatggttaagatagactatagaaccagactgtctagattcagatattctctgctactcagcgagtgttcttggacaaattacctgattactgtgtgtctgtttttataactataaattggggataattatagttcctgtctcatagggtgattatgaggattaaataagttaatatgcatgcactgcttaaaattgtgtctagcatataacaagtagtaggtaaatacttgctgcaggtggcgatgacagcagcagcagtaatagtagtagtagtaatctggtttgctgatgataaaagccagaaagaacagaaaatttggagaactcagaatagcatgataataattgctattgacaaagtagggtaaaagaaaatagatatgaaatataaactatcagatttgccagtgttaaaatttggagcagtatcttttattccactttcaagttcctggattagtcgaatcaagaggaaatatattcttacagaattagtatgaaaatttttactatttataactacttgtatgaaacctaatacagaaataaattatgtcaaacacaatcctactttcaaatttttaagtcctttcaactgacacatttt

SEQ ID NO: 54843 - DNA, 1057 bp, Homo sapiens
tggagtgcaatggtgccatctcggctcaccgcaacctccaccttctgggttcaagagattctcctgcctcagcctcccacccgccaccacgcccagctaattttttgtatttttagtagagacagggttccatcatgttggccaggctggtctcaaactcctgacctcaggtgatccacccaactcggcctcccaaagtgctagaattacaggcgtgagccaccgtgcccggcctgctctttgattttttttttaaatgtttatgaatctccagcctttagcacacagtatttcataagttcttgcccttgaataaggctgtttttactaagaacaagttggaaaaggtgatttttttaaaagctatgttgaaaatatacataacttcatagctacttgataaatatctttttcatatatttcacttatatcctgaaatatatttttaaaaactgaaagaataaggaaacttgtctccatgttggcagttagccattggtaacactctttggttataattatctaactacaaatatagatctcccgtttctacattttacttacaaggatgccataagcatcccaaatctatctaaaaagagataatgttaattatttagcacaactttttagtgattccaatttgaccactcaccttaataggtattttttcaaagtatacatgaccatcagattaaaattgtttcctgggattttcttgggatacatataaatattttttctgttagaatttttgaactattcactattttctaagatctgtaagattaagtgtagtattttagtgggttaaataagtgggttatttttctcatctttttataatcttgcaaattctgtgcacttgaacttgcttatggctgctggatgctttttttcattatttccttaatcaaggttcttaataatgatttcagctgctttgagatgttattttagaacttttttttccctaactatatccgcccctccccctccccccctctttgttttgagacaaagttttgctcttgttgcccaggctggagtgcaatgg

SEQ ID NO: 54844 - DNA, 1067 bp, Homo sapiens
ataaagtagactggaaagatcatttgagttgtccagttaaaactaaattggtaagatacctgtgtttgtagtgagaaaaaaatgttagcatatttctgttgtttccttccagtactgtctttgacttgtacatgctgaattctgtttgaagtattatggtttgtaaagctttcaggcataatgatgtgttattattattggtagtaaaggtttgtttttaacagtaagtgcattttcggagttctaaaagaaaaacaagcaggcaagctttgaaatgttagtattcagccaaaatttaacccttgatttctctgtatctgaacctgaaattccaagtatctcaaaaatggcttgcaaagccttacatgtttttcactttactggttcacatataccagtaaaacattttaatgtttagaagatttctttacatataagttattctttttcttgcatgtaaataaaatctaaacaagtttttaaaacttgattttaaatagatttaagacatacaacttaactagtttagtagaccttttgctgcccctctgttctttttgctgaggtattcacatgggacaaattgctgaataaatctgtatgagccatcctctccttatctttaagctgttctatgggctgtactactactcaaccaacatcctttttcactgaaacaccaaactcagaaggactgaagaacaaggggcattttataataaacagtgtttaccacacacacccccttgtgattagggtaaattgagaggtctgctatttgacaacagatatgccaaaactgtaaaccaaatgcatgtaaaagctatttttacttactgccttttcttagtagttcttcataataccccagttttttggtataattttagtagaaccaaacttgcaccacaaacctctaaaattaattatattcctattcaattttcattattaatggagctatatgttgtatcttgacacatttcagcagttgcagctcagcaataaaagtagatctgccaattaatatatgcccagctaattacaagctggagtgattatcgtat

SEQ ID NO: 54845 - DNA, 1108 bp, Homo sapiens
agaatttattgctgggcgaggtggctcatgcctgtaatcccaacactttgggaagccaaggtgggcggatcacgaggtcaggagatcaagaccatcgtggcccccgtctctattaaaaatacaaaaattagctgggcgtggtggcatgcgcctgtaatcccagctactagggaggctgaggcaggagaatcacttgaacccaggtggcagaggttgcagtgagccgaggttgcaccactgccctccagcctggcgacagcaagactccgtctcaaaaaaaaataaaattaaattaaaatttaaaagaatttatctccaaatgaaacatttcagtaacttgtcttcaatgtgttagtttttgacaaccccgtgttctctttttggaaagctttgtagtataaatatggaattgtgttttatttcccattttttattttcaggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaaggtactgttttctagtatattccttccattggatggtttagttgagataaggtaaaaatgtaagttgcttaatcaatttaagtgtaaaaaagcctctaagcttttacattttttagtaaaactcaactgatttcttgtctggcctattagttcaatcaaagcaaatatgaaggagaagtatggttgcataccaggatcccattccaccatgattgtcaagcaaaggggaagtagaatccctataacatgctttgatcctgtagttctccagtcttcctaacttctggccaaatgaagccaaaaaataataggtgcttttgttcatttatagtaagaacccagtgttggatgaaacttgaaatgaaagtaaagcacataatacctggcacttaattgtctacaataaattgtaacatgaaatctggttaaaaagaatatggactgttagtttacacacctattgctagtaatttgagacacctaacctcacctttaacatct

SEQ ID NO: 54846 - DNA, 1034 bp, Homo sapiens
cgagacttccaactcttagaggcaagtcttcaagtcgttggtccaggcgaacagtttgtgtttacctctctcgcgcgcgtgctctctcattttcactacttctgttagtctcttaacttccgttctcctctgctattcatatacggctggctgcgcttgagtgcgatttgtgcttttaaacaatgttgttggagtaaaaggagttatctataccaaagtataattcatttttgaagttagttttttaaatgatgttcgttgtcttctttaaggcagcgttttttatttcatttttctctattggcagaatagatgggtgacctttgaatgggaaaagtgtacttttaacttatttcttctcatatccatgttctgctgtgtgaatagtaaaattttaggcacagtgctgaaagcttttacgtttttttatcctagcttaattcttcgggtagtctctaataaggagacctggtttaatttacttatccaaggttgagggtgttaagggactacaccggagtcctctatgaacacctgtacttacctttctcaaagagcttgaaagcatcctggctgtttgctttggctactttaaccaaaaggtagattcttaacttctgtaattaacattccaattatcttgttattcaggcatttggtgctaggaattactggatcacctctccctaaactttctactgtttaagggtttttgcacatctttaggtcattcgagataacatttcaggttgtctttttttgatctccctctgtctttgactgtcagttgtctatagctgtgtaaccgccctaaaacctagtagcttaaaacagcaatgatttctcataattctgggtcagtggagtagaactactccacctatgttggttttcccctggcctcatttatgctttttgttgacctagtaggtcagctaaaccgaaaggttccaggattaccactgtttatagttggtgctgtcagctcgaggacttggttctgttccgtgtgacctctcatcctccagtcggct

SEQ ID NO: 54847 - DNA, 1058 bp, Homo sapiens
atgctgggatgacggagagcaacatgtgaacactgtagcgagttgcactcttgtgctccgggcagcaaaggaccttgtaattgccagctgagggaggctggccgggtagtgcgggaacgcgagtgcaaagcttcatcggagtacggaaatgagggtccggagatttaaattcttctttagtggcgctaaactgatgaattggggcttgagaatagggatgcctatgtatgttgcttcacggcagtgttgatgtgaatttcgaagaggagggaacgctgaaggggaattatgtagtgaagtttgtgtttgttaaaggaaaagtaggattatgcggaaagctaaccatatggttaaataccttaaagggttaacaggtgctttaatggatgagggggtctaaagtacaaaaagttggtgtgaagttgtgaaagacaggccagaaaaaagcacagataataggtactttcggattaatagggcactttggcatttggaagagctcagcatggagagcgagagttaaaagaatgacagtgataaattttgatttaaaaatgtacatggcacttaaaaatcagctcaagaggatgtaatttgaatatggaaaagtaatgtgaagtgttttttgcatactctcacctcaaaatcattttaaataccttttgagaagccagcaaaaacaaaaacaaaaaaccctcagcagtgtaatttagactaagaaatagatgttactgtgagtggatgattaatttttaggaaaaatgtaccagaaaataattgtaatattatgtatagtagctattttggtacaaggctttgcaaaagccttgacattttaaagagccttgaaagaaaaaccatcaagtaaatctgagtgaagtgcaactaaagttggaggaaaactagagttacttccagccctcaattctagagtaaaatttgaagagatactcagtttatttacgaattcctttattaatatgtatcttgtgtggtggaaaaaaatgtccactttaaatattgaaggttatccagtctggtttttcttttcttttgga

SEQ ID NO: 54848 - DNA, 1084 bp, Homo sapiens
attatcattttcattgtagaagattccaaaggatagtattgtctgatagtggctttaatataccttgatttgagagtacagtattttgatggtgagacttctaatagagcaatagatgtattcaaaactgaggtgtactcattgactacttgggaaattcactaattaggaattcctaaaaaaaaaaattcagtaatacagctttttatttttattttttaaaaaacaaatatggcattgtagtccacatattacaatgcggcttgctttttttgccttgaatgttatacacatctttccaggtcagtacatatagatgtgacttactcattctattaataatagctgtataatattccaaagtatgcatgtatcataaattattaagccattattctagtaacggacattcagtttgtcccccatctgtcgtgtgtgtgcgtgtgtatatatacatatatatataatttttttgagtgtttcttttctttcttggtattataaacaattataggaaacatccttatgtgtccgtttaactcatgttgatgtcattttgtgctaggatgaattctgtatgtgagattgctgggacaaagaatatacatattttataatttaacagatttaaaaatctacttttcaacatttttttgtttttcaaaagatgtagtaatctacactgccagcacacattcattagcactagaagataatcagcttttaatttttgccagtgtgaagctgtgaaatgatatattcaattaatttaccttctaatttctaggtaggttgaacatctttacatgtttattgcccttttatttgttacttttttctatttttctattgggtggtttacttttttttttaaatattagaattagtaatcctttatctatcctatgtcttttttaaattttttttatttttatttatttatttatttatttatttttttgagatgagccttgctgtcacccaggctggagtgcagtggcacgatttcggctcactcctgcctcagcctcccaagtagcggggattgcaggtacgtgccaccacgcccaggtaatttttgtat

SEQ ID NO: 54849 - DNA, 1410 bp, Homo sapiens
tcaccatgttggccaggctggtcttgaactcctgacctcaagtgatctgcccccctctgccttccaaaatgctgggattacaggcatgagccactgcacccggcctcttatttgtttttgtccaagtttgccatttgtttcttgactttatggtgtgttttgctcatatagaagttttaaaatacacacagttaaatctatcaatttagggaagtcgttttcatattttgcttaggaagacttacccagagccaggattgtgtacattttctgtattttattatagtattttatagtttattacatttggctctttaaaccatttgtatgtttacagagatttatcatgattttctcagtaaatcattttttccaactgtatgttaacattccttcttttaatcacatactaagttttcatatgttcttggatcaattttggatgctattttccattaatcagagattctttaaacctcggggacccataaataggcttcaaggtatcagtgaattccctgaaattatatacataactttcatcagatttgcaaaggagtatgtgattcctttaatggcaaggatcacagatttatagtagatgtttcatatttagtggacttttttttgtttttagtaacataacgtgcagattgtgagttaaatttaggagataagcttattacctgtgaaaaagagaagtttttcaacttcaaatgaagttaatacttcattgtattaaaatgtagacttaattttctagtgagaaatggaaaaggacagggaatccaaatgaaaactatttaactgtgactcgttactataaaatgtcagaatttgtggctggtaaaaagtagttcttcccgaatttcaagagcgcacttgttgctaatattgactggtcgaacagtgcagtgaaatattttctcacataagtgatagaactatgtgcttggtaactttattttctatagggttttagcattgtaaataatatttgttgactgtattcttacatctctatatggatttatgagcacattaggaataatcttttacatggggaaaataattgagaatggattatgtaatcatccattggtgagaattaatgttagtcattatgttcttaaaactctactagactaaacaactaattccagggccaaggttgagactgctttttggaatttggtagtttttacaagtaagttcctgaaaccatgcagcaatacctgtaagatgttccagagaatgctagatttcctcacttctgaaatcatttggaaaacctcatagtagctactgttttgaggactttgggttaataggaatacagttattctagaattggtaattggtgcctcacttagtcttgaataggatgtctagtgccatggagtagtcacc

SEQ ID NO: 54850 - DNA, 1029 bp, Homo sapiens
gttttagtccgttttcatgctgctgataaagacatgcccaagacaacaattaactaaaagacgtttaatagttctacatggctggggaaacctcacaatcatggtggaaagcaaggaggggtaagtcacatcttatgtgatggtggcaggcaaaaaatgagaaagcttgttcaggggaacgcctctttttaaaaccatcagatctcatgagacttattcactatcatgagaacagaatgggaaagacttgcccccatgattcaattacctcctaccagttccctcctgcaacacatgtgaattcaacatgagatttgggtggggacacagccaaaccatatcacatgcttttcctaattttttttgaacaagtggaatattgttataataactctttctggtgctgttgtctactaattctatcatctgggtcatttcttggttgctttctattgatttgcttttctctacattatgggccatattttcttctttacgtgtctggtaatttttaactggatggcagacattattttaccttgctaggtcctggatatttccatattcctataaatactttcaaactttgttttgggacatacttaagttatccagagacagttttgtctttttgaggcttgcttttaagtttgtttgatggcaccacaaagcctttagcctaggactaattttgctccattactggcagtcccttgtagtgcccttcagagtattccacccagtgccctgtgtattacaaggttttgccactttggctgaagggaacactggttgagtgaattcccaaaattgttccacctgcccattttgaatggttcttttttggcctcagtttcttaacacatatacactgagaggtactctgctgaaaattctgtttttagctctgtcctcttcagtgcactgcccggcaaacttcagccgccttgtctttcctaaaaccttgattctcgctccttaattcaaggagaatgttggatccctgaattagactgagttctctctccc

SEQ ID NO: 54851 - DNA, 2036 bp, Homo sapiens
taaatagttctgttcagaggcttctttcctgtattccttccagaatacctttataccaagctaagtaatggggaagagaatcagagggatggtagtgctaatagtagttatattcaatatgttgcatgtatagaaaatgcatatagtttgccctatggtgaatattatcattatagtcctcagatcttcaacgtggcatggcacaattcttgctaaaggtagttaggttgtgctgaacctgtgagtactctaaagtgtcaaggagaagtcttttaaattgtaactcttggcttctcctgtgggaaggtagtgatttgaaaatggtgaattgatttgctgcttatatagcaacttaaaactggatttagagggaaagtaatgtccactttcctaaattccagcacaagttaggaataatccattagtatcaccttatgtttttccattatttatttttaaattcgtgacatagctagaaataagtgatttgtacaggtaagcactcagaaatgactataaagagtgatcagatgatgtcagttgggaaaggagagttgtgttgaaaacccttcgatttttgcttggtatggttaaggatttgaggttaagtggctatgcaagtgcagactaactcttggcatatttatttctaattacaaactacttttgagttgggcttaatgaatgtaatttagagatgttattggttcattgataagcttctgctatgtagtccctgtatgctgtgaagcaaaacactataggaaatgggctaatcaaactagttttatttttttctgctgcttaagttggtagtctgagtctccatagcttgtcttcagacaatgaattgtacatcaaatactctgttactatcatgctttcaaaataatgctttattacagtatgtctttgttaatagtaacttaaaaattgaaatctttagaagaaactaactgcgcagcataaacattcaaactaaaatcttgctgcaaacctgaatttttatagtgtattcagtagagttgtaaattctgccctatttttgttctaagactttgatgattagggctatctgcgtctttcagtttctaaggtgtgatgtaaaaggacattatcgtaagttttcagtgataaaaaatatactattttaaatataggcaggaatattagagctttgagtgaaattgaattactggattaaaatcaataaaatccttcttcaaccttgcatttgattaacttgttcaaattttgtccatgacaaactgaaactggctcaggagtgaggtttgacactaagattcttgaactatatttagatttgatctgtatttaagattcttgatttatattctgtatttgggtgttaagaaagtgcctccaattgccagtatttttatttcaacacagtcttattgcttttcaacacacccacctcttattaactgttggatgttcccagaatgttatacacctctggcagaaaaactcagttgtttcctctatagaaaggctgattagaaagactggcttaacatgattttaatgtattttaatagatagtttctgcatttttaaaaataaaatagaagaaaacattcatcattgtcttctaggacataaatttcttattttccttcctactttgaaggttaaaacaaaaaagcaaacaaagttgtgtgatgatattttagtgtcttgaaatggatttctcagccattaaaataagggatatgtatgacttttgcacctcacctgggatttgtcagtgatactctctgacttgatatgtaccttttcaggtttgtcttatagataagatgccatcgtgtgccctttttcttttaccctaggttggaactttgtgtttaattagtaagccatcatgacctctgaaccttcatttagacaataactaacagttatggagtacttactgtgtgtttataagtgttttatgtgtatagtttcatttaatgtaaatgatacttgtttttgctttcttcagagaattgctgtgaagttaaatgatg

SEQ ID NO: 54852 - DNA, 1033 bp, Homo sapiens
cactcaaatacagaacagtataggctgtacattaatatttattgccaagattttgaggatgactttagaaaagacaaaattcttgaatcttacacagcttcaaacactattaactcaggtaaatagttacttgccattctacaatcagaaattttggtagactgaaatggtggactatgagaggtaaactgtgttgtgatcacctcttttatcatatatattgctgctactttttttcaggaattatagcattattcttaagtacaggtcagccttactgttgaatttaacatgtagctgttgtgtacaatttgaagagtagagcagtgatttcatttgcgtattataatgttttatgtttatggatatctttaaaatttttcctaattagcagtgaaaacattttgaaagaaatgctggatttgttggaagctcagcttgcattttagctatacctttaaaactttaaaaaattcatttcttaatgactttaccaatctagaattgagaaagacagaatggagaaacaacatgaaccttttacatttcacctaaccttcctctatccccacatgaagcgtaataccccataggtggaaactgtcttaaattttattttgtttccaaaaacttaagcatacgttagtctgggcttttgggagttatcttgtagaataagattattaaaggaccttaccattttctaagtagattttatcctaaatttataattgcattggaaaagtgggctttttaaaaaaatttaaccaatgtcatatgacaccatcctcccctattcctcccaccctgagttaccagtttaatttgaaaactttgaatttcccacatatccaagtatgcaagattttgcattgtcctcacataaatgaacaaatcttcaaagcacgaaaagttgagtatttgttttatgtgctcttcatctaggtgcttgtagtaatgttggcacttacaggagaaattaagagatgaggcagagaggtgaagaaaggagtctttaaaataagtgattaaa

SEQ ID NO: 54853 - DNA, 2083 bp, Homo sapiens
atagtaggttttgagagttttgactatgtacatgacgttgaatgtagtcaaaagttggcaatgtaatttttaaattgaattgtattatacattatttcacatttattattcagtttaattctaccttgtcctgaaaaagagttgaagagatacacagatgtgtttgtgtaatgcggaatgggtaaaaaggcaaatgaggtaggaaaataagtcaaagtaaagtatttgtatggatattaaataacttattttaattttgtagcccattttttttgttttgtttttgtgggtagtgaggtattaaagtaccaaaaagatctctatatgtaacccttacttcagattctgaggtaatttggagtgatagcatttttgcagccttttatttaaggagccaggaaagcagatttcatacttgcattttggtcacagaataaaagtgaaagttttattaaataataacaaggatagtttgggaagatgaggcatctagtgataagaattgagttaggattttgtgccgtacatgatttatgataaagcttttcttactatgatactaaaggctttgattgtaagttcaagtagttttcaatgcagaatccatcagtgtggaaccttatataatgattgttgagcacattttgacataatttaacatcatgttattgcttatttagaaaaaaatgcttaataccagtaatctttttatttcttctatcaagtatattttgtttctgagaggattaaaaataacacggtgcattgaagtgatatttcttggtggtttttaatttaagaaaatctgataaagtagtttataacttttctttcttctttttgtagagacaaggtcttgctttcttgcctaagctggtcttgaactcctgccctttaatgatcctcccatcttagcctcccaaagtgttgggattacaagcatgagccactgtgcacagctagatagctaagagaaatatggattaagttgagtattataagttatggttttcaaatatgatttaaaataaatattgttagactaacattaagggctaaagtgaaattaccaaagcacgtattaaagacaaatttggggcgatatcacatgttctcacatatgtgagagctaaaaaaatttgatcacatgagagtagagagtaaaaagataagagactgggaaaggtgagtgttggggagaatgaagagaagtgggttaaagggtacaaacatgcagacagacggaataaatttaatgttataattctcctggttgttcatgatataccatgtaccatttcatataattcatgtaatataccctcttattttataggcaaagcaacagcagcctaagtcttgctgggggataaaaatatttctgaataaataaagtgatacataaatcatataactttgattttaggctagggtcatgatcaaatacattgatttgttatttgtaaaattaaaattactgatttaataaatagtggtacctgtctttttctctgtctgtattagaacagcattagtaataggaagcaagcaggatagtcactaaaagcacatgcagtgtcagaaataagaagtgggatctcttttcaaggggaggagacagaagaaggcaggagaagtacagcaatccaggttaggttattgtggtaaacctgtctttctcagaagcttctgagcacaattctgaagaaggtaacataattataatgtgctcgtaaaataatggggcaaaaaaatattcttcaaagtagttaccttgaggaagttatacattagaaaatataattgctaaaatattttgaaattctttatgaaattggtttcagaaccttttaaaactgcaagatcatttttgtagccatagattaaaattataattaaaatttttaaattgtaaaagtaattatagaatatttagagaacatgaaaagtaacgcttttttcacatactaataaaaccattgttctttgcaaagttttttcatatggattctttagataaaacttattttaatctactcaggtgtagattttttggtgtttatccctcttgagttctttgagc

SEQ ID NO: 54854 - DNA, 1027 bp, Homo sapiens
taaagcctttttattttgaaataatctttaattcacatgaaagttgcgcagatagtacagaattcatgtgtatccttcacccagttttccccatcatgacagcttatgaaaccgtaatacaattatcaaacacaggaaatcgatggtggtatgatactattaattaaactatagaccttatttagattttaccagtttttacctgtactttttttgtcatatgtatagttttgctattattattgcaatggctttctactacatttctctctgtctctttgcctccttccctgccttctgaagagtaaaaatggtgttaattttcagaagctgctttgctaatagattttaaattctgagtttttagttgctttcattgaatgttttttaaatttttaaattatttttaaattttttctcttcttttcaaaggtactgatcattgaatttttagggatgtaattttctcatttgctaaaaatgttatttttgtttctataacatgtcattgcattggctaggctagatttccaaattatactttttgtgcctaatttttgtataatagtcctcgagtttccctttaagagaaaaattagctactgtgtacattattagttgatttctctaatatctgacattaaaattaatcattgatatgcaatgaatgctttaccaagtttcaggagttataatcatttcaaataaatcatgtaatttaacccttacaacctcctaagataggtgtcaatattattcctgtttacaggtgagtaaattcagttgggttaaatgatttatttgttcaaggtcacatagtttaggtaagaagctcaaacctgagttttaggtttcttactcattttgcatttaaccgttcttttatattctcttctattgcaatagaaaagatcaattgtaaactattcagatgaatttcattctacagcatacgtttattccatggaactggcattccagaatggagtgaattagggcatggtggctcaggcctgtaatcccagca

SEQ ID NO: 54855 - DNA, 1050 bp, Homo sapiens
gctaaggcaggagagtgggcttgaacccgggagacggaggttgcagtgagccgagattgcaccactgcactccagcctgggcaacagagcaagaatccatctcaaaaaaacaaaacaaaaaaactacagctatatcaaagcccctggtacctgctactgaacctgttttcctctgttctgctcacaggtaactgccaagtagagtttatctttttcagaaacattttcagaaaccaagtcaatcttttaagtaataaatcaaaatgagtgaaatttaggagggaaatgtttatgagcagaagcttaatactgtacttagaggttataaatagttgataaaaccagttctgcatctggattgttttcatccttctgtgtttgactattcagagctaattgtttaaagactttcctaataaaaatttgaaaatgcttgcaaacctaggctataaggagacacaaaggattaattctactttgttaaaatctactaatgtgtgttgaaatgtgattatggcttgtcgacaaggaaccattggatgaacagaattcagtgtttatagaactagattgttggcaggcacacttaactactgccagcatcactcaaaccagccaactctttcatctttagtaaatactttgtcaaataagttatcagtctctttaaaatttagataatgaatagaattcatttagatgttagttaacagtgcagttaaaataggctatcttagattatctttgttcttctgttctatttggtttagattaaaagtgctaaaggaatgctgaagagggtggaacaacagcataaacatttttgagagggtggaatagagaacataaacatttttggagttctaaatctaaataaaattatttcagaaataatgaaaatattttgtattatttctgaggaaaatcagctttttggggggtactttttctgcagcactgtttagctatttttggcaaatgaaaaaggtattggggtagagacagagatttcctatttgaagttgaggcaatgaataactcctttcccct

SEQ ID NO: 54856 - DNA, 1937 bp, Homo sapiens
aatttaatttattctcttccaaagtactcaaagactttggtagagaaaaaagttttatacgcatattttaaaatcatgttactttccatgtgatctaaaagtcattttctgtggaaaagagatcagtgttttaaaattatagctttttctttttttttttttaagcttttcctattttggtggtaggcaaaggaagaagtactgttgtaatttatagtgctcaaaatgctaattggctgcataaaaaaaggcaccttaatttttcttttctctgattgagataaaattatttggtagctcttagaaagaccaaaggctgaggggaggaagctgaaatgatgacatatagctatgtagctactaatatatgtaaatagaaattctgaatctgtagataatctaaatgagactgcttaaagggaatggcagagcttttgactcacatgtagttagtgtagttaataaaattttgttgatatcaagatggcattaaactgttggataaattctaaatatgtgttcaatttaaatctgaggtaatttttacagtttaaggcattgtttattttataccttttaccaaatgctatgatatgcttttaaatgtaactgatggcatttagtaaatctttatatgtatttaaaagcattatcaatggaaaagtttataaattttgttctctggttatacaactgtgagagcctattttaagggtgaagtacaggggctagtaactaaaaatcacgacctttctactggctatttctacaggctgtaaattttggccaaatactttggaggatttaaatagttctcatgagattcagctttacaaatccaaatttaaagtgccatggcaaatgtatctttggtattttttgtcctaattatctagcataaaaccaaagtgtacatttattaaatgcattatgattattagactgaattgctgcaatttacgtatctatagcagaaacatagtttggaataatagatttaaagtttctgtttctattcagtggcagatgttaacacattctaagttggaaaccctcatggtaatagattttgattgagaacttgtcagtcattgtagcagctgctttagaccacatttatatttaaataggagaaagtgatctgtttagaatttttaaagttgttgccatggcaaagtaacttgctatttcatctttttatctgccatcgaagtgatctgtctggctgcttattcccaggagtaggggggatgaactgttctgttggaaagcttatattaggacaatgctgaatgcttcctaatgggatataagttagaaagactaaagctttcagaaaccatggctttggttaggtataattagaattgatttttttctcaattaaaaacaggcaagataaagctaaaacattttttaagaagaaaaatatgagcttaatttaacaccacttttgacaaattcaatgaataacatattcaaattaaatgctatgaaaaagaatttctttgaatgagtctattatttctgtagcatgaaacactttgtaaatccatcttttctttataaaattgtatatatatatatatattttaaatgcccagtgtctcctgctgcccattttttttttacttgttctcttgaaaaccatggcagtgggctgggtgtgatggctcatacttgtaataccagcactatgggaggccaaggccagaggaccccttgaggccagaagttccagtccagcctgggcagcatagtgagactctgtctctaccagaaataaaaaatgtgccttgtagtcctagctacttgagaggctgaggtgggaggatctttgagcctggtttttcaaggatacatgagctatgttcacaccactgtgttccagcctgggcaacagagagaaaccttgtctcaaaaaacaaaacaacaac

SEQ ID NO: 54857 - DNA, 1026 bp, Homo sapiens
tatacatttaaaatagatttttggaatacatttgaggttaaatttccttaaaaaataacaacaacctatgttgtttgcttgaaaaatacctggcaggagcataaatggcaatcttactctccttagtttagagagatttcatctgtaagaaaaaattttcaaaggccaaaacttctaaaccttttatgatatttttactacatgcttgttcccccttactgtaccttaattcatggtacttaaaattttaatctacagcaaccagccaaagaaaccaacaatttctgttcaactagaaggtaggaattgacacctgtgtttttgttttttgaaaaaacacaaattattcttcttttataaaatcacctaaattgtgtgagctttgcttgacatgttaatgtgatcattacctgttagtaatacactaatgagcttggcctctttttttttttttttttaatctcccacattttccagaacagccccaatttgttacaatcaggattattttatctgctgtatttgctaagtattattttactctccttcttaatttattttattaaaagtgattttcttaagtatgtgatttaaggtttatcagtgggttttattttcaagtaacttcttatataaatatttatctatgtaaatttataacagaaaaggccttttctggactgtgttttgttacagttttcttagttatactttgtcagcttcagggctgcattaagttccactaggttggtatcttattgcttgaaaattgttctatcgaaacgtgctattaaccagccagtcttccgattctctcacttgtagtaggcagaataatccgcctccctgcaagatgtctgtgtcctaatacctggaatttgtggatatattaatttacgtgccaaaggagaattaaaataacaaatgacattaaggttgttaattaggtatctttaaaataagattattttggattatctacattgcccagtggtaatcactagcatccttaaattgtggaagagg

SEQ ID NO: 54858 - DNA, 1050 bp, Homo sapiens
ctctttcaaggcagtggcatgggggacttgcttaaatagtatcttaacaaaaagccagaaattctatatagtgacaagacaaaaaagatttatcttcaggcttccaaaaggtggggtaatatgggaacacatatttactactgctgtctctgagctgataagcagtgttgcaaaaggggcctagctttaggtgagaaaggcagcgagaaggggtgggcaaagtgtgcccgttttgttaagcttttaacttaaactaaaatccccagtattttagagaggaaaattttgttttcctccagatacttaacagtttataaatctagtgttctaagaagtatgttaaaaaaaacaccttattcctgcttccatgtgaattatattacctatgaagcatcattgtacatttatgtaaattcacatttgctaaatcacactgagggaaagcttaatataatcatttcatcattatataatccattcagtatgattgcatttcctcctgatgcaatttgataaacttgtgtttgtatagctgcaagataatgttccacagataatgcagttttatacattttattttcaatgctttttagtgggtgtatgtgtatgctatgtagagaaattagatgaagtttctcttaacttcattatgggcaacaaaattccttggctttgttacagtttactaggccccatagtgaaaacacctctgagtgtaggccaattctagaatacaaaattacttgtgatcagagctgtaatatgagattgaaatttgttacacaaagaggttactatcctttttttgaggataattaaacaatttgtttctttaaaacaaattaatagtgattgtttcaggatagtataaagtacaatttaatctttaacagtgagagaggctttgtagtggggtctcagtggttaagtccaattctgggacaagtaaaaatgttttagggtcttattacagaatgaaaactatattgtttcttaaggaatttaatgaactaaaaaacatttttgcttaacactcttgatttgtagtac

SEQ ID NO: 54859 - DNA, 1067 bp, Homo sapiens
gcatgtttaattaccttggtgtttaagagctctgatgaatattaataatttaccaggatttgatctggaattattttcactctgtgatattagaaaactcttaaaaacaccaacattatgttttatttctgtcactacatagcaattcctgggcaacatagaggtgacatgaagagtaagagagaaaggggattagatgtcgacacttgggattgagctgttagaaatagtatgtttgtctaaagagaggaaatgaaattttttttcttttttctatgcataagaaatgaaattttgtggggtaggtgaggagatctctggtttgtgatcttctttattgacttaatgcattctttcaatatctataggaagttatgtcagtaactggtagataaattctggcattacataccaaacaggagagacaagcttctgccttcattggagcttatattctctttagggatagcaaaaaaaaataagtaaataagacaatttcattgactagtaagtgctatgccagaaataacagagggtagagtgataaagaatgattggtggagtgattttagattcagtgctctggtaaggtctctgaaaaggtgataattaagatgatgagaaagcaccaagtggtggctggtttcttaaaatgaggtattaaattacctagatcaacatattggataaaatatataatatttaaatgctttaaactcttaagctctaaaaagatagccatttttttaatgatagcctgtaactaggtagggacagtagataaggatggtttaatgctgtgcagaaaaggaaaacgaaatggaaagagatttttaaaagaagtaccaaaggccaggtacagtggctcatgcctgtaatcccagcactttgggaggccgaggcgggcggatcacttgagattgggagttcgagaccagcctgatcaacatggaaaaaccccgtctctactaaaaatacaaaattagctggtcatggtggcacatcccggtaatcccagctactcgggaggctgaggcaggagaatcgcttgaacccgggaggcagag

SEQ ID NO: 54860 - DNA, 1058 bp, Homo sapiens
tgcctttcataagtatttgtgttgcaggtacatgtagcccatcttggctggagatggtccagtctcatactgtcccccaaagcaaatgtaagcctctacagatgagacatattatcctagacctcagtgaacccctacaattacattttccagcaagtagtcaaagataacaaagcatatggagaaacagacaactgaaggagaaccagcaaaaagagacagcagaattggaattccatagacttgggatattaaaaatattagacacatatttaaaataactatgcttatgaattataatacatatgaagatatctccaaggaaatcacaaaaagcagcatagcagatttgaaaaggaaccagacaaaacttttggaaatgaaaatcccagtaactgaaatttaataagcctggttttgtgttgagtactttgtatcaaatgaattctcctactgaaaccttataaacgttaggccatatatatatatacaacagctatttgaaagccttggagagcagccggtgtaggttcgacttgagggtctgtgattcttgagaaaagagaagctcatgaagtgatctccatatttattctggtcttttccttgagggaattttctaattctcagtgccagatggagatcaagcaaaaagaaggagttttacatggctaaggagcccagagaggctggtaacggaggcctaatcgtgggggttgggggtgagaggagaactgcagagaactgaatattctgcacataatatctgcatataagttctccttcaagtatggtagtttaatcactacccaggcccagggcaggatttctggaaacccatctgataacagtgactttgaggcttaagagctgagcagaaatttcagcaactttgaaatacagattgagttcgaatgcataagataactagtaattggtacactgaagccattatctaaaaagtatatcctttatgatatattcacctgtgtaaattgtgttcttaaaagctaaagatgagagaatttgtttaaagaaatacagtaataggctaagtt

SEQ ID NO: 54861 - DNA, 1264 bp, Homo sapiens
tatcatccccttattttaatgtaatggaaactgacacagcaattaaatgcctgtttctagtatttcttaccaaaaagtatgtagaacatatctctcagcttttgagttttagtctaaagtccagaagctccaagatgataaatttccaaattatgcccacttcaaatagggaataaaacttggactaagtggcgtctggcatcagactgcatgtgaatagttttaacgcaaaagacttcctgttccaaaaaaatgatccaaagagtagaatgtagttggtagtttgccctaatcaattgttggggacatctagagttgtgcatttgaaagcttgtaagactttgcccagtttcactctatgcatgttttctactattgttttctttatagggcatgacagtcatttaccttttatagcttttgtatgcttcagctatgtagcacagtgggaacatacacaattttgcacttgggaaagtactaccctgttttctgggttataactactgaaacaattttaccagttctaccctcagtttctgttgaggagtagccaaacatgcctactgttctagagatatttaagataccagtccctcagaatcaaaattaatgcctgcagtatattggtttccagggtttgttgctttgtagtggtcaggtatccagaagcttcatcttaagtataatggaagaaagcttttgtttttatacaagtggatataaccctgataatgttgtatatcactttgagaaataggaaaaatagctgaaaaatgagagcaaaaatattttaaaatctttatttttccaaaatgccaaaatgttgtgtggagataatcaggagaagagaggtgctgtatgtgaatacctttggatttactgtacacaggctactcctcataatccattgcttatctttttgaaccaagttcctatctccccaaaataccatgtaatcttcgggttaaattttgttaatattataagtttcaaatctttatttacttttgggggataaaaaagtctgttgtagtggttgttttccaaattttccttgccctgtcattttttatgtgggctatctgcgaaggagaaaatttgtaatctaaatttaataaaacttcaaatatttaaatggtttctaaaagtccaagacagttttcctctgaaaattaaaagagccttctagaactttagagctcagaattaaagaactttaaaaataaagtattacttttaaaaagactgtttatgaaaagtt

SEQ ID NO: 54862 - DNA, 1265 bp, Homo sapiens
cctcccaaagtgctgggattacaggcgtgagccaccgtgcccggccggactattgtatttttaaaataacaactgcctctaaattttttggtaggtgagataactttgtatgtagctactatttagactgttaaatgttaaacctagccaggcgccatggctcacgcttgtagtcccatcactttgggaggccaaggcttgcagattgcttgagtccaggagttccagaccagcctgggcaatatggtgacaccctgtctttacaaaaattacaaaaaaattagcagggcatggtggtgtatgcctgtagtccctgttacttgggaggctgaggtgggaggatcacccaagcctgggaggttgaggctgcagtgagctgtgctgtgattgcaccactgtactcaagcctaggtgacaagagtgagaccctggagactttgtctcaaaaaaaaaaaaaagaaaaagaaaaaaaagagttaaacctctgtgtctcattcactatgtagtttgttttttttacacaaaagtctatttttttcattgcccttttgaccaaaaagttaaaaattttcccccccgctgactaccttgtataggtcccctttttggtcacctacaaccctgaaaatccttgactcctgatcggacgttttgggagtcatctaaagccatttgggaatcattgattagtctagaatgtagatatggaacaatggctcttgcaactttttagcagtggaactatttaattaaaatctgtcatagaaacttaggatgtataaatgtacaacacataagtgaactactcttctctcgaagcaataggtgcagaggttggatttgggccctatctacttgtataagcaaggggtgcgtgtggcccacgccctgatggctccacagatcccagtccagactagaagatggcgtctgtaataagtgatgaatcaggtgaagaaggatctttgaacagggaaagcaaagtattggtgcctcataagttttgaagaaacccttgactggctgtgattaaagtagaacataagattaagtcaaaagctctttaagatgcattttatctgttttgtgttaggtatgaaattagtttaggctaagattcaggagaaaaaaatagaataatgtttacacattgttaaacattagtattcatactaaatgggattttatgtgcagttaactaaagctaaaaaataatttttgaatgtatacagtattcatgaacaaaaaccagttagtttttgttt

SEQ ID NO: 54863 - DNA, 1008 bp, Homo sapiens
ccattccatggtcccagttttgacctctgcagttaaaagtttaagcctaatcagctttccacaggatggcagttgcatgtttaaagatagttatcatgtccctctggtaagatttttttttctttgtatcaatatcttttaaagttgatatcttttgctatgaatctcaaattgagaagggttgcttatcatagtgtgaatacccttttgcccacgcagaggcagaatcctcttctgtacatgttggttttgttatttttcttgagctttcaatattttgtcttgttagctcaaggttggtgtaccttatcctccaattttcctaaattttcaaataaatcaatcctggtacctttttaagcaaataaaatatttaatctatttttgttattttaactaattgactcttaaatcattatattaaattataaagtaaataaaggtatagccagtgaaaaaattaactacaataaaagacaaaattgagtgacattaaacatttagtgtataaataaacatcagtgatttacattgttggcaaaataataacactgtaaacatctctgtagcaattgtggattcaataattaatgattaaatgaatgtatacattttgaatgctcttcctttatatatcatcacttgttggatacctaagtattcagttggccttcgtggcatgtttaagagattctcttttactaggtgaactgagatgctcctaaattataattacatagtgaaagacctcacatgccaatccttgttctcctcagtcatattaccaaaatttggtgtactttgaaggattcgcctatgataaaataactttttagaatttttttaagaatcagtgtgatggaagaaaacagtggatttctgttagtattttgtgagaaatggaagattacgttactgttgtctctacttcttccatgtaaagaaaatatcctcattacatttttgagtgaaaagaaagatttatttctagagccatatttttgtata

SEQ ID NO: 54864 - DNA, 1078 bp, Homo sapiens
ttaatagccaaatggttatagattttagttaattagaatggttaagatgaaaattctgaatgaaataaattgaatcatttctttatattgatccattatacatgaaattattaaagcttaagattgccatgtaaaggtaaatcatgctatgagtattctaactaaagtttgaatcattttagtcatttcttctcataatataaacatgctatgattaatctaaaatttatttctaaatatttgctaacataagataatagcttaatccctttattagcaataatttttgttcactagcagctgctgagttagagcgataaggacaagtcactgttaactttctgttgtagaattcttctagtcctttcattatacggctgctagtactttttttctctacagaatggagtgagtgaaatagcagtcttataaaagagaagatattttagactaagtgagtaatgctgtccattgcagtaggaagaagggtcaattttttttcttacaatagcataaagattttttggtcaacaagttctgtatagattatacctaaataacctcttaatttcttttcttaagccctgcagtcataccagaagcaaatgaaaatcatttagaaactcagatttatcagtttatgatactacttgttctagttttttttaaaaagtttatattcaagaatatagttcatacacgtactttcacacacacatattcatataacatcctaagagatccatgtatatgtgtacatgcattttctatttatctttatattttgtgatgcttggcttcctaacatatgattaaaaatatctaccaaatatttaatttgtagctcctgccaccatttctacaatggtgggaatacctagaggcatggcccctaagttattatagaggatgcatagaaggacatacactcaagcactgtgagagcattatattggtaattatacactcccagcatagcaaggctggttaaaatgtgataggagaaaccacctcctgtttcacttcatacctgttactttctactcattttttttcctctcaaaatactttgcactcc

SEQ ID NO: 54865 - DNA, 1103 bp, Homo sapiens
ttatttgcaaattaaagtaaaagttatttttttaaaaaattttatttgtaatttttgtgggtatatagtgggtataaaataattttaaattgtagcatataactaagaaaggtactcagatttcggaattgtgaggaaagaaataatattttaatagaaaattacttacattgggcatcttggacactgcttttggtctagtcttcctgacaaataatttaagtagaatgtttcctgtattaaatctcaagagaagcaaagtcaatttacctgaaattatattgagatataatcaatatgtagagtgacttaaaaataagaaaagtccagtaggttatacagaaattagtctcattacttttcacaactcgttcttagggcaaaataatgtataacatataccatcagttaatgactcatatttagagtttgataattaaattatatctaacactgaagcagaaatgaagactgattgcttgtgtcatgtattgacaaaacatttatacactgtaatattttgaaacataattactgagcaacaatgacatgaatgttttacttaattgcatttgcttcagtatcagttatccagaaactccaaggcagttcttaagcgaactttctaaattcagtagcaagtaaccttttagtccagctcataaattaatgttttgacagccatttaaaatggcaagtaggtaaatttattaggaaacaatgcaggataaaattgaaaagacttggagtgggtacaactgtttgtgtttgactggctcaagaaggtttcacaagccccattacagtaaaaattcctcataagcagtattttaaaatattaaaatctacttgctaattctctagctaccaagctacgaaattcagaaggagttgtgttgtgttgttttgttttatttatttattcgagacagggtctcagtctgtcacccaggctagagtgcagtggtgcaatcatggctcactgcagcctcgacctcctggactcaagtgatccgcctgcctcagcctcccaagtagctgggaccacaggtgcatgccaccacaccctgctgatttttgtagtttctctagagatgagattt

SEQ ID NO: 54866 - DNA, 1049 bp, Homo sapiens
aaatacagttttcagatcctcagccctaggatcacaaagcagagtataaaagggtaaatttggaattaagacacaatagcttgacaaatgcacagagacatctgtgtagaatatctcatattttaacaccaaatttatgtatttttcatatagaaaatttgcattttaaaatgtttttgtctagaaggaatttgcgtgtacatatactttccatcaataatttaagatgtgttcctttcagaaaggatgactgagttcactaagaattccacataatttgcttttctccccacaacccccaactcttgctgaaaatttgatataaaccctcatgaatctctaggaaaccttttccttctttattgcatgtgattcttccaggaattaagatttgcagaatgtaacatgaattaaaaattaaatttgaaatatttgcagtcatatgtttattgttactgagtaaaattgctagtgtggcttcagtttcttgcagttaaagcagggtggacttgtagagctgaggctgtttctatgatttaaaagatactgtgttaaaaaaatatattcttattcttctttgctaaagtgagccaatagattgcaactgtatttttgattaaatatagtttgatatttttgcaaattatttttttaaaagatactagtattcacagcaaatgtgcagacgtaactaagacatccccacacctctgttacaactagatatgttcattcgattttggtagttatacagttcccagtgaagtcaccaatgtttattggccccttccttcactgagatacgttcatgggttctgatgagaaatacttgtaattattctaagagcatgctttagcatgcaaccttggtaaaaatatggtaggatcatactcttaaaacatcttttcttttgtctgagtgcaggcattaggtaaattatgtcacacacagcactgcagtgatttatagaagttaaataaatgttcgtaagtaatcttaatacctttaaaatattttgggaggtaaggttttacattatgaaaatatt

SEQ ID NO: 54867 - DNA, 1888 bp, Homo sapiens
gtgaggtgacagcctacactttactgtgtgccaatccttacattgactatttgacatttcattaagtctttactaggttaaggattaacattctaaaggactgaatcatggctctagtttgatcaaggctccgtttttacctgaattatataagacaattatgttacctgttcttaatgtgtcatattaaccacctcttcaaataaagaggcattgatcttttgtgtgttctccaagaattatttacctttcctttttttccccctttgtaagtaggaaagaaatctcatcttaggaaaaccacagagaagaaactccccactaaacaaaccattgcaaaactacagcaatctgatatttggaaaatggagaatgagttctatgaatttgcactagagcagttccaattcatcagagcccatgccgttcgagaaaaagatggagacctctacatcctcgcacaaaactttttctatgaaaagatttaccctaagtcgaactgagtataaggtgtgactattggattcttgaactaaaatttgaccctgtcttcacctttgttctcagctccacagtctggattgctgacagtaggtgtatatgacaatttgtattgagccaaattaggaaacagacagtaacgtcaaggaagtagatactggctggcattgtcagtgttctaagtttcaggcatttttatttttcctggctaaacgttggtgaaagttataacctcctgcctgggagaaaatatacatcacctaaaatgaacttatggcaggtctaatcaaaaggctaaatacaatttcagaaaaggttctgatactcttgtttttgataaagcattttttcaactaaccatgaattaagatgagtccatttgcctcttctgccttcactgagggtttgggttatacacctctactgaattgtgttaataactgtttggcagtgtgtactttgtttttgtgagtcatgtctcatgaaatttattggaatgtttaatcatatttgctaagaaatgtttctgctgtagttggatttgcccatatttatgtaggtggttttaattttttaaatggtgattagtgttaaaaatcaatttaaatcatgactaatatggtaaaaagataaagcatcaaagcagtatttctcattcctgcctcctcaatatctaatactgggaagatacttcaaagaatattgagattgtctgaagttttagttaagattttcacacattaatatcaaaaaagtaagtttagtatttgtttctccatgggttatttgtaaagctgtaaactgagatatcggtgactccgtattatgactccattagtgagctgtggtatgggtaggattttcctacttcttctgtacttttacctgtagactatttttactaaggtgctttataatgtgttttaaagcattgcatttacaaaacaaggaaaatgctgtaaatattgcatattttatgtatttggaccaaaaggttacaagtaattagacaaaagtggttttgcaccaattttatgtcaagtaaaaccatcagacctactgttcttgtatttctcatttaactttactgttaagacatcactgaaatgaacttcagtaagctttcaattttgatacacagttcattattcataacttgaggcagtaattacagtggaatgagtactggacaaggagtcaaaaaacttgatttcaggtcctagctctagcacttacagctgtgtgatcttgggcaagtcacttaacctctctttgcctcaatttcctcatcttgaaatgaggataataatacctgctgtacctacctcacagggctgttgtgaggattaaatgagatggcatgtgaaagcactttgaaaattgtaaa

SEQ ID NO: 54868 - DNA, 1045 bp, Homo sapiens
gaaagaatgatttctgcgttaggaatagcaatctggacacctgccttccaaacccaatttacaattcatttactttttagaagagtaattttacaaaacattctgtaacttcataagagggcatttttgttcattggcggtaccataacatttgaataagttatggcttttaaaaccaagttcttgttcttgctaacccgcttagtgccattaatagtgccattagaaattatgtatcttgattcttgatccacaacttgaaaatccttgtaccagaattaaaaattaggaaattatacaagtatacaaatcatgtagtattagaagatattccagagggaaaattggtgatcaacagttgtccagcacccccagtactggatagttttagatctattttaatctccttaataagtcctatagctatgcaagtgagtgcattttgataactgctgtgcctaatttgtaacaattactgtcaaccttcagttaagagactgttcattccacaccggcccagaaaagagtgaaatgtatgactcgtgtgcataattttattcacatcatatttcatactgattatgtattgatgacattgattcatttactctttacagcgccacttgcatggatattaaatcttattgaccacagatgaattttaatttcagattggtgatagatttttccatcagctctgatagtatgtttgactttttcatcattaacccaggcaatcacacagcactgagttattgcattgaaacaaaaagtgcacacttcacttggtaattctttatggatttacaataggaacttcattaatgtctgttgtaaggatcacaaaaaaaacaacatttatctgcaaataggaatttagcaagcttcaaaaatctcggggaaaaaaatagacttttttgtcttctgtaatgcattttcttagtgcggtggtggaggtgggggtttgacaaatatttgaaaacttttaaccattaaaattatgctgccatattttgatgcttatatttgcccttttcccttgctc

SEQ ID NO: 54869 - DNA, 1052 bp, Homo sapiens
cccactgctgggcaagatgttacattccttttggaaagacacttgctcttaacagagttaagcaattaattgtagtactttacaccagaaactttctgagcgtccatttactgtctcattttctttgctagtaaaactgcagaaaatgttatgctttagttcttcactgccagagtaagtagcatagaaagcctctatcaagtcacagttggaaagtaatctaataaaagaagattagtgaatgtggggaagacaaaagcagtcatgtttgagtttaatatctctcaaatttagcattttagctaagatgcccgtttttatttcttgcaggtctgctaaaaggtcagagtaatgcagaatgcgtgccttcatctcagatttgttcatcacaggtggatcccatgtgtcttcagtagacaagtcacctttgtagctagcaccagtgccagctccatgccattgcaccttctttagtcttgattgcccttcccgcatttattggtgtattaaaatgactgaatatgaacattaaggactccatgaacctgggctaatgggagactgtagagaaaatgaaaaaagatccaccagaggacatcttggggagggggagggagctgggggggagggaaatgactaatgaagctaattaaaagaagcattcaaatctgctttctaccctcattaacaattagcagggcactggccagagtttgtaccctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatggcaaagaaaaaaaaaagaatgaaaaaaagaaaaaaatttggaaaaaaaaatcaggctcatagcagctactgtgtagaaaattccccctacttctaatttgctgaatgaagaaaaaaaaaaatctttta

SEQ ID NO: 54870 - DNA, 1051 bp, Homo sapiens
tttgaggtatttataatacatttttcagatgagaaaatagatttaaaagaggaaaatgactttccaagtcacaaagattttgaatccaaatcttcttccttctggtttagtttagtctagtcacaatgcttcctttctatgagtaaagtatattttaaattactaccacccagagacatacagagatgtagaggctatctgtaggtttgtctggtcagcaccataccttctttaggggaccaaatgctgccattcatactattctacccttctggtcactggagtatgaaaatgatccatttcaagcccataatactactccaagctatttcaattttagtccttctggaggatttttcaatttagaggtaaagagggttattgtcctttcaagtttcggagccagaaggatggaaagtgagtgtggtctgtttatggccatggaggaagactatcgtagttggagaaaaatgagacaagccaattgtgaggtagaaagatatagagccccaggctgatcacgccgaataggtcagctccatcctagatatgttgaaccatatgaaattgccatttttttgtaggtcaaaaatggctaaatatcattttcatttggctcaatctaacatgcaatattatccagaatcttaagaaaaatttccagctcaagactctcttgagataaatgggaaaatgagggcctagaaatgtcagaacactagctcaaggttagtactaatgcaggttttctgaatttcagtctagaaccctgtccattaagcataatgactctaaaattttaaattagtcactttcggctgggcgcgttggctcacgcctgtaatcccagcactttgggaggccgaggcgggtgggtcaggaggtcaggagatagagaccacggtgaaatcccgtctctactaaaaatacaaaaaaaattagccgggcgcggtggcggccgcctgtagtcccagctactcaggaggcggaggcaggagaatggcgtgaacccgggaggcggagcttccagtgagccgagatcgcgccactg

SEQ ID NO: 54871 - DNA, 1021 bp, Homo sapiens
ttagatagcctagtatagtatctcttacgtagcagatatttgtgtgtgtatatgtatgtgcaattctgtatgtattacagaaatttaggttgttagctagggactccatggccctcagaaaattaggtaagcttgccttgaaggcccagtttcatagcctctaaagtcaagagcctcttttcacctagtccaatttttggaccctgaaaggttattcacaaatattgtcctccttctctcttcctccacatgtattcccacaacactcctctatcacctttgttctttgactatgcctatattgatagggatcagaagcccagcccgtaacttttaactaccaaaaccctctgtcttcaagcatttcatgaattcattaactttgtaccaaacatttaagagggatcacatgacaggatctgatgcctttcaccccaatgttgggtcttttgctcttttttcaccctcaatacattaacaagcaaatcctgctcctttccctgctacagtttgatcatactcaggtttttctgattctcagctgttatcccaaataagattatttggacatttcttcaaaatataaactgttcttttgaaaggggtaccagaaaataccattttttctaacttgggacctaatcaactgaatgaatgctaactgcttgagttgtatgtatttgaagtaatgaaaagaaagtgtgctttaatcactattgagaagttgaactttttattcttaccctcagtgttatatattgaatattgtcctctacaaattcatatattgaaatcctaacctccaatgtgataatattaggaggtgggggcctttgggaagtaattaggtcatgagggtgaagaccccatggatgagattagtgcccttataaaagactctccagagagctctcttgctctctttctgccatgtgcagatgcaatgagaagtcagcagtctacaacctggaagagggccctcaccagaacctgaccatgctgcaccctgatctcagacttc

SEQ ID NO: 54872 - DNA, 1045 bp, Homo sapiens
cctactttcctgctgcgtttaacggcttcactgtgaacgctagaactcgggagcctgctcgctgttgttttttcgggtttcgttttttttttctttcttttttttttttcccagttccaccttgccgaaacttgggcctaactttaacaggcccttttctaacctccataacccaaagagcttcgggactcagatcttacagattattcctctgctctccccttgacccccacgtcaacccaaactaataatcttgccttttgctcaccctcaaacccagcccccagcgcgccttctcgaccagttaaggtgcacagctagctaaacgggtatggtctgtacttttcatgaaatgtaagcggctggatccctggcaacttttaatgtacggcctttaagatgtctttttcttgaggttgaactactgttgcttgtactggagaactgtacagagctgagaattagctgggtttttttgggttgttttaactttatttaagggagggggaggtgggacgggattaccctcgggaaaggaaaaaagccacctttccttggcgtggtaagcattaaagctaacctgactacttagtaaaatatagctaagtaaagtaaatctaggtgtttgtttttaatgacactatggtattaaggaatttcgaagtctcctacaggtagcttttgtttttgttttgtctgagcagtgaatggataggtaaacgcgtaacttttgattttttgaagctgcggtacaatacctttgttaaaactacctggagagagtggtaagggttatttaggtacgttgctacttagaaagggcattcgttgacatatttcttaggaagtgtaacattatgtacttctcacacgctccatgtaactctgttggcctgatgccaggacttaacgtctatccttttgccttctcaagtctcatacatcaattcagcaaacatgtattgaagatctggagttctgtggccacagtttctgaactctaacttatcatatgtgtgataaagaatttttctggtgtgtactt

SEQ ID NO: 54873 - DNA, 1081 bp, Homo sapiens
tctcaccaaatgtttgcttcacttcagcagccctcttcaggtgacagagtttctttcctctattttgagggttatctttttcttttcttttcctttctttttttttttttaaccgagtgataaatacagggtgcctttctctgctacccctgcccagatccgggagctcagatgctgatgcttttcagactttcattttccctctcatttgagcaccagagaaagagctaataagttgtttactaatgagaaagcagtcgactaagggaaaacattgggcaccacatgtctgcaaaagatgagagcaaagtagatcgcttagttaagtcatgtcgagtagcaatgttatttcccatttccagataaatatttgataatgtaggcacgattttctttagatctctatggtgtacatggggacttaagctaccctgtcgggtttttcattacttgggagtgttccagagatgtttgttttttgacttaaaagttattttgctttattttaatatagttatcttttagctactcaaagattgtagatgggaattaggagaaaaaaatagcatgcctgcatttctttttgtgtgttggacagttaattttttttaaaaaaaagactaaatcaagaaattctgaagagttgatgtcaaaattaagtattgcaactgcatctaaatttcttgtttaaatatactttttaagaaatctctttataagtttggtttcttgtgcagtcagacgtaagcttgaaaactttggtataatggttgatatttcctccacaaaaatagagactttaacaatgtatatcaatgcagtgttgcacatttagaatcctttggtaatgcaaagctgaatttcatataattgaaaatgttgctatgtagtattttaattacagttagccttttataagcagatcttacagcataccacatttgctaaatgaatggaatttactattttattaatagtaaataatttacatgagcttttaaaatgaagatgatgtgaggcaagtcagaaatactttacattgcctggtcttgaaccatgaaaaacatactttggttttgat

SEQ ID NO: 54874 - DNA, 1035 bp, Homo sapiens
attttcttggtttatttgactcccagttttgataaaagttattgcatttaaactttatcgtgtttattaaaatgtttgcgactattacttatatcaacacttaaagataaatagtcataaagtttgcttctccaaatatttccatctattcagactttttatttcattgggtcctgaaacttagtgtacagcaaccaagtatttattaaacttttgtttcaagattcacttttttaaaaagcttctaaattgtttgaatttagactgaaatactgtttaatatgaagttcttaattcttctctgccatacagattttaagtatttaagaagttttgtagccagttttaagatgtatttaatggttaaaactgttactttgctatgtatcctgtctcaggaatacttgtttactctgaaagttacatattacaacctggctttaataaaattgatatttatttagaaatatatccagcttttcattattttttcaaattgtagaatttgaaatactccactgcttgagctggaattggcttttggtcatggaaaggcaaagtaagaaaatctgaaactacagtattctgtcttgttaattactgtaatagcatggagtaatgtttttaagtattgttagtaattcaggaggcttattcaacaaggaagcattaataaactatgtaaactttggtggctagaggtttcaaggtataaggaagaatatttactgtagtaaaaataaaaatcggctgtttaaaatggccaatttctaatttttatctcataactaatttgttgtgttgtattctctttttttatttgaagtatagcagaaaacagacatttttgcaatgccaaagaaactaaagtctatttccaagaaacctggattaatgaaaactgtaaagaatctcagaatgaaagtgttggctacaatggtaattttgtagaatgcagaccaaatattgagcagtgtactaacaaagctaccttgttgattattggagattcattttcttcatcaaaatgcccaa

SEQ ID NO: 54875 - DNA, 1264 bp, Homo sapiens
cactgcagcctctgcctcctgggctcaagtgattcgcccatctcagcctcccaagtagctggtactataggtgtgagccatcatgcatggttgatttttatatttttttggagagacggggttttgccatgttgcccgggttggttttgaactgctggactcaagcagtccacctgccttggcctcccaaagtgctaggattacagatgtgagcgtctgtgcctggcctgagtatcatatattttacacattaatcatactgttttcccttccctgtagttgctaccttagggattctttaaggaggtgtttgttctccatttcagaattttcattgaacaaattttatgcaacttttggatttttaaaaaatttgttaaacatcaggcacactgcattggattaatcacctatctgtctgtcaatcattttaataagtactcatggaccaccactccccctctctcaaaacaagctaggaactttaacctacgtatagttttcctctattctatccgtctatttccaccttcttgtcatctaggtcatcatttttgagtcctgtgttcattctcttccttatatagtagtccctccttatccacggtttcagttacccatggtcaactgtggtccaaaaataggtgagtacagtatagtactataagatatttataagtactaagatactttgagagaaaccacactcataactgtaattacagtatagttataattgttctattttattattagttattgttaattgcttactgtgcctaatttataaattaaactttagcataagtatgtatgttaaaggaaaagtgtaaatagagtttagtactgttcgtggttttaggcatttactgaaggtctctcggtggataaaaggagactactgtgtatagtttagttggacatataaatctaaacatcttttagttgtttgtatagaattgtgaatataatctttttgaacttgatttttcacctgttataaataagatttatccacatttttgcatgttgctatagtcattatttaaattgctatataatatttcattgagtaaaatattcattaactctactttggtggatatttggatatttatccactctcccttgttgggcagttattttccattttttgttttgttttgtttgtaattataagcaaagatcctatggacagtctgcatgtttcctactgtgcatgtgccacagttcctattatatacctagaggtagcattgctgcc

SEQ ID NO: 54876 - DNA, 1114 bp, Homo sapiens
ctaatattgcttgtctgtctgaacagcatttgacaaattggacaatccttaaaattctgataagaaaatcatattcattgactatatgaatatatttatatctaataaaagttttacttaagatatatttttgattaataaatttagggaattggtcatgaagcattttgatacatttgcaaattagtctctgattttacagctcctgttattgaataatatatcacttaatatggtaattgttacatgtctctactactttcaagacaggaactaggtcttactcctctttatgtcgctagcaactgacatataggttatgcttaataaatgcttgaataaataaatgaacagattttaaaaaacattatatgaccaatctgccagacctgacttctctaaatttccaaaagctattcttcccctggctgctagaaatctgctagttacttttatttgactgttgcttcagtctcttcagttgtttcttctacttctgtatcttgagttcattcattactttgccattgtttaagtgtgggccttcattatcatttggatgattataatatcttgatattttacctccacctcttttgccttgttctgctgttatttaaactatgtacaattgctagattcagaatttgtccttagcattcagtgactccttaatgcctgtgggatatagtcctaattccttagctaggcaatccaagctgtcattgttgtagccccaaaatgcttttcattcttaagtcttactcatgtaagcagcttattttttcaggcatactatgattagtgatttttcctcacctgtatttttactacattctgtcagctggaatacttcaaggccaaattcaaattttgcatatttatttttttccttattttcccctactcatgttcagtctctcctcaaaacttaagaatattttctatctcatgacatttattatatattgcattgtactgtagttgtttgtatcctacttcattttctcttctaggcttaatgcttaaaatctttgaaggaaaggactatatttttaatcttcatcatttacccctttagccctttagtcctgaagaaagtagcttgcacata

SEQ ID NO: 54877 - DNA, 1151 bp, Homo sapiens
aaaacaaatgataatgaatacatattgatgttacttaatcgttaaaacaactcagttgaggccgggtgcagtggctcatgcctgtaatcccagtactttgggaggctgaggcgggtggatcacctgaggtcaggagtttgagaccagcctgcccaacatggtgaaaccctgtctctactaaaaatacaaaaattagcctggcatggaggcaggtgcctataatcccagctactcgggattgtattttctttacagcttgagagctatacttttattaagcccttctactagagttagccttatcttttaaggaagttaaaataattgtatacagttcctttttttgagttttgtttttctggttgctcaatatgagacttgctcaaggccagctctattgtcagtgcctataaaacgaaacaaaacaaaaaacagcaaagcattaagtattctgactttattttgtctagccttgtgacttcttaaaagagctccagtttactcttcacagttagatcccataaagtaaaatgcccagctattgggtatggtgtggtaatgtataataatataatttgatttattttgggattactgtaactggtttttgttttattgttttcaataaatccgagtttccatctttgagaagcatctatttcatttattgatgactttagatttctagttagctactatatcagaagtacttatttgactgaattatgaaaagtcaaagtttaaattacatttggatagcaatagaagagatggctcaaagtcacacacaatttctaagtgacttgtgcaacagtcattgtaggactttagaggagggagtggtcatttgttttgttttgttttttgtttttttgagacagagtctcactctgtagcccaagctggaatgcagtggcgcaatccgggctcactgcaacctccgcctcctgggctcaagtgattctcctgcctcagcctcccgagtagctgggaatacaggcatgtgccaccaagcccagctaattttttgtatttcagtagagatagggtttcaccatgttgtccaaggtggtctcgaactcttgagcccaggttatctgctgtccttggcctcccaaagtgctgggattacaggcatgagcaaccgtgcc

SEQ ID NO: 54878 - DNA, 1050 bp, Homo sapiens
taggaaatatttcaaacatgtaccaaaaggctgagaataacttatgtctcttttccttgagtaaatgttctgcaaaatttacattgtatttttttaaaaataaacgttttatagatgtaagccctactttttttgacattcttcatcttactgcctactacgtttccttgctgtacagaggaaaatgtggcagatgaagtcttacattcattatattcttttacaagtttttttaaatttaattcttttccatatttattcaaggagatgcatgttaatagattggttttagcgacagtgtagtgtctcattgcattgcatatattataaatctgtttttttgtatagatgattatatgaattgcttatgatttttctcatcacaaacaatggtatgacaaaccttttgcattttatatacatgattatagcttatatgcatctagaaatggaattgctggttctgagcaaacgaatatcttcaagttagccatatgttgattgccaagttgttttccatattatagttccttttccttacagattatattttaatctttttccagtcattttggtaagaaaagatacctcattatcttaattgtatcttcctgattgtaacaggattggtatattttcatttgcttattttccattctggatccattttctatgaattacctggtcatatttttctaaccagaatattgagagaaagcaactcaaatgacattttacatttctttatctcagagcactcttagataatggtgaaagtaatccatatgtaacttatattcaaattaatatggttcttgggtctatagttgttctagtatttttctttccatgcatttttatttgttttgtgtatttgaaggaaacccagtctattggacagtattagtagtatatgggaacaagactgctgtttggttttattcagtagcatcactaacactaatgcagattgttaacctagagaaaaaatgttgaaattattcattattaaggctttccttaatacataaatacctggtgatattgtgt

SEQ ID NO: 54879 - DNA, 1291 bp, Homo sapiens
gaagggaaggaagcatacaatcccaaatcaccattaaaccaaaagttgtttacaggattcaaaatggacataatagaaacttagggttaaaattagagccatattaggaacatatagatcattctaaaaatgtcactgagtaaaaatatacaggttaagaaaattagttgtacttggctagatgtaaacatatcacttgaacaaaagaacagcatacatgttattatttattcaaattgtgtattactccctctttttacaagaaccttaaaaaaaattatgctgggtctccagttgaacagtgccacttctcaattacacattctctttctccatacacatagccttgactttgagaatgtatcagagaccttgcaaagggaatggaaagtgggtatgtggtgtttggcatctgattggatgtggagggcaagagaagggacaggtaaaaaaatgatccttaggattggaggtgggtgattgtggattttggcatcatcaaaagaaatagggagactaggaatacagatgaaacatttgttttgagtcatgctgaatttgaaatcaatagactacctcaagtggtgatgtgtaaacagacagttagaaatgtaaaaccggtcctgggattcaaggtggagatgcactttgggaagtcatcggataatatttgaatcatgatattatataaattagaatatattaagtgccatattagtatagaacataggaatgataagtttaaagaagagattaattgaaggaatcttcctggaagtgagttatgattaagatctgttagaaaagagaaaaattttccaggcctattttttctcctattttatacttaatatattgaggagaaattttgcataagaactacttttattatttctttacattctatggtatttttacatgtaaaagctatcataataattatttgaaattaatgtagctgaacttaaccactattttagaaaagacacaattgaaacacacaatttaaggatttgccatgaatcttgtcacaaaccagttttctaaagctcagcatcactgatcattacagaaatgcaaatcaaaaccacagtgagataccatctaagactagccagaatggctattactaaaaagtcaaaaagtcacagatgctgtcgaggtggagaaaaaggaatgcttatacactgttggtggaaatgtaaattagttcaaccattgtggaagacggtgtggcaattcttcaaagacctaaagacagaaataccattcaactagcaatttcattatt

SEQ ID NO: 54880 - DNA, 1028 bp, Homo sapiens
gagctaagccaccaacttatggaaagagtagcttgctctttatatcaccactgactagaataggatggcgcatataataggtatttaattaatttttgctaaatgagataattttttaggaaaaaaacctgtattctaagtataggatagatgatgtatcaaaatacctatatgccaaaaactgaattgtaatttatatctgatcagactgttttaggccactggtaccccttcccaggtttgcttttatactacctatggtggaatatgacttctgtaggaggagtgtactttcaattatgattttgcatactactaaaatttcttcaagacagtgaagcatactgtattctgaattattaagaatgtaatgatgtatgtgattctttcagacagaaaatactcagggtgtgttataaattattaaaaacattaacaatataccataaaatgtaaagtattttaaattaaggttgtaaatgagaatccatttaagacactaacttgtgaagattccagttgactattacttaaatgatacatttgtgccatcttagtagtttcgtttattttattttatgtttttattatactttaagttctagggtacatgtgcacaacgtgcaggtttgttacatatgtatacatgtgccatgttggtgtgctgcacccattaactcatcatttacattaggtatttctcctaatactatccctcccacctacccccaccccacaacaggcccagtgtgtgatgttccccaccctgtgtccaagtgttctcattgttcagttcccacctatgagtgagaacatgcaatgtttggttttctgtccttgcgatagtttgctcagaatgatggtttccagcttcatccatgtccctacaaaggaagtgaactcatccttttttatggctgtatagtattccatggtgtatatgtgccacactttcttaatccagtctattgttgatggacatttgggttagttccaagtctttgctattgtgaatagtgctgcaataa

SEQ ID NO: 54881 - DNA, 1523 bp, Homo sapiens
tacttgtatttagaacttcatttacaatatttgtgaattatcacagtatctctaaaaggtggctactattattatttagattttgtagactattaaaactgagtatttgaaaagttaagtaacttgctcaaggttcacagtgtaggggttgggatctaacctgggttcctaagataccaaaatccgctatctttacacagcctttgtgtgtagatgtgttcactttattttaatataaatgtatttgtcaagtaatgctacttagtagccagtgagttcttgaatttatgattttgtatggttataataaaagtcagtaagtagttggtctattgcttattaaggagataattaaatatagttaaatgtaatgtaatcaagaaagactctcttaggctgaaaacactgcatatttactgagcagccaactctcctaaactcccacatttgtatgtttattttttctgtagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacaggtatagtagtgctttatttgatgtttatatggtatattaataaaaaaaatgtatctttttagaaaatagtaagtttggggacatgaatagtttttagcttttctgaaagtagagagactttttctcttttggttaaggtcttatttatattctgtttagaagggcaggagttgataggtatggaaattgaaatgtttacttagaatttaataaccctaatgtattctctcttactctctatcagtaggacgttacttagagtgagtctccagtattaatgttttgtattgagtcaatcacatgcttttacgtgattcatcctgtaatcaacagcacaagtttgccagctgacttaaagttaaaactgtgttctttgaacaagagatagttttattatttgcaaatgtaattagtcaaacctatggccttcattctttgtgctctaagcaactgaattaacaagtaaactactaggcatagtgttcaaaaaagaaaaacataatagaaaaaactgttacacattacttttattttctttatagaaaataagaggaaaatataacctatgatttcaatataaaaacataatttttaaacaatagaattaataaatatttatgttggaatttttttaatggtacagaaaataaagattgaaaacccacctctttctttcttagaccgtctccttaaaggtaacattactttttgttgtatatccttccagataaaaaattctatatttgtgccaa

SEQ ID NO: 54882 - DNA, 1069 bp, Homo sapiens
tactaaaaatacgaaaattagtcgacgtggtggcgtgtgcctgtagttccagctactcggaaggctgaggcatgaaaattgcttaaacccaggaagcagaggttgtgttgagccaagatcgtgccactgccctccagcctgggcaacagagagcgattctgtctcaaaaataaaaggtttattgaagtataaattacgtatgacaaaatgcacgtattttaagtacatgatttaatgatttttaacaattgtgtgtgtgcacccagctaaccatctctacaatcgatctagaacattttcatcacttcagtgcttctcgtatattccttcccagctaacccatgatccccaaccctggccataggaacccgctgatccatcttctatcactttagattgaatttgtctttcctactgttttatataaagaaattacctcctttaagtcctatcaaattcctgatcacccttaaaaaacaatttttaggtattaccataaaaccttccatgacattctctgctttatcttctctgtgctactttgtccattcattgttgcattgtaatgtatttctgtacatgttatatcactaaactgtctcctccttgaagggagggacatgtgttcactcatctattttcaaggcttattacagaaactgaaacatagtagatgcttacttgggaatattatatctcaaaatagaaaaacacccagcaaatcgcatcttatattagtctttagaattagtatcaaagcctaattattatgacacttgaaacattaaataacttagaaaacaaagacttaaaagttttatgataaagccagaaactttttatactgaccatttttaatactgacatttcagataattggagggcagatgatatatgaaatataactttatactgtgacttcttaatacttcagtttgtttagaataaacttgataagttcgtcaaatttttattttattaaaaaaattctgtttgcaaatggcatatttacacaacttggtaataagtcattttctcttttttccattttactaacttaacaatctaa

SEQ ID NO: 54883 - DNA, 2034 bp, Homo sapiens
ggctcatgtctaaaatctcagcactttgggaggtggaggtggggggatcgtttgagctcaggagtttgagaccagcctgagcaacatagtgaaacttcatctccacaaaaaatttaaaaattagccaagtatggtggtgtgcacctgtaatcccagctacttgggaggctgaggtgggagtattacttgagcctgagagtttgaggctacattgagccatgatcatgccactccagcctgggcagcagagcaagacctggtctttaaaaagaaggaaataaactgccaaatatattctagagtagtgatatttttcattcccactatcagtgaatgagaattctagttgttccacattctctccagcacttggtattgttaatatattttattaaccagtctaacaagtatgtagtagttaatatacattattgtcatagaggaaataaaaatagagcagcaccatcttaaggagaatttacaaaagaacagtgcatgccctaggtacagagttatgtacagaatgaagaagtcttctctactaggagatgataggtgcagttttcaaacattaagatatttcagatagaggcagttctgcaatttttatacctaggttgcttgttttaccttaaaaattattctaactcaatcacgtgaacccaggaggtggaagttgcagtgagccgagatcgagccattgcactccagcccggcgacagtgcgagactccgtctcaaaaaaaaaaaaaaaaaaattattctaactcacagtgttaaccctgcctatttctgtaacatattaagaaagcttaaaccagaggtggtattagttataaaatatttaccaaaattagttcagttggtgatatatgacaagggctatcgcaagtatataaaataaccaattaagcctcctttaattattcagcattcattacaacctgagtaggttccagagggctgtaaaaggtaaagtatctttctttaagaaagttggactttaggagaagtataaagttaacataatggtaacacatggcaagattctggagcagtttatttttaaaatagtaacttagagacttataggaagaagtatgttaagaatatagataaatagtaagctagtgattttgtatattaaccttattaatttagatttggctaagtttatttcagctattagtatagttcctctttaattgtttaatgcagtaaacagtgtttcttaagcagatatcctggctattcaagtaccactttatgaattttggacatagagagccagcttgctataaaataaagaccaaaggttatatcatctgagatgtcattcagctgcactattaaatggttgtgtggtgtataccacctggaacctgtcgagaccttggttttctcatttgtagaatgagagggacagacaatatgtaccctatctagggtgttttgtgaacatggtattttgatagcttgagaaaaagcatgaggtatccaaggccatctaagtttgaacatgaaaccccatttggatgtaaaataaagtctgaggaggctttcctgggtctgagaagtaaagactcaagaattaaaccatattcctaatctccaacacaatcaaggaatcagggtaaggctagaccttaagtagtcagaagtcctctaagaaggatcgggattgctcctgtgttctagaactctgtttcatcttgtaagccaactgctgagttgtggttttagagaaaatactaaaagcaccagaaacagcaatctatttattgctctacacgttttgggggaagctaacaaattcagtatttactccttattctggccttgggaaatcttatccctaaggaaattttaatcatatcctattttctggtgacttccaaagttgtatctccagctaggctgtgttttctgggcttcatctgatagtttatagccacccttttggatattacctggatgtcctgttggctttgcctcttatcatgtctaaaattgaactcttcttttcttggacagc

SEQ ID NO: 54884 - DNA, 1137 bp, Homo sapiens
cagagaatattaggaacacctctgtgcatataaactagaaaatctagaagaaatggatgaattcctggacacatacaacctcccaagactgagccaggaagaaatagaacccctgaactgaccaaaaacaagctccaaaattgaatagcctaccaaccaaaaaagcccagaaccagaggggttcatagccaaattctaccagatgtgcaaaaatagtgttggagaaaccacggacaatcatctaactgagtttcagacttaatataatcacttttatattttaagtggaatctaccctgggaagtagtcttgcaactcagatacgtgttttttttttttttgcatgaattggttgaattcatggattatctataagtataaggagatttcatttaggctcatctcaaagtttgaaaaatgctgtttatttgaaaaatattaacttccaattttaagcagcaattcattctaataagtaattttaacaatattttatttacagattgcccaaggactccagatactccaaataatgaccctcgttgttctactagcaacaatagattgaaggccttacaaaaacaattggatatagaacttaaagtaaaacaaggtgcagagaatatgatacagatgtattcaaatggatcttcaaaggtaagtgtagttaataaatgtaactatatagtcagtcattatttgcagattccatagttataaatttacctattcaataaaatttattagtaactccaacatcagtactggtggcatggcactttggcagtcatttgtgtacatgcatggagcaggggaaatttgaattatatgacatgcttgtttccagctgagttcgaacaaggtgattttgccttcttaagctatggtacactaaaaagtatcctttttcagatatatttagtgctgttttttttcacatttttgtgcttttaattggtaatttcactgtttaaacactatattgtgacatctgaaatcattttgacctcagaatttgaaagaatggataaaagaatttggaaacatgtttttctttgttgttgttttttttgtttttttaggtaacattttaaaaattgtttattcctaccaagacccagttaataaaaaatttta

SEQ ID NO: 54885 - DNA, 1153 bp, Homo sapiens
ctgtcctttttaaatttttcagatattttcaccctcctgcttcaaaaccctccaatggttttccctcatacttaggacaaaatccaaaattcttattctgactctggaaatctatagcttctgatctcatcttctaaaacaccttcctctctcattacactctagctactctagcttcttttctatcccttaaacatagcaagcacactcttacctcagggcttttgcacttgctatatctttgcctaggtatctattctcccaagtacttttgtggctttctcattcattaagtcatctacttggatgctaccacctcagcaagctcttcactactatcctaagataaatagcaacctctgtctcttcttaacccttcattgcattaccaccaccttaaattacaatttatgtgatcaatttatcatcagttttcagcattagaatataaatttcatgcaggcagagacattatcttggttatcaccctatcttcaatacctgaaacaatactccattgaaatagtttgctacaaatactcaataagtatctgttaaaacaatggataccgcttcgctgcccatttgtggccgtttatcttcctctggcccataatttacacattgttctttttcttatttcatacctgtgtgtactataattattttcatattatcccttttatgactaactatttttattgtcagcacaaggatctgaggaatgggatgcagttattttaccccgttacataagtagtatagcttgccatttctttatttggtagtgtggctttaagcagcatcattggttgtgtttgtttttgttttgtcctttggaatgatctctgggggcttgataagacatgttaaagacatgcctcctgttttttgttgttattgttgttttgttttgttttgttttgtttttgagacagagtctcgctctgtcgcctaggctcaagtgcagtggcgcaattggctcactgcaacctctgcctcccaaattcaagcgattcttctgcctcagcctgcctcctgtgtagctggaattaaaggtgcacaccactatgcctggctactttttttgtattgctagtagagatggggtttcgccatgttggccaggctggtcttgagctcctgacctcaa

SEQ ID NO: 54886 - DNA, 1010 bp, Homo sapiens
aaatatgctaagagagtaaattttaggtacacataaacatacacatgaaaaggggtaactgtagaaggtgatgggtcagtaaatttgtttgcctgtaataatcatttcactatatgtatgcataccaaaacatcatgtacactgcaagtatatacaataaaaaataaattttaaaaatacacagccataataagatttccttttctcccaaattgtcttaactaatggagttgtttttcacaattatcaccctgtaagtttgatggctcttttttagtaaatgtatctataagatatactatagcgccaacagcattcttttaactctgtttttcacttgctgatatatcacttgatctgtttagaagataggaaaatgtttcatttttccctttatttgcttaatttttcaaacttatttttttaataggatcggaaactccatggtacagctcagcaactgctccaggacagcaagacaaaaatagaagtcatacgaatgcagattcttcaggcagtccagactaatgaattggcttttgataatggtgatggaataaattgtcctccttcttatgagcataatggtgctaaataatcttatgcaggaacagggcagtggttcaaagttaagagggaggaagcattactattacttttttttttttttctttttttttttgagacggagtctcgctctgtcgcccaggctggagtgcagtggcgggatctcggctcactgcaagctccgcctcccgggttcacgccattctcctgcctcagcctcccaagtagctgggactacaggcgtccgccactacgcccggctaattttttgtatttttagtagagacggggtttcaccgttttagccgggatggtctcgatctcctgacctcgtgatccgcccgcctcggccccccaaagtgctgggattacaggcgtgagccaccgcgcccggcccttttttttttttttaatcttgagttttagactcttcacttggatag

SEQ ID NO: 54887 - DNA, 2239 bp, Homo sapiens
gatctagaatgtatctcttcatttaaatagattatcaagtacttacaatcagtcttcatttaaaaaaaaatctgttacctgtttaagagtatggctttgttttcttttgtttttttgttttgttttatttattttttaattccagaagaaatctttaaagctagttgctaagagtaggagtagaaactttcggtctccccatgttacaatatttggatatctttcagctctaaaatctttttttcagatttgtaatttagatgtgtaatgacaaaaatgaaaggctctgaatttcaatatcatatcaaatatttttatttcagtgtttattgatgtaaggactaagttattgtaatgttataggaattcatttcttttcatgattttaatcactgcaaattggaaagtcagataaatggtgcaattaaaatttttttttcctttctagcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagtaattttaaataaaaatttttatttggtttaataaatacattattcaaagtatgtgattatttaaatgacaacaattgtcttttccctgtgcaaggctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtatgtagtgtatagccattgttttttgtgtgtatttttgtctataactggttctgatttaataattgaaagaaaaacctgtgcatagatttttaaaattatgataagatacacatagaataaaatttgttgtattaaccattttaattttattcaatttggaagcatttgctatattcacaatattgtgtgaccatcaccactacctagtttcaaagcattttcatcaccccaaaaggaaacgcatacctgttaagcagtcactccccattcccccttcctcccagctgctagcaactactaattgtctgtctctacagatttgtctattctagatttgtcatatgatagaaattatataatttgtgaccttttttgcctggcttcttttacttagcatattgttgtcaaggttcattcatgttgtagtatgtatgagtacttcactcacttttaatgtctgaatagtattccacttgtgggaatattctaaaattcaaaactttttgtgcacccaacatgatgctcaaaggaaattctcattggagcattttggatttgggatttcagatttccagattagggatgcttaaccagtaagtataatataatataaacattccaaaatctgagatacttctggtcccaaggatttcagataaggaatactcaacctatactatatttgattgacctatttgtcagagcatatgagttctttttaccttttgactgttgtgagtagactgctatgaacatttacgtgcaggtttttgcttgaacatctgttttcaatttgggggtatattcctaggaatataattgctaggtcatatggtagctatatctaagattttgaggaactgtcaaactgttcttctcagcatttacattattttatacttctaacagtaatgtataaagtgggtttcagtatctccagatcctcaccaacagttaatattttttttcattcttctttgatcgtgttctaataggtccattattggaagtatggtaatatatctaactatgtctgtagaactgtctgtatttctcccttcagttatgtaaatttttgtttcctatattgtgggctgttttgctaggttcatgtatgtttacaatttttatatcttctagacggattgactcctttacctttaccttaactcctttataatgtccttctttgtctcctataacaatatttaatttaaaatctgttttgtctgattttataacagctacccctactttgttttggttttgtctttgggttcaaatgagtctcttttagattatatattattgtattctgttttataagat

SEQ ID NO: 54888 - DNA, 1374 bp, Homo sapiens
tatacatatgttaagtgtatggtcttgctttcattgttttgcatgagagatctcctgccatcttaatctttgttcctctctacgtaacatgtttttttctggctacttttagtgtttcttgttcacgacttgttttgagaaattggattatggtgtgctttagtatggcttgcttctgtttctttgtttagtgttctttgaacttcttggatacttcttgagtttatacttttcatcaaatgtggagaattcatggccttttttttttctaatacattttgtgtctccgattctttctgctctctcttaatgaggaatttcagttacacatatatggccacttgaagttaaactcacagttaatatatgcactgttctttgtttattctcaagtctttctttagtgtcttctatttttgataatttctttgctgtgtcttcaaggacactaatcttttcttttgcaatgtttaatctgcctgcagtcccatccagtgtattttttttttaatctcagatattgccattttttaatcactagaaatttggtttaagtctttttcatttcttccatgtgtctgtgccacattttcagtagattgactgttttgatgtccttgccttctaaccctaacatttatgtcagttaagccactaagcttgtaataatttgtaacgcaaccatagaaagcaaatacacctggtaatctttgagtagatgcagacattgtgaattttaccttgctggatgctgaatatttttgtatttctataaatgttcttgagctttgttctaggacacagttacttggaaacaatatgacccttttgggtactgcttttaagatttgttatgtgaaacaagcatcatttagtttaggggtaattattctctactgctggggcaagactcttctggatattttcttcagtgcctcatgaattgagattttcaagcctggctggtggtaacaaacactattcctacctatatgcactgagtattgttctttctaactttttcagtgggttctttcccctgcctcagatattttcttcataggcaggtgctgattagtactttgatgaatacttgaaaaccctctgaccatctcaggagttctttctatgaacagctttaactgccttgtgaactctagctgctttggtttccttgtactcttatttctgtctcttcaacttggctccgcctgagtttccccctccctgcactgtgtcctagaaacccttaagacagtaagctggagcaatcttagggcttatctcatttgtttcccatctctcagggatcactattcgtctttaacctttttcatatattttgtctgattttctttttttggtagtttgaat

SEQ ID NO: 54889 - DNA, 2519 bp, Homo sapiens
tgcaacctctgcctcttgggttcaagcaattcttgtgccccagcctcccggatagctgggactacaggcgcacaccgcctcgcccagctaattttttgtatttttagtatacagggtcttgccatgttgcccaggctggtctcaaactcctaaattcaggcaatccacccaaagtgctaggattacaggcgagagagctactgtgcccagccaggaggtgctgttcttttctataaaatttcttatagttgtctaaagaatttgtaatggtttctctaattaaaataggaaagatgatagctacctcatagatcctctgggagaagagtttttgttaccagattttttttttctttttttgaataggtaagagatttagattaaggattccatagattaagggttgatgttcttatctgatatttatgtttgccaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccagttcagtaaccagatttttaaaaatcatgtaacaaactaaagtgcttatacaagggatttatgaagtgttcaagttggacaaaacactttaaaattatggtttttataatttaattaaaaaatattaaaacctgtgatgtcaggaaacaaaaaggcaacaaattctgttttgttgaagatacattagaaaacttaatgacaaatgacattagttcttttggaagaatgaaatattgagcatcactcttatgccaaactgaaggtatacagaagctatgagactggtccttcttgtagaatcgtatcttgattcttttatttttctttattttttgagacagtgttttgctctgttgcccaggctgggtgcagtggtgcaatcaggtctcaacctgctgggtttaagtgatcctcctacctcagcatcctaagtagctgggactataggcatatgccaccatgcctggctaatttttttttctagaggcagggtctcactatgttgcccaggatggtctcgaactcaggggctctagctgtccttccacctcagcctcccaaagtgctgggattataggtgtgagccaccatctccagccttgattcttttaatggtttagtgacactttaatagtaacattgaaattttggtaatctaactgctgatccagacgtgtttactgagatagtagcctggtagtccactgagatgggggatggtaggggttggtttgaggagagtaaaatgcaagaggtttggaaagcactggggagaaattctgaagtataagcataaactatatgtagatgtataactggggggaaaagcatgtgacagttcagcctaccgtagaatacaaaagtgaatttgcctgtgctttcatgtgtatagagagaggctttaagaaaaataagaaaataaggaattgtttaaggaaacaagctctataaatataagatatagaaagaaaaactgattgatattcacacaaacagtgtggcaaacaactactatttatctgttctttcagtcacatgccaatgtaaacaaaagagatagcagtcactatttgtgtttttgtcaaacaatttgggagtgtctagtaggagtatatgtatctgtaaaactagccatttaagattcaaaagttttaatattgattatgaaaaactttattttcaaagggtcttaagacttttattgctaatcaaacagcagtacttctgttttttataaaggtttaaagtttttaagcaagtttgtaaattttaattacagatgatgtctgtgctgttttgaagctcgataatactgtggttggccaaactagctggaaacccatttccaatcagtcatgggaccagaagtttacactggaactggacagggtaagaggactaacattttacttgaattttaattataattcattttaaatgtgagttatattttttagaaggcttcaacaagttgtattcttaacaagaataaaaatagaacttagattttttttttacatttcttattcaatgagttatgcataaatctaccttaatatagagatgaatatcagattgctgtaggatctttcatttgtgtagtaatttgaaaatgtttcattcatagcaaacttaaagatcagtaaggtgtaatattgaagcatattggtgatcttaatgcgctaacagctaaggcgattcttctggctcaccatgtgtaggttatcttactcgagctatatttgaaatgagctattaggcttggtcacccagccttctgtgtgtttgtgtctttcaagaataatttgaatagctagaattcagtctgtggccatagaacccatcagaagttaacctggtccacagtagatttaaatccatagtggtaactttt

SEQ ID NO: 54890 - DNA, 1094 bp, Homo sapiens
cccaccttagcaaagatgggtttatgacatcaccagaaggaatatggaatattctaatgttgaaactatgaactacctttcgctagtagttctcacagtgtcccatagatgtcgctgtgttccctatgaaaagtgaaaatactctctggcaccccagggctcctcagtgaacacttcgagaacctcagcattctttgtgctaattcttttatgatagatgtgtactgttcttttttcaattgcaatacatgttttaatttgttgctttctaccacacataaggctgatgcagtgtctcttaccttttttgtttactttcagatcttagacttcagataagacatgcagattctttaagtctaccaagcagttttctctttgattctagattcaattcataataagacaaactgaaacacaagttgggacagtacctatctcaacttgtactgctcagctttttttggtggtagttttactccgtctagaatatcgttgctcctagagtttgaaattatctaacagcatgcccttgccttgtgtaactgacctgcttcatctagaaaattgccggcgtaccagcaatcacacttgcattttaaattctaaacattgggccaggcacagtggctcacgactgtaatctcagcactttgggggagccaagacgggtggatcacctgaggtcaggagttcgagaccagcctagccaacatggcaaaaccccatctctattaaaaatacaaaaattagccatgtgtggtggtgggtgcctgtaatctcagctactcaggaggctgaggcaggagaatcacttgaacctgggaggcagaggttgcagtgagctgagattgcaccattgcactccagcctgggcaataagagtgaaaccccatctcaaaaaacaaaaaataataaaaaataaatggtaaacattagtgacatcttcttatgcagaagcttcagtctatctgtatggtaccttgtttttcagataccatgtgactgttttacttattcaaaccatgctggatgttaggatttaaagtgggattgaacacaagtggtggagtactaacataaaatatctctag

SEQ ID NO: 54891 - DNA, 2608 bp, Homo sapiens
gtggcacattgtgagtacagaataaatgctatttgcagaactttttctggcttagcaatgagacaaataaatacaaaggtttcaaatgagttatttgaagcaagcattggggtagtaacatagcacatgatggcaaatagaggagggaaatctgaaagattgaagctctaagagaaggagtttcggtggttattcatctgtattggttgttcccagttgtgtattctttaagtatactttaggaataccttagctggaaaatgtcacaatgtaagttttgtttctttgaattaaaatgtgtaagtttgataaagtactatacagttgagaaatgttacaaacctctttaaaacagtgtgacctttgtgtgtgtaatttttgtttattgtatttgtatttcatattttttgtgatattttattcaagtgtgtgtccaatgatgtcttttctgttttctttattattttttttaattatcctagtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggtaataaatgtattttattaaatgtgcataactacaattgaaattacatatgtaggcagcataatatagaagtagaaagagtgttaggctgaaagacagatgacttgagttcttggctgagctatgccactgaataggtatgtgactttgagacaaatcaattattcttcctatgtctgttttctcatgtagaaaatgaggggctggactaaactgtaactaagattctcttaagctttaaaattttataaatttagtagatttcatgaaccatgctattttcatgtcaacttgaattttcttcactgcaggttaccttttttaatccagttattgaaagaagaccaaaacttcaaagacaaaagaaaattttttcaaagcaacaaggtaattactaacaatcaaatgcatagcattttgatattttcttaaacaatctaattaccatttaaaaagtaatagccatctgtgtgggtttttttgttgttgtttattcatttatttctaacttcttattaaggaatattttaaatgtatccataagtggagagactagtgaaatgtacagtcacccggcttcaacaataatcaactcatggccaattttattttatccatatgccatcctctcactactttctcaaatttgaagcaaacccagacatcatattgatgtattcataattattataatttatatctaaaagataagatttatttttaaaaccttactactagacttaaagagaaaaaaacaatttcttacctatttatttttaaaactacgtatgctattttgcattagcctttactagcaaatagtaaaaaactagtttttttaagtgacaaattttgtttgttcttcgtagattataaactaatggataagaatttttaaattatgacttttggttatacataaagaaattacttgctgtttttgtttttttcaacatctacaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctaggtatgtgtctgagattttaagcatctcttatacaaagttattgggacattcttacgtactgattatagcaggtgtactgagtcttgcttttttcccaagtagtattttgaaagtagtgttctgtttacttaaaaagtaaattgtttgctttaattttaaagctgtttaaaatacagactttctattactgttttggtgagttactttatcttctataagtgattctacagtaaccaaattggactttgatcttgagcctgaacctcctccagccccaccacgagcttcttctcttggagaaatagatgaatcttctgaattaagagttttggatataccaggacaggcaagccattttaaaccttgcataattcctcttcactgaatgaattagcaataaaagcatcatagtgaataaggcgtgtctttccatttaaaattgccactgaactgtgaatttatggttttttgtttgttttttgtttttgtttttgttttttgagacagagtttcactcttgttacccaggctggagtgcaatggcatgatctcggctcactgcaacctccgcctcccggattcaagcgattctcctgcaagccattctcctatctcagcctcctgaataactggggttacaggcacatgccaccatgcctggctaatttttgtattttcagtagagatgggatttcattatattggtcaggctggtcttaaactcctgacctcgggtgatcagcccgcctcggccttccaaagtgctgggattacaggcatgagccactgcacccagccgaatttatgtttcttatggtctagtctcagctaaattagactgagtt

SEQ ID NO: 54892 - DNA, 1102 bp, Homo sapiens
atgagtatctgaattttacttttcactccaacatttatattgacttttgaaatgtttttccttaattttatcattatcaaataagttgttttctgggtatttctatggattcacgtgtatttaatattttacaggattcagagactgtttttgatattcagaatgacagaaatagtatacttccaaaatctcaatctgaatacaagcctgatactcctcagtcaggcctagaatatagtggtattcaagaacttgaggacagaaggtaaagaatatataccaaattttgcgactacatgtttggtaccatactttattgtcttattattaattgaaatttctcttttcagatctcagcaaaggtttcagtttaatctacaagatttcaggtgttgtgctgtcttgggaagaggacattttggaaaggtaatctttttggaattttttggaatatctacaacattaataactcaagtggaaaataattattttaattttatttcaggtgcttttagctgaatataaaaacacaaatgagatgtttgctataaaagccttaaagaaaggagatattgtggctcgagatgaagtagacaggttagtttttaaaaatgaaattgtttatttttctgaatttgtaagttaagagaaatgatatatgtattacaacagcaaaactttatgattttacagtaatatgtgaagaaattaaatataatgtatctatatttgacataaggtagacattagtttttcttttttgcccctttttacccttcttgtgacaattaactggttaatggataccaaaaaaagatagtgaaatgtttgaactaattttgttaagttttttatatatggaaatattaaagtgtttatatggaatagaaactgttattcatctgtggttttgtggggctatatttcattctgtcttaatggaaatgacaaagtcatttacaaataatctacagttaatggaatggtttaaagtattttacaaagcagaatatgttatcttatttttttccttttattttttttaaaaacatgttttttgaccctaacgtctgggtctaataaagtaagttgtggtatctta

SEQ ID NO: 54893 - DNA, 2459 bp, Homo sapiens
ttctgctaccttgttacgtctttgtgctgaatctttgtaggaaaatgctttctaatgaaatctatagaaagtttggatcacaggatgatgctgtagccagaatctaggccattacctctactgaaaattaatccagtcttgtgtagagacagggtctcactgtgtcacccacactggagtgcagtagcatgatcctagttcactgcagccttgaattcctgggctcaagccatcctcctgcctcagcttcccattgggaccacaggtgcatacaactgatccatctacatttctttcccccatagtgtcagggtcttggtatgttgtccaggctggtctcaaactcctggcttcaagcgatcctccttggcctcccgaagtgttgtgattataggtgtaagccaccacacccagtcttaacttaaatctccacttttcagtaacatgaaaatttaaaaatctcaagtagaactggtataaaaagagagaaaagaaaaatccaagagtgagaaataaaacacacttttagagaaatttgaggaatgaaggtaagaaaaaggagtacttttaaatttctagcatacctgaaagaaggcaagaaaaaaatttataagtttttttttaagactagctttttttttttgagacggagttttgctcttgttgaccaaactggagtgcaatggcatgaatttggctcactgcaacctctccctttcaggttcaagtgattcttttgcctcagcctccctagtagctgggattacaggcttgcaccaccatgccctgctaattttttgtatttttagtagaaatggggtttcaccatgttagccaggctggtctcaaactcctgagctcaggtgatctgcccgcctcagcctcccaaggtgctggggttacaggcatgagccaccacacccggccaagactagcatatttttaaaagtaatgtatttcattacttgcaagtataaatagtaaataactcaagctaaacttattataactgagcagaattttaaatatttactttccacttcctagctcatctttttaagccatagagtttggtgttattgtttattttttaatagctgttcctagtatactttatctatatattttttgagacagagtctcactctattgtccaggctggagtgcagtggagtgatctcggctcactacaacctccgcctcccgggttcaagcgattctccttccttagcctcccaagtagccaggattacaggtgtgcaccaccatgcccagttcatttttgtatttttagtacagacagggtttcaccatgttgaccaggctggtctcaaactcctgacctcaggtgatccacccgcctcagcctcccaaagtgctgggattacaggcatgagccactgtgcctggcctactttatgattcttaatgacagttctcatagtctaaattttctttctatagtctgtattatattattttactttgaaattaccttttttaataaatcatagaaaatttcaaatcaacctctttttaagtgaacacaaattatggattctaaaataaagtgttagataatttatgaacaaagatcatattctgtgtacctaccattagtaaaacactctaagtcccatttgcccttcagttgctgagtaaggatattatgtttatgttactgcaatgcctcctcactcagcttccttttcttaccaatttatatttcaacacaacagaatagggttggaagtatatttttgtgtttgtagaagaaagcacagctaaccagcttatgtaggattcaattctaagaccttggttttattaatgatgttttcccctgactaaaataactatttatataagttttcaggtttctaacttatctgaaaatgtaatgaactttgaaggaagtacacgaaacatgttaggatagaactagtaacttagagaaacgagacattaatacattatgtaataaaggtggctagatagagttgaggttaaaataagcaatacaaacaatagcagttcttaggaggaaatcagtgtactggtgtactactacaccatagtacatatagtgtactactccccaggtgtgcaactcttctagtcttccctattttattaaacagcaataccagttgttcaagccagaacacagtcattcttggtgctcttttccccttacctacaacactcaaactattagcaagtctggtcaacttcacctctaggatatatcccaaaccatacaaagcataaaaccaatagtaaatctctattgtatttactcttaaattttcattccacatctataatctgatgaaatatcaactgacatttgtgttgcactttcactttgacccctttatttgattcctgtcatcatgatcagaagtatttagagcaagatttaggtagagtcttataaaagaggttggatttttgct

SEQ ID NO: 54894 - DNA, 1065 bp, Homo sapiens
ctagtcttttaaattaaaattttatgcagcatatctgtactgttcaacttcatatcaattttatatgataaaaaattgaatactatagcttgtgaattatagatactgtctttgaaattaccttcaccacaaacttttaaatttttcaaagtacgctttaaattgctaaattctctgaccaattcctgaagaattttcatatttcacccttaattaagccttttaaaaaatcaactgtaaccactaaccatgtatgtgctatagactatcaatgtgaatgctataatcttttaaagtttctattaatatatttcaactgaagttatttattttaggtaggtcagttttcatagcacatatagcaaaactaagacacatgttaggatttttaagttatagttaaaattttgcttatttttaagtttagtaatttataaagaatgttatttccaactagaattatttttaatctgcttattttaaaatattttcttttacagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtgtgagtatgctttagacatttgtctgagtttttccatgactgatttcattctgggaaggaaaagagattctttgaattttagattttttttcctaacagaaaatagatctctgcaagaaatactagaactccttacttacttttttgccatatactttttgtatgtattctgttgtctgtgttgaaaatgtcatggattgcccaaaaccacaattgatactttagataagcaatttagattcattttagtaaaatttctttttttgctattagattttctcactagagaatgccatccagaattacagctttaaagacagattatactcaaaatgcactgttaagtttttgaaaagaaagtacagaagagtctgtatcatatatttat

SEQ ID NO: 54895 - DNA, 1018 bp, Homo sapiens
gtaaactctttttgtagtttttgaattcaaggtttggcttattcaaataaataagaataatagtaaacacttgaaattatatatgcatgtgtgtatattttccctgttagtatcttaattttgtagctgttaaatggtggagctaggatttgaacctaggaaagtgatattaatacctacaccctgcatgctggtgtttaccaaatttgtgtttccagccccgtcctcttacctaaacttccaactctaataatattcagtggtcagctagttttccatttgtgtggctaaatatcttatttaacaacttaaactgaactgattttttccatttttctacctacctcatctactactccccaggcctgctactcttagtcttccctattttattaaacagcaataccaggttcaagccagaacacaaaaagtcattcttgatgctctttttcctttaacttcaacactcaaactattagcaagtccagtcaactccacctgtagaatatatcccaagtcataggaagcataaacccagtagtaaatctctattgtatttactctttagttttcattccacatctataatctgatgaaatagcaactgacatttgtgttgtactttctctttgattcctccatttgattcttgtcataaccattagaggtatttagagcagagaattgtaatactgtcataaccatcaagtttcagatgagggacataggggttaattctaatgggtactgaagcattttaaaaggagggaaaagccagaaagtagtagaaggctacgaataattcattccctcaatatttaaggcagagcattacaattatgcctaaccttatgctgccatgggaatttgtttggttttattttttatgcttgtttttgtttttaaaataatacataaatgtagtttgccttaagaaactgttatttttgctgagaatataaattatatacaaataaaaccataaagtccagtgaaaatacaagaatacaatgctgca

SEQ ID NO: 54896 - DNA, 1021 bp, Homo sapiens
gcctggccaaaatagtgaaaccgcctctctaataaaaatacaaaagttagccgggtgtagtggcacgcgactgtagtcccagctactcgggaggctgaggcaggagaatcgcttgtacccgggaggcagaggttgcagtgagctgagaccacgccattgcactccagcctgggtgacaaagtgagactctgtctcaaaaaaaaaaaaaaaaaggattaaattagattatcacaaataacaaattaaatacatttttccttttttatgtaacaggagaagaatttctcatgagctaccttatatagagtaataaacttaccaaaaggaagaaaactgaatgtttgtgttatagtatttaaatctcaaatcataacttggaaatcccatttttaataaagagaaaacacagttccaattgcaattatttttttaactgtataacctactgatttctttgatttttttttttcatgctgtatctttttatcctgaacagagatttgaaattggataacttattgctagatacagagggctttgtgaaaattgctgattttggtctttgcaaagaaggtaatcgaatgtttttaagtttcttttctgattcagaattactgtttctttgtgcatcagtagttttcaagtttgtctatggaaaacaaactgtacttttaactttattcttcattaagacattgtagatacaatgaaaacattgcttatataacctaattatcacattaagaatttgttctctgaatacaaataaggttagatgtatagaaatcatagtaagcttctctgtgtgattaataattttgtcactactttaaggaagtattgattaagcaccaaaatcgtttattctggtgagactgtacacagtgaatttcataggcctgataatttccttccagcttcttaaagttgaaacatttaaaaatagaaaataaatagagataggtatctcatgtatgttttttgtatattcaaaagtaaataagtaaattggggaaatttg

SEQ ID NO: 54897 - DNA, 1057 bp, Homo sapiens
ttgtaatgacaagaagaaaaagtaactgaaaagaaacatggatatcttatttctatttacccattaattagacagtatagttgctattgcagtttttgctataccagtccttactgttttcttgaaatgtcttagatatgtctgaatttgttcaccatgcacaaatgtgcaactttaattttgcctcccaaagatagctttgattttttttttatgctagatttgttttctttgctaacaaatgtttacattttatcttttccaggaatgggatatggagatagaacaagcacattttgtggcactcctgaatttcttgccccagaagtattaacagaaacttcttatacaagggctgtagattggtggggccttggcgtgcttatatatgaaatgcttgttggtgaggtaagcagtgtgaaataggtaagagaacagaggaaggatgattgaaataataaagcatgtcatttataaaaccacctaatactgtcttcagtatgagtggaatttaagttttataaatatttatagtatactagtagtcagctatctttctgtaataccttcaataaagatttttatgtggtttgtggaatgcactatcagtgctttgaaaatagttccttgtatttcagtattgtacttttattatgttttctgattttaagacatagtcattttatagggaatggaataacagaaagactaataaaaggaatgtactctgtacctgtaaagaaaagcccactatagattggtcagaaataaatgttaccttcgacttcctccagacttccgtctgagcaacacactctgcatccttgcttcaccgggaaactactgaagttcctggggaagcaaagtagaatttcgtaagaacaaaatggatggagagaggagaaaacctatggtagctgtgaaggccctgatgccatgtatgtcaaattgatatcatccgatggccatgaatttattgtaaaaacagaacgtacattaacatcagcacgataaaagccatgttgagtggcccaggtcaatttgctgagaatgaaac

SEQ ID NO: 54898 - DNA, 1563 bp, Homo sapiens
ttagtgctgaatgaacaaattatcaaattgaatatcagaaatttctaaagttttgttctatgcttgtcatttattggcacttaccccaaacaaatggttttagtttcgccggatggataaccccttttggtatgtcaatttgaagtggattccttggaaaaggaggagaagtatggctaattaaaatttatcatgtgctaagcactgtactgtatgccttaaatattagttcatttaattttgcaacagcctttaataagctcagtactgatcttctgcccattttcggaggtgtaaatagagacacaaagagattaatgacttgcttaaagtcacacagctctcatatggtggagctggaattttaaccttgtcactctggctccagagcatatctaaagcattatgctttgctgctccaggacaggatcttcaattcatccagccttgtttctgttcttaagactagtggtccagatctgaatttttcacctctatttagaaaagctgttgtgcagtgtttaggttggaaagatttattttagctccagtccacagtggcttttactttctgagagtgccagaagttctcataaaatagttaatctgctgtaagctctggcatacttgaactcctccccacccccttcctttattttaacagtaacattttggagggtttttttggttttgtttcatgtagtattcaagtaagtatgagatttatgagattcaattatgtgcttgcttaaaatttactctccatattagagatgacatgtgcaaaatatgagtttattacaaaatactgtagaattaatccagttgaatctactccctcctattataaagccactggagggtttggcagaaaacaaggaagctcctgtttcatgttttttaaaagagctaattgattgagctcttaattacctagaagataaaagacagtggatctggctatttcttcacagttgtttcttgcaatttctctttagtatctccacaagagggtagctgggaaaagaactaaacttaaaactcatcagtctacttcataattttatagcattagtgaaatgctagtgataactcctttttaactatgatgaaagtaaggtgtggctaaagtttatgtcagatttctctattattacaaataattgtaaactcaccggatatattatacatgttcagatttgtatacttctactagttttgattactggaaagactccaggaataaacaaacatcgcaagtcccctttttcctgtctcagatgggagtgaagataccagagagattgaacagaatgctggacatggttttagatactgtcagtgttgacatctgaacagactattggtttcctttaaatgtgctgaaaacacatttgttagctttcagttgttagccctgtttgcttacaatctatttgcagaaaaaagatactacatattttaacaaatgtatagatatttctttgctgttcagacttgtagaatgagttttcaagtaaaaattgttcaagcagaagaccaaagtgctgtctttgtattatc

SEQ ID NO: 54899 - DNA, 4565 bp, Homo sapiens
aggatttatctattatctaaatattccctactgtctgttagacactaaaaattgactgtctggccaaataggtgattgagtgaatgaaataaaatggaatggagtggaatgaaattaaatgaaaagtcatatcatatatgagatagacaagttttttataagggtctataaaatttaaagatttcagaaagagtatatggtgtattccctctgtaatagatacatatctgttgtcacttcttatagttcttttgttgttgttttggtaggcatgggtttattgttgttgttgttgttgttgttgttttgtctgttttttctttttcactgcctggatcttggttgtactttgaatgggtgataagattttactgccttaaaacttgctttaacttactcaaaggtatttcttctagtctccctttcctggtgatgatgaagaggaagtttttgacagtattgtaaatgatgaagtaaggtatccaaggttcttatctacagaagccatttctataatgagaagggtaagaattaaaataaggataagaattttttaaagactactttaattttttatactaaagaaaatttcccagtagaactttaaaagctgtttttcagttcataaatgttgcatggcttagacaaaaaaagacaaaatatatctaagttttttaaagtaataatccttatcagtgaattttattctattggttttattttaacttttttattttacattatgctagctgttaagaagaaatcctgaacggcgccttggggctagcgagaaagatgcagaggatgtaaaaaagcacccatttttccgggtaagtgtgactatttaaaattttttatgaaactagagcgattagatttaacaaactaaactagtcattttttattttatgatccagctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctctctgtgccaccaatagcttctgagttttttgttgttgttgtttttattgaaacacgtgaagatttgtttaaaagtaccattctaatacttcttcaaaagtggctcctcattgtacttcagcgtaaatatgagcactggaaacagtttcatggagtttaagttgagtgaacatcggccatgaaaatccatcacgaatacttttggatcaatagtctatttttaaaaagaaagaaaaaaaccacttttttatagtccctagctttgccatatgcccgccttaagtggaaggaaagttaatcacttaactatgttttataaaaagaaaaaagggcttggaatgctattactgttcacacaaagtatgattctgtttgaataaggcaaatgctcctttttttaaaaaaaaagacattactgtaatatcaaaaaccgtggcagtttgtatacaactcggggcttgattttttttaaaaaaacagaatgaattgatgtcttattttataaatgttctatatttattaggagaaaactttatattgccttttttatcaatcatgtaacaggcttatagctttccaacagagctgcttgccaaacaattttttttgtttattaaacagtgctgaaacaaacaggatcagcatttacttaagatgttaagaatgaggacttttaatcagccgaaccaagatattgttacctgtatgcattcccaaagtctagatgctcagtatgttcagtcatatctttcagaatcagtgaaccgattaccctttttttggtattcactctacatctgccaacctagttcaccttggttttgtgtctgctgtagaagggaaccataacttggttaaaccgtagggattatcattgtatacatgctgtgaacatgtatatgtgcaagttttaatgtattctatgttgtaggcttattatttaattttaccacttcatcacttttgtacagtggccaagcagacacctcaaactccagcatttacattaagtgcatttgtacattttaggccactggatccagattttatattggcagttattgagggcaaaagcaatatattgtaacagaatgtataaatatttttgataaaacagtctatattttattaaaaaatgaattataacactaaagctgtacctcaaaagtctcaaaaataatttgatgaaatattttatacaactcttcaaaggatccgtctgtggctttttatactcttttagggttgtctttttacaaaccatgactttccacttgcctgtagttttttgtttgttttggtttggtttgattttatatttttttctcctaatctatgactttattgttttttcttagtttagtaatagcatctttgatcctgtgcttagcatgttagggtcattatacctcaggaatagcaagctgttaagtaaccatactgaattaactatttaattacagtgagctcatctcttaaaaattgttcaggtgtaaatcttatgagaaacatgaaaaagcacactgatttatggagagttgagctaaaaacatttataaatatttgctgggatgttttagcatcttttcattgtactctgagaacaattaaaattgtccagagatcatttatattaccttccaaattgtttattacccaagatcctttgggagaaaatcttatagaatgggggaacaatatgtggtttaaagttattttaaaatgccagttaatttcctcggcaaaggacaatagaggaacttagcttaattgtctggctttaatttaaactgtgttaatacaacattaaaataaaacactaaatacttttgaggtacagtctgctcacttttttggttctcaaatagcaaagaaagtaatgtctaaaataggctcttagcattaaaaactgacagcatttcgtaactacacagtgtacagaatttttttttaattgaagtcaatcactaaaaaaattagaaggcagggtctatttacacaattaagctgaagaaagcactaattttttgtagtttaaaatatatatatattttagtcagatttaaaattttaagctttatagagtgtaaatatattttgctattactgtatgtgtatgtgactgctcaagcactttgtaaagaaattaggatattttagaatggtacactatgcattcaaatgaaatgtgcctttcactatgtcattctaagaaaacaagtgttttttgcagtcataaattatcacaaatgcacaaattaaagtctatatagattgaaatttgtaactttggttttaagtattctttccttttagaaacttcctaatgattaaaatatactttaacttttctgtgttcaaaatctcaaagactaattaactttaataaacattcttgcaagtactttttgtcctagtgaaggcttaaaaccatgaacattcagagcaaactgtccacttcattgggaataatgggaaaagtttgtattctgctcctgtaaggtcagtagcatcttttatttgaagcatatttatggactgcttactgtgtatagatactgagaataggaagtttttttttttaaagcaacaaaatgttgatgaatgaagaacagcctgttttaattaagatgcaagcaccagtattgtatgtacttttctcttgtttgaggttagcttattttaatttaggacctggcttctcaaaaaggcaaatgaataaaacagaatactagtattttatagtaatcttacttaaaaattacaaatggaatattttagaaatataaaatgatccatgctctccctgtaacacaaattgaggacataatggaaattgcaatcatatattgacttggtaaatctgctgtacagattcaagtctaacaagatttttgcaagtactgccagtattcccaaagccactgaaggagtaagtatgaaaaatccaaagaagcaaatactaatccacagatcataaccttaatttaaatttagaattcttatttaccttccagccatcttttgaggtctagggtttttctgagatactggctttatacattagtatgatgggtagaggctttaaagttattaaaaataatatgtatacatatacatataaaattagtggaagaccgtcaataagatacgtaatttgaggtattgatgatctcaataaaggtaagagtggtctctggcaacccttcaccccaaaacaagcaaacaaacttgagcagagtctggacaagttagggcttcagcacctaagagttagagtgggagtgctcaagcacaaaagtaggaatattgagagaactggaagctgagtctacagagtatggcagagtagcaggaagttggaaaagatagga

SEQ ID NO: 54900 - DNA, 1020 bp, Homo sapiens
aataaatgaaatgctctttagtctatgagtacaccagtaagcctaacaaagaagaaaaaagaaccagggatatgcagattctataacataagattttaacacccaaaaattaaaatctgttgttctactgctgcttttatcagcatcatattctctgctcaataagctcactaagaaaatcacatacttagaacattttaatgtctctcaagctggtgcctttcaaggcccaagctcatcacttcttgtttaataatatacataataaatctcacatacacatcctttcaaactggaaactatgatgttgatgttaacaatggttctcaaaagcttttgctctttccataaatttattaaaataaaaaactatgtatatataagtaatggaaataaagtctatcagctttattagctgcaatgatttgcattatttgtaattatgtatcataagttacatgtaacatataacaaaaacttgagttttgaaaaatgttttattcaagaattacataatttcaaatatcttccaaaatacagtttcctagattgctacaaaagaaatttgataagaaatttaaatcattaaatatgtttcactagtatatacatacagaatgccaagcaatagtattcagccctggaatgcgtaccatgtcttttgtttttcctcatgaaaggctcaacccagcattttgtataggctatgtacaacaggcaaagttttgtattcaagaatttgacgttagctgcctcaatttatagctgtggtagtttgtccactggggtgtcaaatttgaagtctgtaggaaacagatctggggctcgaggatagatcagtctataggactgtctgattgtaacatcagcaacaccagcaatatctccaatttctaaaagacaaaaatcgaaacattaaccatcatttccatcctacctcctttccactacctgcattgtaatttgtgagatatgatagtataaagtgccaaacttaaaaacaaaaccagaagtgatttc

SEQ ID NO: 54901 - DNA, 1034 bp, Homo sapiens
atagatgagcaggatgcacaattcagatttctggtctatgtagaatcagatcttgtaagctatattttcatagaaattgtccatttttcatgctttccaaaaaattttttcatagttataaaactgttttatagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgtaagttcttgtctacctcctttaagccattctggcattgactttgcataatttaatgaacacatgaaattttgatattgcagctaattaaatgacgtagagttaaacttagtttctctgctttgaaggatcgaacaaataatttattcaagcaagtatatgaacagaagagcctgaagggaagagctaatgatgctatagcttctgcttgtctctatattgcctgtagacaagaaggggttcctaggacatttaaaggtaagtttttagctttgtttttttgtgtttgtttgtttgtttgtttgagatagggtctcactttgtcgcccaggccagagtgcagtggcgcaatcttgactcactgcaacctctgcctcccaggttcaagctatactcctgcctcagcctcctgagtagctgggattacaggcatgtgccaccacacctggttaacttttgtatttttagtagagacagggtttcgccatgttggccaggctggtctcaaacttctgacctcaggtgatctgcccactttggcctcccaaagtgctagaattaacaggcgtgaggcactgtgcccatcctaaaataacattttctacatcatattaaagaaacagaccaatgtcaggcagctttgacacttagaagctaagtcatctttattgtgactacagtaatccacttgagcatcatttgccaatgcctacttatttcattccttgacagcaaattcatagcatgttcttt

SEQ ID NO: 54902 - DNA, 1048 bp, Homo sapiens
ttttcatcagattgttactttgaaacagaagcttaggcttattttctgcgaagcatttcccacgcaaacttagtgacattttaatatgaaattatttgcattaataccattctaaaaaatgttttctctttttttcccatgcctattgcaaattttgtgcaaaatctggttcttaatcattattacattggtttacctttgcatcacatatgaatagctgtactttgctacttttgactaatactttttcttccaagagttagaatatcatagcataatgtttcaagaggattattgttagattggcacaatagttaaaggaatgctttaggacaaatgtctgaaatgtgatatttaagcttggtcctagatgtccatgttgagatttcctgggaataaaatggcttagttgggcattggacagtgtagttaagtaaaccctatcttgacaaaatgattcagatatgtgcttatattcttaggtgaccgggttattgatgtgggatctgaatggcgaactttcagcaatgacaaagcaacaaaagatccatctcgagttggagattctcagaatcctcttctgagtgatggagatttgtctaccatgattggcaaggtaataagtccatttggcaggaaataccaattgcagagtgaccatagacctgagagtttgggaactttgcaaaagtatcagtcactgcaccagtggggaatcttgacctgtctaataagatttgccagtaatatcattgtgaatgatggctaacttgtgtgtgtattccatcttaaagtggggaagaccattaaatcaaaattataaagcctttatatcaggccttttttcataaatgacattttctgtacacacaaaaaatgagtgtagtgtggccttcatgagttaatattgatatgttctttgaatatcaagaatgtcttctcagctgggcatcatggctcacacctgtgatcccagcactttgggaggccaaggcaggcggatcacaaggtcaggagttcgggaccagcctggcaaatatggtgaaac

SEQ ID NO: 54903 - DNA, 1056 bp, Homo sapiens
aggccaaggtgggaggatcacctgaggtcaggagttcgagaccagcctgaccaacatgaagaaaccccatctctactgaaaatacaaaaactagccgggcgtagtggtgggcacctgtaatcccaactgcccaggaggctgaggtaggagaatggcttgaacccaggaggcggaggttgcagtgagccgagatcgtgccactgcactctagcccgagcaacagagcaagactccgtctcaaaaaaaaaataataataataataatgtttagggtccttcacttttgcatagtttccaaactatcatttaatgaacacatttttgactttcttccccaacaaataatttattgcaaaaaaacaattaggaaacagaaacgagtaaacttattcagagatatattttattgtatatccaaatgtatatttttataatgtggggtgggagctaatccagaagaaacgaaaaggccccagtaatttcataagtccttagtctgaaatatttggtagaggactggagagatgggctgacactcatgcatattaaataatgaatacatgtaatcaaacttttgtggcttttttatacattgggaagtagataaacatgatttttgagtcccacttaaagccttttagtcaaaaagaagatttattataacttttatacagtcatctattgatgaatatcttgtataaaattattgccaaaaataacacttaaagtttcaccttgttcctacttgcacactaatctagatatgcagcagaactttagactacagatagtctgttcaaaaattattcttgtggtggagttgtagcatctgagaataggggtaatatttagcagtttgaattacttaagaatgaaaattctagaaggattgtgggcagtataacagaagcattagtagtggcatactgtggacttgacttacttggtccaagaaggctgcttgcctcagacctatagtgggagttttaaagtatagagttgctaataggaattgagaatcatttgcaaccgtattctgctgagtaaggaatatta

SEQ ID NO: 54904 - DNA, 1063 bp, Homo sapiens
ttttccagttgaaatgtattaacacaccttccacaatcattttataagagtcagcataacatagtggataagaaatgtgagatgtttaacctctcagtaactcggttctctcattataaaataggaataaaatcagtacctgtttcatatgaaggtcgtttctgagaattaaatggactaatgtatgcaaaaagcctggcaaacaataaacactcatctgactttagccggtttcatgtttccaccattgtgtaaaaactcctaaccagttccacccctcaaccacatctatttgttttgtgtacccacctgtagttcctccccttcatttaccaatggccttgaactctgttcacagttttgcttcataccccaagtactgctgttatttgcggtggcttcaggtccacatagattagccaggctttccatactttgacatcctcacctctggtgatgttcacctccactgcacttcagccaccgctgccttggtcgctccctgaggcttttatgattcaagtcggcttcaccttttgagatcacaaattcatcatctcccactataatgacctattcttccagctcattgttgctgtcttgtgcacatgctctcccttttttttttctctctctctctctctctgtctctctctctcctccatctccttctcctcagctcttttcaaaatatcacttcttagccaggtgcagtggctcatgcctgtaatcccagcactttgggaggccgaggcgggtggatcacttgaattcaggagtttgagaccaggctggccaacatggtgaagccccatgtctactaaaaatacaaaaaaaaaaaaaattggctgggcgtggtggcgtattcctgtaatcccagctacttgggaggctgaggcaggagaattgctcgaacctgggagatagaggctacagtgagccaagattgtgccactgcactccagcctgggcaacagagtgaaactccatctcaaaaaaaaaaaaaaaaaaaaaatcacttctttaaacttactacaatttcaaatccactatttcacaaaaa

SEQ ID NO: 54905 - DNA, 1048 bp, Homo sapiens
ctcccttatacaaatcagcaaatctatcttcaaatcacagacaaagccagcaggtagcatgcttattactcagaacaataggtatagtgcatgctttggcagtggaaaacaaagaattcaatcaaaaatgattaataatcaaagaggaggggccaggtgcggtggctcacacctgtaatcccattactttgggaggccgaggcaggaggatcacttgaggtcagcagttcacaaccagcctggccaacatggtgaaaccccatctctactaaaaatacaaaaaattgaggtgggtatggtggcacatgcctgtaatctcagttacttgggaggctgaggcatgagaatcacttgaacccaggaggcagaggttgcaatgagctgagattgctccactgcactccagcctgggtgatggagtcagactctgtctcaaaaaatataataacaataataataataataaaagaggaaccaactgtgaatctatataggacagtataaggaaaagagaaaggtacaaggaaaaacaagtgttagagaatattcgcccaaaaaaaatgttgccatggagcaaataaaattagtgctatttcagatttaaaacctttaaaatgagaaagcagagattttacgaattcagggaagatagagtaagatattataagaagatcaaatgggagctatcagagttcaggtaggaaattgaaaagaaaaaataaagctattggaaattatggtgacattattaatagaaacaccacaaagaacactaaatacttctgtaaggacattaaggatggagataagtgagcaaaaggaagtagaaaggaacaaataatttttaaaatattaggcagaaaaattattgatgcagaggaaaaataaaatatgtggagttgccagaaaaaaataagagcagaacaaatggaacctgcatataataataattgtcacacaattattaacactgagatatacctcgcttgatatattgggcttcaaagacaattcctttggtcacctagacagtaagatcaaggcctcc

SEQ ID NO: 54906 - DNA, 1040 bp, Homo sapiens
gtaaagccaattaccatccataatatgggtgggcctcattcagtggaaaaccttaagaggaaaagactgaggtcctcaaggaagagggagttcttctgactccagttgcagcatccgttcttccctgagtctccaacctgctctgcagatttcagatttgccagccctcacaaacacataagccagttccttaaaataaatgtatgtatagctcacatttatttcaatgtttcatattagaagtgtttcattctttatttagaagtatagtagtgattttgtgaccagaaatatgctgtagaaactgaactcttatttatctcaattagcctatggtaaaattggtcatgctgtatatcattttgcttaaagctgcagtttccaagaacctatatgacacttttaagtgatgacttgctgtactgcatttaatagaagcacataggagaagcacctgaccctgactcgtagaaccaaagaaggcttttgggagggaatgaagtcgaatttgagaactgcacttggcaagtggaataggagttagccaagtgcaaggaagggtggtggggaccaggaattggactgagtagagaacatgcactctcaacaagggcatgatctcccccaggagaagaaaatgggtgcttggcagacaagataaatcttagctatcacactgttttgtcaccatccaaagctcaatcctatgtgacaaaattgtattcctcttaatatttaattgaggggagggaagatgactaggaaagaatttctaagaaggtctccttaggtgggcaataataaaaaaaaacattgagaaacattggtatagaaagagcatttgggcataggaaagatcacacatgaaactactgaaatgagagagaacatagactatttgaaaaattagaatgggtgtggcatagaattgggagggaagaggaagcaggaagaacaatgagagaagaggccagtctagaaacaaattttaaagaaaattaaacctgaaagtgcatttcaacctcaattatctaaataat

SEQ ID NO: 54907 - DNA, 1051 bp, Homo sapiens
gccaaactgtttgttttccaaaggggctatacccttttatattcccaccagggttgtatagagttccaactgccaacactcagttttcagccattctgatgggaatctagtggtatctcattgtggttttattttcatttccccgggtgactaatgctggtaagcatcttttaaggtactttttggccagttgtatattttctgtgaagtggctgtcaaatcttttgcccacttttaattggattgtttgtcttattgagttgtaaaagttctttatatatactgtattaaagtcctttgtaagacacatgttcgtaaatacttttctttcattatatggctcagaatctggcaactttttaagagatacttgagcccactgaatgatatatagatcttatagtttttttaagtcaagccttaataataattaacattttttgagtgttcatctctcagtccctctatggccatgaaggtgggagatgtgactctgtttagtctcaagtaaagaaatgcaaactgagataatgggtacaaatggagatgaagcaaagccctgtgatgttcaagttcctggtttctgttaccattcagtctggctggacctctgcctttcccatggtaacatgacctttctaatgaattctcccttttcatctaaactgtttcagattgagtttctctcacataactaagagatctgattactatagcttcggagcttctaaggcatcttatgcacttgtctcttccccactgttcaatctgaagcatgtactctgccctttagcaaaaatcacaactccaccaggtgtggtggctcatgcctgcaatcccagcactttgagaggccaaggcaagaggattgtgtgaagccaggagttcgagtccagcatgggcaaagcaagaccctctctacaaatgaatgtttgaaaaaaaaaaaaattaaggccgggcatggaggctcacaccaataatcccagcactttgagaggccaagacaggaggatcacttgaacccaggagtttgagaccagcctgggcaaca

SEQ ID NO: 54908 - DNA, 1452 bp, Homo sapiens
acttggtgtaagacttacacaatctctcagtactattattttagaaaatgaataatcaaacattcataattggaggggaaaggtagagatacacatacttagttccagattgttctagtccactttctttcctagcctactttgaagaacaaggagcagttattaaacataatttaaccttctttttttcaacaaagtgagttatcatttgaaccaagtgccagaaccttgtggcattatgaactgtcataaaatgtggttaaaagtcttagtagtctgcgcagtgcattctggggaccgaggtcgagccagccactgctgccgtcgcctgagggaagcgagaagaggccgcgaccgggaagaaaacgctgagtcgccactggagagaagtggactccatagcagcagaccccgccagagaggcccgcccacccgttcgcccctccccctgccccgttcacaatgcagcctgcttctgcaaagtggtacgatcaaaggcactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatacaaacgattccaagcataaaagaacggacagatcaattttatgttgtttacgaaaaggagaatctggacagtcatggccaaggttaacaaaagaaagggcaaagcttaattggcttagtgttgacttcaataattggaaagactgggaagatgattcagatgaagacatgtctaattttgatcgtttctctgagatgatgaataacatgggtggtgatgaggatgtagatttaccagaagtagatggagcagatgatgattcacaagacagtgatgatgaaaaaatgccagatctgcagtaaggaatattgtcatcacctgggttttgagaaagaaaaataacttctctgcaagatttcatgattgagagaattcctgagttgatctaaaagcagatgctgtagctgcctactttaacccatttttcaacctgtttgttttttaaagggcttcactaagggttgatatgtaccattgtagggggcaattttaagtcagctaaggcaataaccttatgcatgaacatttcccagactttcatgaagctgttgaggtcctaggcaattaatgcggcagttgtgataaataaaaacatctcacctaagtctccttttcttcataatatagatactgacatgatgataggaagctctcagcttagggaaagagagctaaattttagattatagaacatggattcaaaagtggctgaacaaattggctgacaccttactggtaacctgctattcctctggtgttatccttcaggattgttccactaaaatttatttttcaaaaaatttacttca

SEQ ID NO: 54909 - DNA, 1125 bp, Homo sapiens
ttctagcgttgctttaatttagggcccatgtttcacttctgacataggactgtaatatcagaaagtatttctgacaactgcttcatttaattaatcattcaaaaacatttaatacatagtctactggctagcatacaaaagccaaggaaaccagtcataagtttcttcattttgtggtagatgtcttcccttcctctccaagagttctttcctgactctcgctcctgtacaaaaatggattttccatgccttcattggattagcacaaggctgttttgtatgattgcataaaacaagatttacaaggcaggggagctgcagggatgcaaagatccctggaaaagtcctcagcccccttgcctgcaggctgtctcttcaatgagccctcttttttacaattccacaggcaagaatcccaaaattcaaaattcaaacatgcctagagagtgtatcaggcatttcttccgaaaacggaagtgctttgtctttgaccggcctacaaatgacaagcaatatttaaatcatatggacgaagtgccagaagaaaatctggaaaggcatttccttatgcaatcagacaacttctgttcttatatcttcacccatgcaaagaccaagaccctgagagagggaatcattgtcactggaaagcgtgagtctttttttgtcccaaagcatgtctgtctgtggtccaggatgtgttgaagctgtaatgactgcaagtttttcaataatattgtttgcttctgtataggaatgcagagaaggagatgttcattgcacacatagaaatgaatgtttcttaattaaagtttactcatgtgaaactttcttgaggcctaatatgtctcacaaaattaatacactaatggcataaacacaaactcctaaggagagaaatctgcatgatgaggaaaagtcctataggattagtgtttctcagtgaagatatataatatattttataaatttacattagtcaggaaatcaacatcaggccatgagttccatgcaagctcattgagagtttgagaaacaaatttaaatgtcatattaagtacggggctagcttcatggcatgcaacctgtgtagtcgtccactccctatggtgagatgggcctgtg

SEQ ID NO: 54910 - DNA, 1007 bp, Homo sapiens
gtgacctcctctttgtctgattcatagatttctctttgtctccattttgagccgttacttggcatcattctcacatttaatgtccctcgcttttttatatagattattcacaaagtaagccattcttgaggaaatacagaaaggaccatcatgtatgttggggtagttacaatccaaccagtctgatgctgtggccccagggcggcttggctgctctgctgtccctgtgcttagcttcctcctcttccctgcaggcttccctctgggctccacggtgcagtctgaaaccaagggcatctggatgtggtgcgtgccccacccatccaagccaaaccacaccctggtccttctggacaccgaaggtctgggcgatgtggaaaaggtaagacagagagtcatagacaggttccttttattccagacgtgatccttgtaattaaactgttgtgatctatttgtgcaaactagaaatccaactatagcaaataaggcaaactttgacctgtttgaatcacacttctagacaaggttagatatcatggtatattaggtaaaacattcttttatttcttggcacagtggtgaatgatttgattcaatttgataaaaggttgttaagcagttgagttccaggccttggggctgagtagcatagacattggtgaacaaagtaaaggtcctgcccacaaagagccttcaggatgtagtgtgactgggaaagaagcaggttgctgagagggaggagatgggaatgcaatgcaatccctgccctctgtcaattccatagggaactctgtggctggaatggcccttttgagttatcatgttttgggacaagggtgctaggccttcatccctggtgctggtcaatcactggaagtctgccctggaaaactttctcattaagagagctgacacctgtgatccaggcagcacctcacagctttcaccacatacagttgtgtataacagtgctttgataagaaagagaagaggtattgactcca

SEQ ID NO: 54911 - DNA, 1053 bp, Homo sapiens
ggcagctgactactacagccagcagatggcccagcgagtgaagctccccacagacacgctccaggagctgctggacatgcatgcggcctgtgagagggaagccattgcaatcttcatggagcactccttcaaggatgaaaatcaggaattccagaagaagttcatggtaatttgccttagtcattactgttcatcatccttccccttgaagaatgaagcctatagttgcctttattgtcaccaatgctcatctgtcactgaggaataacttattgtggattctcatgagggatagagtttcaaaagactacatataagcacttaactagaaaatcttctgataactgaggtaaaatcaatacagatcacttaagatcctcaagtgaacacttctaaggattccaggcctgctctgaacacgcacaagtcatccctgagcagtgcactttttctgtgcatagtttacctttcccaggaaacaaagattctcttaccagatcgtaattccgggccattgttcaacttacattgctccttcttgtatccttgtaccattgaggacaggaacacaggatgataccattgcaacaaaccatagagattatggaatgtagtctcatcatgtcacagataaggaacctgaagctcaggaagattaatgaacttttccatagccttgaagagaatttctagcattgtaaatgtatgaagttttgtgtttctgattccacatctactccactagaatgtttttctcatgaggaccacagttagattgactctaccaccagattctttagaatttcatctcctccatgtttcttctggtgacatctctctacatttcccttgcaggaaaccacaatgaataagaagggggatttcttgctgcagaatgaagagtcatctgttcaatactgccaggctaaactcaatgagctctcaaagggactaatggaaagtatctcagcaggaagtttctctgttcctggagggcacaagctctacatggaaacaaaggaaaggattgaacaggactattggcaagttccc

SEQ ID NO: 54912 - DNA, 1024 bp, Homo sapiens
tcaattacctaagattaaataaagtgttccagctactcaattccatcacctggacaattatttttaagtttattattttttaagttttatgttgcttatatttttatgtttagggacctgtatagttttaaaataatactatgtttagaatataagttgtgatacatgaatcaaatatttggagctatagaagctgaatgatccatgtgtccattacattgtagtatgagggcctgaaactccttctacctctaaattcttgtttctttgcctatgtggctcttttctttttacttgacgagcaaaagaagtatactttgccaattttgttatctgttgtaatggccctaacagtgatgtgaaaatatgtctgaatcaaccccacgctttgagttttaaaaaacccacacagtgtaaccttccccagtcatgtcagcttttcccctttgtgacacgaatgaaagaacaagagcattggagtgggagttggaacagccagtgctgaccgtggcacagcctctgccaggggtgagcttggagatacatttatatctctatacaaagcatacagcttcctcaggaagagcccaggagccccaaggaaggttttgagagattatatcagattagttttgggaagtaacactggcaactgtgtggagggtgtgctgaagatgagagagatcatattgcgagaccaagtagggcagtgggatgaagtagaggagactagtagaaaagttagtttagaaaaaagtcataggattaaatattctatttccttttatcagaagatcctatggtaattacttaagtcaaactgtgattactgacattttactagttttactatagcttctaactttttcagagaaggagtggattaagttttgaaccagatgatttggggtcaaattgtcaaatttcaggttaccagtgagtgtgctttatattagcacaactttttaaattatagcttctaaacatttatgtcttctgactggaaatgggaaaagatttgggg

SEQ ID NO: 54913 - DNA, 1056 bp, Homo sapiens
caatatatttaatttgtgtaactcatttatattcattttaaagcaataagaacagttttcctgttttacatgagtatagattttttgtggttttatatatatatatgtaacaaaatttactttttaaactattttaagtaatttttccttttttaagtattttaactatttttaattctgtggcattaagttcatttatattgttgtacaaccatgattatagattttaagtcgtgaccctctgcttgggtgacagtcatatcagacctgtctgcagcataaatcttgactgggattatagacattgcatcaaaaagtagaggttaccggcacaggttaactttttaaaaacattgcatcaaggtatattaaaggcttcacaacactttgccttccttatgggccacacaataaattattaaggaaagttacatttcttttcacgacactttctagtaatgagtcttgtgatatatggtgagaactggcatggaaatcacaacttaggtggaaaaccaaacctcctaatatgtaatctggtatttgtttataggatcatactttaaaggcaacctttaaaggattaattttagataaagttactactatgttaataaataatcatgtttagtgcttacattgtacctgctgctgtgctaagcatttgaattgtagttgtctcaattaattcttaaaacaactccattaggttgaaaccattattatggttattatccctattttacagatgagaaaagggatactcagcttatctaagatcaagcagatggtaaacaacaaagtcaaaactcaatcttaactattctgcttccttcccttccaagtctctcacattttcatcagttttaggataagaactaggcctaacaaagtaacacattgaaaacatgtgatactcctttttaaagtctttcaaaaagaaggtcatatatgggtaatatggttttgatttattttaaccacattgtaatcggtatgtctggaagaaaagccatgtaaaacactgttatttaactacagattaaacttgagtta

SEQ ID NO: 54914 - DNA, 1059 bp, Homo sapiens
ggctgaggcaggaaggcatcaaatcagatattggtgatacagtttaatggaagcataatagaactatcagtattccctaaatgctaaagaagcatgaaggactaactacttgtttagggggacaagtagggtagcagtgtttgttttaaacatcttttgtgtttaatagtcacttaaatactgaacattaaatgtttgtatttggtggtcagaaattagctcaagcactaggctgatttgcagtgcatgacaatttgattttgtctttgggttaagagtgtgttatagcagatgtagcattatttacggtgatcattatcagacgttattggttttatgagactaaagctatctaaggacgtgcaatattgtcagctcaatcatagctcacagcattgtggaattagaacatttatgaagcacctaatatgtggtaggctctcaggagactagaaaggtctttgccctccagagttcaggacaagtgggcacagaatggtttgatgtgcagcatgcttgtttggatgataccttgataatcccattggtaccagtatagttcttgttgcattatactaaggttaacttgtggaaaagggaatgattgtgaaatcataatttgataagatattaaggtcattttggaatgctgtggcatttatccagtgtccaacactgattcaaaatgactctcagtcattataatgcaccagtcatgctgaatttgacagcagttccccattcagatttgtaaaacatcccatttggtgagtaagttggcaaatataaatttttctcctttctccctgaaggatgaagacttagcctctgcttctgaatttctgcccctgccatggggtgatggaaatgcctgaggctctgtcgctgtcatttgctttgccacccttccatacccaccatgtgtttgcaccagtggtgttcacagatctttctgaaagccaggccttctcctctgtacccttggttcctaaatgggtggtgaaacctgatctgctgtccttcatttactcaacaatgatttactaaatattcatggca

SEQ ID NO: 54915 - DNA, 1066 bp, Homo sapiens
taatgttagagaaccactattagaaaaatctttctttctaggtctcaaaactacgactgagtttgggaagcatgtttgttatttgaaaatcactgtactaacaagatttgaaagaactacaaagggacataaggaaactagtatatcaaatgttattgccggtgatcatttaagcacttgaaatatgtttaatgcttgtcattaaatctctcaagaatggtgaaatgagttacttagcataaagaaaaggggcatattaatcagagatactgatgcattgtttcctagagagagaactcaacaaaaggcgaatttaaatttcagttagatatatgttagtcccaagaaacatcttaatgggaagtagcactaaacattttgaagggatataaggtgatttttaaatcaattttcaatgagagtagtgtagagaaccgctatttggaattgttcggctataatccctgcctggggtcagagacagatctttgaagtagcgtcctcttctcagtatataatgacactaaataccatctgatcatcatttgtttattttttcacttgttattttagaaatgctttcaaagtaaaataaggactactgggaagtaaagatgcctaacttgaatgttgatgttacagtcttagagactttggagtaagattgtcaagtgaattcatgtgttttgaaaaagcttttatgacttcttaatgaggtttaaaagctgaaataatgggattagaaccgtaaaatccattactcttaacatttctttggattgatttagtgtgtttgtatattagaaatagatattttatttggattgaatcatcattgtttactaaaatatggtctggaaacaatttcctggacagacagtattaaatggcataatgacaaaagatagctatgcttaaactctctagttaagcacttcaaataggaaaattatcatcattttatacataggaatgctgagatgttttatatatacttaaatccagatgctatatatttaaatattaagttttagttcagtagaaaatatttagtaggaaaatgttt

SEQ ID NO: 54916 - DNA, 1054 bp, Homo sapiens
cttgttcctatgctactaatatttttttctttctttctttctttttttcttccttttttttttgagacagggtctcacaggcctcagactcttggcctcaagtgatcctccctgcttggcctctgaaagtgctggaattacagctatgagtcaccacagccagccacctaatttccagtggtcacattttaccttccaaaatgtctgagtaagctcctttccacaccttgtcccatgtctgaagcatcacttacagcccaagagttgttttagtcaccacaaggagcctcttttaagcaagctctgctttgtgaaattaccccttaggcttagtggggtctacaattctatgcccagaacaacctgtcactgaatgcattatctcctttccacacaagctttcgctttgtaatttaagtacatgagtatgaaaaaacttagagtatttaaaagttgggaagtatttaaaagttatggcttaaaaaagaataagaaagaaaagctctgctagaatattctatcatggggactccctctcatgtttaatgttgtgatggcaaagtactaaaaggataaacgatggaggcatattccattattaaattacttttgccttcaggaaaacaagattatcttgtattttcatactgaaaagtattcagacaacattcctgagaatttctatgttgagtcttacatacatcaattgtttcaaaaattgctaatcagtaaaatccagatgatctataagatggcacagagtaaagtaaaaggaaatatgtgggtcttagaaaatatctgataagaaaaagaagaaaaataataatggtagcatggtgcccccttgctggtagtccagctctaatctattttcaagggtttctcttggattttcttgagtctgaagtcttatcatttattctgggccagagttactctctagacactctagtattagtagcatccccaaggaagccttttttttttttttttttttttttgagacggagtctagtggcgtgatctcagctcactgaaacctccacctcctggg

SEQ ID NO: 54917 - DNA, 1133 bp, Homo sapiens
gaaacagatcaacctcaataatgaatggacagttgagaaactgaaaagtaagcttgtgaaaaatgcccaggacaagatagaactgcatctttttatgctcaacggtcttccagacaatgtctttgagttaactgaaatggaagtgctaagcctggagcttatcccagaggtgaagctgccctctgcagtctcacagctggtcaacctcaaggagcttcgtgtgtaccattcatctctggtcgtagaccatcctgcactggcctttctagaggagaatttaaaaatcctccgcctgaaatttactgaaatgggaaaaatcccacgctgggtatttcacctcaagaatctcaaggaactttatctttcgggctgtgttctccctgaacagttgagtactatgcagttggagggctttcaggacttaaaaaatctaaggaccctgtacttgaagagcagcctctcccggatcccacaagttgttacagacctcctgccttcattgcagaaactgtcccttgataatgagggaagcaaactggttgtgttgaacaacttgaaaaagatggtcaatctgaaaagcctagaactgatcagctgtgacctggaacgcatcccacattccattttcagcctgaataatttgcatgagttagacctaagggaaaataaccttaaaactgtggaagagatcattagctttcagcatcttcagaatctttcctgcttaaagttgtggcacaataacattgcttatattcctgcacagattggggcattatctaacctagagcagctctctttggaccataataatattgagaatctgcccttgcagcttttcctatgcactaaactacattatttggatctaagctataaccacttgaccttcattccagaagaaatccagtatctgagtaatttgcagtactttgctgtgaccaacaacaatgtaagtaaatccattctttcttttattcagtatctgccgtacttatagtgcattacatagggaaagaaaacacacttcaaatcatactgtgtgttctcaagccaagcccaatccgatcttgcataaattaccaaaacactgagcatccatttttaacctaaattacaagtcatcgtggaga

SEQ ID NO: 54918 - DNA, 1039 bp, Homo sapiens
aaatcagtgatccactaaggtaatttttggctctctggctcatgtgtcatacagtctaagaaagggcatgctaaataaattagttttaaataattgttttctaacattttttatagaatttgttgacccaggcaaaattggagttcttgtaagcttcaaggcaaactatttttaaagctgtaagtagatttttcaggataaaattgctgaattgaaggaaagtcttgagtctttaacaaaactccccaggctcctttagaaaaattgaatgagagtaggtgaggtaagatcctgtgccttagctgggcagagagctggagagaaagccccagagatggactctcgcacatagccagcgcagcccttgactcactttcacagcagcaatgctaaggggctggccctgaggcccactcccactaccttgggaaatccctctcttctagtggagcctaagaagttcactaaaatcacagatgtagagatttggaaggagactggtgggaatgtggtagtgctgatagccagacaagagagtgagggcagtggcttcagggtaatcacccagtaggaaatcagtccagttaaacgaggtacttgctgggaatctgaagctgactgaagaagggaaatacggaatgcctaatgcagctcaggttagggcacttttcttcataccactcattacagacaattgtgtaatcgtttcatgtttctctcttccgtgagacttgtgcttctcaactgggaatgattttgcctcccaagagacatttgtctggaaacatttttggttgtcacaactgggaaggggagtggcactggtaactggtgggtagaggctgaggatgctgctaaacatcctacactgcacaggacagccccacagcaagaatttttccacccacaatgtcaacagtgctgaggctgagatgtccatggtgacctgcattaggctaaagttttcaaaggcagtctttctaactcagtacttgatcccagcagctagctgggagcctggcacattagaaggcactca

SEQ ID NO: 54919 - DNA, 2140 bp, Homo sapiens
gggtaatttatttctgatcaaggactcaagagtaattatgatttttcttactggtttgtttttatcttaacgacaatgtgtgtataactacattttatttaagaattgcttgttagagtgtttaaaaccaaattcgttgcccacccatatacagcaaggatgtaggtgtccagggtagccacagtcctcactcctcattgtactcctgtcttcattttccctctatcttttcatctacttcaaatttatcatcattgtagtctgcatcacttataaacctccagaaatgttttgtttttttttttttggaaaaaaggtaaatgtcttatcataagccaccaaaaacctattttaccagcttcttttttcttccctttccagattgagatgctaccagatgggctgtttcagtgcaaaaagctgcagtgtttacttttggggaaaaatagcttgatgaatttgtcccctcatgtgggtgagctgtcaaaccttactcatctggagctcattggtaattacctggaaacacttcctcctgaactagaaggatgtcagtccctaaaacggaactgtctgattgttgaggagaacttgctcaatactcttcctctccctgtaacagaacgtttacagacgtgcttagacaaatgttgacttaaagaaaagagacccgtgtttcaaaatcatttttaaaagtatgctcggccgggcgtggtggctcatgcctataatcccagcactttgggaggccaagatgggcggattgcttgaggtcaggagttcgagaccagtctggccaacctggtgaaaccccatctctgctaaaactacaaaaaaattagccaggcgtggtggcgtgcgcctgtaatcccagctacttgggaggctgacgcaggggaattgcttgaaccagggaggtggaggttgcagtgagccgagattgtgccactgtacaccagcctgggtgacagagcaagactcttatctcaaaaaaaaaaaaaaaatgctccagggctttaaatgagaagtaaaattttctaagttaataaagatgaagaatgggtgactattatgatgaaccataactaaatgtcttattaaagcaactgagtgtctagccctaaattaaccaggtaaaaactgttaacactaacctgaagttttgtgaataactgttctttaacttattgagatgttgcaagaaatgcacatccagggtggactgggagctatgaaatgactaaattcctccttgcagtgtttaccttcaagattgtataggtattctctcctcttcttcccccagtccccattacttatttgcacacttgttttaactgacttcctgttttgatatttatcaccaagaccataaactcatcaatatgaattttcttgatgtatactcacgactgtctttgatttatgttcctaaatttttttagatagggtatgttgtgcttggcagaattcttttttggcttaatttttacttcctttcccagcttgcttgagtcttccttaacctggttttctcttaacaccaatgatgaaccctgagaaaatgcctgcatttggcctttgcctagaacaggagctgagtatttaagatgtattatcctcggggcatcctgaaaattaatgtattccctaaaatttcttcttgtctatcatcaaggcctttttttatttgttaagaatttttatattaaatgtaaaacatataaatattttctattgtataatcttggattcaacatctgtgaggatcatttttgtaagatacatagaatttgtgcatttctttatgaacttactgttagtgttcttggtttcggctgtttatgactcatgtttatgtacattctgctccaaaatgtttttgtactctgcaactaattacttttggataacaaaagccttgtgtttaatgccctaaagtatttgggggtttccttgtgagagggtggccgaatcatctacctctctcttccatagttgctgtgcaatcgtacgggtaaaattcttaattacttacaaaaactgtgatagaggggagaggtacagatttggtttttaaattgattttaaaatactttatagaaatttagtaagagttaaagcaaaagactttttttcc

SEQ ID NO: 54920 - DNA, 1141 bp, Homo sapiens
cagtgctgtggcatagctccaataggtgtgctgtggtgcactgcagtgatgtatttgcataacattgtttgatagtgaaaaattttttttcggttcaagtgttttgtgattaaaattttatgtttaattaaaatattgcataatattgatgggttcaaaaaccattaaaataatcaaacaattattctgtgcccttaacattattttcttgtgttttcaataaaattttcttttcatctttccatcttcacattctcttagcatcatcctatgcacataaggtatgttgttttccttctccactcacctaccgcactaaatttgatcagcaattgtacagtaacagaatatatttgtgccagaagatttgcaatgatatttgagcatgtatttatttaggaggaagccagtgcctgtaattatgtctcattgagtagttttactttgcccatcctgcagtatttagagctgatctgtacccaaagcaggacaatgtaactgtagatctgctttgttttcagtaactgtacattgcatcagaatctgtttatttctatctggaaacagacagaatggtgggggagggaaggagttattttgcatcctagtttgtattatgaagtcatcatatatatatttgaaatagtataagctaattactgttgcagaatgccctcgatataattatttcttttcagctggatgtgaaaagctgaagcagtgaaaacctgcagtcttatttcactggtttccttctgtttcttgtccatcacttctgtatccacagggagctatctactacatacctttggtaacaggctacattctcttcagattttttatatgaataatttcatcagcactaaagcattaacatagaataatgagccaaagtactgagtcgagatggctttcagttgagtttaatttcatatttaacttttgcatttaacttgtataatacactactgctgagaaaaacaattatgaatgccttctgcatgttgtacattatctctaacagagatggtgcaattttaagaatacaaaggggtatagagttagaatggatgtgttcgtgcatatatatgttgtatttaaatattaatgtttacaagaagattttttttaaattcttcaa

SEQ ID NO: 54921 - DNA, 1069 bp, Homo sapiens
ccaagtagctgggattacaggcgcctgccgccgcacccagccaatttttgtatttttagtagagacacggtttcaccatcttggccaggctaagcttgaactcctgaccccatgatccacccacctcagcttcccaaagtgctgggattacaggcatgagccactgcacccagcctctccttatgtattttaagaacttatcaaaatcaacaaaaattactaactagtctttttcaaatatcttagagatttatgaaaactagaaactggctcaaatatctttttaatatgaaagatatatcctataaatgtaacttctgggaaaatactgtagagaaattactatgagaatggcttcattagcaaaacattgtcaggctaatttatattatctcttgatattagcaaggttcagtataatatgcttatcagtaaagttaggagatactgtccagcacacataactttctagttagtgcactgctatgtggacaactgtgaccagaaagtgattatcaactgaggaagtagcagctggaggtatgtccagggtttggatctgagttgggtgttttagaattttatctgaggatctggatggcataatagaaaacatgcaggtgatatttatataagtgactttgtggtgtatagagtgccttgattttgaagcaagaatttgaaaagagtttggcaaaataaaatatataaaattaaagtgaaaggaaataatcaaagataagcaattaaattcatttaaggaaagcacagggtggtacattgaataaaaccaagcaaatgacataaatatactacatttgtatttgttttgttaaatttgtttctgtagtttccagtatttagaatagtatatgacatgaagcaaacatttaatacacatttgctgaataaatatatgaataaaatataagatggaggaagacaacatgtgattagagcaaaattaagattattcctaaggggatggaaatgcgtaagtactaaactgttagaaaaactttttggacaaataatttctgagcatgtgttaaaattttatttgtcttag

SEQ ID NO: 54922 - DNA, 1023 bp, Homo sapiens
atagctaacctagatttaaaaaatgtgggttcaaggtcactagacttttcactgacacctaacaatttaactggatggctaggtagctggtttctaagaacaagtgtttccctattaaacttaatcagaaaattgcttaattattaggaatatgtgtttcttcatagaaggagattgtgaattctacttcacaaataggttctgttgctgatcaagttagaaacttttttttttaatagtctctcaatttagacagtctttgcaggtctgtcttggtcaaggaagtctatccatctcattacatttttgcattagggtcattgaatttgttacctactcattaacttttaggtttctttatttacactttgcatccagagtcacagttacaagcactatttatataaacactgataatactttgaactggttttctataccagggaagattttcaaagcataatctaaactaacatagtttcagtgttatctactttatataatttatggtcctgggcttctatatttctgtgttctgttctacttagcatgctttgttttaaaaggtaccgcaagaggagcttattaatccgtttaaacgatctttttatgtgatcaaggcattcgctgccatatgatattgcacaaccagtaaggccaatgagttaacatctttgtggaagctttgtgaaatccttgaagttatgtttttattgcttctttcacactagaagtaatttttatagtactttcctctcagcttgtctactccaaggccagaactcagggagtatctaatttatctccatcagattttgcctctagtacttgtaactgtggtaaccctattttcttgaggacgcttttttcctcctcagattcttatcctgctagatagttatattccgtactgcctaaaaagttgagattcttttgaccatagagtagataccagactagtatccagggaggatgttctgtgcattgctacaatttatgtagtgtagcattagtaccttaata

SEQ ID NO: 54923 - DNA, 1045 bp, Homo sapiens
taactgtttacagacacagacaattgtacaggaaacctctgaacccattcctataggatacaattttaactgttcaacaaatgtaaatactgatacaaatatatacacaaacccactgcaggcaaaacacaaaataacttaagatttctgtgaatgttgtcataggataattttcaaaaagttaaacatgactcttaaatatagaatgaacagtcaaagatttatttaactcataaatgagggagccagcaggatggcaaaactggtgcaaagagtgttcaaggaattatttttgaaaggaatgttagaataacattgctagatataaaactaggtaatgtccttcaggaaaataaaacccataatgtttttagttttcttttctaccagccaaaaatctacaagactggaatttaatcagtagaaattaggaagtaaaaaaaaaaaggtatatttccccaagtaatccatgggtgggccaattaaataattattcagtattacattgaaaggatatattgctctacctttccctcacttccaagttttgaatactttttgaaacaatgtacacttgcttatcctaaatgttctttttaagggctttggttgtttcttagtaatatagtaaactttaagccatagaatgtgtcaaatacaaaacactggtggtggaaatcttcaaacttagaacatgggttctaggaacagaagttttgggttctacacttccacacttacatccctccaatatcaaatactgctctgatttcaccctgggggaggagtcctgttttaactccaaccccaagttcaaccacttcttagagctcaaacagctctccaagctctcaacttagatggcaagtcattttaagcccagtagaatgggagtcccttcagatggccattagacattgacattcaagtgctcaaattgccatatctcagaaaaaaaataatccagtgatcaagaagcataacacagtgggtaacaatagcatatatgccatgaagtaccttgatccagaggctgacaataact

SEQ ID NO: 54924 - DNA, 1061 bp, Homo sapiens
ttatgtgccagatactgttctaggctctgggagacaggagtgaacaaaacaaagtccccatttcttagggagcttaccttatgatgcagcagagagatagaagtataactaaatgagtaatacccgtatagtacatctgataaagataatgctattgaggaaagcaacttagggaatgaaaaagggagtgctgggatggcatgctcttgcttttggtgagttggtattaatattttcaatagggtagccagaaaaggtgtctccaataatgatatatgtgcagagacctgaaggaagtgagaaaacaatattcatgccaatatctggtggcagaatgctccttgctgcaggaagtccttagaccgttttctcctctctatatgctgcctaggtggtttcatcctatcactttttataaccctaatgactcccaaacttctatctctatcccagatctttcctatctctagtccagtgtatccagctgtttgtggagcccctccacttgggtgtctagtagacatctcagatttcagatgtctctatccaaactccttattccccactccctaaacctactttctgtagcctctcactccctttataaaatggcaactccattatttcagcttctcaacttaaaaatattggactcataatgattcttctctctcaaacctcacacccaatccatcagctagagcacgagttacttatattgggaaaaactaaaaaaggagtaaacctagggcagtgggaggaagaaattaaggtaaaatacaaagcagagcagtaatagagctactttctgggcagtgtttgatgggatgaggaaaatctaagctgaaggcatttgagccttggaactcaggttgctgggaaatcacatcctaagccacattcccttaaaagagctaaaactttaaagtggtttgctatgttttgatatgtcttaacatcaagagtgagttagttggcaaaactcaagctgtcaacccatgggttagaaagagactttaggtacccgtgagaatgttttacataaagtttacctaaagtat

SEQ ID NO: 54925 - DNA, 1075 bp, Homo sapiens
tttctcctttagatacaaagccttgcattaaatattcattagctggacagacaaaacctaacattctgatttttaggtacattcttatcagttttaatgctcctgaagggccatttttcctggaggctggaggacctgaaatttttccttccatcacaaactttactgagctcatccaacaggaaagaccaatcaacagctggcatgagatggagggcagccttcttgaaaagctccaaagataattagtcaaccgttagtgtttttctgcaattatcaaactttcatggtccctgattctagatggtacattttaaaggtagattcctgtaaagattagcttaactgaaaaggaagataaaaatgatcatactctaaacccattagtctttcagtctctcactttaaacatcagtctcttggtttctgtgcagtgttactttgtttcctagttttttatgtttaacctagctggaaattttaaattttacccctatttaacaaaaacaaaaacaagtgaaaaagtgtttgacaaaaagttgctttagcttccttgtcacactttttggttgacagtttgtataagtaccagtctaccatctatttttatggaaaggtatttgaaaaacaagctacatttcttgtcagaacagaaaagacaactttctccctatgaaatcattaagagttcaactcaaaaaaacaaaaaaacaaaaacaaaaacaaaaaacctttttttgagtattctaggccccagagcaaggaatataaaataaaaggtgaccccttgccttttcagaaaactgtaaattccagaagttacaaaataaacaagaaactttagttttaatgctcttgagggcaggagtcttcttgccttccgcaccctcctctccttgctgcccttcatcagaaagaaagcagcattccccgcacatggctttgccagctcctgtcatgcctgggttttctgggctgcgctgtgtgttcatggtgtgcctgctgcttagaaccctgtgccctctttgttcaaggggtaaaactggattggaggtaaacctcagtctctttctgt

SEQ ID NO: 54926 - DNA, 1083 bp, Homo sapiens
aattcatacggggtggactactcaattcaacaaacaatcctgtgcatcagcaatatatcagacactctgtggggtgttagatgctaaaagaaaaacagcacagcccatgccttcagattgctaattgtctgaagaccatagaaacacataagcaatgttttccaatatgtaaatgccttaatggtgcctcaagagcatcaaatatgatgttgtcatctcagtcactggaagtgagggactcaagaagataattgagtgaagtctcaaagaatgaatatacaaaaccaaaatatatattttaataagacgcatgaaggggaaaactcagcattaacagaatatttagtgtgatcattttacaaagccctcatggattggcacagtgaccggagggcccagatggcatttttcggagagggtggggtcagggatattaaacatcctgcaatcggtgggacattcccacacagcagaattgttttatccagaatgctaatagcacatccatggagtaacactggcaagagaacctgtgctagaatctgtatgtactttatttagttcccagaacaaacctgtgaaagtagattagtcccatttttcagatgagaattccaaagtgtagaaggttagataacttgccccaaagccaagagggatgcagctgagattccaatcttaggctgattctccatgaggcgtctgtcacccctgtgcacactgctatcaaatattatggaaccatcacaattgcacagattgtgagggcaaggtttggcttataaaacaggattttcagtgtaaaagcaagtacaaaatgataaaaagagaaaatcgttacaaaaagtatcaattttatgaattataaattaaaattttaaggggcattcactatatacctgctatttaaaaagaaaaatttgcactctatagtgagcattaacaaaacaagaaagaatgcatggtacaaattatcaaagtaaaactacctaggatccatataacaaattaatgttccataggggaagaatttaagctcttattttagctctgctatgataatccactaaaaatggcttaatg

SEQ ID NO: 54927 - DNA, 1162 bp, Homo sapiens
caataccacatagcctttaactgacagagctacctttttaggtcaggtggcctggctctagaggtccaagcacttaatcacagtactgcctaaaaggaccatgtaagataaagggcattatttgtgcatctcctcttaccaagtatgatgattctaacttgatttgttcttacctaaactatagcatgctccaagacactcaataatacttttgaatgagggaatgaataattgactttcctacaaaagaagaatctgagctccttggaggagtgattttgcattcttccattttatcacctagcagagtgcctaacatatggtaggcaatatgggtttcaataatctgtaaacatgtttttgaaaaattttgcagcaatcaaactttataaattgatctcaaatgcactgaggtggcttatgagtaatgtcatgatgaattcgttggaaaatgaaaaatagccctggtgggctaaatatggatatacctgcatagtcatacacaaataaatgtacagtatatttgcttgaaagtggtagtaatgctgaagagtttcaaattatttgagcctctctctcacctctctcagtttcctcatctctgaaatgggaatactaatacatacctcagttgattatgagggaaagagttaaatgacataatatgtggaaagggcttagccaactgcttaataggcatcgctcagtaaatgttacctaagtacaaccacatattataagtgtgatcaaatttctcaatctagtgtgtctcttaataacataactaacataatatgcaatatctagagcactttatttttaaaagacaggaactcaatacatatgatgctttaaaattacatggtaggagttcagcctaagtaaatggtaaaacaaatgttttctcattttctttcctcccctgcgctacctactactttaatgttctttctattctttatatgggttagacccatttcaaactttctttatatgggttaaacccatttcacttctcagacttatttaaactcttgcgggttgttttttgtttgtttgtttgttgtttgtttgttttccgagacaggttcttgccctgtcacccagcctggagtgcagtggcgccatcaccactctctgtagcccaaacctcttggctcaa

SEQ ID NO: 54928 - DNA, 1351 bp, Homo sapiens
gcttcggccccgggcggccggccctgcgggaggggagtgcggcttcctggctcctgaacccctcgcgcgcgctcccttctctcacctccctccgccctatcggaaaggcggggagagccggtttcggctctgctggttcctcccggaggtgggtgtttggtgtctggccttgctggcccggcgtccaaaggtgagccctttaacttctccagaatcgcctcccctccgcttccttcctgtgcagggtgggctgcgctgggagcccggcgggcgggggcggggaggtgaaggcccgcgccccgccccccgcgcctgtgggagggagctgggggcccgcaggtgcacccagccgtccgcgggccgtctccgggttgggtaccggtataatccgcttctagcttgtttggaggcgtgggctcttgggagcgggacttctgctcaaatcctgtccaggggcttgaaaaggaggagaattgggggtggttgccgggaggaccagcacctccagttactggagggttgataggggccttctcctttccgtcaccctttactagggggtatcccttgcagataaatgagattttttgatttcttaaaaagccagctgcagtgaagaagaactgctgcaggtcgaggggaagagaggtaggtccttgctggagagggagaggtgggctgtgaggttccaggagcacgcacttggggtgtgtgtggccgaaagtatggaggtagggttgtgggaaggaaacagccgagatgagagggagggcgcactcaggatgtaggcggagagatggggaataggtactggggagtcctagcggaatgtggggcccagctggagccgcttggcttatatttggctcctcgttgcctcgcagatttcctgctcttggatcttcaaaaatatttttttgttggacaaagaaaactctgaggacatattttggaagagctgatttctggaaactttccttggcagctttgatagtaaaattccgtacaggcagcgtttattgagcacctattacgtggtttgtaccggactttggaagagtctggacaggcagggaatccccgtttgcagtaatgatgagggctgtctaccttataaacaaataaggggcccctcccagtgccaagaatgagagtgatcagaccttcctcgccatagcatctgggacctctgcttcttacagacctgtgggaagaaccctgcaccatatcctgtaaatggggtcctcaggcagcatttatttttgcagtccaaaaatagtgaccaaacacctactgtcagctaggcgagagttggggttcttgcttcatctgtcttgacaccaactaacta

SEQ ID NO: 54929 - DNA, 1030 bp, Homo sapiens
gtggaaccagataaaagtttatgaagtatgctgagggaggagtggaaatctgaattgacttttgacagtggtcagggatgtggaacagaatatacgactaataaaggagggtagagggaacctagttcgtgaaaaacttaaccacaagtcagtggtgttaatcatttgcctcaagaccagtggctctcagaagtaggcaattttgcttctcagcagacattgaggaatgtcggagacatttatggttatcatagcgaggtggcaggtgctgctgtcatctagtggctagaggacagggatgatacataagcatcctactgtgcacaggacatcaacccccttcctcctaaacaaagaatgatcctgtccaaaatggcgatagtgcctgcccttagatctcagaataggtcttgaagggaggtggttcttgacatgggaggagtaataacattgagcttaggaagctgatgtaggagacttgtgctcaggtctgatgtgattagggtctgggcaaatccttattgaaagaaaggggcagtttggagggagatcatagcagatgagcacagtatgatagtggagtaagttgggaatcattgaaatcagaattggcattttagaggggccctatccaatttatttattttagtaaattcttaccctttctaggtaacttttgtttaaccccaggaaccgtgaacttctcctgaagacaggttattacacctttggactgtttgttgtatttttacttgagctgaagactgtctccttgaatttttttttccaatgattttcttcttttggagctgcctactctctttgaatgcaccaagacaatatgatgtccccttacccccagttgactttgctaatgcaaactagtcccaattcttttcacagtcttttattgggatgtggtttctcgatgtcttctcagtttatcggcatctcacatggagaatctggaattgaatatgtaattgagatgtgatctggccaacagagagtacagtaagacagctgtttg

SEQ ID NO: 54930 - DNA, 1763 bp, Homo sapiens
ctgtggctgcaggcagttgctgtagttcaaagcaaacagccaagctagagtaggagggacactgacggggtttgttcattagaattttgaacattaatttttgaaggaaagaaaggggagtacaaatagaataggaatagaaatattgtgaaattttctttataacagaacaaaattgggtcaggagaaaggactttaagaaatcacttaacatttatcattactttgaaagcaaatgccttttttgagtaaaagcaaatgctttttgagcatttactttgtctgcagtgcactctagtggggtgggaaacgaaagttagcactaaatattaacaacggctatcatgttagtgcatttcaggtggtccacagtgggccacttttctgttctattcttatatcagccatgaaggttggtgtcattggtgttccatttcaaagattacaaaactgaggctcagtgtgtttaaataacccactcaaggatacagtgctaataactagcagggagagctaaacttcgacctaggtctctttctcatccacaatatgaaagatgagtaagatatgcccctgctttgaagataagacctgcatgtaaacagtttagtataattcagcacagtttgcagtatatgttgtaattcttgtgagagctacattttttggacatttgctcagaaggagagactgattttgactggaaagatcaggggaggtctcacaaggaaaaataccttgaatagggccttgaaggatgacaaagatggtgacaggtagagaattgatgggagagctgagggaacgttggagcagcaaagcatggagttgtagaagtacagaatgtgtttgggaaatgctgctgggatggagtgagggatggaggaggaaaggaagccagagaagtagtttgggacagattacagagggcctagagtgtcctgctgaggaatttagacttcacttggttgcctttgaataaaggttattccattgaaggttcttgagaagggaaataattttgccttgatctctgccttcagcaattctggtggtagcatgggctttcgccagcactaggctgcatctaaggatcacttgggagtttcctaaatgtgcagattccaggagcacccctccacccccatgatttcagtggttcacatcttgggtagggcctgggaaagtgtgttttgaaggctctgcaggtggttctgagggcagcctggtgagggaagggttctagagggcattggggcattctagagaaaggtctgagctgaagctaattttgagtttgtccctgtatggatgattttttaaaccatgggagggggccagtcatcaaactttgtggaagttctgtctgtgtaggttctatggtttgctttttgtcctctgtaagtattaaacagtaatctctcagagcattgtcatttggctgaagtttttcacatgtatttcctgttcaaatctagaatgtgggatggctctaatccttatgcccctgtgctagatttctccttttttgttgctgtttcttttagaaggcagaggaatatatgggattttattgtgggctgtacctgtcttcaatgacaatctcttggagagcatgagctctgtagtttactgcctgggtttttactctgcctttctagccatgggaacatgggaaagttacttaacttactataaaatgaagatacaataatatttacctcctagggttagttgtgaggatggtttatataaaatgctta

SEQ ID NO: 54931 - DNA, 1871 bp, Homo sapiens
agtggggccagattatacatacgccactgacattttcatctgacctcctaaactcagcctttgagccccttcttttctttgggttttcctaacgaagtcttgttgaaaggaatattatttcccatggaactttactgatagtgtatggaataatacgatcatgctctgtgaagttcagacctgaagtcttaacattttaaacatgtatctatttgctattgcttacttagttcagtcttggcattttaggtttagaggtggttactacccattggacatccatagccactccctgcaaattaaaggggacacaaaaatgaaactgaacttctgtttttcttcacctctctgctaatttaactaagtcaattggctcgccctcatttgccctcttcacacctcccaaattaatgttatgtgcaaatttgattaaaacagcgtgagtaatttccaagttacttttgaatacggattgaattccgttccttgtggctttttcttcatcatactagtagatgtagccagtgtttttgtttctagcctgcttaacttgtgtggttcttggaacaacataagttttggttgatttaggatcctgatttcacaggatactgtatcaactgctttaccaagatcaaagtacatgggttcactgcattcctttcagttgctaattcagttgtgctgtagccaggcaatcctggagccttgaaatccaggattctggtcaaggtgaggaagcagcccttcctcctggccttttcattctgcaaataccttttctttccttcttaatatttatttattcagcaatgtggcccaggctctgcatccctgacttcctaaagctttcagcctagtgcccctagacaagtggttacattcttgctacaaactggaaagtctctgagcccctcaccccactcctccccacttcttttcttctgctgtatttatggcactgtacctcatgaactttcacacaagggaaagcaaactcaatccaattgggtcttatgggtaagaaaatgtgttggttaaagtagattctggtcagccaggctatcgaagttttagtatttactagcagtgtgactttgggcaaattacttaacatctccatgtccatgtctcttttctcatctgtaatatgaagataacaataactcctacctcatagggttgttgtcaggaatcattgaagtgttaatacatgtaaagtgcttggcatttattaaactagggttagttaaaaaattgatgaataagctattaaaagttcataataaagtttctggagttttcaggtactccgtttctctttcgtgctatttgccttggctattccactacaggcaaaggaaaggagatgaaatttaaagtatctaattttgtaaccttaaattattcatgaattgtttttcttcgtgtagactccattataatgtataatggagaattgtattcaagatatgatgtgtgtgacttattccttatgaactctgaaagtcatttttaagaacacttcttaataatgaacattatatttatttgactttttaggatccaacccttttacattgttgggctttttaatatgttatttaaaaaacaagattgcccaggccaggcgtggtggctcacgcctgtaatcccagcactttgggagaccgaggtgggtggatcatttgagtccaggagtttgagaccagcctgggcaacatggcgaaacccctgtcccttaaaaaaaaaaaaaaggggggaaaaaagaaaaattagctggatgtggcgagctcctgtagtcccagctactggggaggctaaggtgggaggattggttgagcctgagagaacaaggctacagtgagctg

SEQ ID NO: 54932 - DNA, 1468 bp, Homo sapiens
tctcctcctccacacccattagtcctcagaaaagctatttcttgaaactgaatttggagcttctaaaatggctttcacagtgttggtctcttcatctggggattatggtacttagggagtggagactttcaaagtgaaccttccacatttttccaaaatcttttgtggcataatttgtgcctacctgagagcgcattttttctttttatgaggttgtgattttaatatatatacatacacgtgcacacacacacgtgcgcatgcacacacacacacaaaagcataacagcggctatgagaaagaaacacttctgcatgaaacacagaaggagcgggcgaatagctgaccaggggaaagtatgagatggtgttcaggcctcatggtagttaggattaggaaatgtcaggggctgtgttgtattctccaaactgtaaactttgggagtcgtacagagtgaatgttaataaatatttttgataaggaggagggtttgggtttatagggagcctaagaaagagaaatgtggctgcccttcccccacagctggccactgctctggaggggagagtattagacatttgggtgtggacatagcagcataggcgaataccattgttagtctcccaccaaatgctcttctgtattttgttacctattaaaccatacaaactctcctatatatcattaaattatcactcagtacagtacttggacaaaataggaatagtctactgttaactgtttttagattaatgactttgaatttttcctaagagagattttaagaagttagatagtctaatcgcatgagtcccaaatataaaaaacaaaggctctgcaggtttaagttttcctttgccttttcttaagaatttaaatatttttcttcagaggttttccttgggctcttagataatgagtaacaaaaatgaaggagggataccaaaagatatttcaaaacataattgtgtccttaaaaacatggtaataattgacagggtttttaaaatgagagaagtttctagctaaatgccctgcttcacatccccactccccacactgagtactttgtggaaaatatgtggtagctgtttgggaagaagtattaagtttgtgaaaagacatgaagagttgccaggaccacggtaagcaaaggattgagagaaggaaaaaggtgaacagagctagaccctaaaaggatgctaagatcccttgagaagtcttttagtaagaagccctccttagactgcgagtgcctagtggacaggaatgcatctcactggtccttgcagtcttcttccccgcccctgcctttgtacttgaaggccatggtcatctgggtgcactacaattcaagtctgtgaggtgaggagaaaagggtgggtgaggtgtagttcatcgtctggaggcctcagtattgtcaagaccacccccccccttttttttgtgagtgcacaagactcttaa

SEQ ID NO: 54933 - DNA, 1211 bp, Homo sapiens
accacgcgggcagccggtgcggcggggtcgccacggccaggggagcgctgggtgcccaccatggcagttatgcaagcggtgaccccctggtcttgcctccccgccgccctgcactccttcctccccgctgccgacacttggatctctctagctctttctctcccctgtgttttcaaacaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggtgcgcggggtcgggtctgggtccagggagcgggtcgggaagtctgcggcacggagcactgctagtgtcggatctgcatctccagctctgtgctgcagcttcacttgcccgccccccaccactggcttctcacccggggtctctgccaaactctggctgctgccgccctgggttcgggccggcggaaggccctgggcgtgcgctgcggagccgcctgcgaggactccactagggcgctttccaggctggactgccccgggctgcgctggagctgccagtgctcggggagtcttcctggagtccccagctgccctctccaccctctcctccagctgctgctgcctgaagcagcagctctttgttcctcccttactggtctggggtcatacacataaatgtcctgggaggcagggtggtgggagggtaaggggttgggacgtagggaagaggaagaagatgagttgtgggtgaagtgtaaggtggacaggagaaaagaatcttagtgtccatgctcagaaatcagctcttcagctgctgaaacagaggaccccggttccttggtttctgttttgggaaagccaggccatgccaaacagagggaattaatgatgcaggcacacaccggaaaggtagggaccaggaatgaggcacagcagcgagttctgagatgtttagtctggtgtctggcttgttaactccactgtggtttctgagccaggcctcctcgctgagacagaaggtactttaacatatgagccaggcatctttattaattccatttgtcatcaaagtaaaattgagagtgacttttctcaaattcaccaggtagattatactttcacttccacatcgtgttccatctcaaatgttcataggagaataaaac

SEQ ID NO: 54934 - DNA, 1503 bp, Homo sapiens
cttaaagttgaggctctctttagttacagttttaatgttgcaccattaactaaactgtaaaattatggtttaatttgttatactgcaaattaaaatttggagtacaattttcataagtgttggataaaatatttgtcttctcttcaataattggaatatttgtagtggcctataacttcccctctgtaaaactgtggtcaaaaccctcagggagaggagaaggtaaaggaggagcaaaagagaggaaatgagagctcattgttttgtaagggaggaatgaaatgatacatgtatggttccttaatacgcagtgcactgccttttctgtctgtcggtgagttgcagtggcttgtgaaccagccgtgcatctcttccaacagaaaggctaaaaatgaaagggtaactagctttgatgttaaatgccaaggaaaagttaatggccaagaggggactaggagtggagataaatgcaagttaagatttcattttttcaaaactttttttcccttcacgtatattataaagtaaaaaatgccttcttagtcaaattgtaaactgtaatgcagtggctcctgacaccaaaatcaggaagcttttatttaatattaaaagatttcaacgatcttaactggttcactgttttacttcgtatctcttataattgcagatgtttcatgagagttatttaatatcagccaagtatatattgcaaataatgacttcagcatcttcctgtatttgtaaaatagcactgcatgtatatatgaggtagggattcagcctacagacctcttgcagtaccctgaagtctacaggttgggaattgaggccaaagcaaaacaactgctccagactgaaaatgctgaaatggtgatgaaaaatgcataatatgttagccatcagattataaagattcccaggtggaatttttcctctttgttgtacattaaaaggatgatgtgttaagccctgattttggatctggtcatgtttccgggctaatcgtttttcatggtcagctttgagatctttgcagttagtcatggataactggatttctcttaagagcattttccctacaatacttctgcgaatatgccttccctgtttttgtagagtcaggactgtgaggccagtttcagaatcatgatggtcatagccactaccaccaccaccaccagccctatattcatttcccagaagctaaaagaggcttcccaatcttaacctttacaatttgtggtaagtttaaggaaagggagataggatttatccctgttctgcagtgggaaaaactgatgtgtgggttcatattgaattagtctctctgatttctgtgtgtgttgtattgacatgaatgtaagtcattctgcttgagataggttgagcagggcatggaaatctaatagggttatttcatgaagttcctttatttgttaaaagaaattacttcctatctattgaacaccatatttttcaggcattgacaaatagacactgatt

SEQ ID NO: 54935 - DNA, 1097 bp, Homo sapiens
atgtgtccatgtgttctcatcatttagctcccacttataagtgagaacatgtggtattcggttttctgttcctgtgttagtttgcaaaggataatggcctcccactccatgcaagtccctgcaaagcacatgatcttgttcttttctatgaatttttatgttcttttttatcaaggaatactactccttggtgtatatgtaccccatttcctttatccagcctgtcattgatggacatttaggttgactccatttctttactattggatacactgttttaattgttgcatgtacctttatataacatgattttattagcatgacttcttgttacatgtacatttatataacttgaccttattgttatgattgatacattaatataaattttaaagttcaagactttaagattattttgaggcagattccttgcccttatttgtatgtgttaactttttgcagctacacattttctaaaaacacatttctaaaagacacatttttctagaaatgtgtcgacctatctaggaatattgtttaatttccttacttggtaacataattttaatattgctgacgttacattttcttctgtttttttgtgtttttttttttgtcttttcttttcttcttttgttagcagttatggctccctttcatacttggtcatctgtgtagggcagtggtgtgtcactgcaaaggcttgtcctcctctgttgctctgtatgtgcttgtagagctatgaggtacattcctggtacggcttttgaatgaatgttttatgaggtgtgatgcttactgactgcatgggtgaatactcttgaaagtctcttaattacagatgtctctttattattgggacaactttgtcagtttcagcttgattttctccaagtttactttgctctagtcttctcagtttagtgggtcttattcttccccgtctgcaatttatgtcacactgaatgctaggtcactttatttggtaagtgggtgtttgtgtgcctctgcagagtacaatgtattttccccttgtctttctttttctttttttttttttgagacgagagtcttgctgtgttgcccaggctggagtg

SEQ ID NO: 54936 - DNA, 1248 bp, Homo sapiens
ttttctagtgtctgtagttcttcaggtgctttatggacacaggagagagttgcagtctttttagttaactgctgagatttaccaagcttgcacaaagtctgataaaatcataatatagaatgttctagggtccgaaacctgctgagacggataagactgatatctgtgggttgttggaattgttctcgtattgtgctttaaatgggatttattagctattctcttgagtttgattataacagccctagctagttacctgactaaacttacatgctcattagaggactttatcagtatggaagttctccatttctcattcagattcctctgtgctccccttagtagctgtcctaccagccttccctcttattcaattattgtaatataattggcagccaaactacttcatccattcaacaggagacatttgctgagctccaaattattaaatcttagtccccgcccctccgtcatccccacctcctgtgtactggtcattttgttaagttctgaggatgcaatgtgagtatgaaatggtgcctaacctctgaagatagactcataaaccactaactggaacttaacttttttataacttaaggcactttatagcaatatattgtgacgataatgatagagagtagggcacatagaagggagtgttttgttctttcttgtttgtgaggaaggaattcctgaaggaggggattttggtgctgaattttgagaggctgagatcatttaccaggccgagatggagaaaggacagactgaggaaacagcccaggttcagagccccaaagggctcagtgaatgtggaacatggactaggagtgaatggagccaagcgatggtggtacagaggggagaagaggctggaggtgcctactggcttgggttcttggtcaaacccatgtctagggccatgcatttcatttctgaaagtgtgaactttatcctgacagcattgtggagtcattaaaggtaaaataagtgttgcaatcactgttttcagatatgtgaaaagaaagcagggagcactttagtggctaccatcataatccaggcagacatcatgaggacccaaactaaggtgatgaaggtgagaaaggaaaggcgagactggattgaagaaatgattaggagaaataattagttattgattagatggaaagtaggaagggagtaagaggaaggaaaaagatgattcttgattcttctggttttgatgacttacatctgaaggtg

SEQ ID NO: 54937 - DNA, 1058 bp, Homo sapiens
cagaagggtccggtagagtgaagattgaatataggagattggatctgacagttaggtattcagtgggtagtcagaagacctctaaagcctaacactggattgtcaccagtgaggaatgaggaggagttaagaagtgggggcatcaaatggagagacagcgagagagcacaggcaggagagcgagcagatacacgcgggtgtgtacacgtttgcgaggagttgtgtgtatgtgtgtgatagtgattagagcttatagtttggttgagaatagtggtgaggaagtgactacaagtagaagaggaaatcattaatggagtaaagttccagaaaagataggggggccaagttctagagcacaagcatactcaaaggggttgttataaaagggaattgggacgtttattccattgggacaggagaagacgaggaagagatatgtgtggctgtaggtgaatatgcaagtggatgggaaagaagttgagaaagtttgttcctgatggcttggatattttcagtaaaggaggagatgaaatctgctgagagtgtggggccttgaggagacagctggaagttagtaacagttacctttgtaaaaggagcccagtgctttaggatgagtgatagctgtgtgtcattgaaggcccagttgtagttttgtcagtggtggttaggtgctgacggaggatttttttttttctgtttgatagagtactgtaatatgaatagcatgaatgaccttttacaatagaacgcacaggccctgcctgaaacattaagtttggatggtgatttaaagattggacaggaggagagaaggagcagcagacttaacattagggaacttgagttctagtcctagttcttccatttaatggaagacggggagttcttcctcctcatctttcaatggaggaagttgcatttgatgtcctctcaagtcttctgtagctctcagaacttctgtgagatttgcacatcattagacaaaaatgagtggagaagagagtaagagcagctagactcccatcacttatcatttatgggttcttctgatggca

SEQ ID NO: 54938 - DNA, 1112 bp, Homo sapiens
cttgggaaaggattgataggccctattttctacttgccttttcatccatttattttgtgataattcctctatgtttcctaatcatttgctctttgaaaaaagtgagagcttgtgatcagtcctgcacggaagccagtacacaatctaggtattagagcagtgcattgacagagaggctaccttccattttgtgcttccaagaggtggttgtaaataggaaagtgaaaattgttaaatgacaaaaattactttgaagtaaatttctctgcctgttttagaacttaactctagatgaagaatcagtatattttggggggcagtaatagtaagaccaaaaagcaacgtttttacagcagtgtcagaatatctatttgccaagtattatttccactttatggatggggcctaaaagccagatagtttgtttgacttgaaggtcactggttaatgagccttttattactacgtaggttttcaccggtgctgagcaagaaagcttacaaatctcctacctaaggcatgcttatatccgaaccattccaagataaagaaaatgtacaatttaagcttttctggaagaaaggaaaacctcaacactttctgatctctctcagatcaatagcattttaaactaaatcttttatgcgaaaagttaattaaggcaactccaattcctttcttaacagaaatggttttacatcatcctccatgaagtaactaaccaaagacaggcccaccttcatctttctccttagtaagtttattgatcccagggctctttactcttacacgtccaattttaaaatgtacacgtggccgggcacagtggctcacgcctgtaatcctagcactttgtgaggccagggcgggcagatcatgaggtcaagagatcgagaccatcctggccaacatggtgaaaccctgtctctactaaaaataaaaaaattagctgagcgtggtggtgcgcggctgtaaccaaagctacttgggagtctgaggcaggagaatcacttgaacctgggaggtggaggttgcagtgagccgagatcacgccactgcactccagcctggcaacagagcaagactctatctcaaaaaaaaaaaaaaaaaaa

SEQ ID NO: 54939 - DNA, 1048 bp, Homo sapiens
catttagaacagtgactggcacacagcaagtgcagcacaagcattggttggataaaataaagggctgcccatgtagtcttctggtctgtggcccctggaggaagaggcagaggcagacccaaaatgtagatcacgcagtacacaagtgggtaatgggctgagctgtgtgttgaagcagagacaggaagaggcggcctgggaacctcagtttctttttgcctccttagtgatcctaataacctggaatattaataaacttatgtccctcactttcaagatgctgaaaatgattatgcttcttttttttttcctcctagctttcagagagctcatggaaaccaagcctgtttatttgagatttttctgttgcagggtaggccagacatgaatttcctttcatgtgatattttctgtggtctgtgttatttagttcttcctttgttttcttgtgctttggtgtgaagaaagaagatgccctgtttataaagccttggtctttcatgtatcatgcattcttaaactaattccagttgctctgaccctttgagattttaaaattgctttgttccggtttttaagtacttttgaaatattaaaaatgttcatgagggagtgggtcatgggaaaaatttcccagggttgtttgttcttagaaaattgtgaatttgcatggagaggttttatgctgggttaaattctgccaggtgcattggtcacttgaacttgagtctggttcttttgatatttaaatccgtgttgttatggcataaagtgcagagctggaacctcttaaaactaaatgcctgctatgttgagctcttgccccattgtcccatcaaagaaaggtcttaaccagtacttgggtttgcattgaggcaccatgtcaatagtgaggatcaaaagattggtctgttctgttttttgtctttgaaccaagactttccaaaaagaacatagacttgttttgaatattgccgcctctgggtgtgagtgattatgcaagtcagtagcatttttgtttttttgttttgaaaaaactgttcaacat

SEQ ID NO: 54940 - DNA, 2003 bp, Homo sapiens
ccagctgtgttatctggatgtggaacatagcgttctgctatctgttttcagaaatgtcgcatatcccttccagggcagaccactcattgccaaggcataaggtcgaaaactgcccagtggggtggaaagcaaaggcagttggttagctgttggtgctttctttactctctacgaggatctttcaatggcagtgaccaggacttcattctgttatttgttatagaacaggcaagacatgaaccaacccagtcatattctgtaccaaacacatctgtggtccattctgctttccccagctttggtttcttcatttcacacgtccaagagaattttcttaaggataaccatcttattagaaatatgtctaattgataatgaaatgtctgtatttagctatttaactttgttctgggttctctctgcttacttaatgtgactgcatttccctgagatgaatgctgtgggtttttgcagtctctccccaactttgcccctcccctcttagatgaaggtgcatcactagagaacctgcaccactgtgtctcctacactgtgtcaggtagacagtacatgattagtaatgtgtgtgcaaagctttcatgaatgcttttaagaagttgaactcttaatattttgcttaatttccacatgtttaggataggattaatgtagagttgaaattaagatagcatcttgggaattttagataggaatcgtttgtgacccaaagtgaataaaaattgatattacaagcaggcttttaatccagaaaatttacttattctgtccagactgtgaacagttgttttgttctcaccaaaggcaattttggtgaagtgttcttagaaacagtgtgtacaggcttctgtaattgtacaggggagagatcatagagatccagggaacatcaagatactaattcaacctgtcctctttgaaaaatttgaccccctcccctgtaactcaacaacccctcaaagctgtcgatgcaaagttgcaaaataacaaaggcttctgtattaatttctgtgttacagccttctgggaagagaatgctgggagaaaaaatatttctaaatgtataattgcatatatacactttttaggttctccttgtatttttaatgacctaatactagaacattttgataagtttagttcttaaacagaactaccaaacacaaaagccagctggaggcagcaaatgactaggtggatgttgaagctcatgacttcctttcagtggcctcttctttgtatacagctccatgtttatgtccagatggactgactatattgataggttccagataaacaatggacacattagaagaggggtgttatcatcaaaaactaacaactgaagagttaaaatatgaaacatatctttgtcatgtaggattgaaaactatcatattttattgaatcaaatttatggcatgtttctcgtaaacctaaattttataatcctgtctgttaagttggttggcaaagcccaaatgttttcccttacattcctgaaacaaatttataaagtcaaagaatcagccatatcatagcaaatttagagtgccgtttgataatgaacgacctagtaggtcattaatcttttctatgggcagtgttttttttcctcatcagctgcctaaagtatttgggaaattgtatcttgtgggagttgccattcatcaggaaatgcttgttcatagatctaagccagaccacatgtagcagtaaatgttatttatcactatggaaaccaaaaatcacaaatgggatagtctaagtgttaagcattctgcttcctatggcagtaagtcatacccaaatttggttcacttcactcaaatatttgtgaggcacttaacgattaaagggtttgtaggtactttgtttaatgaataaatttctcctacacaaagctgaaaacatcataaagggaaaaactaggaggaagagttgccagtttatgtggcttatcaagctcataattgtagacccct

SEQ ID NO: 54941 - DNA, 1398 bp, Homo sapiens
tattgcaataatctgaattgtagatgttgaattgactcgtagccaaaaggtggcatttaaggagtataattgctgttcatagataaaagtaagaataatgacttaagcagtaatccaaaaatgttaagaagttggtggaagaagaggctggctgaattgatgagtgagaatgtttattcataaattcatttaattcttagttctactgagactttaccatgattgtcattgcagtagttcctatacagtgggaatatgttcctataatgggaatttgaatcattcagtgttgctgatctggttgtatctggacgaggcaacttctcttacctgttgtctcattatttagtggggggaatatctatcccatccttacttctcaagaataatatgaggataaaaaaaacctgtataaagctacaaaccaatattattttgtacaggttaagtagcccggtagaatcttttggaattgattgaaaatacaaatgcctttttgacaggcattgctgttggattttttttaacatgggagaagtttactagatttcaaattttaaaatatgcatgggattgaaagttagaagctctgaaacatttaactatctggtctttacaaaatatcataataggtgtccattaaatgttcttcattcactcattcatttattttatagtttttgatcatttgctgaatgccaagcagtgttttagaagctagattatacagttgtgaatataacaaaatccttatccttatgaagaccatatagtagatgagtctgataagcatgtgtttcatggatatctattagatatcctttaataagtgctaataacaaaattaagcaagataaagagatagggcaatgagagaagggggtgttacatggtcagagaaagcctttcatatacaacagtgtaacttccacctcttttaaggtcttctttatttctatatgttgtcatctgacactgtacccaacacatagaaggtgcttattaaatgtttaaatgaaatttttatttatttaacaaacacttatagaggacttactctatgccaagcagtgttctaagtgccttgcaaatattattttatttgattttcacaagaacgctttgtatactgtttcattttatgaggaaactgaggcaccaggatgttgaggaacttccgcaaggtcacagctaataatgaatgaatcagtttgtaaaggaatttaaaaaataaagattcttaaaggttcttagtgccacctcttgctttcaggaacaccagatagggtgggactccatattttgggatcatgttgggtagggagcatgtcagcccctgaggtccttttgaaaagctcctaatacctctacctcccaggccaggcagataccactctt

SEQ ID NO: 54942 - DNA, 1133 bp, Homo sapiens
gaagcaaggggagctatggtgtaaggaaggaaggaagtgtttatagtaataaggcaagtggaagggagaacctaagggggctcaagacatgaatggcctgaaaaggcatgatcatgccttttcttaggcatgaattgtgatttccatccattaacctggaacagcctcactgaacttcatttttagcttctgtttttcatttccaaattcatagttgagtggtcattggcctgatgacccttggcccagaacagcaaggccatgctgagggtgcccctggctatgaagtaagagatggagttggccctgttaactttaactctgcgagctgttcatgagtcttcatctggaagcagtttatccatatccactgccttggtgatggagtagtgcactgggaggggctgggactcctgaggccctgctcagcagagcagctgccagagagaggaagataaggcctcactgccatcagagttaggaccaggacctatgtttctggttgtatgctgcctacggagcttttggatgcactctgggacaggagactagaaactttggcagttgtttgagaaacaagttcctgtagaacagtagctatggctatttagcatatgtttgttaggtccccttatgtgctaagccctgtgctgtgccccaggaacacaaaggtgaataaggtagagatatccctgctgtcatggtaatttatttcttgcttcctaccattcatttgtttcattagctttgctgtttaagtactacgtgctgtgcactggactggctattggaattttaaaaattaatatgagtctactcaagggtaagcagataaattataatacctttatatttactctgtgagatacactgcaggcgctgtgagtccacagatggtaaatgctgtgggagataatgaatgcagaaaagggctcatcccctgccctcagggaggttatagtccatctaggagaagaaaaccacagtacctccagaagcatatcccgctatttaaatttttcactgtttcattatttgtatgtcaaactccaagtgtttttgtattcccagcagagttctggcgccaaagtgctaataaatgttgattgaattaatggataaataactgtgta

SEQ ID NO: 54943 - DNA, 1064 bp, Homo sapiens
tatacaatactgttaaccaatctagaaaccttatgcaagttttgccagttttcctactaatgtcctttttctagtccaggatccaattcagaatcccacatagtacttagtctcctccaagccatgatgatagttcctcattctttttttgttttttattttttttagagacggagtcttgctgtgtcatcactctggagtgcagtggggcgatttcggcacactgcaagctccgcctcccgggttcacaccattctgctgcctcagcttcctgagtagctgggactgcaggcgcccaccaccatgcccagctaatttttgtatttttagtatagacggggtttcaccgtgttagccaggatggtctcgatctcgtgaccttgtgatccgcccgcctcagcctcccaaagggctgggattacaggcgtgagccaccgcgcctggcctcagtttttgtctttcataacatcaacactttggaagcatactggccagttactttgtaccttgtctatccatttgggttttctggtattttctcatgattagattggggttatgcatttttggcaagagtaccacataagttatgtgttcttccaagttcgtcatatcaagatgcacgtgatgctgatatgttttattactggtggtgataactgtgatctgttagtaaggatgatgtctgccactccattatagaattattgttttctcttttgtaataaatatcttgtggagagatactttgagactatgcagatatcctgtttctcatacttttgctcactacttttagtgtttatcagtgtcttgtgcctgcaacagttattgctgtaatgtttgcctaacagtgatttttgtctttccatcatttcctctacatatattatttggaattctgctttaagaaagagctgtcaaggtgcattcatttttagtaataatgataaccacaataatgttgattataattataatggtacccaacattgttattatgacttgctttgtgcctggcacagtgctgagttcttggtttcacttttataacaccttcttaa

SEQ ID NO: 54944 - DNA, 1223 bp, Homo sapiens
tacctgataactctcattagagcaatatatgctggaagcagagggctcttgttatggactaagtgtttatgtcccccacaaagtgttgaaatcctaaccccagtgtaatggtattaggaggtagggcctttggaaagtaattagggcatgagggctctgccctcatggatgggattcatgctgttataaaagggaccccagagagttctcctgcccttttctcaccatgtgaggatagacagggaagtcagctgtctgcaatctggaagaaggccctcaccaaactcggctgtgttggtaccctgatcttagatttccagattccagaactgtgaggaataaatgtttgtcatttaaggcacccagcctgtgtaatctgtaatagcagttcagactaagacagccccatattactcactctccatctgagagtgagccgagcacatagcattcttggcatcagtagcacaagggtatgaagggaaatgcttgaagataactggaatgtatagtagaaatgtgattcctgtttatctctgagtgttaactttcagaacataggaaattgagatgctcccttaaacattcttttagatagcaatttagggaggcaagctgaacttaaatcttttaggaaattggacagagtcatagcccattgggtttagaggtagtataagaaaggttgctgacattatttggctaaagtgaatggagaacagagtaaaccaagaagatagtgttcatgtacatcatcagcacaatactgagtaagctgaaatatagaaaaataatgtatgcttactattattggaatgtgagtgacataagtaaatttcataaagggaatataagtcaccactcaaatagttgtttctttcctttccttaagatacaagtgttccatatcttacgggtgagtacaatattggctgatgtgatacggaaaattctgtcaagttcggagacagccatagtgttgaaagttctgagtgctttcaacactatcaaatagtgctcatattctttcattgtcagattccatgacccaagtgtgtctgtaggtgaaggtctcccacccccaccccacccactgatcactcagtaagcaagcaggctgatgtctcagtgcctacagtgagcagtgttaactgactcctgtacttgcttgtctgaggacagacaggtgtgctagataattaacattttttggaaacaaaatt

SEQ ID NO: 54945 - DNA, 1398 bp, Homo sapiens
aacctggaaggagttgaaattgctaaccttactcttaactgcaccattgcccagtccccagctgtcctcacctctgccccaccctttcattgccactgtctccttcatacttccctttccacctgacctgtccctgccaactccattctttcatgcctgcctctctgtatctggagggaatcctttggtgcccaagcagggttagattaccagatacgcagactaaacatgtgtttggggcaccagaaaagcagacaccgtgctcaaatattttttttaaaaaataatttgatatttgctgcttaaagaaataaagccgtgatcatgagaaaaagcagaccttagctggactttcttatacttattttatggtttattatttaaatttgatttctgtttggaggaacgctataatctttgcagtacgtcgtgcctctgaaggcttcgtcttcttcctcctcctaaacttgttgaactcagcctttccaccgaagcctcacagaggtagggagatgctgctttgctctacccttttctctgtactggcctcatgtgtgctgcttttagtatagtaacacatttctctatagcactttctaggtgagcatctccatgctgggggctaggccctggggcagaagtaggccagggagagaggcacaaggtgtgagacacactcttcctcctccagagtttataattgaaacatatgttttctccacaacaattaaatgccagaaatggccatacctatttgaaggcgtgcagaccagtctctggaagatgctcctgcagcagggaccttgaagagaagatggaggaaagtttaaccgtattaacaaagtgtgcatatctgaatagcctgctactttatttctaagccctaaatcccatgattgtggactgttggctgtttcccattttcagagctgccccaaaccagtttctcccagactcaggcattctctctgtgtcttcatatctcttctgaactgacttttgtcctttgagcctgccctctctgataagctgccgtagccactgagaagaatgaccaagttgagtccctgagcccacagaataataaaaggatgttttctttttctttttttctttttttttttttgagactgagtctcgctctgtcgccctggctggagtgcggtgacaccatcttggctcactgcaagctccgcctcctaggtccacgccattctcctgcctcagcctcccgagtagctgggactacagggcccggctaattttttgtatttttagtagagatgggttttcaccatgtttagccaggatggtcttgatctcctgacctcgtgatccacccgcctcagcctcccaaagtgctgggattacaggcgtgagccaccgtgcccagccaat

SEQ ID NO: 54946 - DNA, 1047 bp, Homo sapiens
acttccccctactcaggattcaagccagttctgtccaaggacaaaccagagagggcctaaagaattaaagtgggtggggcaggatgaaaacactaatagtagagagagctttctgagctatctggaaggatcgtcctcaccctctcccaatacttctgtcaaagttaaaaacatttcccccttagtttggctccttcgggaatccccaggcccagttgcagttttcattgcagctgtaagtgaccatctgaccactggtgaattcaagaaagttggaccttcaggctctttttggagttaatggagcatcctgtagtttaacagatgtgaaactgtttttagagatatcagctgcctgctggtctggttcctgggctgtgccttttcggttcagcccaggggaaagggaggaaggaaataaaatgaaatgagttcattcacttttcttccttaaaaggactgcaggaatacaggaggacaggggcatctgaactcagtgaattaacttgttcttctgtctgctccaggttatttcctttggttcttgctgacatgctttacctggagctctattggccactcctgcactgcacaggtattaggaccagactctgtaaggctgcagggagggatgtaaacaccttagcatccagagtcatgacttagtagaaaacacgtcagttttattatgagacctaagtttgagtcccagtgccactactattaattagctgggtaatattgggcaatcttggagttgaactttttgaacagttttttccctaacttgaagttggtaataacatttactttacaggattgttgaatggttgtgaggatgaattaaaatgttgaccgcgttaaagtcattttgtaagccatccagtatccttgctgttatagttctatgcacagctgattttttagttgcaggcaaacgaatttttacatggaagtacttgattttggaggttttaaataacccttttataaaggattgatagtttaaaatagttggttgtaaaaatgaaaaggaacttggaaaga

SEQ ID NO: 54947 - DNA, 1046 bp, Homo sapiens
ccaagcttacctttgtctttgttttcctgtagagtgcttaattatgagtcaaactacatgcaggtggtctatccgaatgagttagcatcagaatgacctgttaaaaagagttctaatatgttgcccagctggacattgaaaaatgcctgttagagttgttgatcattttgactttggtataattaatagtgaccttttctcactgccagtatttggttcaggttgggtgccttctgagcacccttctggaatgctgtacagttgtgagtgattcattctgttaacaaatctttattaagtgcctaatctgtgctgtgccctgaggatacgcagataaaagaaactgtcctcccattaggtggaggcattgaaacccaagtggaggaagacagggagacagaactgacagttctgcaagtatcatgagcagccattgtctgactttgcattcatttctggtcttactggctagaatctcctaataaactaccaagtaatccttttaactgaataagctacctatccaaggattagaatttgtatctgagtgtttttctctcatactaactttgagaactttttgagggttagtgaggtaagcaccagagcaagatactcaggttcttttccagcaatctgtaccaaaccaggaataaggactgacaggctcccagctgtctgtcaccagagcagatatttatgggtttatgatcagaggttcttttggtcccaaaaagtaactggaaaagaatgtggcaacttcctgggaccatggaaagctgcttgggtgtcagggatatgctatgccaggtatatgctagaagaaatactattaaatgtcagtaaacttaaaaggaaaatggtcaagtttaatctaagatgtccattttgcagatggaaagaagcagggaatttaaaaatgcaagcaaagctcccattacaaatcctactaactgtctcataaactggatgaagttaggcgataaagttgaaccaaattcttcactcagtttgggatgactttctctggagcctttattaaggtc

SEQ ID NO: 54948 - DNA, 4195 bp, Homo sapiens
taggacctgaatgagaaaactttagttaggagcaggcatagggtttttctcatttactcttttcatttgcatctctagaataatgtcttttgtcttcttgttttctaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagccaccaaccaagaccaagatgggcggacaacaaacgacatttcctttgggacatctgctgtgacacctgacatacctctcagagccacatatcctcgcacagatttcgcacttccaaatcaggaggcaaagaaagagaagaaagatccaacaggtcgaaaaacaaacttggattttcagcaatatgtatttattaatcaaatgtgttaccatctggcccttccgtggtattctaagtactttccatacctagctcttatacatactattattctcatggtcagtagcaacttttggttcaaatatcccaaaacatgctcaaaagtagaacattttgtttcaatattaggaaagtgctttgaatccccttggacgacaaaagcgttgtctgagacagcatgcgaagactcagaggaaaacaagcagagaataacaggtgcccagactctaccaaagcatgtttctaccagcagtgatgaagggagccccagtgccagtacaccaatgatcaataaaactggctttaaattttcagctgagaagcctgtgattgaagttcccagcatgacaatcctggataaaaaggatggagagcaggccaaagccctgtttgagaaagtgaggaagttccgtgcccatgtggaagatagtgacttgatctataaactctatgtggtccaaacagttatcaaaacagccaagttcatttttattctctgctatacagcgaactttgtcaacgcaatcagctttgaacacgtctgcaagcccaaagttgagcatctgattggttatgaggtatttgagtgcacccacaatatggcttacatgttgaaaaagcttctcatcagttacatatccattatttgtgtttatggctttatctgcctctacactctcttctggttattcaggatacctttgaaggaatattctttcgaaaaagtcagagaagagagcagttttagtgacattccagatgtcaaaaacgattttgcgttccttcttcacatggtagaccagtatgaccagctatattccaagcgttttggtgtgttcttgtcagaagttagtgaaaataaacttagggaaattagtttgaaccatgagtggacatttgaaaaactcaggcagcacatttcacgcaacgcccaggacaagcaggagttgcatctgttcatgctgtcgggggtgcccgatgctgtctttgacctcacagacctggatgtgctaaagcttgaactaattccagaagctaaaattcctgctaagatttctcaaatgactaacctccaagagctccacctctgccactgccctgcaaaagttgaacagactgcttttagctttcttcgcgatcacttgagatgccttcacgtgaagttcactgatgtggctgaaattcctgcctgggtgtatttgctcaaaaaccttcgagagttgtacttaataggcaatttgaactctgaaaacaataagatgataggacttgaatctctccgagagttgcggcaccttaagattctccacgtgaagagcaatttgaccaaagttccctccaacattacagatgtggctccacatcttacaaagttagtcattcataatgacggcactaaactcttggtactgaacagccttaagaaaatgatgaatgtcgctgagctggaactccagaactgtgagctagagagaatcccacatgctattttcagcctctctaatttacaggaactggatttaaagtccaataacattcgcacaattgaggaaatcatcagtttccagcatttaaaacgactgacttgtttaaaattatggcataacaaaattgttactattcctccctctattacccatgtcaaaaacttggagtcactttatttctctaacaacaagctcgaatccttaccagtggcagtatttagtttacagaaactcagatgcttagatgtgagctacaacaacatttcaatgattccaatagaaataggattgcttcagaacctgcagcatttgcatatcactgggaacaaagtggacattctgccaaaacaattgtttaaatgcataaagttgaggactttgaatctgggacagaactgcatcacctcactcccagagaaagttggtcagctctcccagctcactcagctggagctgaaggggaactgcttggaccgcctgccagcccagctgggccagtgtcggatgctcaagaaaagcgggcttgttgtggaagatcacctttttgataccctgccactcgaagtcaaagaggcattgaatcaagacataaatattccctttgcaaatgggatttaaactaagataatatatgcacagtgatgtgcaggaacaacttcctagattgcaagtgctcacgtacaagttattacaagataatgcattttaggagtagatacatcttttaaaataaaacagagaggatgcatagaaggctgatagaagacataactgaatgttcaatgtttgtagggttttaagtcattcatttccaaatcatttttttttttcttttggggaaagggaaggaaaaattataatcactaatcttggttctttttaaattgtttgtaacttggatgctgccgctactgaatgtttacaaattgcttgcctgctaaagtaaatgattaaattgacattttcttactatatcaccttttttgaggggtcttaatttactttgcttaattggtgcaatattgctttaactccgttcactaaagacaaacacatcaagtccaaacttgtaaatttagatttgctgaaatactgatttatttcctgttttaatttaaagtgcctcaagtaagcacctctcacaacagttgactggtactgctgctcctgagcacctcgtgtcatagattttatactcttacagacttggaatgcagtagaggtatgtggatttttaggggttttgtttttttaagaataagtaacaagaaataacacatttcttaataatagcttttttgacatagtttggagttctgattatatggtacatttttctaccagtaatatagggttgccaataaatagaaaatgttttctaaaaataaattttattacaacaaaataaaaattttaatgacttattaacacaacctccagtatcaccaccatttggaagataacacagaatcacaagtatcatttaatttcttgcccttttcagtgttgttctggtgttggtgggaaaataataggaaatgtagttcattgggtagggaaactcttacctttccctatcttaatgacaagctgtattttctgtgtttttgtgcagctaggcgtcatagccagacaaatcctaggagaatacactttttagataatgatttccttcattatctaactgaccagtatctaatcaatctcagaaaaatccaaaaaattccctgccacctgtttagatattagttggcagatgtttcataggccttctacaggactcttcaagagaatagaacagtttggcactctgacaaagtagtgtcctctcgctacaaaactggactcacttaaacactggacttttgtcacttctaagcacagcttgaaggattttgctgataatgggcaaagatggactcatatctttgctttcctccccagaactgaactctgggagtcctggtctgtggccaatggaggtgaatctttgcctgccatagagcctgtgaatgctctgagaagtattatcacaaatagaaaaggctgcatcccctgtagctgagtcaggaattgacgctggctctggcaccctggccattccttctcctcctcaaaggcttgag

SEQ ID NO: 54949 - DNA, 1120 bp, Homo sapiens
agcaagaccttgcctcaaacaaacaaaaagtgtacaaaatctgtgtaaatgaataatggcaggggtggagtgaacttaaagaagagcttcagggaagttttgtagttgtaaacggtcctgaacatttcccttccaccagccttgtagggcactgttctccctgcttggtaatgccaccacctgaaattagcacagtatttttagaaggatgccactccatcttagttgtgagataaggagtccagatcttaggatctttgcttttaggactggaaaacttgtcttcccttttttaaacaaaacaaaacaaaacaccttattgaagtataattggcatatagaaggccctacatctgtaaggcctttacatatgtaccttaaatatggtagcaaactacatctcaatgagctgcctttcttaaaacaagtgtatgttgtttttgaagggcaggggtggcaggatgccacagttcactttgcttttcagagaagagccattctgtaggaaccacaatctatgagataatccctaagtttggccactggcagccctgcccataggctcctgtttcctaaacactacttggggttcagtcacttagaactggttggtgttagatgccttcaaacagtatcaaggggtacctcttttacccaaatttctgttgactatcagcccttactaatttccttgaactctgaaaagttcacggtcagttggtttaaatgtcacattccataccactgtttgcaaataggaatactcagagagttcctgagaaatgctgactcatgcaacagactttaaatatactgggttttgacacctcaacaacagaaaaagagttgtgggcccaaatagactgtcaacctatgtgtcctcgtgaatttatgttggcatcgcatggaccagacatgggagaaaaacaagttagtatgtataagctttggcttaatattttcatatctttctacgaagtccgttgagcaccaatctgaagaagagtatttaaagtctgtttttaaatatgccatgtctgggtgagtctctcaaagtctgaaagaacttggtttccttgtggctgtttaattttttctcactagcagttagttggcgtga

SEQ ID NO: 54950 - DNA, 1035 bp, Homo sapiens
ctactaaaaatacaaaaaaaattagccgggcatgatggcaggcgcctgtagtcccagctacttgggaggctgaggcaggagaatcgctggaacctgggaggttcaagtgaaggtgagaaagagaaatcaagaatgtcaactagatttatgttttgatcaacacataccaggtgacaccatttcctgagaggtaaaacagcaacaacaaaaataacaacttgtatttcagacaaatagaaaattatgaagaataacttaacttctaaaacattcatttgtatgtatgctgatgcaaatttcatttagaatctgacgttaaaatgaagagagaagggcaaatgcatctaagactttagaatatttttggtaataatgtgttaggtaagaaaagaatatctggataagcgatgtaactactctggcaaatgatgttttacattataatgcaagttaaatagactattttgcctatgcctggaattttccagtggaggtagatgatttcttagaacagggatgagtggaaagttagggtatttctgaagacccactagtgaaatagcagtgtttctccctcagagattgttccctttttgattcctatgactaattctgtcatttgcaggagtttaagaaaaagttacattttttttccagctatgtctctaacacatttttctggcactgtttataagctcaaatttccagttgaaaggatggttaagattgaattactcttcaaattcctttttcctttcacagttgtttttccttgacgaagtctctttgtcactatcaaggttaagtgaagtcactattgaaggaaagaacagaaggaatttggaatgcttttccattaacttctgaaccacagtgacttattccttgagaatctccagtaaggcttagggtctttcggataagtcattttggagaaatgttttcttcttttgctgttaggttgacatggcaaaagaaataatattatttgtgttaacctttgtcctagtatgttattgctcaaagcaaggttgt

SEQ ID NO: 54951 - DNA, 1020 bp, Homo sapiens
atcacgccactgcactctccagcctgggcgacagagtgagacccagtctcaaaaaaaaaaaaaaaaaaaaaaaaaaaaaaaggacaagtctgtcaacaaacctggacagccttttgtcccaaaacattgtctgctttgtgagcccaacaggctttgtctcaggccattatatgttcttggagcccattaaattcccctaaaaatcatttactaacccccttacatcactcatacttccccatctccctttcttctaagaagaaaggcataaaaacatctagaccccaattcacggagaaagaggggataatatctgggattttcctccatgcactttaataaatttatatgctttcctcctattaatctgccttttgtcagctgattttcagcaaacctttagggggcaaaagggaagttttcctttggctgctacacagctctgaactgatgaggaagagctactgcgtgtaagagtctggctacgagccaggtgccttccatcctacatctcagttcaattccacaataaaatggaaaggcaggtattactgaactcattttacctataaagaacctgagaagcgaagtgacttgccccagctcattggcaagcagcagagctaagacaggaagccaggttttccgagtataaaacccaagcagagtcactatgctgtactgagacctcctattactgattatgaaccaaggtaattttatcctacttgataactcagatgtcacctcctcctgaattagtcacttttatatgctcctcttgtctctcttcttttctattttctccaagaactgagctgtgggacgcttaccctcatgatattcccttactttgagataactgcgattctctcacttaatggcaaggaaaaaaatacttggaatgtggcccctgaaaggtaatgttaaacattttatatacattgcaatcttgtttagtctttatacaaactcataacagaagtattatagatctattttaaaagtggggaaactgaa

SEQ ID NO: 54952 - DNA, 1153 bp, Homo sapiens
ctcagttttgcagataattgggttaatgtcattttaaaaattgtgcttgttttttactggatcggcatataattttgaattattgctaatatcacactaattcctttttgttaaatgtgtcttcatagattacacacactccgcctgcaggaatacttatcagggctttaatggtaagtatcctctttcagcttttctcttcatgcgcataaaaatatagtatcaatgtaaaaggccagttctacctatttcagtccttgttttggttcttgatatatcatttatgtgttaatattgtcttactatatatagtatttgaattggggaatgtgctatcagaaaatgttaggggttattcacattagtttgattttttttttggtccattttgtttgaattatgattattttaatgtgttccaaagggcctaactacattctgagtgatgaatcacaagacactggctgagttattttggttgaattagaggctttggtattgagtaatgtagactaagtggattattggcttggttctatatagcttgtattgtaatgcattttgaccttgtttttgaggtcattttcttcagtgtgtccaaatgtgttagtatataaagagctgtctagaggagcacatgaagaagcttgattgtttattgacatgagcatgacattagacttgtgactatagaactagatagaatcatgagaggtatgtagaatacaattggatgtcattttgatagttattagagttagggccctgccacacaagataataatacaaaaaaagaacacagaacaattaatgcaggttaaaaaacatatgaaggacttgaggcattaaatatcatgattgccagagaaatgtaaaatccaactttcgtacagaatagaatatattcacaaagtaaaactgaagcaaatgtatactaaagactatgccatttatgggaataattactgaacagttaatttttatttcattatctttaaagattaagataaactttggatttcatgtgggctaaaaaggcttaacatatagggagttagtactgaagaatgtatttgtgagctggaaattgaaaattaccaaaggaagtttaatttgcatccacatgtaagttatattgaaaactggaaaatta

SEQ ID NO: 54953 - DNA, 2341 bp, Homo sapiens
agctttttcttaataattaaaaaaaatcttttctaatgtggggtgctatgtaaattagcaaagcagtctaactagaatggattttactgaaccagtctaacatttactttccaagaaacattcaggacatattcctttaattctaattttaaaggaagagcatattgcaataataaaaatatttttaaaattatgttcaggttatttattgacaggtactacttacaccaaagcacttgtgctctaggctagaagcattgtattaaagccatgaatactatacctttgactagtcgagattgtatttatattttcctgttactactgtataaagcttaaacctacttaaacaactacaagctttaaggttgaccatatttcaggagaaggggtgtctactttttgaggcacaaaggttcctgctgaatataagtaaaactagttagtagacatgtgaaacagtcatccttctgcataaattgaaggatccggattccttaatgatggactgaatgatgcttactttccttctttctgcttccagtgtaccactatggtttatagtaaagaaaaattaagaaagtgaacagttgcaactattttgcttatgtgatagatgttttgaaaaatgtagttggaaataggaataatttttatatggttactaggattcagaagtaaatctatttagtgatctgtaaataattgaagtaatgtaacacttaatgttttaatatgtcagttattgcccttttatattgtgaatgtaatgtgcataagctatatccgtagatgttattgttttatctcatgtgtaattgtgggcctttataaaattgtgttgtaagatatcaagcaacttttgtaatccatgctttgggtttgtgagaaggaagatgatttatttcttctgttaactctcttaaaacctcgaggagactgtgtgctcccttttttagggtagttttatgtgataatttcctgaaggaaataattttgcaaataattgaatatattataagatgtattctttctcatctgccttgaaaattcatatgcagagggtatatgttggtgatcttttatgttttatctgtttatccttctagatttgttagattttctagtctacaagtaaaaagtgattgaggattgattaattgaccttggctgaagtttggcagattgttaaatttttataaccagagataattccccaaattttgactcctacagacacaatgaagcagtttgtgatatagattattgggagtgcaaaaggatctctctgtgtcacaaataacctacatctaagtagacttcaatttgtgtccctattgaaagccaaaatattgtaaatgttttgtaatttttaatattagggatagattcaaaaaagtttgaatagtttgtgaactttagcaaatgaccttttccaagactagggctgggcttaaataatgacagacaaatcttttcttcttcataaaatagaaaagctgctaagaagcagattttaaagctaagttttactaaactcaattcatatttataatctgactcagatagctttctatctggtctcacgttgaactgcccagccctaatcaaatgtgaacaaaagtagaactgtgcaaaccagtatggtataaatgaattttagttgataaatgtcatctgataatttgtcttttgaattgtctaacattagtaagcttacttttgttttttccctcactgtgcaacttttccaggtttggaccttatgagtcttacgactccaggtcttctctgggtgggcgagatctgtacagatctggctatggttttaatgaacccgaacaaagccgcttcggaggtagttatggtggtcgatttgagagctcctaccggaatagccttgactctttcggaggtagaaaccagggcgggtctagctgggaagcaccttactcccgttcaaaattgaggcctgggtttatggaggacagaggaagagagaattactcttcctacagcagtttttcttcaccccatatgaagcctgcacctgtaggctctcgggggagaggaacgcctgcttatcctgaaagtacgtttggaagcagaaactatgatgcttttggaggaccatcaacaggcagaggccgaggccgaggagtaagtacaacagaatcttttcagattcttttcactagtcactcttttaaaccctttcaagaccatcgttttcaactagaataaacactgttcatcccggtgtattttgaagcaaaagctgagtcataaacataatttttaggttgactgtaaaagtttttctagcacctcagaaaataag

SEQ ID NO: 54954 - DNA, 2019 bp, Homo sapiens
agattgtacaatgatttgtggtcagtgtaattttgctaactcacgcttacaatatgtccagttgctggttgttttattttccctcgtgttactagttttactcttgagaaataatttccacctgtacagatatgtttatggtttcttcttaggaagtaatattttgtaaattattgcttaaatgagtaaatatactagtccacagttgtttaagtttagggtacatagtgtaaacattatgctttatgttcttaggtcacttgattgacatgaaaatttacctagtaagtgtatgcagattgtggggttattatatagtttgatcatttaaagagtattgtatttttgttataatgtaagaatccttttaagtcagctgctcttaatattttatttgcagaggaaagtatttctagtaaaaaaggtagtagggtacacgtttttgactggttattagcttttgatatgtcagtgtagcttgttatacttgtgtagaaattttgcatttttaacagttactctttacttatgtaaaaatgcattgcacctttaatgcgtaattaaggaagattttcctgttgtgactttttaaattacctggaaacacaactaggttagataggcattcctgagcatagtatacaaatgtaagcaactgatacattacagttccactatacttcatgatcataggttaattgaaaatagttgggatgataggctttgggttttgaattgaaaatccattctagtttgaaaatttggaaaacacttaatattttccatgctgtatattattttagacaaagtgtgttttcttaatgaggcttcaaaagtaaatttcgttttcataataaacaagtattcctgtactttgtatttaccattctagtctgaatggacttttctttctttcctcctgttagtgaagtagatgagccaataggacctacattttaaatcttcacttgtacaattccccttgggtccttctcttcagattactcctccatctttatcttctaaaagtaagattagcagaataaatttctgtggacatgtggcctcttggtgtagtagatttggataatgacaagagaagaggaagggacacaaagagtcgtttggttgcatgactcttcatctgtaaacttttgtttcttgggcttctgggtcagaaaatgtttctctaggtaagaatgtgaatggaacgtcagatgcaattctttatctgaagtgtgtcttggaagttgatgcatggttatgctttaactctcctatttcatactaatgttccatctcgccttctcattccctttttcaacagggagaatactaaatgatttctggatcttttttacttcaaactacaaatatggtcttctttgtgtatcttagttttagtaaaataaagatttcttttagggtcttttcatgggaaaacatcaattaggaactctgaagaggagttgtcagagagttgtacaagtggtaacatttggacaggcacatatgttgtctataatctcaagtaattttgaaatgtaaaagtaaaaacatagttagcaaatattcattatttgttctactggaaataaaaatactaattcaatggatttgagtttatgtaataatttacagagtttttcaatgtgttttttcagaatggacatgtaaaatttagttacattccagggaattttcaggtgaaaattagtagatagttaacatgaaaattttatatgaattcatattttttcttggacaatatgctaatatttattgatttcacaaatttacagcatatgggtgattttggaagcattcatagacccggaattgttgttgactatcaaaacaaatccaccaatgtgacagttgctgctgcaagaggaataaagagaaaaatgatgcagccatttaataagcccagtggaacctttatcaagaaacccaaactagcaaaacctatggagaagataagcctcagcaaatcacccagtaagtaagaaaacataa

SEQ ID NO: 54955 - DNA, 1456 bp, Homo sapiens
gaaactttctgagagctcctacaatatgaacatgagttcttgcatccagggctctgcagtgtttactggacttccattttcatgctcggtcaggttactttagtgtttttcccaaagtatgtgatgcccaagatgattttaggtgataaggatattattgcttagaataaggataggacaaatgagcacatttaaagaaaaatatgtagcaaataatcacatagatgacaagcagatatgacagaattcatgatgatggtattcaaatgaatgaagttcatttagtgaagtttcagaaatactggatagtctcaaactccgatttttttggtgagttcaattttagattacaatcactaagtatacctcataagtatgtactttacgaactgatgattggaaagagagaatggaaaaatgaattttagcttttacttttttgtgtaatatcctagcaaaaactgatcctaaaaatgaagaggaagaaaagcggcgaattgaggctcggcgagagaaacaaaggcgcagaagagaaaaaaacagtgagaaatacggagatggatacaggtttgtacttagagtcagaaaattaggttcattaaaaaatgatttcctagaaaaagccaacacatcaattgtaatattaaaaagttcttaagattcaaatgaaaagacttgttcaaagatacagaggaatgcttttggtttttgatatttatatgtaatcactacttagaaaacataagaaaaaaggcattctattcatattggcaatccaaaagatatcaaatattcagaaataacagtattcttaaaaagaaacacttgtcattgagatttgactgtatggagtcatagtgattttcatgggcaggaattaaatattacaaatatgtaagttctttccaatccagatcccaaaggaaattctgaagaagagtaaatgagtaggtactggcttttatagataatcaatcattaaaaagctataatagttaaaaatatgtggtaatacacaaagctaattattataccagattagcctgtgaacagactgtaaggaagaatgtaatatttaataaagaggatattagaaataagaggggaattgggctaggcacagtggctcatgcctgtaatcccagcactttgggaggccgaggcgggcagatcacgaggtcaggagatcaagaccatcctggctaacacggtgaaaccccgtctctactaaaaaaatacaaaaaaaaattagccaggtgtggtgggtgcctgtagtcccagctactcgggaggctgaggcgggacgatggcgtgaacccgggagtcggagcttgcagtgagatgagattgagccactgcactccagcctgggcaacagagcgagactctgtctcaaaaaaaaaaagaggggaattggttgaacaatgaaataacaacaaaaatcagtttagagcct

SEQ ID NO: 54956 - DNA, 1050 bp, Homo sapiens
ttttatcacccaagaattccacaggagtgaattatgattgtctggtggtgtgccaccttgctttattgatactaccattggtttagaagcttgaggatggaacaacatgtaaaataagttgcagaactttggaacttgatacttcttgaggtttgttttgcctttttaattggtccaggcttgaagtggataacttatagatcccctgattcaatttttcctacccggaagctccaaggtgggctagaaatgcaaagtggtatatgggtactgtccaaatatgtacttaaatactgttttttttggatttaagctaagtttaattcagtcataaagaggaagaaaggaaatcatttatgttggtaaaattagtttcaatgttatattcttatgaactctttatagttgaataaagtaatatttaaaggaaaacttttttttctcttacagaatggcatttacatgttcattttgtaaatttcgaacatttgaagaaaaagatattgaactgcatctggaaagttcttcacatcaggaaacattagatcatatacagaaacaaactaaatttgataaagtagttatggagtttttgcatgtgagtagctgtttttgaagtgagaagcattttattgatatgaatttcttatgatttcatttttcactctccccatctctcacatttatgtttctaaaattttaatttactatttaaagaaagagttgttttaaaattaactcagaattacttgtgaattcctctataatagaatttgtatttgttatttcagaaattattacatttttcacagtttctgcgggaggtgtcctttaacaactgtattgatgtggagtcagctatcatccattaactggagttgtgctggttacattcattcgttatttcagttgagccctgtaacaattcatttttatcatgaaagattatgctcagagcagttaaatgactgttaagtgacaatgccaggaattcagaaataatgtaggagtttagcaaagggaaagacagttgggaatgttaaggaatgc

SEQ ID NO: 54957 - DNA, 1012 bp, Homo sapiens
aatacccacctactctggaagacctcttaaatattctagctccctttgatccctttctctatatgcttaaaatatactttgaaaaatgaataatttttgtaggttcctaatattttatgattatcttttcaattaaattataaactccttgagaaaagatgttaattcttatgtagcagatactgtatcttccatagaatgaacatagtgctaagcattatacttgagtgctcattgaaagctatttagattctttctattttgttttctaggagtgtatggtgaataaattcaagaaaacatctattcgtaagcaacagacaaataatcaaacagaagtagttaaaataattgaaaaagatgttatggaaggtaagtatttaaaacaaattattttaaaattctacatgtatttttatatatcataacctgtttaaatgtaaatgatagccactagagtgatatagtacagtcatatatacagtagctctgagtgagttaccagaaatgaacttctttgtcttcctgttctaatgcttacaaatttatcattacctgccattactttcttcacttcagtttgagaggaaaagttaccttttcctctagatgaaagatacttctctctgttctctgtttctgttattccttctcccaaaattcaagttatgaaatcttctgttttttagtctttccttctcttttgattccatctctggagtctgtaaatatgcttttacttaaaaaaaacaaaacaaaacaagaacaaaaacaagaactaaccaaacaaaaaacagccaacaaaaggaataaaagaaaaggaaagaaaaacagacactagttctcctaaataacctgtcttctttttctttttaaataaccatgcttctttaagcataacccacactattctctgcttcttcatctcccatgtattacattaagctaattaaacaactttctactactgttagtctactgaaactgctgtgacagaagttaccaacaccaa

SEQ ID NO: 54958 - DNA, 2808 bp, Homo sapiens
acatttatcaaatctgtttctttacctctcctttaaatactgtatttgttcaaatccttttctgttgtcttgacaattgtagtatttccgaagtagtttcattacttccagtttttcttatcttacgattttattacatgatctcattatttcaggaactttcagtggctcttcatcctctccaggatcaagttcaaattcctaggcgtggcacatacagctctttattatttaggcccttctttttttctattttcatctttagtctcttcttctctgttccagtcgtactaacttgcagaaagtaccattctcttacacccttcccttgcatatgtttataccttcacctgtaataaaccccggtcaccatttgcaagatccagaatacctttgttccttatgaatccagttttgacatcctttccccttttcttactcatccacattcataatcatggaaattcttattttactacaaaatcaatatttgttttcctttatattatagttttgggaggatgaatgtacaggcctcagagcatggttgtttaacatgattaggaactataatgtaattgtaccttaataattttagttagcaatatagtaaatctacatatgtagatttatgagatgtggtagaaatactcagcataaacctatgcactctgatctttattttggaagaaggggtataaataatcatggaaattaagtagtaaaaacttcattggtcagaaataacatatgaattatttctttaataattggatgtcttttgtaggtgttactgtagatgatcacatgatgaaggtagagacagttcattgcagcgcttgcagtgtttatatccctgctttacatagttcagttcagcagcacttaaaatctcctgatcatatcaaagggaagcaggtaaaattttcatctgtcttaataaagttgccagattatccatcaatcttttattgttctttggccatagcttcacacctatctgcaattttatcaatttatcaatctcatatggaaataactgtaagtatactcagagaggcagtatatagtggttaagactgagctctaaagtaagactccctgagttgttcaatctataacatgtgttacgcaagcaagttaacctttctttgtctaagtttccttatctgtaaaatgagggtagatgatcattctactcttatctgattttttttaagaattaaattaattaaaacgtataaggcatttaaaatagtgcctggtaatggtaagcattcaggaaatcgtagcttttgttgaactgttaactttttaaaaagtcagtacaaaacagttttgtgagagagtgtgtgtgtgttgtgtgtgtctgtgttttagaataaaaaagaaagtaaagatttgattattactgatacatttttctgatggttgggaaaaatacatttaaaaacagcattatcagctagcatctattcttacattttttagtagaatatccctgaaaaatttactgtcttctttttggtcagtatatttctgcttctctattggcttggctggttttatttagtcagatttacttcagacaatacaaatgtttatattgtgggaaatcagtttgtttgaaaagcatatttaaagattcagatattaaagccttaagttttaaatagaacatacccaagtgttaaacttttattttgtattgaagtgaacctcatttaattcagatttcttcaagcatttttgaacacatacaatcttttcttaatctatgtctttttcttctcttgatattcccttgacaccattttggcaattttctatactggtaactttcttcctctgtataatagtcttgaaataactacagcctagaggaagactagatactcttgtagtatgaaaaattattctttattttttgacagcgtgaaaattaatagttgggggctggggaggcagatgtggagtggaaagaagagaaggcagctatctagtagaatctagacttgtagatttgtgggactgagtgttttcttttgaagctgattggcttgaatcttcattgtttgaattcatagatttagactgtggttatagtagttgctattgctctatagtttgtaagaagataagtcatttaaatctaagggtttgagcatgaaatgctgttttaattatggaaatatttttcatggcatggttttcaagaaccctcagtgtgttctgttttttataggcttataaggaacaaataaaaagagagagtgtcttgactgctacaagcattttaaataatccaatagtgaaggcgcgatatgaacgttttgttaaggtaagattttagggcaaaaaccttttcaataatattgtagtattgcaataattaactggtgacatagtaaccttttgtgatacttgaatatagtataacatattaagaagaattttactcagtatcttgcatataggtaaaacatcttttttcctaattgttgggttggtcaagatgggagcagtgattcctctcttatcacctttgtagctctgaatcaatgagaaatacacaagcattagatagaaaatcaaaatgtcagctttattcttgatttaagaaaaaattgacttggagaatatatcttagctatgtagttgctgtggacttttaatatttcatttctgaattaggtagacttagatcctcccaatttctgttaccagcccagatggacagcaacaggcttctcctagtttaccacatggcatagaacagactaggatgtaccttttctgtcactagga

SEQ ID NO: 54959 - DNA, 2270 bp, Homo sapiens
taattttacttattaactaccagtgtaatgtgtttcctgtagtgactcttccaacctttaataacctcatgtctcagatttcattcttgctctctttgcttcccatattctttttcttatatatatatattttaagacagaatctttttgtgttgcccaggccagagttcagtggtgcgataatagctcactgcagccttgaactcctgggtttaaagccattctcccacctcggcctctctagtagctgggattacaggcacacaccaccacactcagccacttcccatatgcttatttcttctcctgcattagggagattgagaccattagatgtaaattcagtaagtgttctcatttctgccttagatatatctttccttcacctttattatttgtgaggaaaaatcttctttgcctttcatctttgttctaattccatcattatttcttcccttacttgcatctgatttttttcctgtttttttttttttttttctaatcttcctcaaatagacatgcttatgagttccctaaaccaaaaatgacttaacttttcctagactttggcccaccctattttatcatcttgtctcttcccagcatacttgaaatggtagtttactttgcacgtgctctttgcttcctctctattattcactctttaaactagtagttctcaaccagaggaatgtgttcaatcacccgtgaggctaagataaacaaaaagctgcctaagcccttttttaggctttctgaattagggtttcccaaacttcactgataaatatctccaaaaatgcttctcttattttgagacagagtctcactctgttgcccaggctggagtgcagtggtgtgatctgggcttactgcatactccacctcccgggttcaaacgattctcctggctcagcctcctgagtagctaggccacacccagctaatttttgcccgaaatgcttcttaaatatgcaagttactgagcgtctcccctggaaattttgattcaggcagtctgagattgatccaggaatttgtgttttcagcaagagttccagtacagactaaatgaaaatctcagggtgctggaatcagggcctgtggtttttgacagcttcataggaaattttaaagatacattcttggacaactgctgctgtctaactgtcacatcatacttttgaaactgctcttcctaagattactaatgttgtcattatcaaatctagtggtctttaaaaaattataacatattaaatgtatgaaaataaggggatagtacaataaatcctcaagaacccccattctgtattgatgattaactctagtgacctttttcaattgctttctgcttttttatatgtatcatttgacactgttgatctatcacttattcttgaaactctcttttatcaggtagtctttttactgtcctgggtttcctcctgcaccaagtgttccttcactttttttttttttttcgagacagagtctcgctgtgtcgcccaggccatgcagtggcgcgatcttggctcactgcaggctccacctcctgggttcacgccattctcctgtctcagtttcctgagtagctgggactacaggtgcctgctaccaggcctggctaatattttgtatgtttagtggagtcggggtttcaccgtgttagccaggatgatctcaatctcctgaccttgtgatccacccgcctcagccttgcaggtatgagccaccgcacccagctgtgttccttcacttctaacttctgctgctcccatgtatagtgtaggcatcttcatagggtttttattgcagcccttttttctacttaatccaccagtcccatcccagggccttcccatttaagaccctggcttcaccaatgcactctctgcaagcaggcaattcgtaaatgtaaatatcttattctgaactctcctctcttttgagttgcaaatttatagctgcctattagacatctagatatctgaagttataattatatatattaatagcatatatacacttcctccccttttcctttccgttggaatagtgattgtaatttacctgttctgtgaataatgtcaccacatcttttacatttccctggtctgggatattagagtagcctcctcactagtattccttcttttggttctctgcttcatcctacacattcctgtgtcattcatcttaaagggtagtgccaatcttaatattttcctgcttaataaccttcactgttacttcatttcttactacat

SEQ ID NO: 54960 - DNA, 1050 bp, Homo sapiens
agaagtaaggcatggtatctagtagattaagcgaggtacctgattttcatttgagttttaaagagattctgtaacattaatactcatataattaagcaaaatgtaaatctttgcatcatccctttgtttctaccaaaaaccacacttgtctttgtcatgtgtatatatgtgtgtgtgtgtgtgtgtgtgtatgattatttagaaatacagttaaggggaaaatatgacctttaagcatttcagttatggaggataaagtaatggcttcagtaaattatatgctcacattggtatggaatggacagtcaacaaatacttaatgaatttgttataatttacaatgaaaagtttcaaaatggcatttatttctcatgatatggcaagtaaaaatttcacttgccagatcatgtaataatgaatgtgctgattttgaaagccatttcttatgtttttagggtgagaatccttttgaaattcaagaccattctcaggatcagcaaatagaaggagatgaggaggatgaagagaagattgatgaacctattgaagaagaggaggatgaagatgaggaagaagaagcagaggaagtgggggaagtagaggaagtggaagaagtagaggaagtgagagaaggaggaatagagggcgagggaaatatacagggagtaggggaaggaggggaagtaggggtagtgggagaagtagagggagtgggggaagtagaggaagtagaggaattagaggaagagacagcaaaggaagaacctgctgacttccctgttgagcaacctgaagaaaattaaatataaggtattagatttaaaaggagctttacatttcggttctaatgtaaaaaagggtaagaaatttaatagcttaaaatatgaattaacacccatgttgcatgcattccacatattaaaatttgttttatataatttctaaatgtttaacatttgtttaataaaatgaaggcaaaactattttagtttagtttttatagctaccagacttagatccgataaattgtttgtataatttttaagctta

SEQ ID NO: 54961 - DNA, 1081 bp, Homo sapiens
catttgtcttatttcactgggagtggtgcagtacacactgtagttaaatttggaagcagaagctatggaacaacttctcccacccacagaatatactcacaccttttgttcttttgtggccaacccccaggtacagagataatcacaaaatttaagtttactgaattcccatatggcaacatgggtcttttatttatttttgcacactgccttggtaaatgttcatagaacaaaaagcctgattcccacttaatatatgtttatatattcatatatgttcatttagtgaagaattaagaacatgttacaactggaattatacaattgaaggaaattagagaaattttagtccaaacacctcattttatgcataaggaaattgagccaaagagaagtgacttgcctaagttcatagagtgagttaatcccagggttggatttagaactcagatcttctgactcttaatctggggctcttttgctgttctagctattatattggaaaatatttaaataatatccaacatttattgactacatattacattccagatgttattaatactctttacatttattaatcattttactctcacaacagccccacgaagtgggtactattattatactattttacaaatgcagaaactaaagcatgcagtgttaaataacttatgcaaggtcaaatggtagaatcggatcttgaaagtaggaattttaacagaaggtactccagatagatggagatttctttggttcttcttattttttccagcctacatcttttgaatacttgagaattcactcagtagctttctcatacataagggaatgatagtcttggtaattgcacttaccatgaattgccctaagtggaaattaccttgggctggtgttcagctatgctctgaacctcaggtatgcattgattatgctagttaagattatccaaataatccttgcttttctgtaagatgccccccaccacctttttagagatgattattctttacagttaactagttgtgaggtaacatgagttacctcccctgaactcaacacagaagctgtgacagagcac

SEQ ID NO: 54962 - DNA, 1098 bp, Homo sapiens
agcgatccacctagcttagacagtgcattacttgtaggctcttcagcatttgttcttccatttgtttattctctggccggttactgaaaaatattcaagcatttgcttttattacacccagtggtacacattgctgaataccaaccctgagggacctaaaagtagaaggaaaaaacaatttttttaaatgtcaggttttcatcttgcagatctgtttgcaaactggcattttgaggccataattaaaaggaagcccaggaacagtggcacaggggaatcacctgagacttggcagcctggggatcttgtaaagccatcatggctgcttcaggactcaacttattttatcgtgtgagctgatacagtaaaaacctaatctaagcattgctgaaattacccctatggaatagaagaggaaaaaagtgtcatctgtgctcagtgagatcacaaactggctgcaaacagctgctgaaacattaattaatctgtttgcaaataaattgtggatctgtactagctgaaattgctgttataaacaagctgggatgctgtacttatcaggtttacttgtattttaatatttttttacctatgctgtaaaatcaccagagcccagatacagcactgtgtgtttacttctggaagctctgagcaagtatactgatgttaccttgtagatacccagcttgaaagcaattcatatcaattgcgggacttttgtaggcttacaatactgtgttgaagcgtccacacttcttttaagtcagatttgttaatcaaagagaatgaaatattctacagtgcaaattgatgtggatttagcaattctgtaattttaaaacatttcgtaagtgtcacagttgcttaatttgttctaactaggctgtggcaaattctagttgccttgacccttaaaagattaatgttggttccctatgtttactcatttttaaaaaagtggtaggatatgtagctggaacagagaatctgagagagtttgtcttgccaaaatttgaaattctgatactccctgttccctgtttttctgtcctttttttcttgaagatgattttaattcaataaacactcacatctctt

SEQ ID NO: 54963 - DNA, 1070 bp, Homo sapiens
gcccgaggcttcccctcagtggggctgctccgcagggcagacgcggtgacccagggcgctgcgttctgcgctcctggagctggaggtagcgaggcgtggaggcgccgtggccccgttgggggctttgtgtgcacttggggctcgtgactcggatagctctggttcccacgttgcagttggggaggaggctagtggagagacccagtctggagggagctgtgcccaccgcaaaccccaggagagggcgtggagagggccggcccgccgggacggcgcagccaggcgatgccggggtcgcccgggggtcgctagggcagcgggtgacgcgctgtggagcgcggcgagaacgacggcctctgaccccggagcgctcgccaaggccacgccgaggtggctggaccctgcccctccccgctgccggcctgggccccagcctgcctcagagacttcgatttcagtttccagcaaaagtgtgtgccattgtgtggtggtcgtggaggagggagacccacgcgcctgtctatcgctggatgggattggaatttgaagaaaaaatgtccctactcctgttgcgggttcttgcctatctggccgcctccagtcccgcccacgagacctccagctttcattttcttcctgaactaaagcccgaggactgaggcccttcacgcgtagcgtagcccccacccccggtgcccaaagccggccatcgcacggcggttcttagctttttagtctctgtcacgctaatacatgctgttagtccaggtcagggatggttccatgcaggcgattttgacagcagtcatcataccaagctattaggaagcgtgatgtcagtgcgttctggaaggacagataatttataaaccagttcttgacatggtatcttacaaggaaacatctgaagccatcagtaaaagaggcattttaattcacacactaaaaatattttgtgtttagttaacatcgtgcaaatgttgaaagaggtagtagcatttatcattttgtaggtatttatcaaggtactcaaaaaagtccctataggaaggaggaggtttttgtcttat

SEQ ID NO: 54964 - DNA, 1008 bp, Homo sapiens
cctacttaagctggacttcttcagggctaaaggcattgataacatgtctcatactgtgtttcaagaattgacctgaattattgtggaacaaaatgatattgaagggttgtgagctgaatgaagactgcaaaacatattaatgcttattcagatgtctagtcacttggtcttcctaccctggaaaaccgctgaaactggtgtaggaaaaaagaaaactcatttaaaagagcagtaggccgagtgatggcagttttaacatttttaaagaacaaagcctattcagccagtctcatactgggccctaagcttctgtcttgaatgtaagctccacccagatacaaatatgaagggcgattatgtggaagatggtgatcagctgttctctatctcccctgcgttccaaacaataaatggatataagcctcagtgtgagggatttgggcaaggaatgaggaacaatcttgtaaactgaagtgggttaccgagtgaatcttattctatggaagtcttttaaaaactcattactatctcccacaacatttattgtctatctgtgacatgggtagccctgtagtaagaaatgtgatgagctacacaagaatgagaatcccgaacctggagaatgatcagtacaaacatcaaataacaagatagaagcacaaaaatacataatgacacaaataagagagcaatatgtatgtatcaatgtaatgacagcatttaactaattaaactggaaattttctcagtgctcttggaatactaagggagtcttcatttttagccttgtcagttgacacaatttttaaatgagcctgagtctcattggcatctctgatctgtatacagtttctggaagagccttctcctggagagaattttcaaacaaacatttggcatcaatagaatgttttttaatcaaactgtctgttttctatagaacagcctttgatttccagaagagtcaaactgtcttagagactgagaaccttagggcattagaccagc

SEQ ID NO: 54965 - DNA, 1058 bp, Homo sapiens
agtggagggagatttgtttaaacaagtatttctaaaagaaatatgtacatagttctggaaattatttgtggtaaggaaatattctttactccagttgcatttctcagacaataaagtggtgcatccatgctacctcctactttgtcaacaaagatgctatttaccctttacatttttgtatcataatagattttaaaaatctaatgttctttattgcaagacattcttttgttaacaggtttgtttctttttaatgttttacctaaaatttgacatgcttacaggacaggtttgcctcttactttatttaacattgtagaaatgtaattaataaacaatgctcactacacagtttagaatagacgttctcatttatattatcttccaaatttgatcagttagcaaaacttaatacaccaattaaaatatttctacatatgagaatgtttacaatttaaattttagaacttgttttggatgtgattatatgtacgaaaatcgtgtaacactatgctcatgctaagaaccgacataacagaattactgaaataaatgtgctgtgaggaatggaaaatatggtgcaggtgtcttggtcatgataaattgtgattctttttaaaaattttttccaaaaacaattaggtattttaatctgaaatcagattcctttacaaacaacaagtttttgtatgcaagcaccattttatttcatgtagtatggctaatactatagttgaaccaaggatatgcattgattctttgcttcgtatgtaaataaagttaaaaacagttaaaataaggagtattttggtagagtatatacatacctcactgccagtgaaattgctttcctatggtatatctccttaccagaaaaatctctaaataaaaaaaggtttaaagaaaattaaaatgtgaaacatttcttatttttatcattggtggtaatagttcacttcaggttgtgtttcattggatttaaattgtttatccttgccaggttacttggatcacagagcatagtttttctagaatcacctcattggtcaatataatgt

SEQ ID NO: 54966 - DNA, 1013 bp, Homo sapiens
ctggtcagtgatttatatctaggataatgaagtatgtgtgactgcagcaacatatttaaacaaatgatgcacaatgttgtacaggaatattacctgtattaaataggagtaaaacattttcattcataggctgtctaaatatcaatggttaaattactgagttttgctttatttttactccagaagtatttgttgagttcctactacatgcgaggctcttgactgagataactaataagatccttataagatttttctattccagagtttggttgtttagctttgaattacccattctttaatacctaacttgacttctagtagttctttacttattagactcttcttctaaggataaacagaaaaagactgtgtcctagattttacttttgaataggcaggtgacaggaagctgaaaccagtggcttcaatgagatttaggtttcttgtggttttgaattttctatatgacatttctgttatcattgccatttgactaaggaactatgtttactggttttgtaatagtagcatctattcttttggaatctggactttgaacaattcgtttcacagagtcattgaacagccagttccttctctcttacttagaatttttccagggaatttttcacatggcaggataatggaagaaaagccatttgggtaactcttctgttacatttgtatccctccccccttggatccctacagataaattcttaccttctcttcctgctaattgaccagcagcaccctggattgctatcatccctttgtccaaagaaatggtgtagctgtattcaaagacctataaaatgttatgtgctatctattgctacctataaaaaatacctttttttctttttaaaatcaggttgttttagaataaataaaggaaaagtcaattaatggaaaaatttcaagaacagttcacataaaattttggtctattttaatttttttttttaccttttcaaatcacattttaaaataagcagttggagaaaatg

SEQ ID NO: 54967 - DNA, 1087 bp, Homo sapiens
gttctattaagttattaatggagtgactatacatactggtttaccttgttgtcacacctaagtactagtgcctcttttactctcataagtgtcctggattgaatgataaattaatcatcctggttattaaaattgctaaagcatttaaaattaaggtaaagcatattctatcaacctaatctgcaatcaggaaaaaaaatatattttgaggtcaaaataagagtgaatttcaacaggtagggaaagggaaatacagagtagagagaatgttgttaaaggaagtagatctgtcagatgaatgccacaatgcttttctatggtagatagcatgttgttatcttttgtaaagaagaaacaatgatggtagcagtcagcattttaattgagactttattttatatcttgaccacatgtacaaacttacattaatacaaacacacaattccttgtgtactcacctaaatgtactttaatattttcttttttattatattctttgttgtgaaaaattaatgctggtcatgagccagtaaattgatttgctacccacttaagaagtcactatcatagattgaagacactgccctaactgcctctttctcttaggggttggtactgaccaatggtagtagtatcttagatgtcataactcttctgtggcagcaggtgaattttctatactcattctatccacatttttctctctagatcacttttgtaaatcaaatgctaacctctgggacttaaagtaattggaaatttctagttactcatttaaaattaatgcaagaaaaatatttttatatttgggaggggcttcatttcattatcttcagaacaattttgtgtgtgtgtgtgtgagacggagtttcactctagttgcccaggctggagtgcaatggtgcagtctcggctcactgcaacctctgcctcccaggttcaagtgattctcctggctcagcctcctgagtagctgggattacaggcacacgccatcacgcccggctaattttgtatttttagtagagatggggtttctccatgttggtcaggctggtctcgaactcctgactttaggtgatccacc

SEQ ID NO: 54968 - DNA, 2193 bp, Homo sapiens
atcctttattagaaaaggaaattatagggaaatttcaaaatgtagacttgattaggaaactaagcaaactaatgaattttcattagtctatagattagatctttgaaggggtgagccttaataatggcttgtgttgacaagcgaatagatttttcttttaatacttcttaaatatattaaggattaataaatttagctatgcacataagtgttaacatgcacatttctgtgttatttttggttggttagcccaaccttgcagatacctcttaatactgctcatctgtgaaaattttattagcttacttatatgtaatacgcttcttataacctacaaaatgctttgcactttcatttgtagtcttttaagctaccctgcttcagcaaatctcatttccctcacatcttaaaatataccctctttttgacatagatctacataaattcttttgcctaaaattctttccaatcattttatttctcttgctcttttttagatcactgcctcctgctttcttctagttgttttcccagcttttttgttcttcctcatgtcctagaacttagatccaatatgttcttgctttcaaaaaaccacttatatttatactagtgtctttcttctgcttctttgcattcttccttaacttgatatacaaatgaccagggatgaatgttgacaatttatattaaaaagagaggagtggggtgagttttagtctactggattaggcctcctactctgagattataatttttatataccctcacctttatcaggcttggcaagtgattgcagacattagaggtggggaacaataaaaataagagactatacaagtaggaaatcattattgttaccatacttgctaacttttattgaacatttactatgtgtcaggcactatgctatgcaatttacatgcataacatttaatctttacaacagccatacaagttgtaggtactggaattctcttaacgttttataggaaactaggacttaaagaacttaatttgctcaaacttacacagttaataagtagcaaggttgtaattcaaatcagggctatcttacctaatctttgtttttaatcactattctctaccttacacaggcggtctatttttgaatttcttatttttaaaataagaaattgaaataaaaataagcaatggaaaattctaaaatgaaggtgggtttgttcatttatttatttatttattttgagacggagtctcgctctgtcacccagattggagtgcagtggcgcgatctcggctcactgcaacctccacctccctggttcaagcaattcccctgcctcagcctcccgagtagctgggattacagactcatgccatcatgcctggcaaatttttttgtatttttagtagagatggggttttaccatgttggacaggctggtctcgaactcctgacctcaggcagtctgcccgccttagcctcccaaagtgctgggattacagccgagagccaccgcacccagcctgaaggtgggtttaaaatggggactattctggtgaagactgaataaataagagtctaattaaaaagagcagagatccaagaagtgcttaggcctaaattagactttagaggagttaatgttccattctgattattcaagcagattatgcaaatatccaataaggcaagatatctccagtccagattttattagtccattaaaaaaatgcttttacttcatctgaaaattctgcaaaacacaggattaattacttataaataactggtagtaaatctccatttaccaagaatgcacttatgaagattatctaaaaaatcttcattatcagagagaaaagtaatgtaggatgactgggaatatgtttaggtcctgaagaataaaagagggtgttattttaaaaatatgattaagtactaccaaaatattagaagtactaggaaatagaaagcgtgtgtttggcagtcctaggcaaagaaaaggaaaatgagaaactgaagaaagcctagggtcttattttccacacccagtagccacttttgagaaactttaaaaactaatgcttctttttcttggaaattctgaaacattttttccctcattaaaaaaaatcttcttgatcagtagagctatacagatgtctttgctgcttattcatgccaactaagaagttttttttcaa

SEQ ID NO: 54969 - DNA, 6331 bp, Homo sapiens
attcagtattttattcaacaaatattgcctgagcacctatggcaagtgatgtactaggttctagagatatgatagtgactagattacattcccagccctcaaagagctgacattctttgaagaaggcagatacttccaatgtggccatttctaagagcaggaaaaaaacaggttgcaagggaacttttcatagtgggggtaggcattacagtcatggtgtgaatggaccccaaacattcagaaatactgtttcctttaaaaatattgtacttttttctcataatgattaaatatcttatcaaaaatgcctagaaaagttttatctacattttatatgaaataaatttaaaacatatgtttatgctattctattgtaaaatgtgttaggccattgcactagaccaccagatcataagtgggataactgcttttagagaatgcctagaatttgaggccccacatatgaaagtttgacataaaccttcattaattttaactttagtaaagttaaaattcgctttactaaaatttagttaactttactaaagttaaaattatagttaaggttaatttgaataaggaatgaacaaaactatgaataaagcatttttacaattgatagaatgttgggagaacattaagcatcttgagagcaaagcagtcttttaaaaaggactatttcatacataaaacattgatgttgatagcaaatatgttcattcaataaagttatttactgaatggtgttttgttaccttcaggaatgaacttataagtgacaaatcttttacttctctgcaatatttgataatttatattgttctctagaatagagtgactacctctgataaacctacttaagtgaaagaattttctttgtattagcaatctccacgtgaggtttaaaattttttcagtctgtagcatatttatattgtttttgagtctgtgtatacatgtgtatctgtgtgtatgctgcttttccctagtgtgtttgtgtatgttgcttttccctagacattttgtatacatgacgtattggactgttgttgttgcctagcatgaagaacaatattaacctttgaggtgctttttaaatatttcaatatgtttgtgttctttcattcttggaaaattattagaatctcaatataaagagtagaaaattaaactaataaaaatatgtactttcaactctccatacattctaatagtattttttctttcatgcaaatctaaattttttttttccattttctagactaaatgtgttaaatgggcttgccaacaatatggatgatttgaagataaacaccgatattactggtgctaaagaagaactcctagatgacaacaattttatctcagacaaagagagcggagttcataagccaaaagattgtcaaacatcatttcagaaaaataatacgttgactctgcctgaagaactgtcaaaggacaaatctgaaaacgccttaagtggaggccagtctagtctatttatacatgctggtgctcctactgtttctagtgaaaactttatcttgcctaaaggagctgctgttaatggaccagtttcacactcctccttaactaagacttccaatatgaataaaggcagtgtttcattaaccactggacagcctgtggatcagccaacaacagaatcttgttcaactttgaaggtagcagctgatcttcagctgtctacaccacagaaagcaagtcaacaccaagttttatttttgttatcagatgtagcacatgctaagaatcccacccattccaataaaaaactacctacctctgcttcagttggttgtgacattcagaattcagtagggagtaatataaagtcagatggcactttaataaatcaagtagaggtgggtgaggatggtgaagatttattggtgaaagatgattgtgtcaatacagtaacgggaatttcctcaggtacagatggatttaggtcagaaaatgatacaaactgggatccccaaaaagagttcattcaatttcttatgactaatgaggaaacagtagataaagctccacctcattctaaaataggtctagaaaaaaaaagaaagcgaaaaatggatgtaagcaagataactcgttataccgaggattgctttagtgattctaattgtgtacccaataaatcaaaaatgcaagaagtagactttctagaacaaaatgaagagctacaagcagtagactcacagaaatatgcattatcaaaagtgaagcctgaatcaactgatgaagacttagaatctgtggatgccttccaacatctaatttataacccagataagtgtggagaagagagttcacctgttcatactagcacttttctttcaaataccttaaaaaagaaatgtgaagagagtgattctgagtcacctgctactttcagtaccgaagagccatcattctacccctgtacaaagtgcaatgtgaattttagggagaagaagcacctccacaggcatatgatgtatcatttagatgggaatagtcactttcgccatcttaatgtcccaaggccatatgcttgtagagaatgtggacggacatttcgagatcgcaattcacttctaaaacatatgattattcaccaggagagaagacagaagttgatggaggaaattcgtgaattgaaagaacttcaggatgaaggaagaagtgcacgattacagtgtcctcagtgtgtgtttggtaccaattgccctaaaacatttgtgcaacatgctaaaacccatgaaaaagataaaaggtactactgctgtgaagagtgtaacttcatggcagtgacagaaaatgaattggaatgccatcgaggcattgcacatggggcagtggtaaaatgccctatggtcacttctgatattgcccagagaaaaacacaaaaaaagactttcatgaaagactctgtagtaggatcatccaaaaaatcagctacctacatatgtaagatgtgtccttttactacttcagccaaaagtgttttaaaaaagcacacggagtacttgcattcatcatcatgtgttgattcatttggtagtcctcttggacttgataaaagaaaaaatgacatccttgaagaacctgtagatagtgatagcactaaaacattaactaaacaacagtcaaccacatttccaaagaactctgctttaaaacaagatgtgaagcgaacatttggatcaacctcacaatcaagtagtttttcaaaaattcataagcggccacacagaatacagaaagctcggaaaagcattgcccaatcaggtgtaaacatgtgcaatcaaaacagctctcctcataagaatgttacaattaaaagcagcgttgaccaaaaacctaagtatttccatcaagcagcaaaagaaaagtctaatgccaaggcaaatagccactatttgtatagacacaaatatgaaaactataggatgatcaaaaaatcaggtgaatcatatcctgtgcatttcaaaaaagaagaagctagttcattaaattctttacacctgttttcatcatcaagtaattctcacaacaattttatttcagaccctcataagcctgacgccaaaaggcctgaaagcttcaaagatcacagacgtgtagctgtaaagagagtaattaaggaatctaagaaggaaagttctgttggaggggaagacttggatagctatccagattttttgcataaaatgactgttgtcgttttgcaaaaacttaattctgctgaaaagaaagatagttatgaaacagaagatgaaagttcctgggataatgttgagttaggagactacactacacaggccatagaagatgaaacctatagtgatattaatcaagagcatgtaaatttattccctttatttaagagcaaagtggaaggtcaggagcctggagaaaatgctactcttagttatgaccaaaacgatggcttttattttgaatactatgaagatactggaagtaacaactttttgcatgagatacatgatcctcagcatttagaaactgcagatgcttcattgtcaaagcatagttctgtttttcattggactgatttgtctcttgagaagaaatcgtgtccttactgcccagcaacatttgaaacaggtgttgggttatcaaatcatgtcagggggcatcttcacagagcaggattaagctatgaagcccgtcatgttgtatcaccagaacaaatagccacaagtgacaaaatgcagcatttcaaaagaactggcacaggaacacctgttaaacgagttagaaaaggtaagttctccatggggatgatttgggctgataggtctgtgttctaattctgaagatttaaaagttttttttgaatttagtctttattagaatcataattttatgtttcagaattaactcattttagggtggtcagtttatataagaaagtctgatattactcttaaaaatttttttctagctatagagaagtctgaaaccacttctgaacacacttgtcagctctgtggtggttggtttgatactaaaattggattatcaaatcatgttagaggccacttgaaaagacttggaaagacgaaatgggatgctcacaaatctccaatctgtgttctgaatgagatgatgcaaaatgaagaaaaatatgaaaaaatcttaaaggcattgaacagtcgtcgtattattcccagaccatttgtagctcaaaaacttgcatcaagtgatgactttatatctcaaaatgttatacctcttgaagcataccgtaatggcctaaagactgaagctctgtcagtgtctgcatcagaagaagaagggctgaatttcttaaatgaatatgatgaaacaaaaccagaactgcccagtgggaaaaagaatcagtctcttacactcatagaacttcttaaaaataaaaggatgggagaagaaaggaattctgctatttctcctcaaaagatccataatcagacagcaagaaagagattcgttcagaaatgcgttcttccattaaatgaggatagtccgttgatgtatcagccacaaaaaatggacttgactatgcactcaggtaagaggacgtttatgactatgctatacacagtttaaatgcagttcaattatgccttctttaatggaatctatgtggaaaatactttctcacaatcttcctgtttaagctgctttttttttttacagagcacagattggttattctactgtcatttctgtataactcatcaattgatgctcattagcactgagttctctgtgcctcttttcttggtctgaatgtaaggtgagaacaaaagcagaagaaaaccacacacacacacaataaaaacaacaaacaaaaagctgatctgtaaaaataaaacttgctctggctggaggatggttgtggatgggaggttgatgttcaaaagcatagcattattgaaaaggcatacctctgtcatatttttgccagttctccaaggtgatcatgttttcaagatttagctgttggtttttccactgcttaggtaaaacaaaacagactcttaaagctgaatggattggtgtctgttgtgattaacccaaagaaacatctccctctccaattcctcattgtattgcggaatagtttggttttggagaacagttgtgaacataaaacatatttgtttggggttttaggttttaagatagtgctctaatggaacaggacagatgatttagcttagtgctggtgcaccaatagttttttccttttgaaaggaatattttgtatgtattggcaaataatgtggcagataaagtagccaaactttattcagtattgccaagtgtggtttatacttttagactagaaaaattttaagtgttttttctagatttctttttgaaggttaatgttgaaggtttatgtaaatggtctcatgattagagctctaagttgaatgtgtcagaggtaatagttaatggattaataacgactaacattactgtaaagtaatgttgtttatttgctttggggcagacattgtgatatcccgaatagttgtaatgcagttttgatttaaggaaagataactttgtattgtaagtggtctggaaagcagtttatcttgtatgagcttctgtttaatccggctttttctttcgaataaagagtctctgaaagtcaatagctttcaatattttttcagaagggtaaaacgcagggaagatgtgttagctgtgttgaccaaggggtagtatacttcagagatggaaagcatatttgtggctatcacagtaatgctgaagaaaccagttgaaatgtgttggggga

SEQ ID NO: 54970 - DNA, 1046 bp, Homo sapiens
aaatgaacatagggtttgtgaaaacctgacagatcctaactataattcagctagtgggcagcattataatttatttatagctgtgtaatatagcaattaatgaactaatatacaatgagggcaaattgtactatattttgcatgaaattatacaacacaacaaaggttggcattatgtagttaagtacccacaaaatgttaacctacttgcaataaatacaattaataatgtacataaaagaatgaaattaagctaattttctatcagaaaagaattattcgtgaacagaaagtggacagcatagatttgatgacagaaaggttgtatctaatctgaattactgagtgacctaggaagcttgctcagagggattacagaataattatgttaatatgcaattatcacctcatttcttctgtagtaacctcaagatgtagtgtagtgagggtgttatagcaagtgctgatagtttgcaaaaatactgatgtttgagatttctgagacaataagtctagcttgaggcatataagtgatgatctgtcatcttgaagacagatctgacctttgtacaatttttttagtgctcacagtatataactagaggcagttatagctgtagaactcattatgattttctagaaattgaaatatattttatgtagatttaaagttctgtttgcagctttttaaaaaggtgtgtgaattttttagacttttaaaaaccagttaaaagaaaaattctatggttatatgattatatggggaagatttagtaatggtgtctaaacagtgtttaaaaatcttaattgatatataaggagtccaaacatcagtttatttatcttaatttattagcttctgttttttaaacttaatgaataatgcccaccttcaaatacgttcctactttgttatagtaacctaaactggtattgatgtctctgttatatatacatttgactatacaaaggtagttgaaaaactatttgagatggtgtaaaattaactcaagtcaaatgctttcttgcctagatgccacataacc

SEQ ID NO: 54971 - DNA, 1054 bp, Homo sapiens
gaacaatatttactgcttttgaaattaaacaaattttaaatgtttataagtttattttaatataataatattccattacatgttaacataaataacagcattttgagaaaaatatacattccagaacaaaatttagtgagaagagtaccattgttttacatgttttaaaaatctctttaatgtctcacttaatagaagacagttggattcttatacttgcttcagttcagatatcatactttatatagcctctggaaaactccattgtacacttgtgagagaatggcagtgaaaaggcaaataaggtgttagtattattatgaaaatagttttgtttattgaagatcctctaataaggtcttagggatgccccctgggccccacaactcacacttttcagacctcatgtcctagagatcacagcatgcacccttgacctaatttaatcaaactgttaataaattaagtaaattagattagattgataatttgttaatttaattgttttgtttttgcagacagtgcaagaaacctaagacactttaatcctattcatttccttccatactgtaccccttactcaacttatttgccactatactcttgtgtttttaaattccatatatattttagccaccatgaaacgtcatcatcgttttgctatatagatttacctacatatttaccacttgtatcgctttttattctttcctccatcttcatttcttcatctgtgaccattttctgtttttgaagaacactttctattgtaccctttagtgtaggtctgtagtgagaaattctcttcatttttgttgtctggtcatgttctgtatttcaccctcacttttggatgattcttgtttaggattctgagttggcagttattttcttttaatgaggatgttactcctttgttttctctgccttctgtttctgttgagaaattgttagtcttgtcaatgtcctccatccaaaaagactagcaagaacacctgtagttgagcacattttttacttgttgcaatgagggagatcacacactaaagggagc

SEQ ID NO: 54972 - DNA, 1071 bp, Homo sapiens
gaaaatgcatgaagtgtagggtacagctcagtgaatcaccacaaagtaaacactccatgaccaccacagatcgagaaatagaatactgccagcaacccagaaaccccctatgtctcttttctcagtcactatccctgttttttctttcccaggttaaccacttgcctgacttaaaagaaaataacttttttttacttgtttctgaaatttttcagaaatatacagaagtattattttgtctagcttattttgttcaacattatgtttgagagttagaaattttgtcagatgtcgctatggttcacttgtataattttatcacaatttgtcatgttactgtaggaggtttgggctgaataatgctgctgtgaacattcttgtacatgtttcttggtgcatatgtgcaacatttatactaggtgtataccaagactagaatctgggtcattggtttgaccagtgtatgtatgttcaaatttagaagatgacacatgaattgttttcaaaatggttgtatcaatcacatcaagtatatgaggattcctgttgctctgtatcctcactaacactcggtattaatatcccctttaattttagtcttctgaaagatgcatttccctgatccaaatggaattgaataccctttcataaatgtactggttgtttgggtatccatttttgcaacgtctcttctcctatcctcaccaccttaacaaaattactattgagctttctaacttactggtttataggaactatatggtttatacatacagccctatttttcctattggagtttctgtacttttccttttgtttttaggagtttttatatgctctaaatacagactctttgttagttacatttaaaaaatatatacattccactttggcttgactttcaccttcttaatattatctgttaatgaaaggaaggtcttaattttagtatagttcattttatcattgtttgctcttattgttaatgctgcttgtgtcccatttaagaagtctttccttgctccaaggacatgaagatattctcttaggctcagaaactatgcttctcta

SEQ ID NO: 54973 - DNA, 3738 bp, Homo sapiens
ttacaggcgtgagccaccgtgcctggccataagcttggatctttttgtgcactcactggtggctaggggcaggctacccagaaatatgcaatgtgtctgatgaaaccagttgaagttaataaaaggaaaatttgttgtgtttaattcctataattgactgatatcagggctttattcatttatagtcagcctgtgttgtctgtgttccttcattaggttgactactaccttttagttgttcaaaacagcattagttgttcaacacagcatatgcaatagaagacatggttcccattctcttggaatcacagggaaggtttttatgttttatgttttggaacttaggaccattaggagagagaaatcaataatcatcagctaaatatttgaaagagttctgaaaggaaccgttctgtaagagcatttgtcaaaggaacttgacacagagtgggttgaggagagcttcacagagtaagtgactttaagagctgtgatctgatgagattatgagttaaggttaactagatttgtgcgatggagggctgaggattccagaccaagggaactacatgtacagaggccctatggtgaagaggaacatgttggggaatttgagaggaggacagtactttggatcactgagaactgatgggagtagaatctgagactacagtggagagataggcagggcccagcaaagccatttcaactgtataaaagatttgggattatatcctgagagaagggaaaatgtgttttacagagaagtggaaagatgactctgcctgtggtgcagaaaatgattagaaaggggaacagtagattctacttagaagtcagacatgcattaactttaagaaactctttctgcttatgataatgaacaaaaaagtagtcacaaattccccacctcagcctcccaaagtgctcctatcacgtgagctgctcagctcttacttactgctaccttaagaccatctcccaaaatgcctactagtccatgaagttggcccgttacccagatttttttttttttttttttttttgagactgagtctcactgtcacccatactggagtgcagtggtacaatcttggttcaccacaacctccacctcctgggttcaagcgattctcctgcctcagcctcccaagtagctggaactacaggtgtacgccaccacacctggctaatttttatatttttaatagagacagggtttcactatgttgcccaggctggtctcgaactcctgacatcaggtgatctgcctgccttagcctcccaaagtgctgggattacaggcatgagccacccgcacctggcccctgttccccagatttaatttagaccttaacctatggctcaaaatggaacactctaggcactattttggatgtcaagggtacatcagtgagcaaaatgtgtctcttttctcaagaagcttactttgtagtggggagaaaaaaacaaatgatcaaataataatgtatcaggtgttagtactataaagaaaaatatcagcagagaggggcatagagagttactaagagtgctcttctagtaactttattttggatggtctacgaagaactaagaaggagatggacacaaatgtgaaagaaatgatccgtaagtatatttggaggaagagcttcaggcagagaatattaagtgcaaaataaccagagcatagtcgagaaatagtaaggccaatatgagtacattgagaaagagagttggggccaggcgcggtggctcatgcctataagccaggcactttgggaggccgaggtgggtggatcacctgaggtcaggagttagagaccagcctggccaacatgatgaaaccccgtctctactaaaaatacaaaaaattagctgggtgtggtggctggcgcctgtaatcccagatacttgggaggttgaagcaggagaatcgcttgaacccaggaggtgaaggtatcagtgagccgagatcatgccactgcgttccagcctgggcaacaagagcgaaactccatctcaaaaaaaagagagagttagtgggagatggggtctaggacaaagtgcattggatatgaactatatgactcattacttatatcaaaattcagtccttttttgctgataacattttatgtaattaaaatagtattctgttattttacaacttttaggaactattttttgtcctccttttaaataagaaaaatatacaaaaatttcagaaaagaagagtagtgttaagggttgaattatatcctcctccaaattcttatgttgaaatcctgtccgcctctacttcagactataacctcacttggaaatatagggtctttatagaggtaatcaagttgaatgaggtcattagggtgggcttgtccagttatcactgatgtgcttataaaaaggagaaatttggataccgagacactaatagaaggaagacgatgtgaagagacctaggaaaaagatggctctctacaggccaagaagaaatctgaaacagatctttcctcacagcagtcagaaggaagcagccctactgtacttttgtcttggacttccagttcccagatatttcagccaataaatttttgttatttaagccaccacttgcaggactttgttaaaaggcagttctagctatacagatccagtatagctttttctgttatcctagcaaattaatacagttattaactaaaaagtaaaacttactctcctcactccttccccatacttaacaagggtaacagattgttatgaaacgttccaggtcttttattgtgtttgtgtgtatgtgtgtgtgtttcattaatttgtaaagcaacttatgtcttctaaggaaatgtggggaatttaaaaacaacaagcaacaaaaagtaaatgctacagcattatataatagttccttgccttccaagaaaatttttaactctaaaactaaatactatcacaagataatatgcacaactcttttccaaaaaaaaagacctcttctatttttaaagtttcatactaatatacttcacagtcttatttaaatttgtcaaaagattgatttttccattccagtataatattccagtatagctttttctgttgcttcagtgtggtattttggaaaaagaatttgttaccacttggtggcactatgtggcttaaaaatgaatcacattgtatgcaattaactatactgttctaggtaaatgattaaattcagagggaaactgatactgagcaacttaatatagtaaatgtttgattcttctgtaaataaaatattaattggtattgtagagttttattaaaatgtcatggaatataaaaatataaaccaaggcttagtttgttgggtagggaagtatatacatttttgatagaaacctcctttaggtcaggtgtcatttatcattctgtcttaatccccttctttgtctaaatgtgagaaaatagatttttaatattagaaacaaacatcttcaactttaatagtaattaatgttttccaagatatgtattttattttctcttatataaacttaagaaattgaaattttttcaaatgattaaaatatgtaaaacttaaaggaaaacagaaaaattaaatatattgaatgatgtcttcctgcagcatattgaaaaatcaagcagcccttttaaagatactgtatttgtttcatttaattagataaaggatcttgaagtataacaagaaagttattttgttcc

SEQ ID NO: 54974 - DNA, 2003 bp, Homo sapiens
aaggagatattcgcacacacaccattgccagagtcatttagattggaatttttcagaaggggactgaacattagtagttttaaaaaagtcttcaagtacagcaatatttaaaaattctctagattgttttggctacaaatacaagttgtatggggtgctttaaaaagtctataggccttggtaaagtggaatcaaattccaggggaggagttgcacaatctgtcatttttaaaagtttcccaagtttatctgaagcacagctaggttcttagtactggtctagaattttctcagcgacaagaaaggatagttagcaatttattttgattaagatcatttgcaagggccctgaatacaggttttctattgtatgggctgaaaggagatccatatgttttaaatgtcaattatacaggagctaagttgtttacttaaggaaattgacataggtgcttatccagatattaatctaattgctgtatagggttgcaataatatgaataggcaggaccaccaaatattttcttaggcaaacttgttcttatgtctaaactggtattctgctcacatctcagcatttagcataaagcatgttggagatgaccttagttttgtgttttcagaagatagaaatattcatgtatatcacagtagaacttaaatgcagtgtgatttaaaacatctcatttgttctgccaagttgagcatattagtctgctagggctgccataagaatctacagtagacctacctaatccgtgggggatacattccagtacctccagtggatgcgaaaacctcagtacagaacctatatgggctgtttttttcctacatacacatatctgtgataaagtttaatttataaattagacacaatgagagatttaaaacaataataatagaacaattaagtaaagtaaggtttacttagcacaagcactacgatacctagacagttgatttgataactaagatggctaatagatagggagcatttacagcatggatacacaggacaaagggatggtttatacataacctgggtaggatggagcaggacagtgtgagattacatcacactacacagaactgtgtgcaatttaaaaggtttgaattgtttatttttggaattttcgatttaatattttcagaccatagttgactaggtaattgaaacctcagaaagcgaaactgcagatgaggggtgactattgtaccacagactgggtagcctaaacaatagaaatttattttctcacatttctggaggctagaagtccaggatcaagatgtttgcaggcttggcttctcctgaggcctctctccttggcttgcagatggctgtcttctccgtgtgtccttacatggccctttctcagtgcatgcccatccttggtgtctctctgtatgtcctaatcttcttataaggacaccagttagactggattagggcctaccctaatggcttcattttaactttgtactagggcttcaacatatgaattttggggggaacacaattcaatctgtaacattgcatttaaagtgttgttctttatagtgaatgaattaatgagtggagttaaattatttggaattatcagatgctgcttactgaagaaaatttgccaaaaatgatgactttgatttttgtaatgaatatttaaccatacttttagaatgtaataacaagatgtggtgcattgagtcagatgtgtgacttttggtttgctgtggcaagtaaataggataaatgcatctagatgtgcatatatgcattcaaggtatactgataaatgtatctatttatcaatatatctatttatctgtatatattgaaaggtatccttaaagtattcaggaaaagaatcataaatctgaaagggagttacagtataccttcatgtcatctattatacaaagttatttaaaaaatttattcaacccactttaaatattactgtgatatttaaggaaacagtaaaaatttgtactgtctg

SEQ ID NO: 54975 - DNA, 1026 bp, Homo sapiens
gttttatttcttaagatatattcagtactttaatatagctaatactttactcatagacatttaataaatgtctatttaatgactggatggaaatatggcaaggcctcccagaagtgacacttaaactgaaacttggaggaactgttggtgattaatgtggataaaaaatgtggggaaggactgttagcagaagaaatagcatgttcaaaggatgagaggtaacagaaagggaagattgctggaactgaaataaatgtaagttttgaatgtagagctcaccgtggggtgtggatgtggggagtggctagtctcaagagattagacgagagagtaaggctgggctattttattgaggtttttataaaccattgaaggagtttaaatgtgaggaaatgactttattctatctgttttagcaaatgaacctaattaaaatggggagaacagatcacagggaaagctggattggattcaggatgactagttagtatggggagcatgctggcctgacttgagagtggtagaagtggggatagaaagatgtggttggatttgagagagatttacacagcaaaagagaccagctttggtggttaattgtaatggaggtgggagtaggagaataagaaaggagttaagtatgactcatgtttctagctgggcagtagtgctgtattattcacagataggaactgtgaagaagaacatttggagagaacaagagctacattttagatgtattaagctttaagtagctcaggacttctgagtagaaatgtcaggtggcagttagatatgagacctatctataactcgagatgtgagaatcatcagcgtgaaatcttaatgtccctcaaattcttttttttttgagacaagagtcttgctgtatccctcaggctggagtgcagtggcgcaatcttggcccactgcaatctctgcctcccaagttcaaatgattctcatgcctcagcctgggattactggcgcccaccaccttgcccagctaatttttgtatttttagt

SEQ ID NO: 54976 - DNA, 1538 bp, Homo sapiens
attaaataaatactgatctagaaagatgtgtgttttagtaattattttaattattgccattgccatactattaaaattaatgaaaacaatttagaattttttttaaaaaaaagaattagtttcaatttctcatttgaatagattattatttctcaaaaaaagcagtgaggttggggggcacttagcaatagtttcctaaagattaaaatgatggtattctggttgaatggtttttttatgttatatcaagaaatataatttggtttgtgttttttcatttaaaataatagtgtattgtagctatggttattcatgcctgaaacaaaaaattaaaccttggtcattgtgtgtatttctttcaggtttgatttaattttggatgagatcgttcttgcagcaagatgttaataagacaaaatctaggtaagtagaagactgctttgttaaatgtacatatcaaggtaggaataatacaaaaaaattatgtcttaaaaatgtggtgttgagttcagaaccaaagagtttttaaataaaattttgaaatgcaaataattgactttttgacacacttggtccagttgatttgatgggagtaaaattataactatcacattgtggaactaaatttttagtttccttcttttgtgttgaggttaactaaagcattcaagtttccagtgaatattctaaaatgttagaaaatcaagttaatgtttggttcagccactcttattgaactctgaccacttcagtaagacatttattgtgtcacttcattgttctctcctttgttgataaagtatatgaatagtcattgcttttgtgaattttgcttcatttttaatgttaaggaagcactttcccaaatgggataaatttgccaaattgtgatttctttctgttaatatagtattcaaaattgtaaattattgttttaatgttttcctagtgggtgtctctactgaatgacctctctaatatagcattctgattagctttctaaggctgttcacttttaaaaaattgaattggcatcatgtactttggtatgtgaaagaatgctttttaataatataagccgttgacatgttttaaaaagatacatttactatttattggtaagtgaatatggcttcaaaatggaaacaagggaaaaagaacattgaaaaaattggagttaacttggttttccctctaaccagatgtttcagctgtcaaaaatttgctgatctcaatgtttgttaaagaaaaaaaaagtctaggatgaaaagtgctgtagttcagtaatatgcactgaaggaaatctcagtcagtggtttgggcatgttttgaagcaaaattttgcttttattgctattatataataataacagtagtggtagtttgaagagtacttattgtgctctaaattctgttaagtgcttgtcataccttattgatcgttatagtacctcctcttgttgtgtagaaaaattttattttttgctttatagtgggctgtttttctttaggaataataatttacttctgtagcattt

SEQ ID NO: 54977 - DNA, 2039 bp, Homo sapiens
aaaaggcacagacatgagaattgtggaatgcaagcgttttccttggttagagtctattttaaatgcatataataaaaagtaataagattgtggcatgagctggagggatctaaagaagtttggattagaaattggaaataaggagttctactgaagatcattgaatagaattacatgaagaaatatgattagcagccagatacagcgtgattggagggagattgaagtgaggaaggccagttggtgattattatctttgtgagtgggaagggtatattaagagtaaggatgcatagttttaaataagtcaaatcaaatattgtggctcctcagtttgtagtgcagagctaaaataagaatgaaagaattttactatcttctggtattcaaaataaatggagatagagtttgcatatgacttactagcactaattgaggtatgcctttttcttaaaaaaactggcttggccttttttttctgttaagtttactttgaaaaccaataaagttatgctataatggtgttttcctaagtaaaaaatatttaaggtaactggtaagaagagcttgtacttgtatgctgaattttgagttaaaattctgtattttagccatggcttaagagacattataatttgtattggagctggcaggaaaacaggaaataataaaaattaacaatgtggactacatatttatatttgtttttaaatagatacttgttttaaaatttaggaacatttgggaatactctgcttttataggaaaataatgttcttaaaatgtagagtttttaataattcctaaattgagtgtaccttatggtttattatgggtaaaggtcatttttaaaatagaagaattagaaaaacaggaaaaatagaagtaatacagttttttaaatcctctttttttttaagagttaggaaatagaacagaagcttgggaactaatagttttagagttttaagataccacgttttagtataacatttacattttaaacattctcacagttaatataggcttaacttggaaatattaagcttttaggatttagtatgtagtagttctctgctggcactaagtctttccccttcgctcctttccaacaggtattgcccaagctctcataagccgttcttttctttctattatgattattattttgtagagatggggtcgcactttgttgcccaggctggtcttgaactcttgggctcaagcagtccttttggcctcccaaagtgctgtgattacaggtgtgagctgctgagaccagccttttcttttaattctgatggtcagtactgatgaagtcctttccagctttgggtacacagccttctgttattcctgctgtcaattttttgtctttctactgtgcttttcaaccttggttattcatgtatcaccttcatctgtgcgattattaccatttaactgcagcaagtaaagacgttaatagtgaggtttttgggaatgtggtaaaaccgggaggtatatttgactttgtccaagttatctgatgaggcagatcagctaaagcaaaatacagtgggttgctccctactatcactgggacctagagatttcatctacatctctgaaaaatggggtttctgtatgatagtatgggtgagaaggaatgacagcagaactatcaactgttttctgattatcctgatgaactagtggtataggaagcttttctgaaaacgctgctctgaattgcttgcttaagtagttgcttttttattcctgtgtatggctccagagttcttgggaatagccctacctccatttgtttgtagatgagagaaagctgaaccttctgctgtcagtggagaaggcctagaattagtctagaactggtgctatagggccctggaatgcttcaggaattggtggctgcagggacctctgaaggaattgtctaaaagtctgtataacaagtaagcaacactcatggtttcaggaatggatctcttgcctcatccaagttttcttctttgacattcaacctgaggatctctgta

SEQ ID NO: 54978 - DNA, 1804 bp, Homo sapiens
ttttgtttctaaacttcttatggcatatttgtcctccctcccaagggtagtgagaattgatgcttgaatccatctctcttttcttctgtccttgtttggcattgttatgaattgggaggtaaatcaggtgatatttggtactatggcccttttttccccccagtgacaaaatcagagaggtgcttcttagtgttcattaatagtaatcctttagaggttagttttatgacttgatattttgtttagaatgcagagatttgaatttgcctccaccgataacatagttgcctggcttgctgtcattacagtattctctaggcatatagccaggaagtaggtggaggaagttgtggattgcctccttatatagatggtttttggagcctctttgatggtagcttccaggcattatgtcagttagctattaggcattttaggttgcttattaaggtatttgggtatttctgattgtaattttagaggtaggaataaataggtgtactttttttttataggtaggcatctacctgttcaacagaaaagtagaatataactagaatgttaccttatggacagttgcttacaagtgtgaatggttaaagcccatgtaggagactttataaatggaaaactgaaatagaattgttgatcatgatttttacttttagtgcttgaatcagtttttttcccccaaatggaattaatagttgtagcattatttttcgtaaatactgagcagtagaaaccttattgtagtatagcagtattaaattggtgctttgcagataaagaattttttctgaaatgggtattataatgttgttaaacgtatataataaaaaatatatcttcacattctagtatatctggttttgaagaatgaatatgtaaattgcgcagaaatgggtatgaaaagactttctcattaacatttggattgtgaatgctcgagtttataaatgaaaatatttactctatataaagaagttttgtcttttggaatttgtaataagttcatttaatatactcttgctccagggatttcagtatttgtcttgaagaaataataaaatctcacctgtcaacttttcttattgtagcttttgtgaagtatagaaggctaaagcaaattggttaaattagacattgaaaaaagtatatgattattatctccaaaatattgagactttacacataacagcttttgggggctagatttagaaaatcactaacataaaacaattagaatgttcttaattatagttttcagaactgactatgtagaaaaaaatacactcaagtttgtgttctatgtttacatgttgttttgacaaaaatgaatgttatgtttgaatttagttttgggagatttcagtttttttgtattcagaaaagtcttgtttgtctggttgtatttcccccaattttcataacttttatttaactgggttagttgtcatacaaaattcagctaatgctccactaggggtagggttgcatatacatagagcacagatatggcttctactccaaagagctcatgatctaagatatagcttgaagagtacttaactatgaaacatttaaattactgagctgacaaaataaaatgaatgatctgtaataagattaataaagctttttgacaaaaataattttttacctagattttgaagaagtggtgtgtataggttggtggaaagggaaggagataacagctagggggaagagcatgttaaaaaagcacagatattttgggatgctgaggcaggtggagcacctgaggtcaggagtttgagaccag

SEQ ID NO: 54979 - DNA, 3624 bp, Homo sapiens
tttatctaattttttgaaaagattaatattttacttaaaagtatctctttcattagtttcttgaggaagatattaaatacagtcatgtgcagcataatgatgttctttggtcaatagtggactgcatttacgatggtggtcccataagattgtaatactgtatttttactgtattttatgttctatgtttagatacacaaatactaaacagttatgttacagttgtgtgtggtattcagtacaataacatgctttacaggagcatgttgtagcctaggaacaataggctataccaagtagcctaggtgtgtaagtaggctctaccatctaggtttgtttgagtacactttgtgatgtttgcacagtgaccaaattgcctaagaatgcatctctcagaatgtacatccatgcttaagtgatgtatgactgtaaaactagtactttcagagcaccatttattggggaggagaggggtaattcccaatttattgttggtttgtgaaggtgggtaaaaggcttcacagagttggaattaattgccttttgtttgctactgactcactaaatactttacacacagacacacacacacatagaatcacaattgcaattgtaattatgcatatataaagaggcaggatatgataaagtttgaaagtgtaagccttgaagtaaaattgacagggttcagatttagctgtgtgagcactaggcaagtggaattagtaattaccatcttcaaagaggtttagggttgatattacataattcatgtaaagtccttagctttctggcatacaatgctgagtaaagtaagtgttacctgttagagtaataatagttattattaccattgtttaattattctttctacattaacttgagattttcacctgtgagtgatttgcagttgtatacttttgctaatgtcccattttaagccatgccgataaagacaaggttgttatagaggaagtgagaggtaggcatcaaagtgtgccttctctgattctagcagcagaatcttataaccaggttaaatatttcaggaatgcattcccagcactgtcagcagatgagtagatacacttgggaatgagtacattttaatgaagttatttcccagccagtgcattggtttgtctttgttataacatgctgaatttcttcactctcctttcaatttttgactgtgaggccatgtggtgactattagtagagagaagaaggtgagtggctatgcgtatttgtaatgtacgtataaacccaagatgagagtgaggagtggctggtaggtagctagattgaggcgggtggaatataatcttttcattggatagtctgagttgggaatttcccaaacagcatttccttttgctcttttcctctccacactttgttttgtatatgtctgtgctggtatggtgttaaagttatcagttccccctctttaattttctttctaccaccaacctcctcctagcacaaacacggattttaagcttataagcaaatttgtcaaagacagctagtaaaaataattttaggttcatttgaggaggggtactagtatgaaattgtaagtttttcatttatgcttgaaaaatacagcaatttggaaagtgagggaggggaagtcacccataatcttattaccattatataattattagtattaaagacagatgacgttaattaagcatctactatattcttttaataatcctgtgatgtatatattcccactttacatgtgaggaaacacatccacttaataatggagtagccaagtttgaacctaggtatatcttgagaaggtctagagaggagacctttctgttctaccttcctgttcttcttacatatatatccttttacctagttgttacacaatttgtaagtttcatctcctagttttaaaacttagcattataaaaacatttttctccccccccttatttcaagtggtgtcgtattgctctcattgtctattcataccaccatataaaggctctttgtcttggctgctggacattggtacaatgatgttgaccaaaatggatgctgccctttactgagtgactaagatgaaaaaaatcaggcttaatcagaactaatactttatgggatttggattgctacaggtttaatcatgctatctatccttgctggtgggacatttgacttagaattgtatataagtaaaatatagatgaaaaattgtataatttatagctatctgaaaacaacttttttttaatatttgaacactttgaaatgccttacacttccttgttaaaaatcttaaagggatattaaaattaaatggcacttaattactattagtaattcctaatataatatttaattcataaaagaaaaaagcttaatgttgaattctggcactcatcgggaagatgacattatatgttaagagataatttgtggggcatagtaactatagttaatattgcatacttgaaagttgctaggagagtacattttaagtgttcacaccacaaaatataactatgtgaggtaatgcatgtgttaattagctagatttaaccattgcataatttatatgtatttcaaaatgtgttgtacaccataaatatatacaatttgtatttatcagtttaagaagaagaagaagaaaaaggtaatttgtgggcatttataaatagattgtataggtcagcactgcccaatagaaatataagttgagccacaaatgcaattttagattttctatagccacatcaaaaaataaaataaataggtgaaattttattaatggatttttatttaacccagtatctaaatactattatttcatcatataaacatgattgaactattttacattttttctttttttaaccatgttaagtcttcaaaatctgttagtattacatacttaaagcacatctcaattcagactagccagagttcaggtattcagtagccacatgaagttactgtattggacagtgcaattacagatagtaagtcctatggggtatagggaaagaataacatagaaattgaactgaaccgtaaaggatagctgagaacagaaaatgcttgagaagaatattcccataaagaagtgataggaattaaaacagcaaatacagtttgataccaggtaatagagtggcttgaatccagtttagggaatttggtttgggtgtgtatatgtgtgtgtgtgtgtgtatgtgtgtgtgtgtgtgtgtgtgtgtgtgtgtgagagagagattggaaatatatattggagggtgcctaattcgtgtctcatacatgagcacttgataaatactgaattaactgggtgcattggctcatgcctgtagtcccagcactatgggaggctgaggtcggcagatcgcctgaggtcaggagtttgagaccagcttggccaatatgatgaaatatcccgtctctactgaaaatacaaaaattagctgggcatggtggtgtgcacctataatgccacctacttgggaggctgaggcgggagaattgcttaaacatgagaggcggaggttgcagtaagccaagatcatgccactgcatccccacctgggcgacagagtgagactcagtctccaaaaaacaaaa

SEQ ID NO: 54980 - DNA, 2344 bp, Homo sapiens
agtttttatgggtcatataaggtgcttttaaattactgatttttgttagttgataagctgttttataattttcaacattatgtgagtggatttacttacactttcattttgtgaaaattagagtcactttcaggttatttgtagttataaagtggtctgtcacctgccaaccttaaacattttccagttttagtttgtcattcaagttataagagtgttttggttgaattgagactgttaatgggtagcaggaggagaaaagaaagtttcaaagagaatagaagtggtgggatatctgcaatctagagaaaggtcaggtccattttttttctgtcatcctaaatattgttttttagtgttacttatttagaccattttctcaggatgtgattctggaaggaaaagtgaatcttattcttgggaaggcttttcagtcaggtcttaagacaattgtagcttgcagcaaatggagaaattggcatgttgagttatctaaccctgattttatagagcacttgttttaaccattttttaaactgttttctaaatgttttaaattagtaaccttgtaaaataaaacgagaatgaagagtggatactgtaatactatggatacatattcaaatgagcttttatttacacttattaatctttctggtagagagaatgtctatttcgtatatggagaatctgtaaatattgagtaaagttgtcaggtatagcattgactgaagcagttctagaagtggtgtttttgattcaggtttattagagggaaataaatagctgctgttaatagtgcaagccgtttacaccattgagttttgggagatttgagaatcatggaactgatgctagcactagctcaccctgctggttggctaaaagatttctcctcttccccttaagaaacaaacatgaagatcacaggagacccagagggtagtaagactctaaattaaattctgtctttcttcagggagaggaagttcccatgaaaaaggtgttttcttgtctctaaggccttagttgctgcattataattttttttgcagatctgccaagttgaaccatggagttactatcctttctttttctttctttttggttgggggacggagtctcggtctgtttcccaggcgcgggtgcagtggtgcaatcttggctcactgcaacctctgcctctcaggttcaagtgattctcctgtctcagcctctcaagtagctgggattacgggcgccggccaccacacctggctaatgtttgtatttttagtagagatggggtttcatcatgttggccaggctggtctcgaactcctgacctcaggtgattcacccgccttggcctcccaaagtgctgggattacaggcgtgagccaccgcacctggcagtagttactatcctttttgaacttcctgggaactcttatgtgattatggaaagttagtatatttttattcttttaatttcaagataagaaatcctttgacaattgagagatgttaggaagaaaaacagccctgtgagagtaactttccaggaggaaaaaagcagaggatttcaagagtaagaggaggaggagcctgccagggcagaagtagcagcagtgcacacttctcttggttgggagaaagtgagactggattaagattagcgtttctgggagattttctttcccctctcctactaatcttggccctacctcttctgtctgctagctgtggtcttcccatttcatttggaatcctttgaactgagattttgtaagtaaaaataaagataaatgatttgttccttgaagcttaattctgttagcctagattttggtagaattgaagctgggttagagtgatgaaggcagattttatgtgttaagccttttggtatgtgtatcttttttttaagttgaaaatacagcttttaaaatactttatataggccgggtgtggaggctcacacctgtaatcccagcactttgggaggccaaggtgggtggatcacttgaggtcaggagtttgagaccagcctggtcaacatgatgaaaccctgtctctaccaaaaatacaaaaattagctgggcatggtggcacgtgcctgtagtcccagctacttgggaggccgaggcaggagaatcacttgaacccaggaggcagaggcttcagtgagcagagatgccgtgccactgcactctagcctgggtgacagagtgagaccctgtctcaaataaaaaagactttgttcaaactctagaaacgtaagtatattttgagccaaatagacaactgaaaattaaaaatacctaataaagtgttgattaaaattctttacactttacaaagc

SEQ ID NO: 54981 - DNA, 1072 bp, Homo sapiens
ccaccatatttggagcgtgcctactttggggcgggaacctccttgggagtgattaggtcagcgctgggggaggtgaccttgtttggtttctggcacccgagaacagtggtgcactgtttccgctgccctcgtttgtctaattggcccagacgctccaccagcgcgaagcttcccgggagctcctcgctggccacccccgcggcccgcagcccggcagaggcgggaaagcagcgcgcctgcgccgtgggaaccggggctggaggcgaaaagcggggagcggaggggggccgctggagccgagtagcgtacagagcggcgtgtgacgcggggacgccgcgtgctcccaacgtcgccccggtttgacgcacacggcaccaaactgtgagtttcaggggttatttggtcagattcgctgggacccgagtgggtttcgggcctctgggctgtggcagcggcgggactgagggtggcggaagaacttgggggacccggcctccggctctcgggcccggggagctacgccctaggctgggtcccagccatccaaaaggacgcattttgccgcacaggctaagatggcggcggcggccgaggaggcggagttggtgctacacaaggagcccgggccccgggttcggggaggcggcggccgcggcggtcgctgggggccacggagcctgaggtgagcggcggccgccgccgcggggcgggactcggcggggggatggggggggggctttccgctgcggcgtcggaggatccggtagcggacacaaaggggctgagctgggcactagacttgggggttttgtttagtcacatgaagccgagcagccagtgagcagtagggggaaggggccgagatcaggcggcttggggagcctggcggtcgccattgcaatgcactgagtaacggggcgggccgagagcagtcaccaacccctctcgttgaggctgctcggttgtggccagaaacgctggctctggcattaactgtctacacccctccccttacttgggacaggaccgcatagccctcccctccccccgtcctgcaagatcttatgcggct

SEQ ID NO: 54982 - DNA, 1047 bp, Homo sapiens
tataggacagtgttaaaacagagcttcgtatgatctaaatgtaggactgaattgcgatttggaagactgtaatacaacctgttttacggttgaagttgctatggtctcagtattggtaattaagaatgcagaaatttgatgatgcccaaattaaatttctcttttgtatctgtgttcttatctctactcaccacattgccttaagcttaaatgtagaaattgacactggagatcatcacttaagtattcaaaagcagaactcacagacaaaaaaatatgaaatgtttgtagcaataataaagcaccatatctcagtgtacagcatgaaatgttctttgaccgtaaaccagaccttagggtgaataagacagggtcaagcagtgcctgctcttgtacactcgcatgtgtaccttcatttctgctctggcacaggacctgggacatagtaggtatttgttaataataaatatttgttaaatagaggaattctagttgactgtatttttttttttctgaaagggtagccagatcatctttcccatctttgtcttaagtgaattctgtgcttgtctaaaagatacttattttgaccttttgtccatatattctttataaccccaccctagaaaaatatgacatcacatactttctgctttgatggaagtcagttatcccacttacctaaacttgaaactttaatcttcagctgatgctttttatttgttccccatatcgtcacctagctttatttctttttagtaagtatggcattgtgtcttctttccattcccatttccaccacattaattaatttccttacactttgttcctgatttacaacagtttctcacctatgctgcctgcttgcacttttccattcttcagttcatcttgtatgttggtgctagaataatcttaaaatgccactttcatccagtttcatggatactgttcctcttcctttccatttttccagcagttagctgtttttttagttcatctttcccttactagtcactggacacataacacagtaacacagtcatt

SEQ ID NO: 54983 - DNA, 1012 bp, Homo sapiens
tgaacttcagtgcctaacagtggctgggtaggcaatttaaacatattttaattgaacttgtatataatttataagattttaaagtagatatttagcagggatgaggggattatatgtgaattaaatacatttttcagtcaagtgtttgcaatttgctagcactttccttctaaccttgcaatagttagttaaatttatagtaattcttttagattggatttcccttgaggctcgacctgatttcctgtcttttatcactgctttttgtaaccttcctgccaaatcataaaccttggctttcatggtttacattattttgtaaatgtagggaactcacatttcacatttccccagctattgacgacctcatctaatattttatttagaataacagaatcatctggtatggtttctctctgctaggtcatttctgtcaacatatggacatgatttagaatcttaccctcctaaactgccctccttcttccacctgctccatcatttctttgttcccccttacagccagacttctcaaaaattatctgcatacattgttttcattccacacctctctttcactaaatacctattgcggctgttcttctctatgctaaactggaaactatagagtcaatcattactctaggcatcatttaacacaattgacgtgaacccttgtcttgacttctgtcctgccacaccctccttgttttcttcttccctcatttggcctttcattttcagtgtctttgctagctcttccacttctatctgacccctaaatattggagttcctcgtgcttgctcttaggtttctctgtattcttagtgtcctccatttccacatgatctaaagtaatgattcccaaaagtatatagttaatctcagaccttttatcttaactacaggtttgtgtatatccacctgcctatttaacatttccacttggtgcctgataaatatctcaaacctaaaagacaaacctaaaccttaacataccaaaaaaaaaaa

SEQ ID NO: 54984 - DNA, 1018 bp, Homo sapiens
ttactcaggctcaaaatcatagaaatcacctttgtcctattttcctcttttatgaagcagtgtaacatagtgattaagaacatatatctggagcaaaatgcctgggttcaaatcctggctcattgatctattagtttagtgaccttgatttatttattactgttaccatcttatctgctaagtcttattaatcttttcccttttttctcattctgctgcttccccagtcacaactataattacctcgtttgaattattatagtaacttcaaaactggtgccatttttgttttaaaagaaaactttaacacgagaacacaagtcacttgtgtttatattatgtgatgatgatttaagtcagttttctagcaatatgtatgcattgctaaaattgcggtttttaaaattaggcataaagtttcagtccctctgacctttcttctaaaagttccttgtgcatttttccactagggggcaagataatgtcatgggagttaaatactgctttaggaagaatgatcatgtagttattgctatgccatatctggagcatgagtcgtttttggtaggttttaatatttcttgaatttttattagctaaatatttaattgcaaacaatatttgtaactcatttcatttgtaactttgttttaggacattctgaattctctttcctttcaagaagtacgggaatatatgcttaatctgttcaaagctttgaaacgcattcatcagtttggtattgttcaccgtgatgttaagcccagcaattttttatataataggcgcctgaaaaagtaagtatgaagagttactagaaaatatttatcctatttcttttaaaaaacaattttattgtctatatttaaggtattgaacatgatgttatatatagtacaaaagttactattgtgaagcaaatatttatctcagttacccatcttatttttgtttttacggcaagagcagctaaaatttactcatttagtatgaatctcatatacagtacagttttatt

SEQ ID NO: 54985 - DNA, 1013 bp, Homo sapiens
ttaaagcattttatttgcttgcttaatacctcaaaagtttcctgtgatgtagatatatttgtgtttgattaaaattacttttgttattatataaacaatataatagcagttagaaggttttgaaaaagaaaaatgtcttccgtaatctaaaaacttaccatggagctggaatccaggaaacatcttgaatgaatagatgaatcctgctattcacttggattatgggctttgaagaaatgtattcattcattgaatgtctgttcttgcttgctaatgataacaaataaataaatgagaccatctgttcacactctagtcaggacaccatcaaataattataaaataacctgttgagtatggtaataaaacttattcagggtatttaaggagtatctaactatcctaacccaaagagattatgaaaggcaattcatgaaagaaatgacctcttagaatgtaaattgggctgagaagttagcatagaggcatgagccaaggaactcaagaaacagcatacaggaaactaaaaaagtttcattttggccagacgcggtggctcatgcctgtaatcccagcactttcggaggctgagatgggcggatcacctgagatcaggagtttgaaaccagcctgaccaacatggtgaaaccccatctctactaaaaatacaaaaatcagctgggtgtggtggtgcgcacctgtaatcccagctactcaggaggctgaggcaagagaatcacttgaacgcaggaggcggaagttgcagtgagccaagatcgcaccattgccctccaacctgggcgacagcaagacttcatctcaaaaaaaaaagtccaattttgctagaatattaagatgcaagttgaggaatggtgagagataaacctggaatgaggtagacaaggtcagaccacagttgttacagtttggactatatactgtagatattggaaagttaagtgaaaaaagtgacaatggtatatcctagatggatcattctggcaggcgtgcaa

SEQ ID NO: 54986 - DNA, 1053 bp, Homo sapiens
taattattaatacagtgtaataaggactagggaagagaatggaaatgtgtgttgtcaggttgtgtaggtttacggtagcagagaagcagaatgcatagaaggccttaactgatgggatattattgtaagcatatattggacttggatgtcatctccttagccacgcaagttcttcaagactgggatgtgcagtgtacttcatagggcacataagaattatctcagccttgctctggccaacaatctgaactcaagtgcccatttaatgtttattttccacgctcagttatagttaatactttccaaggaataagtgggattgactcagcttactaccatacaatacagaacacctcaggagacaaagtttcagccagcctacctcaagagtagctgggctgtcttgtgctcaaccccaggatcagtgggtcttaaccagagttgcatgtcagaattatctgagaatctttaagaaatacatatgcctgcccactcagcctattcttggaaaatatgattcagaaaaacaagatacttaggaaggctccagccttgttagtttgaaaaagcaagtgattctgactaagaaactatgggtgtttaagaaccactgcaaaaattactgcccttgcttatgcactagtgctatagtctaatctacaagaaaaacttagtggtggttgtgaagaaagcctcatcttaatagaggcttgccaaaatatgtttctacagtaaagtcagtccacgatttgtaactatcttgtacttattgtaagaaaattttatttgaagataataggatgaaataatacaagggaaaaaaagtgaccatgagtggaaagcaagattgatatcttagaaatggcattcttacataataatataacaagtatgtttattctcaactgagaaaactttcatctactattgaataacttcgtgagaggtttatgaacatgaagtttatcagccaataccaacatattttattgaagagcttgaatctcccccattgtaatccaagttataatcagggccaacaatggaaataca

SEQ ID NO: 54987 - DNA, 1640 bp, Homo sapiens
gaagcttgagaaattggcagagtcaagtgagtgcctggcatagcttagtaagtcactgctttgtacttactatctcccactttatctcccactatgcaattcaaatacaacttaaatatagcatgtggtgctctatctcatactgtgtgtgtgtgtgtgtgtgtgtgtgtgtgtccatgtctataaagcatatgtttgaactttcatgtttctcatgagagaggcttctgatatattcaaataataaaatgtttttttctgtttttgttttttcttcttttgcttttagggaaatcaatattatgtagcaaagaagttccagcacaagacttgagaaaactctgtgagagactcaggggtatggattctagcactcccaagttaacaagtgatatacaagggcatgcttctcatcaaccagctatttcagagaagactgaccataaagcttcttgcctcgttcaaacacctccaggacaatactcagggaattcatttaaaaagggggatagtaatagctgtgagcattgttttgatgagtataataccaatttagaaggctggaatgaggtacctgatgaagcttatgacctgcttgataaacttctagatctaaatccagcttcaagaataacagcagaagaagctttgttgcatccattttttaaagatatgagcttgtgataatggatcttcatttaatgtttactgttatgaggtagaataaaaaagaatactttgtaatagccacaagttcttgtttagagaccagagcaggattaataatttattttaacattttagtgtttggtggcacattctaaaatatagattaagaatacttaaaatgcctgggatagttcttgggactaacaacatgatcttctttgagttaaacctacctaagtagattttaggtgggttcctattaggtcagatttttagcttccctaattacctttcactgacatatacagaaaaaggagcagttttagttttaattaattaaaattaacagatgtgatgaggattaaatgaatcaaaagacttaatttgtagattcttttagagttatgagctaggtatagtttggggaaactcaacctggtgctggtgctcttaacaattttgtaaataaagaagataatttccttttctagaggtacatattaggccttttatgaacactaaaacaatgaggaaatgttggtcatggggcaaagtatcacttaaaattgaattcatccatttttaaaaaacacttcatgaaagcattctggtgtgaattgccatttttttcttactggcttctcaattttcttccttctctgcccctacctaaaacattctcctcggaaattacatggtgctgaccacaaagtttctggatgttttattaaatattgtacgtgtttacagttgggaatttaaaataatacatacactggttgataaagggaagctgcaggaccaaggtgaagattgatagtccaaatgcttttcttttttgagttgtatattttttcacaccatcttagatataattaggtagctgctgaaaggaaaagtgaatacagaattgacggtattattggagatttttcctctgcgtagagccatccagatctctgtatcctgtt

SEQ ID NO: 54988 - DNA, 1255 bp, Homo sapiens
aaccaaaagatctttttaaaagagagagagaggaaaaaaatcaccttttatttgtttgggtctcattgtcagaattattattcagatcaagaaatctgtgtcgataaaacctaatctcatattggagagtgaatgtcgttaagtatttctgaaatgtttctaaaaaatgaacatgaaaaaaataaggtattttctccctagcttctcattacagtatttctaattgcttcacactttacagttttaatacaaagtacaagctctacttttataacgtgtactacaagtttctttaaaagtattgttgtatttcagctgaactcttgtatctgcagtcttttgttatttctgcaggctacacccttaatttgcagaggccattttgttgtttgtttgatgctgaagctgttgttaaaatgccccaaactccaaggcagattgtctgtataatacgctatagcttttcaccatgtggtgtttaccagctgttactctgtattttaaaaagccagagatttcttctgtctaaactgtttctatagcattttctaaacaaaaaaaatggtttttttctttgccttgtaataagattgtaaatccatttcctgcttgtgttcttagtgggcatgattgtgagtgtgtgtggggtgctcacacgcgtgccagtctttttgtactgtaactacctcatggtttgaatgatgattgtactgctggttgtgttaacagagcacattttgttgggtgagtcctatgtgatttttttcatgtttgttttatctgggggttgttcatgaaactgacagatgtttttctaaaaaggactattatcagtttccaaatacaatacttctctcttctggtttttcctgaatgagcctgattttgttgctggttttcatcatctatgagggtaaaacgagtacccttaaaatccctgtggccagtttgaacacccctgttgtattcttttctctgttcagtgtgtcagctattttgtgaagatgcttagatgtatagttttgataaccacagttttaaatcttttatctgtgcataataaaaagatatatatcagttattaatatgtgtcttgttatcattaaattctaccctaaggctcatgtaacttttttcactgtgactttctcctgaatggatcgtctgctccgtgttgatgaggaagtgggaggagaaaggctaagaggtccagagcagagggaagggcggatggactagaagaagagtgcagcag

SEQ ID NO: 54989 - DNA, 1047 bp, Homo sapiens
aaaatgctgtctattttgttggctttagttagggactatctgaaaataaaatcagatgttaaaagccaaagctcatgaagctacagggccttcatccttcatatgactgtcattaatcttcctgtgggttgttatttccagtttaattgcagccttcagcaggtgaggaaccccagcagcttccaggaacagccccacggaaacatcaccttcaacatggagctatacaacactgacctctttttggtgccctcccagggcgtcttctctgtgccagagaatggacacgtttatgttgaggtgagacctgaaagttagccttgaccttttaggttagtgctgggctatagttccttagacatcagctaaaataccctgtacagacctcttcctgtcctacctcacagaccttcaacaggtctgatgagggattggctcagagaacgcttccagactgacttctgaccaaagcaggaaatttcaagatttaatacattatgctaagtgaagacagtattttgtagatgaatgttaacaaaaaaaaaaattggcaagtgtgaattctactggtaaagccctgtcctttgcttttggaacagtagttcagtagttgcagtgttagagttaaccatggaatatttcaaaaccacctcatatgttatcttttatttctttttttttccctgcacagtccccttagcccccagcagggcagccaaatccctgtgggtccatgccgccactgaaactgacttgttatcttttaaattgcactcacttttaagtgaaatgctatgtgctattataactcatgacatttttttttctagatcatgatctgagtatctgtataaacttatttaaactatttcctatatataatgttaataatcatgtgcaacctaaatctggaatctggagtgactacacaatattaggcagtggcggtaataatgaaataacaacatctaacatttgctgcagatttattatgtgccaaacagagttgtaagtattgcagcagttagttaactctttagagccatc

SEQ ID NO: 54990 - DNA, 1114 bp, Homo sapiens
tacaggaaaattatggtactataatcttatgagaccaccgttgtatatgtggtcccttgttgattgaaacattgttatgtggcccatgcctgtactatttctctctctctctcttttttctctgtctctccccacctgcccatttcctctctcctttcttcccttccccatttatttgagtattactatagaaatcatttcattacctacaaaggcaactgaatctgtctgtccacataggattggagggcctgaatgaataggacactcatattatataaaaagagttactcctttacttgaagacactcaatgcaatttaaacaatgacaccctgctaggtcgtgtgaaggtgccagtccaggcctggaaaggggagcagggttagggacagcaaggcaatgcatctgctagctgtcacaacagaggacaatgcaagcgagagctggcactggtcacactagtcaaggatgatgtctaacactttggggcaagatgttcaatctaaaattccagctaactctccaataggaactctccaaaaatgcagtcttggacttttagaaaaagtgaaagcagaaatcagagaggtaatagcaaacaccggggtttaggaaacaaaccaggacacaaggctaagctaagaagttaaaacgttcctaccaagatgcaggttggtcacgtcacttaaatcctgtcattcgtcacagtaatatccagatgctgtaaagttgccccaggaaagtacagcccctgccccggcagagggactgagcctggttggactcggcctttttagaatgaggtaatgccgatttatgttctatgctggctggacagattgtaaaaacctgtcattattgcctcttcccccagatagagactgccttgacaccccctttttttttcgagacgagtctcactctgtcgcctaggctggagtgcagtggcacgatcttggctcactgcaacctccgcctcttgggttcaagagattctcctgccttagcctcctgagtagctgggactacaggcatacgccaccatgcccagctaatttttgtatttttagtagagttttagtagagacggggtttcaccatgttggccagga

SEQ ID NO: 54991 - DNA, 1621 bp, Homo sapiens
atggctggattttagaaagctgcaaatggtattgtaccatagagcaggggtccccacccccaggccacggacctgttaggaactggggcacacagcaggaggtgagcagcgggtgagtgagcattactgcctaagctccacctcgtgtgagatcagcagtggcattagatttttataggagtgtgaaccctgttgtgaactgcgcatatgaaggatctaggttgcctgctccttatgagaatctcacgaatgcctgatgacctgaggtggaacagttccatcccaaaaccatcctctcctcctcggtctgtggaaaaactgtcttccatgaaaccagtccctggtgccaaaaaggttggggactgctgccatagaggggcctttgggtggccccgttaggtgttttctttgtgaggtggtgctttccagcctgccctggactctgtggttcatggtagatcattcgtactgacctggaccagggagcactggtaggagtatctgatttctatgaacagtgcttgctggcactgactcaagaaagaagacaggaaggaatggtgaatacaacttccattgagaaactagagtggaaaaaatgtgcaaattatgctaaaattgtaattaatctgggctgtacaggttgaatatctcttcatcctgaaagaaaaggggaggtcaccatgagaaaatgggattgagggaccataagaactttgtcatacctagttatacatttgtttttttctcttagaacttctgaaaagcttgaagccccagaagcaatagaatagagcttttagcatggttttgttgtgaactaaattcccaacagttcacctttagtgcataagcttaactttctttgatggtttgccattcaaattagattactgtggacagtgtccctaatattgtcactaatattatgatacagtatcagttttacagcaggtttgtgcatcatgaaggaagtcagaacgttttagtgagttacaaggaaaatagccatcaaaagtccatataggttactctgtggatgggttggggagccatcttctggtcttcatccagacttgattgacttaaaattgagtatataagagtgtaaaagatggtaagtgataggcttgaggcagagacacaggcctgcagccagaactggaaaaaaacccacaagtatgaaaagtataggcaaaactataaagcagccaggcacggtagctcacacctgtaatcccagaactttgggaagcagagatggacaaatcacctgaggtcaggagtttgagaccagcctggccaacatggtgaaaccccatctctactaaaactacaaaaattagctgggcatggtggtgagtacctgtaatcccagctactcaggaggctgaggtagggagaattgcttgaacccgggaggcggaggttgcagtgagctgggacggtgccattgcactccagcctgggcgactgagcgagactccacctcaaaaacgaaaccgaaaaaactataaagcacagaaatatgggaccatttggtagatatagtaactgaaatcacatcaagttttaataaactaattagtattcataatggcagccctacatcttcaagaaa

SEQ ID NO: 54992 - DNA, 1042 bp, Homo sapiens
gagggtggactgtgctcttggtgaacacgagctgtgtaaggaccataatgcctcttgattagaaattagcttaggtgatttacttgggttaaaaaaaaaagagagagaataaatacaagagatttattggggttaaaaacaaaaaagaaaaaaaaagaaattatctaaggttatttattggcctcttagatcctgtaagctacctaatgtaagaaaagtgggaagtttaaaaaataagtgcttgatactatgggcttaagtctaagttttgctttaaaaactcgtctatacttgtgttataacattactattattgaaaatatctgctttccaggctgaagtgattcatttattattctagttctgctttcctcctttgtaatttgtgataattgtgcttttctttttaatacaaaaaatggataaaaataaaaacttgaaaaggcaaaaacaaaaacaaaaacaaaacaacctcccaactgttctacacatctttaaaagatattagctgctgcctctgaggcttgccaacattaggcagggctatgtttccaggagttttagtaataagaaaaagaggcatgcatggagaattcagggaaatcagttttattggaagggctggagttatcactggccccttgtgccaggtgagaggggtgccgctgaggtgagctctggagcagggctgctggcattgatgccagtgggctcttggtggaatggctaacttcttcattccactgtctcaattcagtacccagatgtatccttttggaaactcgcctgcaaactgtgcacagatttctattgagaaacacatttcttttcctctctactggatgtacctggaattccaggtagagtccacaggaaaatcgagatgcttttagtctgagctattttcctgctcagaaagctctgaactctttgtgtctgtgggagagcaagctgagataccagctggttaatacttggtctggaatggtacaagctggcagccttgagtagaggctaataataccatattgtatttgtaatc

SEQ ID NO: 54993 - DNA, 1076 bp, Homo sapiens
ccaggctgtagtgcaatggcacgatcttggctcactgtaacctctgcctcccggatttaagggattctccctcctcaccctcctaagtagcttagattacaggcatgcactaccacctctggctaatttttgtatttttagtagagacagggtttcactacattggtcaggctggtctcgaactcctgacctcaagtgatccacccgccttggcctcccaaagtgttgagattacaggcctgagccactgtgcccggcttctgttactcttgaataacacttttcagctcctgtggaaaccattcctaaagtgcttctgaagtactcagtttttgtttttcaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgtatgtatgtcttcaactatgttagtttcaaaaaaagaaaactcctgtaaatttctgtaagacataactagtctttaatattataaaacatatttggccaggcgcgttggctcccgcctataatcccagcactttgggaggccgaggtggggagatcacctgaggtcgggagttcgagaccagcctgaccaacatggagagaccccgtctctactaaaaatacaaaattagccgggcgtggtggcacatgcctgtacttccagctacccaggaggctgagcaggagaatctcttgaacctgggaggcggaggttgtggtaagccgagattgtgccattgcctgggcaacaagagtaaaactccatctccaaaaataaaaaataaaaaaaatttaacaactgatttatttagcatcattaaagtctatcccaatgagtatttttttccaagaaaaaagcttatttttctgagcattcgcattcttattttaataatttgtgataa

SEQ ID NO: 54994 - DNA, 1013 bp, Homo sapiens
gttatttgtttgttttgtttggtagagatgggatctcaccatggctggtctcaaacttctgggcttaaggaatcctcccgccttggcctcccaaagtgctgggattgcaggcctgagccagtgcacccagtctggtccccagattttaatccttcctctttaattgtcaataatggcactatcaccacttaccaacttagagtcagcaaattaagggtcactttagaatttcacttaccatacatactttttctccttcctaaataatcactgacaggaagcagagaagggaaggcagtcctatacttacagcttttctcactattttttccctttccttgttgaagtgaggaaacatggctacattgaggctgtgtacagacgtacaaattaaaaatgtgagcttttgttctgcattctttgacagtgttttgtcttgccctcctatgctcactgctattccttgatgttccttgctctcttcttctaacctcaacctcagtatgatttagccagagaatcagtcaagggattgatggatggtagaagcttaaatgtaagtccctataatatgtaagtggccaggattttgttagtttgggttagttaacaaagacagcagctcagttttgatttgtccctcttgttcttcagccacgaattagaacctgtagactatgactagagagaattgaatcaagtgatcaattaagtttcacgcatcaggatgttccatgttgcagatgacagaaaactcagcccaaactgatttaataaaggaattttgttggcatacataagcaatagtccaaagataggtcaatcttttagtcatggcttgataagggctcacactctgtagttaatcttcacaataataataaatgaaatatttgcatgaaaacttaagaattaatgaaattgcatagtttgttctcctcacctcagagtcagacttactgcgtttcacatccctgttcccttggtagctattttgagtgtctggtatctta

SEQ ID NO: 54995 - DNA, 1032 bp, Homo sapiens
agcacaaatggactaagataggtgaatacagtagtgggcaaagatatgagatggaaagaagctgggccttggcatcattgagacttctccagtctgtccttcctctggactttactattcgatgggccaataaactccttaatgtttaagccagtctaagtcagattttcagatttgtaacataacaaaatatacttgaaactgataaaaatggttctatcaaataaaaaacactgtattttcacattaacaattttatacacacttttttttttccatttagcaagtactcatgagcatctgttagcaacaaggtgggttccctcctgatggttgtatggctaccagctgcagtgcttccttattcacttgaggggtgggatggggggaaggagggtgggaggaaagaacaaattgagtgtttgtagagtttctatttcaattaaagtttgagagtccaacacatttttgtgtaactttaaaaattacttatgaaaataatttattgaaaatattgaccaaactaagatgcatctatttggccattattttcaaggttctgaaagcttttatgctctgaagcatttgttttgtctagggtaaaataggatcatttaataagaagatactgaactcttgctgtatactgaagatacagtttttgtccgtggggagttcattgtctagtggggagaaagacatgtaaaaataataatgatgcaatgacagaaatgctataatagaggtatgtactgaatgtgatgggattagaggaaggagccattaacttggtcctgggggagtatgaatgtcattggctgctttccaagctttcactgtaatgggtatctttatcagttacttgtacctcctgtagtgtactggtattattgccagttttatatatcctgtaatacagaagtcctctgagaatgcataccttgctgatgatattgctatagtgatatgaagttttatttaatatttagagagtaaaatagttactgcaaagaggcaaaagattatattatg

SEQ ID NO: 54996 - DNA, 1049 bp, Homo sapiens
tctgctgttttattttatttattattattattattcttttttgagatggagtcttgctctgtcgctcaggctggattacagtggcacaatctcagctcactgcaacctccgcctcctgggttcaagtgattctcatgtcttagcctcccaagcagcttacagacacccgccaccatgctcagctaatttttgtatttttttattagagacagggtttcgccatgttggccaggctgatcttgaactcctgacctcaaatggtctccccacctcggcctcccaaagtgctgggattacaggtgtgaaccaccatgcccagctggcttctgctattttagattgacctttctacagttagtccaaattaagaaggtttaatattatatatgaaagtagcacactaaggaaactagcattctttctttttaagaatcaccaatgttattttattaatattttatattttgtcttttaggattatatattcatcaaacagaaacataaaaaactatgaagaggaaattcttaggaaaaagataatggagattgggatatcacaaaagcaacttgacatcagttttccaaagtgtgaaaactcatctgattgttctcttcagaagcatgaaattccagaggatatcagtgacagagatgatgatttcatttccaatggtgaggtattttttatggagttgtatttatagccgtaaaaataattatattctgatacagttagagaaaagcatacttcaaaaatatgctttactgattttttttttaataagcatggagaactgaaaacactagtattgttaactcccagtttttcccaagtaattggagatagggttattatgaataaatccatacataactcacaattctctttttagccattatgcctctacgttattgtccttattataatctataccaataaagaagctttggcagagtcaattctgtttcacaccctaacaaaaatggtagcctagttttatgcatattaaatggttaagaaatacataaatactataatacatatggca

SEQ ID NO: 54997 - DNA, 1049 bp, Homo sapiens
taaatacattcttagagcaagaatactttaaaaattagtcctactaaaatttccttctctagagcttctctgcataatccaggccattattctgcctggagtagtgaatctagttcagctaacattaggaagtattgaatagcagtgtactaaagcagcagcaaggcggaaattagggcatcttgatagagccagaagcagcattaacagttgaaattaaacttaatcaaaaggagaaaatagtttttggcatgttggaaaataacaaatttggcaaagatttttaatacaccataccatctacagcattatttttaaacctgaggcatgtgtcctaattaagtaggaatgttttctaagtttctgttttaaggtcagagtaattgtttaagcctcagatgcttctaattttactaaaatggaaatggctgacatgctgtgttcaagtcttctgagaagtagacacaaagatgggattagactttcaagaaatgtattaggctaaatgtatgtgagagaacatagggagaaagccagagaaaacagagctgctagactgcaacgctgatttgactctgagtgaaggagaaagagaaggaagttagatagaagcatcttagactgcagtggagttccaagaaaagttgggcaaggccattattggaaagttcccatgccaaaggcacccatcagagaagcgcctgttttctagggctagacctgccttattgtccttgctggcctcagtcattgtcaggaagtagcttctggtgagatgaccttgtgacctaggtggaataaatttccgagtgctgtagctgaagctatcagtcattatgcagtcaaagattagaggggtaggcccggtgcggtggctcacgcctgtaatcccagcactttgggaggccgaggcgggcggatcatgaggtcaggagattgagaccatcctggctaactcggtgaaaccctgtctctactaaaaatacaaaaaattaaccaggcgcagtggcatgtgcctgtagtcccagttactcaggaggctaaggcag

SEQ ID NO: 54998 - DNA, 1309 bp, Homo sapiens
ctggcctattattttttaaatagaatttcatagttctgtaatgtaggcatttatttccattatgatttacatgtaatgtagggatatatttgggagtgacagcaagcatttttccatctgcgtgcaactggctctgattattggtcacctctcctaccctttcccaggtcgtttaaattggtcatggtaggttttttgttttttggtttttttttcattgatttgaaaaggttttagattgttactaagtatgaagtgtaaatctgggaaagagccttgatttacactttagtatgagatagaaggccaccttgttaaaaatttttaaatttccaaaataatccatattaaattagggtttgctgatcagtactttgtctttagctacctttttatatttaaaaaattaaatatcaattatgtttttataagcttaaaaaattaaagaaccttcaaagaaaaaaaaagacagcaagggcattggaattaatgttttaaacaatcaaaatgcttagttataaatcccagcacttcaggaatagggggattgcttgaggtctagagtttgagaccagtctggacaacatagtgagaccccatttctacaaaaaatttaaaaatcaagttgagtgtgatactgcatgcctgtagtgttagcttcttgggaggctgaggtgggaggatcatacgtgagtctaggagttcagggctgtagtaagctatgatcacgccactgcattccagccagggtgacagaggaagatcctgtctcttaaaacaaaaaacaaaaaaaaaacccttaggtataaatataagcttataagttttattatgtagtaatcctgcctatgaatacaaacaaaacaaatagattattgtgttttaatacataaagatgaaaattttcataaaaaattacattttgaataatatgtaaatgtttacctgtgtttctcccccctcttccctttagggccattttgagtgccagatctagttattttgctgcaatgctgagtggctgttgggctgaaagctcccaagagtacgttactcttcaagggtaagcatatttttacagggccatttgactgcaaatgattgtaaattgtatttcatacaaagcactttttatgaatctgatttccctggatgttcaaggaaatatttctcatgtagaattcaacaaagtacattttctgaaacgggaagtaatagagagcatttattaatagaggtattgtgttaatctgcttatgcttctgtaacagaatatccaaactgggtgatttaaacaacaggtatttat

SEQ ID NO: 54999 - DNA, 1138 bp, Homo sapiens
tccgtttgtctccaaatggacttcttataaaagtttagaaattggcagtttggctgggtaattttaaatttagtgtgatatttagcaacattatttggcacagcataactctcgtatttctccctggtcctacagtaaattttctagatataaaatgtatattttagatataaatgtatattttagagtttttaatcatcagtgtcttttatttttataatcttaatttttctcttcaaaaaatcatattttaaaattaggctgggaagcaaaattaaaatatttatttttaaatacaattaatcagtggccattaattaggtaattacaaattattggcattctgtatttgttcgacaagaatggtttttaaaatgtatcatatttattactattccatagagcatttgaccttgtaatgtcatagttgatatgaaaaggctgtggaaggtgttcatatcaagggcattggtgttttaaaataacatttggttgaaaagatgagattttttagctttgtgttcatttataaaattttgttattaataagtcttcataaataacatgtacccaacgatcttaaaaatctaaatgatgacatcattgatctagcttaggagtaagtagattctgaaaggaataatgactggttgctatgacaatgtggctctcaccagctgctgatttgttgcttgaacacagggttttacgtgcaagatccaggctctgcgtgataagctgtggatcttcctggttcagtctttctatgctgttcgtcacacagaaagctggaagctgatgagcacagatgatcaacagaaaatccaagcaggtacgttagccttgagatatttcaattcttatgtaatgatcattgtgacagcagatattttgagggcattctgataagtgaaaaggttaacatttgtgtgcttctgttggataataggataactgaaactggtgctcatatgtttaggcagttttaataaatcatgctttttagctgttcttagaaaatgaaactcatttcctttatatatatatatgtttctaatcttactatacattagcaacaatgttctaggcaaatttgcttacaagcattcttgtgaagagattaaaagtgtaagaaaat

SEQ ID NO: 55000 - DNA, 1016 bp, Homo sapiens
gtggctcatgcctgtgatcctagcactttgggaggccgaggcgggtggattgcctgagctcaggagttcaagatcagcctgggcaacacggtgaaaccctctctctactaaaatacaaaaaaattagccaagtgtggtggcatgtgcctatagtcccagctactcaggaggctgaggcaggagattgcttgaacccaggaggcagaagttgcagtgagccaagactgggccactgcactccagcctgggtgacagagcaagactctgtctcaaaaaagaaagaaaaaagaaagaaaaaaaagaatgacaatatgatcttaaaatattatcctagaatttctaccaacttaaaaattttctttgttccctttcatatcaaggttggttctaaggaaaatgatgaagtaggtatgtttatcttcagtgccattttatttgtccctttttagcctatttcagctatttttaggatcccttttccttcgcttcctatagccagccagtgctatactagtatcttatttgtccaaaaaccaagctttgcagatgtagtgtattgatgtgctgtgcttcctaggagcttttaaaaaaaaatttttttaaataaggactccaagaagtaaaggattcttcccacagaggattaagtctttaatgataaaatttctggcacttggaataaggttgaagagagaatttttattgaaaatctttataatgtccctcaaattatgctatatagatgacttcggtgtgaggttaaaaaatgagctcaagtcctgattccatccctcatcagcctgagacctggggtaaatcacatacctactttaatcctcaatttcttgtctaagaaatagaaacagccacaggagctagttcatgggactgttgtgaggattaagtgggatgatgtatacaaaagatgtagtataaaacatgggagtaagccttctaaaaaatcatggatattatcattcctcagggcatcctgaatctttatagacattaatctc

SEQ ID NO: 55001 - DNA, 1073 bp, Homo sapiens
tgatggattaggagcatctggacattcgtcaagtaccaatagaaatagtataaataaaactctgaagcaagatgatgtaaaggaaaaagatggtacaaaaatagcatctaagattacaaaagaactaaaaactgggggaaaaaatgtttctggaaagcccaaaactgtaacaaaatccaaaacagaaaatggtgataaggcacggttggaaaacatgtcacctagacaagttgtagaaagatcagcaacagcagcagcagcagcaactggacagaagaatttactaaatggaaaaggagtgagaaatcaggaagggcaaatttcaggtgccagacccaaggtactcacaggaaacttaaatgtgcaagccaaagcaaagcctttgaagaaagctacagggaaggattcaccatgcctcagcatcgcaggaccctccagcagatccacagattcaagtatggaattctcaatttccactgaatgtctggatgaaccgaaagaaaatggatcaacagaagaagaaaagccttctggacataaactatccttttgtgattctccaggacagatgatgaaaaacagtgtagatagtgtcaaaaattccactgtaggtgggttttagcactgtaatttttaatatctcctgacagttaaatttccttcaaaaaacaaaaacctaaacctgtatttgggcttttatttagtttcagatgccaacagaatacttatgtatatgtacttatgcaaacagagaaaatggtagtccttcccactttaatatttcattttgtttatagtgtctaaccagtaaacttacacgtttgttacatatttaatgtattctctcttatgactcactttttcttaatttatagccataaaatctcgacctgtttcaagagttaccaatggaacttccaataaaaaaagtattcatgaacaagacactaatgtaaataacaggtaggtcttcattcagtgttttaacctatctgttagctttctctcaaagttaattatatactaactgctagctaaatatttttaaaatatcttttattttttgttaatgt

SEQ ID NO: 55002 - DNA, 1088 bp, Homo sapiens
cagcaaattcttggatagtgatgtaaaatctcaagaaagaccatgtcacttggatcttcatcaaagagaacccaattctgacataccaaagaacagctctacaaaatctctagactcctttcggagtcaagttctgcctcaggaaggtccagtgaaagagagccattctacaactactgaaaaagctaatattgctttatctgcaggtaatgtacagaaatagaaatgctaaatgcataagaaaataagtttataaaattttaaagttgtatgaagccctgaatgttatattttagtcagatagaataattacttaagcaacagattaaaattttaaatgaaaaatgtcttaatatgaaaattactcattctttattgttcacttaaaatcctaatgaagaagtaatatctagtaaaaattttgattgttatatagagctaacctactaagagattttaaatgaaagaataaaaagaaaaacttagtttgctgctatttagttatttatgtataatttaacacaagaattcttgactattagaaattttattatacattggatatgatttatagacttgatagtatataagaggcctgtgcaataactctagtaatatgtaactaaaagcactgaactattttaacaactagattgattattacaatttatatacattttacagagattaaaattttcaggatctgtctattctaaagttttcaaataaaaagataaatttcctaagagattatatttagaagcaatgataatatatgaaaaaagcccaggcttatttcatattgtttagatgattttctgtctaattgttttgtgttttttgtcttccttattatagtaattcagactaatgacccacatttaaaatatgcaatagtggctgactgagtagctattgtgtattataactaagaaaaatactgatcagtagtttcctgttcagcaaaatcggaagaataaggaggtctttaaagttgtactttttcgtttgtttgtccttgcttgcatcttcctttgcatgtgcaatatacaaataagcctttaggtgaaatgtatttatccctgcct

SEQ ID NO: 55003 - DNA, 1100 bp, Homo sapiens
gcaatgttaagtgttataataaagctgagtataaagtgtaatttggagtgcttggatgggctcctttgctctctaaggattagtaggaattcataaaaaggcacactcttggcagaaaaagttcaaaggcagtggggaattctgttctgtatggctagagagagaaggaaatggattggaagggcaggggatgaagttggacaggaaagtagaatccagagattaacaggatcaggtttgcattttagatgactggtagcaggatgtaggatggaatggagcattgtgacaaggcaaggggactaatgagtcgattgcaataataaaagcttgaatagggcagtggcagtggagacagaggagtggacgtgtttgagggatttaagaggtggaattgaaacccttggtgagtctttggatgtgggaaatgagagatgggaatcatcttaaaagacagttttctcactagggtgcctgggtggttgatgatgtcattaaccaaaaacaggagcaagtgtaggagtgaagatcagtttaatttgggacacactgagtttgagatgcctggggggacattcaggaggctgaggacaaaatgctgtggaatagtcagaaaaagaaaagcctgagacagagactgaaccggcacattcagaagtagaagtaggaggccaaggtgaggagagattaatgttttgtttgttttgttttgttgaagcagggtctcagtcacccaggctggagtgcagtggcgcaatcatcactgcagcctcaacctctcgggctcaggtgatcctcccacctcagcctcctgagtaactgggactacaggcatgccaggctaatttttgtattttttgtagagacagggttccgccatattgcccaggctggtctcaaattcgtgggctcaagtgatcctcctgcctcagcctctcaaagtggtgggataacaaaagttttttttttgctttttaaaaaattcaatgttagcaagagaatgataagtttgggagcttcatatgatgctttagaagtgtaaatttcctttctgataagcagctaagcaagctatatcaggaatgtagctttttggttgt

SEQ ID NO: 55004 - DNA, 2397 bp, Homo sapiens
tcccttcttgatttggtactttttctcccagagggtgcagaaacagatttactgcaaaactcagataggtgaggtgaccattaccaaagttcacatagtaaattcagaataaaatgtgaaacatctgcttagggaacctaaagtaataaaatgtcttttcctgtgattttatgatctatggctaattcattaagttacataaagatttttcatatttaagtgatttgataatgtgtagaaacaaaattaaaacctcctctttctagatgaatgaccagcactatgatttgatagcttttatgtacccagcattccatagaaatttgcaatgacagcacttgtgacttaaaactaaaaatctgtgtatgtaatttatgtgtttaggttttgttgttttattgttttccaggtcattttttttttcatatagaacatataatttcagtttcagtatactggaatggatattgagaaatggtttaaagcatttaaaaagtaatcttaaaattcagaaagcaagagatgatgctctcaaatattaaagataacaaggctttctttaaacaaggatgataattttcacaattgtatgatttaaacaaatggaaaacagtgataagttattactactcaaaaagatattaatggaaatagtttctattggcaaacctaattataaaaatatgaccaaagttttagcttattgagattgctgttgactatataaaaccatactgtaagtaacatatatttttaattaacaggattatggcttcattaaatttattgaggtatttggttatcaaagataatgaaaatgacaatcaagtaagtgaagtatttgaaaagaaactgtgagtatattcaaaaggcataaggaatgtttcagatattcagtacctaaagccaatatttaatatcttacccagatataaaggccgggaagagtgccaacaattattctgaaacctgaagttaattcccaggagcatttaccaccccacatccagctttcctttccctttccatttcctattgtacgtctgctttcttgctgaaagcacttagtcctgttgggtggataagttgcaggtcctaagtcaactaaccttgtggagctcaacgtacatatggtgtcttgttcagtttcctccacctatagctcatgagctgtataaaatcatctgatattttaatattgcctcatcagacatgacaaattgaagcattttcagcactaaaacagaatttgttaacagcaccttttagatatgtttaggaagttggattttttaaaaatagcacatcattagaagtattcaataaatagagaagtattcaataaatagaaaactatttgagggagatttgtcatacagtaaaattatatttgctttttatcttctctttctaccctgttctgatcattgctttccctatatgtgtcacctctattagctagaactacctgaatcatgtgttgttaattggtttttttttagtaattcatttttatataaagatgccaaagaaaattttttttaaattaggtaaatcgtgatttgggatgaaggtttatgagaaaagtagcagtctctttccttcctgacagatctatagtagattcagtgatttgaacccccgttcatccctcttcagctgaaaatagctatttgccatcattgactagtgcttactctgtatcaggtgctatttttttttaacattttgttgtgaaacttttcaaatgtacagcaaagttgaaagaattttatagtgatcattggtttacccaccacctagagtctatgattctactgtactaacttcatcatgtatctatcactccaccctctgtctatcactccgtcagtctattttttgatgtatttcaaagtaaactgcagacgtcagcatactttctccgaaatatttcagcatgtatttcattacattgattaaatatttgtctgtagtttttctttgaagtaaaatttacataatgaaatgttcaaattttaagtgtatattcactgaattttaactaatacatagatctatattactcaaacccatatcaatatagaacatttccagcatcacaagaggttcctcataccccttcctagttaattctgacctcgttgtgctactcacccctgccagggacaaccactattctgcccaagtgctgtatatcattcattcttcagagagcgtctcgttctcttgcccaggctggattacagtggtacaatcatggctcactgcagcctcgacctcctgggctcaagagatcctcccacctcggcctcccaaagtgctggggtaacttccaggcatgggccaccatggaaaaccaagaaaagtactctttatttttcacttttcatagat

SEQ ID NO: 55005 - DNA, 1080 bp, Homo sapiens
ggcatctttatataaaaatgaattactaaaaaaaaaccaattaacaacacatgattcaggtagttctagctaatagaggtgacacatatagggaaagcaatgatcagaacagggtagaaagagaagataaaaagcaaatataattttactgtatgacaaatctccctcaaatagttttctatttattgaatacttctctatttattgaatacttctaatgatgtgctatttttaaaaaatccaacttcctaaacatatctaaaaggtgctgttaacaaattctgttttagtgctgaaaatgcttcaatttgtcatgtctgatgaggcaatattaaaatatcagatgattttatacagctcatgagctataggtggaggaaactgaacaagacaccatatgtacgttgagctccacaaggttagttgacttaggacctgcaacttatccacccaacaggactaagtgctttcagcaagaaagcagacgtacaataggaaatggaaagggaaaggaaagctggatgtggggtggtaaatgctcctgggaattaacttcaggtttcagaataattgttggcactcttcccggcctttatatctgggtaagatattaaatattggctttaggtactgaatatctgaaacattccttatgccttttgaatatactcacagtttcttttcaaatacttcacttacttgattgtcattttcattatctttgataaccaaatacctcaataaatttaatgaagccataatcctgttaattaaaaatatatgttacttacagtatggttttatatagtcaacagcaatctcaataagctaaaactttggtcatatttttataattaggtttgccaatagaaactatttccattaatatctttttgagtagtaataacttatcactgttttccatttgtttaaatcatacaattgtgaaaattatcatccttgtttaaagaaagccttgttatctttaatatttgagagcatcatctcttgctttctgaattttaagattactttttaaatgctttaaaccatttctcaatatccattccagtatactga

SEQ ID NO: 55006 - DNA, 1142 bp, Homo sapiens
ttatgtatgttttaatgattttatattcattacatttagtttctgttattcatacagtgataatatgtattgttttgaatctaagtcctaaattcttgagatttccaaactgcagagtcattgagtctttttttgaataaaaagaattggaaagattttacagaataatcaactggaatatatagcattggttatatcaggtttagttagtttcttagcacttgctgttgaagatctattgttttgaagttaggaaataatccctgagtagatttattttggtcagatttagtggccttagccaaaccgaaagacagatcaaagatggattaaaacttttgatcaagttcttcaacagaatttctccttaatgatatgcattttaaaagtgttaaaatttcagtttttgctgtatttttcataagatgaagtatcattctaaaatagtttacaaattcatgataaattttaatattatttttcagaacagaagagtctgttatctccaaaggattggtaagatgtttgttcccattataacttaaatacatagttatgtcaacaaataacagctgttgacttcactatatatgtatctgcatatattttaatctgtaggagctgctggagaatagtttattgagaatagaagacaatagtctactttaccagtacttagaaatcaagagttttcttactgtacctcaggtaaataaaatatgtattctaatattgaaaatagccctttgcctgttctgaacttaaagtaaggtcttttctgattcctttcccactcttttctctgcaacctttgaaaactctggtgtaatgctgtccagtagaactttgacaatatgaaagccactagccaaactgaacacttgaaatgtgactaaggaactattttttttttttttgaggtgtagtcttgctgtgtcgcccaggttggagtgcagtggtgctatctcagctcactgcaagctccacctcctgggttcattccattctcctgcctcagcctcccgagtagctgggactacaggcgcccgccaccacacccagctaatatttttgtatttatagtagagacggagtttcactgtgttagccaggatggtctcgatctcctgacttcgtgatca

SEQ ID NO: 55007 - DNA, 1031 bp, Homo sapiens
ctgtccatgagccttctcataacatggcagcttagttctttaaagccagcaagggagagagtcagagagcaaagtttctgactctcagggaaggcctggaccccctttaaaaatatacctgattaagttagggccacccaactcaaaatctactgatttgggaccttaattacatctgcaaaaaccccttcacttttgtcatataatctaatcatgggagtgacatcttggcgcattctgttggttgaaagcaagtctcataggtcccactcacgctcaaagggagtgattacacctccccttggtgagaatgtggagtttgaatacacggggtggggggcattttagagtctgtgtgctatggtttccttttttatccatttcatagggttttttatcagcaattggacaccctttccccaaaatgatttttaatcatggaaggaaaaagagaacttggaattaccttgaatttgaagaagaagaaaataaacagttagcagactcaatggcttctctggcatatctagtatttgtacagggcatccatattgatcagcttccaatggtcttaaggtaagagttagtgtttggtttattcatgtattctaaaaggaatttcataaaattctcatttatctaatgtccaatatatgcatattaacacactaatacattttaaataaatagtaaaggctatttttaataagaatgatcccagctataatctgttaaagatagcagtagacaagtaatgaaagtggggagtgttgaaataggtgtaagggaatggtggggacaagaatcagaagatgataaacagggcttggttttgaagcttttgagaccaccctggaactagccaggtacccaggggtatcatcatcttttcactggattactgctgtaatcctgagtggatttatatatctacttttacttccttttaatttaacacattctcaacataccagaaagcgaagccttaaaagaagtcccttactgaaaaccctccagtggctttttattgc

SEQ ID NO: 55008 - DNA, 1029 bp, Homo sapiens
attgatgcttgtcttaatccatttgtgctgatataacagaatacctaagactgggtgatttataatgaacagaaattcattggttcacagttctggaggctgggaagtctgcaattaaggcgctggcatctggcaagggccttctagctgtgtcataatgtggctgaaggtaaaagggcaaaaggcaaaagtgggctgaacttgcccttttataacagcattaatctcatccgtgagagtggagcccccttggcctaattcccacctccttatggcagttaaatttcaacatgagttttggagagcagagtcattcaaaccatagcagtgcttatgttatttttcaagtaaaattaacttagatttgaagacctagggattttatacttggaagtgttgatttcatagttacctatttcttatgccttagttgtttcaaaagcttgaaatgccctttgctgacagcacaattctttgaacagtctgaagaaggtggaaatgatcctttcaggtattttgcatcagaaataatagtaagtacagctaatttaatctgctataatcttaaatgttatcccactatattctcagtactgcacatgtaaattgatacattcattaataaagaaatgtgtattttttgtagaacacacataaacaaaagatggaaaataaaacagcaataattttattatccaaagataaatattaacatcctccaggcttttttcttatatacttatttataataatacatatatataaatttttcaaagattttatatatatatataatcttgtaatctacctttttcctcttcaacagtatattatgaatatttttccattggcttaatagtgttccatggtatggacttagtataatgtatttcacctgtgccatatagttcaacatttggattgtttctaattttccattattgtaggacaactccaagttttctttttttaactgttaagtctatgataagtaacctagtaattaaatttttgcatacttttcaaatt

SEQ ID NO: 55009 - DNA, 1766 bp, Homo sapiens
cactgccaattagactgtgatgtgtcatcttgattcaagagttgttaaaatgtgggaggaggaagtgtcttataattccacatttgccgaatttcttgtcccatgtttagcatacttgatgagcgacaacttgatctctgttttagtgattcagaaacttcataacaaggcatattcaattggattagcattgtctaccctttggaatcagctatctcttcttcctgttccatactcaaaagaacaaatacaaatggatgactatggcctttgtcagtgttgcaaggccttaatagagttcactaagccttttgtggaagaagtcattgataacaaagaaaactcactggaaaatgaaaagttaaaggatgaattactgaaattgtaagtataattttaagaacatctcacagtggacttaagtaattgatagttcagttattttatgtttcttcactttgtttgacatgtaaatagaaatctagtttcagattttgaattttagaagaatgtggggttcagttgatacagcatgggaacttgagacatttatattttaaaaaattataggccgggtgtagtggctcacacatgtaatcccatcactttgggagactgaagtgagaggattgcttggggccaggagtttgagacgagccttggcaacatagtgagacccccatctctataaaaaaatttaaaaattagctagatgtagtggcatatacctgtagtgctactgcttgggaagctgaggctagaggatgggttgaatccaggagtgtgaggctgcagtgaatgatgattggccactgtactccagtctgggcaacagagcaagaccctgtctttaagaaattaattaataaaataattataaaaccaaaatccattcatttactttatattcttctttgtattgccttattcatcatagtaggtgaataatgaaagtgggggaaatagatacatgtagctcagggtgagtgtgggaaatagatataggtagctctgtggagaaattgtgttttactctttcaaaggaagcagcagaaagaccaccagacagaacatccaactggaccacaaaaatagtggtagagtatccacccaatagcattccctccatgggtactatagactaaacatctactgttcaatatggctgtagcacttgacatatggctggtccaaattcagatatactttaattataaaatatcccctggattttgaagacttgttatttaaaaaaaaaaaacagtaaaatacctcaatttttatattgataacatgttgaaatgacaatatttcagatatactgggttaagataaattattaaaatcatctctcccattcttactacttttttcatgtgtctactaaaagatcttaaattatatatggggctgtgttatatttctattggacagtgatagactagattaattacatggaccagtaatttttaaattttggctacttgggaggctgaggcaggaggatcacttgaggccaggagtacaagaccagcctgggcaacatagcaagacctcgtctctaaaaaatagaatataaaataatattttaattttggagactaatactatttttagcttcctacttgtcaggttaggacatttaaaaaaaaatttacagccagacgtggtggctcgcacctgtaatcctaacactttgggaggtcaagctgggagattgcttgagctcaggagtttgagaccagcctaggcaacatagtgagacc

SEQ ID NO: 55010 - DNA, 1661 bp, Homo sapiens
ttaatgtttattgtttggtaagaaagcttttggttcatgaaagtacatgcagaaaggaactcgttggagaaaagacccagtcttattgattggataggcaattccatttcaggatttcccaaattttctggataaaagaattgtctaacctcatattaacctcatatcggacccattgattcagcatctccagggagagacctgggaagctatatcttaacaagtagccttatcgtatagatgtggaatacaagctttagagaggtagttcaaggtcacatttatcttttggcaacattggaactagattaaaatctcagtcctctttcctttgtggtatgttccctaaaagaaaatggaaggcctagaatacaagtgattaaaattgaagtaggaatagggtagaatacagatcagttgtgactaacaaccttagaaagcgaccctgggtaaaaggctagtagagtttacagtcaatatttgatggccaagaaagataaattctgagaaaaagtatattataagaaactgtttagtgatcagtgcaaatatacccaaatatatattggaaggagagctccatctgtatgagttattgactatgggagctgggagcttttaaaaaaccagtcaagtgagatgataagatatggccagtcagaaagcaatgcaaagttttacctgttcaaaaaatacaaaagagattccagactagtctaaataggcttgcagcatgggattgaaaggtcccacctgctggagcccctgagaatctgttaaggcaatttcagagtggacaggtgaagctcaaaggaaacctgagcctaaagatccattgacttcttgctttttagttttatagttacttgaccatcacagattctgtgttttgctcatgcatattttttcaacaattgtataaataattttaatgttaagcaaaaacataattgtataatattttgtcgatacatgccttcttaaaaatagtaataatgtggctttaaatacaacttgtattaaacaggttcaattgtgaatatttttatagttatgcaatccaaaggaattattgttgggtttgcttgaactgattgaagagccctctggaaaacagatatcccaaagtattcttcttttgcttcagccattacaaacaggtaatgagaattttgatatcagagtacttcttgttgtatctctaaatgccttgatggttacctcaaaatgtcaatactacaccaaagtaaagtttacagctaattagtgagtactctgcttaaaccaataatagcaatgccaatgtgaatactgctgctcatagaaagattatagtatctggccagagtgggtacccagtaaatattctgttgaatgtcatactatttttcatgtgctatattgaaaactatacctttttgcctaaccttcctatctgctgcttaaatctagaattttctctctaaacatgtttcaagggttacctctgtggtgtctgcagtactaaatctgatagcattatggtagtctggaagagtatcaggcaaggcattgctcagcctctgctttgggaggttggattgggcatagcaaagctactactgaagaatgaaacgaggagatatgggatgataaggctccatggctgagtgcagtaacag

SEQ ID NO: 55011 - DNA, 1048 bp, Homo sapiens
tttcaaaaataaaagatactgttgtcatttagcttgtgtatagctatagcatcacttcttcctcatgcctcagaattatttcatttaactatataatctacaaagatgcagagactactgtggcagaaatttttttaataataactttttttttgaatgctcactatatgttgagcacttctctaagtgattttgctttattttctcctctaattctaacctctaacttatgaggaaggtactattgctatccctgtgttttcagataagattgatgaggcttagagagctgataaatgaacttttctattaaactaggaggaaataaccctctcatttcattttaggggaggttcattacacctgctcactacagtgatgtcgtggatgaacgttctattgtcaaactctgtggttatcctttatgtcagaagaagctgggaattgtaagtaactcattttttttaaaatataggcttttattattttcatttagcaaaatactttgttgtaagaataagaaataaaacctaaggtcatgaactaaaggcatggattggccaatgatatgatatgtagatgacttaatcttgtaacataacgttcatgtttattatttggattcttttgtaagctgtactttcttttctttaggtaccaaaacagaaatataaaatttctaccaaaaccaataaagtctatgatattactgaaagaaaggtgagtttaaaggctttcattgtggcaattaattttttttctttactaaccactatcctaacaaggcatggcaattaatttttaatgatattaaataggattctaaaagaaactttaaaatcttactggttagaaaatagtgatgttaaaagtttgattttatttgtaaatatttcaatcaaggtattaaaaatttttttgcttaagcttcaattaagacttgaacatttaaaagtgcatattggcacaaatctgggcaaataaatcatggaacagaatagagagtcagcagcagactaaccacatatgtagacacttgatatatgac

SEQ ID NO: 55012 - DNA, 1514 bp, Homo sapiens
atttataatgttcttttcagtctttttgcagcaatttttgttatcaagcatctaagttttttgaagcacaaattcccaaaactccagtatgggttcgagaagaagagaggtaatttaagtcattgtgtatatacatttgttcatatattctaataatttgtttctgctttttgagattagctgagagtaagtctagttttctgtaaaaagttaccattttatatactttatggggaaatggttatattttaagcatagctattaaggattttacacttaaaatcagaaaatgcatacatacaaatgttatttgtttgttgttttagctttaattgcaaaatcagaactttaactccagtgtcctgtgatgctagttatgtctgtgaatcctgttaatataataatcctggaggaagaatgttaaattttttcagaagttactgggtcttaggatccaggtgaactctgctatgagaaaggttagaaagttcaggttcatttaatctttataaaaatcagtacactattttatcaatttaaagacacaattaaaaagtaatttttttttttgtaaaaagagtttatgggcaatgctggagtttagcctcttgggaaatgatttaaatactggcaatgttttactagatgctaaagtcaagaaaattttattattgagggtgaaatggcatgataatataaaggtaacaagttatccttatggtaattaaactgtattgcctagaaattccaatgaaatgcttaatgagataatgcccaaaataaattcatgtttgaaagagtgtattatagcaacacaaggcagtgttacttgtggtaaggtaggacctatgctaaataaactaatgacctaaacataatgagatgcaggttagctaaaaagctctggctcaaaaaaaaaaaagcaaaccttgaagtcttttctgatgcgtaaggcgatgtaacaccactctcaattcaaataacatcaattatgctgacaacagcacctgtgatggcagacacctctgcctgccgatccaatcctgtgtggtttaggatatggaaaacttaacactgtgtggcccttgataattgagttaaacataattaagactaaattgttcatcatttcaccaccagtctgccagcttccttgttgggaaaataaaagactctggcattgttcgacatgactgggaagctaagagtacttttttacttatcctttttctcctttcttaatatttctgtcactagagctgcccagtacttccccagtcctctgagagcaacatgttttattccccactgaaaccagtgtttcctcaagttatccttaactttgcttccaaagatattttctctacatcttaaatttaaccctttgtgccaccctcatatctacctcaactgcttcaaaaccatttaccaaattacctttcctgccatctctgttttcttcaagcataggtattggtccttcctttagctaatttaaaacaaatcttccagcc

SEQ ID NO: 55013 - DNA, 1005 bp, Homo sapiens
aagagaaacttacttaaagttttgaaggagactttgattgagtggaagacagaagaaacattgaggtttttgtatggccagaattatgcttctgtgtgtctgaaacccgaagcctctctggttaaagaagaacttgatgaagatgacataatctcagatccagatagtcatttccctgcctggagggaatctcagaacagcttggatgagtctttaccttttaggggctcaggtacagccattaaaccactgccaagttacgagaatttgaaaaaagaaactgaaaagttaaatctgaggatcagggagttttacagaggacggtatgttttgggtgaagaaaccaccaaatcacaagactcagaagaggtatgtcttacagacattgagtttttccagatcgttaacatttggaaaactcaccacagcaaatcttggagcaggaaggatattgaagagttaattgttaaattttcaaatagtttctttagtcattctgccttttggtttacagtgccatctccactgttggcattactattttacaaataagttgacgtttacccctagcaaattttcatcagtgtgcaatatttttttctaatgtaaaaatagcctaaaatggtgggacaaagttttccctaattcttcatacaataaatgaagcctctgaagaggcttgctttttcttcttcggtattctttcagatttttacatggggtctgtgtgtgtgtgtttaatggaagtatatgccatggaatagacttggtagttacattggaaaatatttagcaagcatgtccattgaaaacattacagatcaaaatagtttgtaaaagagacttattgggaaataatggacaaagagaatggaaagcacattcagatagacctagatttgaacatctgttgtgtcatttactagctgtatgaaaaattagtttcttggtctgtttgctcatctgtaaatggaactattaatagcttctcttgctcaattgtta

SEQ ID NO: 55014 - DNA, 1016 bp, Homo sapiens
cttagtatcagttgataaagaattttctcagtttttctttgtcagaaaattattttactttcacttttgaaagatatttttctatattgaattttagatgagcagttattttctttcagcccattgaaaatatcattcccttgtcttttggcttacatttgtatctcttattgctactcctttgaaagtattgtgttttcttcctctagcttcttttaaggtttttttttgtaagttttggaatgttcccagttatctcttagatattgcttctattccattctgcctcttctctttagtctttttttttactgtatcttgtaggtctcttaatctcctttgtgctttacattatgtgtttggggagtggtgactgtgcttcattctggatattttcttattcagcattctctcttcagccatttctactatgcttttatgtctccccattagttcttacttttaaataccgtatttttctattctagggttttcattttgttattttatgtagtttccaattatctgtcaaaaattttcaacctcataatttttctttgaatatattaaacatgtattttaaataatgctgataacttcattatttagattccctgaggattgatctctgtaggctgtttcagatttttatcatattgtcgtgttttattatatgccaaacattgtatattaaaaattacagagataactggagactcaggatgatgttatcttcctctagaatagatttatatttgcttctgacatgatttgtagcagttccatgtcactgtaatgtaatcagagattaagatgatttcaaggtgggattcactccctgaaagaactagtctatttcctattcttactgttattcctagagtatggtctttccaagtcctggtctcatacttggggaaggttgcccatacccctgccttcttgaaggataccctgaactctttttattagaaaaactgctcaatttctcaatatctaattagaaaattagtgct

SEQ ID NO: 55015 - DNA, 1044 bp, Homo sapiens
tctgccatttctagaatggttaggggtcaaatgacataatgactgaactcctcataatatatttatagtatttgctaattttaatattttaatcccctacatttgtacagcacttagcagtttacaaaatctttttgtttacattttattatttaataaaggaggtattaatatcccaattataaagatgagaaaactgactctccaaagagggcaaatgactcaaagaagttcacaacagcctaacaactgagttgatactcaaatttaaatctaattctcaagtctagttattttcctactgtgccacagatacaaacttttgtgttttaatgtttattgttctgcttatcaaagaaagaatgtaaacttatgattctgttttgctttgtttaaaaatgtgattcagcatgattccacctttccactgatagactcaagttcccagaaccagattagaaaacgcatcgtacttgaaaagttgagtaaagtgtaagtatgtaattgccattccagctttgtagtagttttaaattaacttgacatttaagctcataatgtgtaagtattatcctcagattttgaacattttgaaaaataatgtgaaaagttcacatggatttcttcacttaagaaatttggatttttaagatattttatccaagaaatacaaatttttgtgtagaggacacagaggcacatcataaagaggaaggttgagattgtgggtttagaagaccaaactaccttactcccacctaatcagtgaagtcagggaaaaaatatcaaagctagacccatttaaatactgatttgcggtaaatgtgtcacagcagtttcagatgcaaataagatgttattacaaagttttaagggtctgttaagtcactctgcatgcatatccttagaaccatttcacactcagcaacatgagtttttgttcaactcaacgttgcactttagctttaaacttcccgtggtggaaattattgttcttgtaattagcccagtcataaatgacatttaaaaattgctatcttggtt

SEQ ID NO: 55016 - DNA, 1019 bp, Homo sapiens
acaagttagggataaaattaaaatacatattcatcatgttaaaactccattgacttctataaagtataattatactttaatgtgtatttccacccctcttctcccccttacagttttcacaattacattttagagaaggcattttgtcactggggaaagcaaaaacaggcatgaaggccagcattggataaatagccttacagtgaaaatatggagactttagaaacccagagacatgcacatataaagagaaaggacgaaacacatgcacacgttatttgtggagaagtaaccccacctttcagccttttagcttattgccactaacattgactgtaggcatacatgggtgtatgtcttttttaaaaataattatcctattattcagaaaattttcacatctactctcaaatttccaatggaatttttaagtcacaacttgtagacatttctggaattcatgtttaaaaacaaactgcttataagtctttatagctaggcaaaagattctaaatggcagttgtcacttaagatgaatataagataatatgttcagtagaactgttctttatatatgaatattgctaagttttattattactataatagcatttgtttaatccatgaaagctgttttcagaattcctcatgtgaactcttagaagaggatacatacatacacctatatataattgtattagtatgttgctataatgccacaagtctaactcttgttaaagggggaaaaaaatcaacattttgaccaaaacatgatagtccaggataacataaataaaactgagtcttgaattttcacacctttattcttaaaggaaataaggagttttggtagtaagccatcttctcctggtgactttcattgttctttcacagatgtattaacattttttaaatctgtgccaggtgcagtggctcatgcctataatcccagcattttgggaggctgaggcaggaggattgcttgagcccaggagttgaagaccagcctgagcaacata

SEQ ID NO: 55017 - DNA, 1055 bp, Homo sapiens
gagaaggataagaggtaaggatgtgggagtgagcaaggtgacagatcataggctatgctttttcatataaaaaatgaagatgggtattacagaagatattactaaattgtttctctgaaaagtcttataacttatgacatgaaactacattaaattatatgtgtcaacttcaaaacattacagtacctgaagtggacactgctttggctgtatgaccccagtaaggtagggtcagatgggcatctaggggactggcttttcctgcttatctaagtgatagaagttttcactgttaaaacttcattttattgctcttatttttgtcacaagtccttatgagcttggttgggtgaagggtcacccagaaaagaaccagcttccactttctttaattatgcaaactagagctaggtgactgagaacttgcttttggtctgcaagacatagggagttttgcaagccccaagggagtccagaatttcctgaacatgttgcaaggtggctggatggctttcttctgaagtcatgcaatattgtccttcactttggttatgactgcagaggtgctgggaagcaaaatgaaaactatcaccttgaagcaggcttttcttcataggccccagaggtgaggccagctcatttaaagggaatggcttgtgctgctgctttcatctaaaggtattttgatccaattccacctcccagctcctttattggtaatgttttccaaaacacagtatttttgctgagggaaggacaggcaaaggcctgaacatttagagagtagaaaactggctgggtgtggaccttttacaaaagttcatattttgctagtttaatttggaaaaggacacatgaattctcacagaaaatgagctttattggggaacaatacatttcatgaaggcatttctttatcaggaatcacacaggcagccccacgcagtcactgccccacaccttatccttcagcttgtgctgcacaggagaggagtggctgggattcctgactagggctttgatgagagtgcatgcacactggagcatgcttcttg

SEQ ID NO: 55018 - DNA, 1050 bp, Homo sapiens
aaaacattacccacttcccacaaatgatggtaccattaaatcgtattctgacttatggtgtcagtggaattctattttgatagcctgcttcttataagattagaaggggataattatattacctgtcattcaagttaaggcatcacacagttatcagtttgcatttattttctttgaattaatacaattaaaatatatgtaattcttatttcagtttgactacacctatcatgacacctaatccaaagacaaaaattaaatagtttgttagtatacatgaggataaaaccatggcaatatgacagggtgtggttctaacaagtacttcctgtacataaaataaagaccagttctatatctggtctttaatccaagtcaaacttttccttagtttatttttgtagtcttttaactgttaagtggtatgaattcttttggcttatgcattacataagcgccatccataaaacttgttctggtatgtatcaaggaccgtacaaataatcattgttggatctagaaatttcacccctaaaaatatatcctaaggaaataattccaaatgtagggaaagctatattcaaaaatcttttcattgtattacttaaaatagtaaaaactcgaaacaagctaaatagtaagatgagagtgattgagtaaattatagtaaactagctgatagaacttttttatagcaattgaaaatgaaagattgtatataaaaagcaaggaagatgattgtcatgatttttatttaaataatttttactataaaaagtttatattccatttaagaaaacaggaaaataaagagaatagaaaaaagaaaaataattataatattcgggaagaaaagcagactactcagttgtatctgtaatacgattataatttttgttaaataatagagcaagaatacttgaaagttgttttacagagttttattcttttcttatcagatatatgtagcataatttgtaatatagtcttatttatattattatttataatatacaaataatatagcataatttcttatacgtttatatt

SEQ ID NO: 55019 - DNA, 1993 bp, Homo sapiens
ttgctattaagcttatgatttggaaacgtaaaatttcatggtggatattataatcagaactattcaaaagggaaaacatgccagccattttatatgatgaagtctcttattccatagaaaactgtagaaagatatctgtatctttggagaaggagaaagaaaggaaagaactccagaatcccatcactgttctttaaagcatgcatcacagacctttaagagtatgctttattgagtaaaggttatagtttgactttaagataagaaattttctagaatcatgtttgaattctaaacgttgatattcttaagtaccatttctgattaggaattaggtgttaaaagaatcatggtaaggaaaccttaatccgttgaaactcttgtaatttggacaacaaaaaactagaaataacactcttttctttgaagatctgattcaaatacaccttagaagagtttaaaatctcccaggcctttaggatgcaataggatattatgccttggtttgactccttttcattcaaattaatgtaagtatgttgttcaagactttgaagcattgaacaatgttctcgatgaattttatttaattactgacattttgtgatatttgaatgttattaagttaaacacttagagttgagtatattcaggggagaaaagtgaatgaaatgactcataataagaaagcttgctcccttgggacagttaccttcctggtgtcattgccatcctgggttgacaagctgagagtagaggatacaagtgatgtgaataaaatggaaattgcattgagttaatgaaacagacacttttagatcaagaaaacacttcaacagcctttttagaaattggcacactcctatagtcccacctactcaagaggctgaggcaggaggatcactagagtacaggagtttggggctgtagtgtgtaatgatcacacctgtgaaagaataaccactgcactccaacctgggcaacatggcaagaccctgtctctttaaaaaaaaaaaaaatcctgggaaaagaagtcaaagatgtaattttacacaatttctgcccccaccgtcttttttgtttgtttgtttgtttgtttgttttttggctagatactaggtattcagtgtttgctgagatgacaggtttctactaatcagccagttatttgggaaggagaaaaactttttctcaattctgaacatgatgcagcttgttaactctccagatagtgcctttgattgaaaataaggtctacacctttttaagtatattatttctgacatcgtaagaaataatttagttccttattctcatttatcttttatataatgtactgtaatattcaggtttaaagtaaaataagtatatgaattatattttggtaaaactgtttcatgaccagcttgattaatgtatattaacataccagacattgacagcgaacatttcatgaaatcagttatttacttaccaaaacaatgagttttagcttgaaagttactgctgctctattattaacaaaactaagttttaaaaattaattttaattctactgaagtttaatttctggttaaaggtatagtggatgctatttatgatccaagtttttacatcacatccattgatctgcctatcccttctttttactccaaagaggagatgatagaataatacattcagtatactaccaagaagcaaagttataatgtgtttcattttgctattggaattttttattgtaacattgtatgataacctgaaatgtttacttgtgccttttctttaaacaattaaagttttccattttataagaatttctgtttccttcagcttttcaactttaaaagaggaggggcatcaaaacactgttaacaaatgggtggggcgcggtggctcacacctgtaatcccagtactttcggaggccgaggcgggcagatcacttgagctcagaagttcgagaacagcctggccaacatggtgaaaccctc

SEQ ID NO: 55020 - DNA, 2606 bp, Homo sapiens
tggtgttggttttcctttgcacggaaaatctggttcgatgtctttggaccccgcagtggcagatggtagtgagagcgaaacagaagacagtgtgctggagaccagagagagcaaccaagtggttcaaaaggagcggcccccgagaagaagagagtcgtattcaaccactgtctgaccatcactgtgacctagactatggatttatttaagggatcagttatcatatgattagggctttttggaaataatttgtttcatatgtacatatatatatatatatatatatatatatatatatatatatatatatatatatatattttacagtcttatctgcctttttatctttgccaaatctttaccactgatttaccattgccataaagtagactggtatatggttaatgtgtaaaacaaggttctaacagtattactgaatattaatgtttcttgtttagaaaatgcaactatatctatatgtgggaaccattctgaagttcaaaactatggaaaattgaattttcttcagacaaaactgctcttgtgcaatattttatgctcagtgagcaaattgtgtatttatgtttatcaatttgttctcaaggtggctgtctacagacatttgaccaagacatacatctgatttaccttgtgtttttttttttattgttgtttttttttttaagacagagattcagtctgtcacccaggctggagtgctgtggtgtgatcttagctcactgcaacctccgcctcccaggttcaagcaattttcctgcctcagcctcccgagtacctgggactatatgtgcgcaccaccacgcctggctaattttttgtatttttagtagagatggggtttcaccatgttggctgggctggtctcgaactcctaacctcaagtgatccacccgcctcagcctcccaaagtgctgggattacaggtgtgagccactgcacccagcctaccttgtctgtttgtgtctgggaggttttttttttctatttttattttttcatgaaaattattggtgggccactgaaagtccccacacacaaagcctttattctatataattttataaacacaaattcatgattatctgttttgagagttttaagttttgttttaatgtttaacttttatgtgcatatgatgcttccatgtgttggttactagagtagtaggttaactacagacatactgttttgtttgtacatatttataaatctgtaccacctaacattgaacatcattttatatgaagaacatacatgttgcaaaatgactgctttcagcatctaacaggacttctgtaaataataggttaaaagttaaaaataaaacactaatgttttaagagctttagtattttgcttagcattcaatactagcagattcataactgatgcctgttcaaaaacactgttggtggaatcttttatttcatgtgtatgtaactactaaatttttcatgactgaagaggttatagcacatattagttagtgctaatattctactgaatataatttaagcaatgggctaaggtccaagaaacatagcaattatatctacaaataatctattaacatgatcttcagaatctctagtttttgttctatagataaagccataagaatcctttcctaccagtttttcctatatcatttagatattatttcctagaaaacaggatgcctgtcactgataagttagagaaaacacccaaattatacttgcactatggaaagacgacatgaatatgttgactgggtactttctactctcatttttgttagcctatgaaaaaaaaaacattttgttaacctatggaaaaagccttggaagagaaaagtagaattcagtatgtatggaggcacagttttgcacagtatgttgcatgcggcaaaaaaaaaaatatgaaatagagtagaagagataaaagtagttttctgtcaaaaactaggagttaagccttcaggtacgttgtggactaggctttccagcaaggtttttgtagctatttgcttgcctgagaaatgaaattgaaaacatacccctgcgtgtctgtccttaacaccaggctaaattctggtggttaaataacttatctgtggttacaagctagtaagtagcagagccaagattttttttaatatagagacaggtgtctcactgtgttgtccaggctggtcttgaactcctggcctcaagtggtcctcctgcctcagcctcccaaagtgtggggattacaggtgcgagctactgctcccagcaagagccaagattttaacctagatctccctaacaccaaagcttttgaaagggttcagctgaagaatttctcaattctctgttttgttttgtttttatttttgttttttgagatgaagtctcactgcactcaggctggagtgcagtggtacgatcttggctcactgcaacctccacctcccgggttcaagcgattctcctgcctcagctcccaagtagctgggactacaggtgcacgccaccacaactggctaatttttgtatttttagtagagatggggtttcgctatgttggccaggctgatctcaaacttctgacctcaggtgatc

SEQ ID NO: 55021 - DNA, 1007 bp, Homo sapiens
ggaggtccactctggaccctgtttgcctgggtatcaccagtggatgctgcagaacagcaaagattgctgcctgtttcttcctctgaaagctttgtcccagaggggcacctgccagatgctagccagagctctcttgtatgaggtgtctgttggcccctactgggaggtgtctcccattcaggacacacaggggtcaggaacccacttgaggaggcagtctgtcccttatcagagctcgaacgctgtgttgggagatccgctgctctcttcagagctgccaggcagggatgtataagtctgctgaggctgtgcccccaaccgccccttcccccaggtgcttcgtcccagggaggtgagggttgtatctataagtcctgactggggctgctgcgtttttttcagagatgccctgcccagagaggagggaatctggagaggcagtctggcctcagtggccttgctaccactagggctttttcaagaatcctaccgtctgttcagtatagttcatgtgcctgctcttgtcaagtcagagtactaagttctaggatataaatatgattaagaaataatccctaccatcaagggtctaacagaagagagagaatacatccacacctaccaattattccatatttttctaaacagtgcttattttaaatatttagctctaatgtcaaatcatatgatttagaaaaaatttatctacatatattcaatcatgtgttaataagtacaatatttatgaaagtatttatgaaaatacagtaagcataatttttatgaaagtatttatgaaaatatgcccattgatttattttaaatactataaacattattttaaaatggcttataaaaatgctaatagtttaacaatatcagcataatactagaaaacaaaaaaagacttttaaaatgaaagaagcaggtttcttgtttgtttttattttgttattggattagggatttggttctggctagtctttctattattgtctaaatggtca

SEQ ID NO: 55022 - DNA, 1056 bp, Homo sapiens
tcctgacctcaggtgatcctcccgcctcggcctcccaaagtgctgggattacagacatgagccactgtgcctggccaagcttctgtttttataggaaaaggaaatgagacttacggaaaaattcattgtcttagatatgacattaaaggcacaagcagcagagaagaaaatagataagctgaacatcatcaaaatttaaaacttttgtgcttcaaagatcaccatcaagaaagtgaaaagacaacctagagaatggaagaaaaaaatcaaatcatttacctgataaggggcctgtatctagaatatataaagaactcttacaattcaattataaaaagataacccagttataaaatggataaaggatctgaatagactgttttccaaaaatgatataccagatggccagtggacatgagaaaatatgcccaacatcagtgatcaagggaatgcaaaccaaaatgacagtgagattccacttcacacttactaggatggctataataaaacagataataaaaatgttgcaaggatgtagaaaaattggaaccctcatacacagctgatagaaaggtaaaatggtacagccactttgaaaacagtatatagcaggtcctcaaatggtaaacatagagttgctatatgacctagcagttccactcctgggtatatacccaagtaacatgaaaacatgtctacactaagacatctgcataaatgttcatagcagcattattaataatatttagagagtagaaacaactcagatgtcaatcatctgatgactggataaataaaatgtggtatatccatatgatcaattatgaggcaataaaaggaatcaagtgctgacacatgccacaacatggatgataaatttttcaaaaatcagtcacagaaggccacatattgtatgatttcatttatatgtccagaatagataaatttatagagaaagaaagtagattagtggttccttggggttggaggggaagagaggggttttaagggatgacagctaagaggtgtgtggtttatttatggcatgataaaaat

SEQ ID NO: 55023 - DNA, 1036 bp, Homo sapiens
tgaatcatgaggtaagtgataaattttgatcttcacatattgctttcttccttcctctgtattgtaacaacactttattactggttataagactgacactttcatgctgaatatcttctgtgaattattggttataattaataacatttttgaaaattgtctttttagcaaggatcttctgttctaatattggggatttatttcccttaacctcattagcatgacctagaatgataaattaatattttcatggcaaatattttatttttttattgtggtgtaaaaactcttgatagtttgcatagatgtcaaagttactttaactaaactaaaattttgcttatacctatagaatagatttgtggtatttaccgttgcatgcagaaggaagtctttttactcttgtcttcttttaccgctcatgatggtattactgagattgcaaaaaaggatacttgcctaatatcagttaacagatttcttagtatctgaatgctttttaaactggtactaccttgaatctgtgagattcaactcacaaaattttcagttttaccaagtactatactgagtaatttaaagtatttagtatgttttgattagagagatatgttaatgtggctcgaggtcaattttcttatcctttattattttctgttttaatgataatatttggctaaacactaatggaataccatctttcttgttttgaattatttataaaataatgtttattcacagtgatgagatttgagagggtagtataacctttatttgtttaaaaagaagaagaaagagaaattttgaccactagatgaatttaaacctcacaggaaaaagtttagacgttaccctttcctggtattacacccttcagttaaagtctgtatgttttgggtaatacctcctggaggtagtcagtctaagagttaattctaaatgaagaagaaacaaaacataaacaaaaacagtaaatcttagatgtggctcagtttaatttgttttgaaatttggggaatcattcctgtaaatatca

SEQ ID NO: 55024 - DNA, 1127 bp, Homo sapiens
tacatgatatgagtatgatttgtttttagaagtttcaaatgagtcaccttgaagtcatggagaggctaccgcttaccacatttaccattctgattaatttttcttttggcaaagtacaaatcagtaataacctactaaagcctagtggttgctattgatatttcagtaaggtgatgttgattaatcagagtgattacttaccaagtgttacagatttactcaaattattgggttttcttctactatagtaatttcatatgcagtaataatttgcttaagacattttgcttcatatgtgcgttgaaaatatcaatgtagaacttaaaatttgtatccatgctgcaagttaatgtggttgcctctgtgaccgttgaacatagtttcataataaagcctggaaaaaaaaaagcattatttaaccttttaaacaatcaagagattgctttttaaattgtctctaaaaaggtttgattttttacgaaagagagagcacttgaatatatctttatgtaccaccgtgtctctttttgttagatttttcatctgtgggtataatataaaatattcttaaaatgaaagctttacgcttgtgtttgagactaagcaacttgcattgtgtcatgacccttctaataccacaaaccttctgtaatactactcccggagaaaaacccacatcctatgcataaccttagatttattttgaaatctctatgaaaaagaacagagagagattactaattgtttctgttacttcctttagaggtatgatacctatttgtaacccatgttgtaaatgttaatagccaggagtaaaatgttaaaatatattaagtagtggtttcctatcctaaagttaatatgtgaaaatttaataactaattataagtttcagtttgttatattagatatctggaaagaatgtaaaaaaaaaaaaaaagagagagagagagaaggcattggtacttccagtagcttatacttctaataccattggccagtacaatactagaaaataattgcaaatttaaataagccatctttttaaaaattttattcctattctgattttttccttctattttagatttctttgtattctttatgtaactgatgaaggtggatga

SEQ ID NO: 55025 - DNA, 1112 bp, Homo sapiens
gttattctaattttaaaacccacatgtgaagaacagattaagtttctaatttaaatgaagtattggtttcaattttgtagatatttatggggtacttactatgtgcctgtcactattctaaacactacctggattagtgaacaaaatacaaaaatccctttcctcattgagctttatggtagaatgagaagttagatgaaaaaaataaatcttatggtgtgaaatttagacagtggaagacaacggagaaaaatgtgagaatgagaagatattggtattagggatggaggactgttgctattttcacaatgtggtttataaaggttcattagaaggggatatttatttaaacaaacatttgaatcagatgaggcatgaagatttgggggaagaactacttactaggagaatagtacaggcaaagggcctgacataaggagcaagtctgaagtagagtctgggtggagtgagacatgggaattagaggaagtctgagaggtaaatagagccaattatgtaggacctaaaactttgacctttcccgactcagatggaaaatcattggagggttttgagcatgggagtgatcagttagatgacatttaagctgttaaaaagatttaattgaactgattcaaaaaatacttgtaagaattcatggtatttagtttggagggaaatgaggttaaaaaattaagtttcctcttattactggagttttccaccatctaaatgctatttattatttgaagactttatttttacattaatactaaatggagctatctctaaattccatggagtagaacaaaacatagaaaagtcaattttttcctcagttagttaaggaaaataggtgagaattaaacccaagccttctagtatttaacctgggattgagtttgtattttggttattataaagataagcatattgatttttgtaactatgttaaaagcttctgtgggctaagcacatctataaaattaacgccactttgttacaagtaatggaaagtttttcatttaaaagagtgtaggtctactcaaatccaacttttggtttttttcctggtacccagtaacatttacccattttgattagtttgccca

SEQ ID NO: 55026 - DNA, 1051 bp, Homo sapiens
taattattccaggatactaataataagagtaataatagctggcattactgaacacttggtacataccaggcagtgttctaagccatttgaggatattcacatatttaatcctcacaaaaatcataggagatattggttttggggttttttttgttgctatttttgttattgttttcaagacagggtctcacttcgtcatccaagctgtaatgcggtggcgcagtcacggctcattgtaacctcgacctcccaggctcaagagatcctcccacctgagcctccaagtagctgggactacaggcacatgccaccatgcccggctaatttttgtattttttttctgtagaggtggggtttcgccatgttccccagactggtattgatctcctgggctcaagcagtgcactcaccttgacctcccacagtgctgggattacagacatgagccaccaagcccagcaaaatattgttaatatcttcattttatagttgagaaaactgaggcatagagaaaattttaaaatgagattttgttgtttgtatgaaaacccacttttgaattttttccaggaataaaaggaatttcttttcttcagtatttcaacatactgtcatggtagttatataagttttcttaatagcatattgacagcttcctgtgaatttgcttattatacaactaaagttactattagttccctgttcattacttaaaatttttcagttgtttcccctagcgttggggacaaaattcaaactctggccctccttgtaagatccttcctgctcgaattgttgcctacttttctagctttatttcccagttaccccgacatatatatacccggtacttgaggcccagtataccagttaagaatccttcaaatctgtcatctcattttcctccatgtttttctccctcctcctttgatcttgctttttatttcaaaagtcagcttttctttttattattatactttaagttttagggtacgtgtgcacaacgtgcaggtttgttgcatatgtatacgtgtgccatgctggtgtgctg

SEQ ID NO: 55027 - DNA, 1002 bp, Homo sapiens
cctgtttcaaaaaatatatttattaaaaattaaaattaaaaatagaaaaaagcttatagaataaagatataaaaaaaattttatacacctgtacaatgtttgctaagctaaatgttataaaagagtcaaaaagtttaaaaaattggaagtttataaataaacttacagtaagttaatttattattgaaagaaaaaccattttttataatgttatagtatatttacaaattttcttcatttttaaagctgaataatattccattgtatgtatataccacattttttatctgttcattcattgatggacatttagggtgcttccatgtttgagctattgtgaataatgctgctatgaatacaggtgtacaaatttctgttcaggtccctgctttaacttcttttgagtacgtagaagtggaattgctggatcatatagtaattgtttaatttttttaagaaattgccataccattttccacagaacctacaccattttacatttctaccagcaatgcatgaggatttcattttttccgcatttgcaccaacacttgttaattttctgttgttgtttttataagtaccatcctaatgggtgtgaagtggtatctcattgtggttttgatttgcatttccctaatgatgagctatgttgggcatactttcatgtgcttatttcgcatttatatatcttctttggagaaatggctattcaggtcctttgcttaattgaaccaggttgtttgttgtttttgttgttgagttataggagttatttatatattctcagtatcactttcttatcatatatatggtttgcaaatattttctcccattatgtttgttgccttttctttgttgatagtgtttttatcacaaaagtttttaattttgctgaatcaacgtacctgggttttgttttgttttgttttttttggtggtgttgactgtgctccaagtccattttttagtgaaaatttatcatatttctatattatcaaa

SEQ ID NO: 55028 - DNA, 1050 bp, Homo sapiens
ctaaaattgcctgtctttcttctcaggtctctcttttctccaataaattctttttttttttttttttttttttttttttttgaagtagagactagagacagggtttcaacatgttggccaggctgatctcaaactcctgacctcaggtgatctgcccgccttggcctcccaaagtgctgggattacaggtgtgagagccactgcgcctggccaataaattctatcttaaatatacttaagatctgcaaaggtctttttatgaaacccttttattcagatgataatagtgcctgattaataggattttctagggattaaataaaataatgtgtggaaagtgttttatatatcacaggcctgaaataagcgctcagtaatattagctcttattttgatactgagagtatttgttgcaatataattttttatgctttagcgccacttagctcgtactactgggagatggaaagacccacccaagaaaaatgctatgaatgagttacaagatgaactgatgaccattcgacttagagaagctgaaacacaagcagaaataagagaaataaaacaaaggatgatggaaatggaaacacaggtatgatgggaaagcccagtatctttaaaaagtatcattagctgatcaagggtttgtgcacagattgtatcatccctagaacagagataaaaggtaaagatatgaagctgtatagaccgcagttttctagcccaaatgaagatggcaaaaaattattatattggatttcagagatttaatccttctttgacccattcaacaaagttcaaggaagtcaaattttatttgacttttttgggtaaaactcatagcattgccctgttgcatgacttgagaaggaacaccatgcagagcaaaatttctcaacctcaacacttttaacatttttggctagaagatactttgttttacggagctggtccatgcgttgtagatgtttagcagcatccctggcctctacccactagatgccagtaacggctctcctacctcaggttgcgatgaccaaaaatgtt

SEQ ID NO: 55029 - DNA, 1057 bp, Homo sapiens
catatcttttgaagaagatttctacatttctaaggacaaatacaattttgttattttggaatttagatggttcacattattgtaggtaccctgttttttttctattagattaaaatatatttttcagtaatctttacatgtcttctgtagtatataacagtactatcaaatagcaatataatgtgtcacatatgcaatttaagattttctaatacccacattaaaaggagcaaaaaaaggtaaaattaatatttttatttacctcagtatattcaaaatattattttaatgtaatcaatataaaaatcattgagatttttttatttcatattaattcttcaaaatccagtttgtattttatacttataacttgttttaatctgtattagccacatttcaagtgttcagtagccacatgtggctaattgctatcctatttattgtgcagtgtaggtctgtaaagtcagaaaaaattctttgtatctggatggatggacagataaaaggagatgtttatcttatatgaatcagatttgatcagcgtaataactagttaccaaaacccaataatgtggtcatctttatagatatcaaaggtgggcttttttactcattggagaagttaattggaggagatacattggaaatattgggtagatggaacttctcctatttagttgcccttaatgtaatataactgtattatgtggttgcattgtttttattgtatatacatgtttatactttcatgaaatttcagtgtatgtctgtaacctttagcataaatgcagttccaactacaacgaagattttgtgctacagctagagaaggaattggtccaagcccgactgagtgaagctgagtctcagtgtgcattaaaagagatgcaggataaagtcttggatatagagaaggtaagaaacctacacaaatgcagtcattcccaaattagaggggatatgtgatatttattaagtacttactgagcaatttaattgacttggtgtttttatacattagaagccttacatattagttactaagaggaaaaggaaa

SEQ ID NO: 55030 - DNA, 1071 bp, Homo sapiens
cccaacattactatagctttttgtacttgattggattagttggtttatgccaatcaagaattccattctcatatgggcctttgagtttgatgttttcttggggatcttctaatataaagtctttgcaaacaaacctgtgctacagttgccagggctttaagttgagggcaaaaaaattcttccagtacccacgaaataactgtgatctaattaaataaattatggcacatctagtttggatgtggtcattccaaaagaatgcctttttcctaattgataaaaggtaagtatttgctaagatgatgtgtctgttgcagatgcacttctcgtattgaaatattgtttcaatagtatcaaaattactagaagaaataatgtataatgcattgaattaaagtcctcatttgcacatctttttttggtaactggggcaggagagtaccatgtattaagcatctggttatttttaatagttttgatttgacatctgttttgttcctaacatattaaagagtaaaaataactgtgctttattcatgctagttcagtagaagattgttttttatgactttattttgaaattttgagttgccacattttctttactacataaattaaatgtgaagtgatagacaatttattttagaaagtattttataatgatgaattacatattgcttttgtacagaagcttttctatgggcactggcttaaaaatgacgacttaagtgtttgcatcaatattcatgttttatagagtaggaaagcaaatgggaaagttgcgtgcttccgtggttaatttctttgtgcagcatctgcgtcttctctacttccagcaattatttctatgtatatcttttttttttttttttcttgagacaagagtcttgctctgtcacctgggctggagtacagtggcatgatcttggcttactgcaacctccacctcccgggctcaagccattctcctgcctcacactccctagtagcggggattacaggcgtgtgccaccatgcccagctaatttttgtatttttagtagagacagggtttcaccacgttggccaggc

SEQ ID NO: 55031 - DNA, 1076 bp, Homo sapiens
agagtaaagagaactatctataatgatagttcaccaagaagacataacaatcttatttaagattgtatgtgtttaggaatgtatgtcacctaatatatgtatgctaacaggaacagtaacttgaactgatagaactgaaaggtagagtgaacaagttcaggtcttcgacatccctgtctcagtaattgatgaagcaagtaggtagcagaagacctgaacagtactatcatccaacctgccctgatagatatttatggaacactgtacctaataacagcagaatacatatcctttcaaacatacatggaagatttatgaagatagaacatattctgggccttaaaaggaactttatcaaatttgaagtaattgaaatcatacaaaggatcttctctgactctaatatcattcaattagaaattaataataggtatctggaaaatcccctaatatttggaaattaatacgtttttacccatgggtcaaagaggaagtctaaaaggaaattagaacatattttaattaaatgaaaatgaagacacaatatctaaaaatttgtgggacacatctaatgcagtgcttagtggaaaatgtattaagtgcttataatattaagtggaaaatgtattaagtgcttattaggcaagtcagtaagtctcaaaccaataatctaagctcccaccttaataaactagacatataaagaaattcaagctaaccaagcagaatggacaaataataaaaagtgtagaaatcagttaaattgaaaacaaaagtagagaaactttgtcaaaccaaaagctggcttcttgaaatgatcagtaaagttgacagatctgtgtccagactgatggaagaaacaaccaatgtcaggaatgacattaactttttacaggtgtggcccagttgtcttatttcatattctagatttgtctaattccttcctcgtggtgtcattgtatttcttgtcaactggactcagacatctagattatagatgatgttgtaaacttctttttgctttaaatcaggaaggcacatgatataaattgtgcccattattagtgatgctgagt

SEQ ID NO: 55032 - DNA, 1528 bp, Homo sapiens
cagttctacagcttgttcaaaaagtttatagacaatgcacttaattaaaaaaatcccaacacttctcaggccagctgacccctctttgtccacagctaagaatggtagcagactgttatattaccgtttgtagaaacaagacaagctgaagctaaatggctgaacattacaggggaaacaggactagcctcacagtgcacgctctaagctacgacccctccaaaaggcattgtcccccacaggctcagcgccaagaaacgagcaccaagagtttgtcttggttgttttgttctttttataaactatatatatgtacagttgataacaggatttctagccaataaccgtatagttaataccaccttacaaatgttttttaaaatgtcagaaatatctttaaatgctttgtcacaccaacagcaaagtgcatagagtgaggaaaacatgagattatcttttcgttttggggatgtttggaaatatgtacaactttgatacaatttcagagtgttccagacacacatgaccacttcaggtaaaccactgacaatttttagagcactctgagagactgcaatatgattgtgatcaaattctgtaattaaacctaatgagggcaacagacatttctcaaacaacagatgtgtcaatcatggccctcccctactctaaggtattcacaaggagacagatgaacagttttttattcatcatcaccttcttcttcctcttcctcctcctcctcctcttcctcacatcttctttgactacttcttccacctttttccaaggaactttaagcaggaccctttgcaccagacttgccgttagacttaaagtcagcaacatccttctcgtatttctccctcagcttcactgccttagtgatgcaaggctgcttttcactgacatttaagttatcccacacctcacacagcttttttgctacatctctaataaagatgccagggtttgtggatttgatcttggggtgaaattctgaacggtgcaggaagaatacagacatgtctcttttggagacatgaaggtccttcttcttgcctcacttaactggttcacaatcctgcaccttccaagcatagcatactttatctgcctttgtcatttcaccacatttaggattctctttgccagacactgtcttccacctctcagagcacttcttggaaaattctgcaaaattgacagagacctctgggtttctcttatgttcttctctgcatgtctgcacaaagaaggaataagcagacacctttccctctggtttcttgggatcacctttagccatcctgactaaattgcttcttccttcctggtcacctagcaagagggaaggtgaagggggcaggaagggtgcttggaggagaggtaggaggtcaataacattttttgagggggtggggggtatagaatttctccctgtcgcccaggctggagtgcagtggcgcaatcttagctcactgtaaactccacctcctgggttcaagtgattctcatgcctcagcct

SEQ ID NO: 55033 - DNA, 2672 bp, Homo sapiens
taccaaaagaggaagaggaaatatttgactgagtgcagtggctcacgcctatgatccccgcacttcgggaggctgagacaagaggattgcgtaaggccaggagttcaagattggcctgggtaacatagcaagactgtatctctacaaaaaattttaaaactagctacatgtggtggcacacacctgtagtcctagctgctcaggaggctgaagcagaaggaccaactccttgagccgaggagttggcagttacaatgagctacatgatgatgccattgcattctagcctgggtgacagagtgagaccctgtctctattttaaaaaaacaaaacaaacaaacaaaaaaatttgcttgttccaggtaatgaaaacccacttggaatttgtgtttggtatcttctggaaacacatgattttcaaccacctatccttgtttttatatatttttcttaaggtttaaaaataaaaacattcagtaaaaaatggttttaaactttaaatgtccattttaattagcaatgaaaagtagatggaatttgggtatatttgtttcttttttcctaattttatcacttttatttctttctcttatatttctatctgaatttttccttttgtaggaaagtgcttccttggcagatagattgatacaggtatagtttttgttttgttttagttttttaaaacatcttctctaacttctaaggaaagtcctaaacctcgaaattcatattttaatgcatgcaattttacatgcgtttttctagaaataattttttgggtggtatatgtgggtataaatttaattttttgtaacaaggtgttatcttggtttatttttgcacgttttaaagctaaccttattttttaaagtatttatttcaaaatggcaataagtggattctgtgaaattaactactattcattgaaaattttagtcctgcatgtacaactcagtaatattgcatgaattaaatttttattgactgaaagaattgttcttgtcaggtgaatttttcgtttagtttccgaaaatttgctggagcaataacaagctgctagctaatgattacgtaggctgttctattcgctgaggtgactttttttttttttttaacatgtcaaagtaaataactaaacctcacaaaggcagtctttcttgaatctatcctaaattgctttacacacacaaaaattatgtcctaagggacaagtgacaagagcccaggaggctgaggaaaactacctcataaaacgggagttggccaccatcaaacagcagagtgatgaggccagtgctaagctggagcaagctgaaaataccatcaggaagctccagcaccaacaacaatgggtaaggagtctggtagtgcttttctcatctttctcatcccccttcctttcaatcattttttttttcatagcacagattttgtgctgttgttttaaataattttgttttagactttgaacttttaaattatacaattttatgttctgtgatatttaggggtcttattgtggcctaaggactcctgttctaattttttttctgtctacatagttttgttagaaataggtaatattttctttccttacactgtgttttaagtaatgggaaataagcagtgtatgtcagaattgcttttaagtttttagaaatctgttttcataataggtatcattttgctaacagtaatttttaaatcccaacttcagctagtttttgttcattgtacagatgaaacattatccagcatgcagaatatatgcagttatctcatttaaagcttcgacagtgtggcaatttgtgtcttacgaaatactattgcttagacttcctacatcaagacattgaattatgggttaaggtgtatgcctatatttcaaagggagagaagttgcaaagatgaaaaagattaaccctttaaaaattatcttaattaacctagggtgtatttctaattatcttaatcaacctagggtgcgtactaaacagctactaattgtacatctagcctcaggtatcttttgcagcttagacattttccattggcaaattcagacaagggcgatcttaatcaggaatatgagggtaaaagaaaagccaactgtttatctttgaaaacatattatttcttgtttcagttttccatcctcaagtaggcgctagattgtaataagtaagcagaagaagttgtgttaatcctggaactctatgcagatctggaaggcaaatagagtgactgcaaagtaggacgttctttttattcaataaaattaagaaacagcatcgtcatctcggtacaaaaaaatcagaaaaccagaagcaaaaagaaaaattggcagttgaaagggtcataaacatctttttttttctgttattgaagattgctaagaaaaatgaataggagagtgacaaaataatactaaaaagaagggaactcatattttgctccacttttgtatgtaatgtcaataatatcaaagcattaaaaagaaaaaaacaattgtggatttatattaggaatttacctgaaataagttacttcaatgtgattttctaaagaaaacacaataagtattgtttgcatttagcataagctacagtcataatacattagaatcatgaattaaattttttacattgtttttcaaatattgagactta

SEQ ID NO: 55034 - DNA, 1042 bp, Homo sapiens
catagatcttgtcatatgtacaatccatttctgaaatttcaattaatcctgtttacttatcagatttctggccctctatttctttcacttccttattcgtgctctccccattctgctttatcaagatctctagattgaggtttaaaagccttcttctgatatgaacaactgtgcttcctctgcccttttgtttcctgtattcatgtatccaattgttattgcatagttactgagattgctgacagtaaattatgtttccagtggccttccatgtatatttatattgactttgattaattatctcattcctcacagtggttacttcaaaccttaccattcttcccaaactcccatcccctttttgctatatgtaactctcaccagattaccttattcctaattcagcagtcatttccaaacttcctaaacttgctgtcttccagcttgtagacttagctatgttctttttcttctctttttagaatacagtatttttttttcctttataatgctaattcagaatacgtgatgttactcatttccatctcttccaggtctttgctccattaattattccttctctatcttcaacctctctctctgttgtttcattttcttcaatctaagaagataattttgagttctgacttagaagcaacaaaacaaaaccttcctcaacatagcatttcattttccttttatgaagcttagctgtgaaggaaagaatagattttactcattagctacagatcacattctatttgctttttttcacttgggaaaattttcagacataacaaaaatagaataataaatatccattgcttattgtctgtatttaacaactgttaatattttgtcatatttatttttttcaaagtatttcaaagtaaatattgttaatattttgtcatatttatttttttcaaagtaaagctcagaaattgtgacacttcactctttaatacatcagtattcatgtccataaagtaatttgcctcatttaccacattgcttccaccacttaacagtagttccataa

SEQ ID NO: 55035 - DNA, 1050 bp, Homo sapiens
atttctgtagcatccatcaccatctgacatatatattagttgatttattccatgtcttgtctgtctccctccattagaaattcaggttccttgagaatagagattgtgtttattttgttcactggtgtatacccagagagagaaaagtatctggctgtaaatcagtattttgggttgaattaatgaatgaggcaagttgaggcagttggtttcagaggttgtaagatttgtttaacttctcattcttggtgatagaatgggagactagaactttctgattcttacctcattgctcttaacattgcagcacacagccactcaaacaatgtttgtggttggctgtgtacttagtttaaatatcattggtttatttgtgtatcagagaacattaacctatgttgtttttttttcttccaatgtagatgccagaagaagaagctttctgtgtatttgttaaattaatgcaagattatagacttcgtgaactttttaaaccaagtatggcagaattgggcctttgtatgtaccagtttgaatgtatgatacaggtaaaagtgcagtgttgataaaaaggcatattgcctttatattttttatatcttgttctgagtgccaactaagcaaatttaatgttaaaagcattaaagcacttgaagaagtaagtgttttaattacatgattgttttttggttggttaatgtacaatttgacccttcaaattaggtagatcacagtctaggacttgactccagttttcatattcaatccttaagcatttctgccaaatgtactatacaccccttacctaagcacatgaatttccttattatatcctattattgttacgtagtctaagctctcttacaggagctttatgatattacactgacatcagtccatttacttggagactgtctctttgagtcctctcctctgcctttttacttttattttatttttattttttgctagcccgtaattttttttcctgtaatgttttcttatgttgctagtttaagactcaagttatctagtgactgtatgaaggtg

SEQ ID NO: 55036 - DNA, 1050 bp, Homo sapiens
gcctccctagtagctgggattacatgcgcccgccactacgcccagctaatttttgtatttttagtagagacagggtttcactatgttggccaggctgatctcgaactcctggcctcaggtgatccgcctgcctctgcctcccaaagtgctgggattataggcatgagccactgtgcccagctcaattttacttgatttttaagccctgttacaaattcctttattttattttattttattttattttattttattttattttatgtctttagagctagcaagtttggattgggaaattgtcaaaataaaatttcatgtaataaaacatttgctttttaaatatgtataggataacatctataacaagcaagcaagagcttttctcaaaaataaatgttttttaatctgtctgtcttgccaattttaggttttttggagaaggaaggtataacttaccatgtattttgaacaacttttttttactttttaggcttactctttagtagatcgtgaggttggttactgtcaaggaagtgcttttatagttggattgttgcttatgcaggtaagttaatataagtattaaatgtccaatgaaattttttattaagttggattggagagtttaaaaagcatctttgttttattaaatgtaagtggatatgggtattttttcctaggcataatttgaatacaaatatttagtttgcattttaaaagattaaacatgttaaaataacatagtaatatcttaccaccaaatgaaatttcaacttcatgatagatacatttttactgtaatattctactaaagcttgaatctacagtagtttaaaatcttatttgttaacatttaatgaagagtaatctttttctaaccaaggaggaaataattaaagtgttggtaagaaaatcttatttatattgtacaacatctttagagatttatagagaatttaatttatcatggagctaaaagcttgttatgcatacctcactgcatgccctaaaatagtggtactcagccacttttaccccctagggatataa

SEQ ID NO: 55037 - DNA, 2172 bp, Homo sapiens
gggctctgccttacttttaagccttagacacattgtaaacgttttaggattggttatttcatagatttgttgtacctcttccaagtataagttcttttttcctgaagcctacccaaatacttttctcatcagatttcccctaatttgaatttttaatggagacgaagggaaattataatggggctagtagctcaaaaatttttaacgtaatttgctttttcaaattttcaaactgctataataggtgaaaaaaatatagcagtaattttattgatgtgaccaaaatttatttaaattatgtatattattaaaactatattttaaaacaatggttaaattgcagtaataaagctctaagtatcatcaatgcctcttctaatatcactgtccgattagatcttgaacagtttttaattatattttagattgttagaaacggatagtaagtctttaagatctgtaaatgggtcaagaagaaacagtggctcttctcttgtgtcgagttcatcagcctctagcaacctcagtcaccttgaagaagattcttggattctttggggaagaattgttaatgaatgggaagatgtacgcaaaaagaaggaaaagcaagttaaggtattcatgttctttgttgaagttcttattcttattccatagtgcgtcagacataacttaatagaggattgggaaaaaaaccccaaatacaacttccaagctatatattaaagaggtctgctttatttgttttcacttacttgtacccctaaaagttttaatttgtagacatcagttgttacagaggtcctgatcatatagaaatatataactgaaaattattttatttacttattattattttataaagactcactttgttgctcaggctggagtgcagtgatgcagtcatagctcactataacctcgaatttctgggcttaagctgttctcctgcctcaggctcctgagtagctatgattacaggtgtgtgtcaccacacctcgctaattttttattttcctttttgtagagatagggtcttgctttgttgcccaggctggtctcaaactcctggcctcaagcagtcttcctacctccgcctctccaagtgttgtgagctactacacccggcccgaaaattgttttagaaattaaattctctcattttattgattcagaaatgaagttgtgatatcctgcattcttgaataacagtattttcctttttttttttttttttgccttcaacagccctttgaatgttgggtactgtaccatcattcacagctctgcaggtttcaagtccattaccttaagaggtcacacactgaggtgaaatgatcattattaatcccctgaccagaagaggatacacccagggcccaatcttacccttgacttacagggttccctagtcttattataaagctagctttgtgagttacaaatttaatgatgtcttctacttcattccaaccccctaataagtcttccttggcttgcaagataggacacttaaataattcatttttgtaattttattttatttttaggaacttgttcataaagggataccccatcactttagagcaatagtttggcaacttttatgcagtgcacaaagtatgccaattaaggatcagtattcagaactcctgaaaatgacctcgccttgtgaaaaattgatccgaagggacattgctagaacttaccctgaacacaacttttttaaggaaaaagatagccttggacaggaggttttatttaatgtaatgaaggtaagttttatttattcattttttgaaatgaaatgaattcctggaaggttgaaattatacatttttcatgatgaagcatgacctcccaccacaataatcagttgctttggcagtgaaattggttttagcatcatttttgccttaattcttatgctacattactatctagtatagagaacttgttagaacatttactacgttatttagcattagttgatggaaatggaatagcttaaaagtcacatatcatagagggatcctcatgaaaaggaataattcaccatctgtgaagttcaaaacctgggatgtgggtttctcctatcatatctgtgttcctacagtgagcaaatttttctgctttctatggccagcactgttaagagcacttagcccttga

SEQ ID NO: 55038 - DNA, 1027 bp, Homo sapiens
acagcatatctttaatttgatatttttgctctttttcatttttgaaacatgctggttgatttttgtcactcctgatgggtctcagtttggaacactgttctgatttgttcatgctgcagaactgaaataaacagtttgcaaaagctggatattagggtattgttgctaaaacaggttttacctttacttcctcaaagagaatattctgatgatggttattaagtaaatcctaacagaattattaagttctcggtaatgaatacagtgtaactaaagtatatgcaacttttatttttgtccttaggtggcgacagacaaagttgcagaaaagctgagctctactctctcatgggtgaagaacacagtatcgcatacagtcagtcagatggccagtcaggtggcaagtccatctacttcattacataccacatcctcatctaccacactatcaacaccagccctttcaccatcttccccatcacagttgagtccagacgacttagaactcctggctaaactggaagaacagaataggtgagtgaggttgcttagcttttttctctccaattatacaaatccagccattcatatttacttacactagaatttttttttctattttttggtttcttatttatcaaagttatttacagaagtgttcatcttttttggggggagattggtcttaaaagagactaacattttcttctggctcaaatagctttagagatttgttttcttaatatagcaaattccctaaatccttcttgaattttatcaattttttaaaaagtaaatgaaactataactttataattttaaactctctgaacagtctcctttggtaaaagcataaaataatttaatccagtatagatatctgatttgtggtttagagtgcaaaatcttttcataaattattcatagaaagcaaaatatccttttctcctaatggtattaaatagaatagttttctgctctgctaggaatgcatattccggactccgtttgtttccttaccatgtta

SEQ ID NO: 55039 - DNA, 1028 bp, Homo sapiens
aattttttgtatttttttagtagagatggggtttcaccgtattagccaggatggtctcgatctcctgacttcgtgatctgcccgcctcggcctcccaaagtgctgggattacaggcgtgagccactgcgcccggcctattcattaattctttatgccaccttttttttttttttttttgagacagagtctcagtcttcgcccaggctggagtgctgtggcgcgatcttgcgtcactgcaacctccgcctcctgggttcaagcaattctcctgccttagcgtctcaagaagctgggattacaggtgtgtgccaccacacccagctaatttttttgtatttttagtagagacagagttttaccatgttggccaggctggtctcgaactcctgacctcaagtgatcctcccgcctcagcctcccagtgtgctgggattacaagcatgagccactgtgccccgcttcttttagccaacttttgttgtttagtgtatactagctgctgtgctcgtcattagggagggaagactagtaccctctcttattcagaacaggaaaaaagaaaaaaagatgcttttaggctccaggtcagctcccttctcagctgtgctgctaacctgcaatcctgacctcagtaatgatctcctgatatcttcagcattgtgttgctctctcccttttatttccttactttgtatcttttcagattagaacatatttttcttgtcatgacaaaggactctccaaaaattaatttcccctcatttatgcaaaataatacatatttaacaaaatttggaaaaagaagtataaataatattaaaaatcacaaagttaatgtcttatattgaattttattgtggtaattgcttttggcagtttctgttacttctgttctctttatagtttagccagagcaaactattaaaactcactttggtacttgtatgctcatgtttatagcagcatgattcccaagagtcaaaaggtggaaataacccaaatgttcctcagcatagagatgaatgca

SEQ ID NO: 55040 - DNA, 1027 bp, Homo sapiens
ctcagggttatggtgaagattaaataagataatgaatctaaagtcttgtcacagtgcctggctcataataaagcatatagtaaatgatggtggtagcagcagcagtaatgtgtcattgtgtacatgttttgtttcctgaaatttagctgtaaggcaggaaggatcagagagagatagaaatatgttatatgcctacagataatattaacttggagaaacatgccatatagacatctaagaaaagataattgtcgtgttaccattatttcctcttttttccctttttctgtaattcctactcttgtgtttttttatttcttctgaagccagtgctctgtgtatctttgcaacttccatctctctctgatagttgttagcttaaataagtgaaagacataacttgaaattcttctttttggatatgttttaaaacctatattccattttaatatcaagtattttggtaatacttataatatgcaagacattgcatgggcgtttattcccatttacagaattggaacaacaattcttataacctgttaaaagattgaagataggtattacatttgtactagtcttaaatcctactgtaataagatatttgtaccaaccttaaatcttactggaactaagccatttgtgatagcacacatctgtagtccaagctacttgggagactgagccgggagcattactagagcccaggagtttgagaccaacctgggcaatatagcaagacaccatttcttaaaaaaatcttactggaactggtgtgaatattatttttaactctccacatattaattcagttgtatatcaggttttttatgggctcagagtttttaactccttgaaaactccttaaagtgggagacataacgatgtatgcagatacaaattaatgaccttttatatttgcattgatacagcattttgaaatttgagcaaacattttaggatgtacttctcagtttgatatattgctatttattttggaggcaaataagaaaagaactgtggatgc

SEQ ID NO: 55041 - DNA, 1240 bp, Homo sapiens
tttattagagatggagtttcaccacgttggccaggttggtcttgaactcctgacctcaaatgatccacctgcctcagtctcccaaagtgctgggattacaggcgtgagccactatgctcaggcagggactaccctcttatatgtggtatccattgactgaaatgttcttatgcggtgcatgactgtattttacttttgtgtttgtatataaaattcaagatatcaatcagatgacatggggaatttttactatctctcatggtgttacgatagtccttcctcattggaagaatgtagattgattaattgttgttagaacctgttgattgtgaccccctaagtttgcttgcaaagtgtcatctcatttctcactaggtattgctactagcctggtatgtttattttgcatttttagctgtttacttcaagagagctttctctgcttgtactgtttgcagtttatccttttaagtggccaaaaccaatgtgggtttagtgccttgttcattgttctttgtgctcatccaactcacacagttaaactctctgaaaagtgttccctaaagttagttaaactggctattatctgggtttttgttgttgtttttgctatttagtgtcttgtaagtttgttatcaggactcctcttaagtaactgctagctcctttgttcttgaaagggaccttgatgagagataggaacaaaacttgctttattatggataatgctttttttgtttgttcataggaaagcgtaagcactgagatagaaggaaggatggggattttgtctgagttggtgctcaaatgattatttgctgttgtctttggcctgaatcttttgtatgtcagaaatgaatccagtatgctcataaattatgctagtgactttatcagaacagcgttagcagatactgtataaaagtgtagctttaatgattaattatataatatatttgaatgaaatacatgagaaaggtagaagaaaaatgtaatatcttcaggcataccagaaatcaggatagtttggaaaactgagcataatttgatggtgaaaagaccttgaagtaaattgaaaatgaattttggggataagtcatgaataatgtaatgtctttgaatacagtagtcctcccttatctgcagttttacttaactgtggtcaattacagtctgaaaatattaaatggaaaattccagaaataatttgtaagtttttttttgtttttttttttttgga

SEQ ID NO: 55042 - DNA, 1376 bp, Homo sapiens
tcaccatgttggccacgatggtcttgatctcttgacctcgtgttccacccgcctcagcctcccaaagtgttggggttacaggcgtgagccaccgtgcccggccttctttttcttttcttttcttttcttttttttttttttttttttttttaaggctgagtctcactctgttgcctaggctggatatattctcctgcctcagcctcccgagtagctgggattacaggcgtacatcaccacgcccggctaatttttttttttttgtatttttagtagaaacggggtttcaccgtgttggtcaggctggtctcgaactcctgacctcaaatgatctgcccgcctcggccttcgaaagtgctgggattacaggcgtgagccagcgcacctggcccaggtggtcttttttctgttctaaaatgataactacgatttccgagaactttgtgtcaaataaatcttagaactaagttattgaagtatagagaaaaagttcacaattctaaatgtgcaggtggtctgggtgcggtggctcacgcatgtgatcctagcattttgggaggcagaggcaggtggatcacttgagcccaggagtttgagaccagccagggcaacgtggcaaaaccccattttctactaaaaatacaaaaattagctgggtgtggttgtgtgcgctggtagtccgagctacccaggaggctgaggtgggaggatcaccaaagccggggaggtcgaagttgcagtgagccttgatcatgccactgcactccagcctgagcggcagagtgagaccgtctttcaaaaaaaacaaaaacaaaaaacatcgcaggtaatgaatttttactaagtgaaccaccaaagatcaagaaataggacattactagattggagtatgtacgtaggagtggcattgttggttttataggtacgtgggtgataaaactctagtattagaaattgttgaacattttcccaaagtggttctaccaattagcagggaatgttccggttaccccacatccttgctggtgcttgtcagttgaaattttttttgctagtctagtagaggtacagtaatatatcagtgtggtttcattttgcattttcctggtactgaggttgagtatcttttgttgaccatttatatttcctcttgtgaagtgcctgttaagtctttttgcccagttttcgttgatatgcttatttttctctcatttataatgctttattctggatatgagtcctttctaggatatatatgtattgcatttttatttttttcagtctgtattttgccttttcagtcttttaatggtgttttttttcatgcctggagattcttaatttgtgtgtgtgtgtgttttttgtttgtttgtttt

SEQ ID NO: 55043 - DNA, 1053 bp, Homo sapiens
gtgggccatcccatgtcttatcattattaattcaggtgcttacaaaaggctctttgagaactgttttaaaggttacccaaagaatcttgtgacaacccagctaaaatgatataaaatcagttttaacataactgaagtttttagattctgattccaaatgtcagatggtgacattttacctttctctgactttatgccaaatttagtttaagttttagcatctataattttcatttactgaacaaatatatatttaacaaatatgaaaatacaaccatgaaacaaacaaaatcaaatcctggacttaaggagctaatagtaaaaaattcaccaatataactacccaattacagtttcatgcgatgtgaaaggagtaagagaccaccatagggaggtcagaagatgcttctcagaggtggatactagagccgttgtcaaaggatgaggactgggagaactttctgggcacagagcaaagcatgagtaaaagctctgttgaggccaggaagccggtaaatagggaataaaagaggctagcgtggctggagcacagacagcagggtggaattggtctgagcagtgagaagaggtggagaggtgggcaaggcacctggccattcagggcttggttagttaggagggttttttctaagagaatgggaaagtgtttaagtggtttaggctgggaagtgacagggtcacactgttattttgaaaaagtcactctgcctgttgtgttgagattagagaggggataaagggaatatgggtaaaccacaagaagactaggtcagtaatccctccacccccactccccaggtgaaggtagcctagactagggtggtgatggaggaaataggagaggacagattcaaggaccatttgtaagggaaaaaccaatagaatttgctgacggatggaatataagaggggagaggtacattatcaaggatgtagcttagttttcttatacaaggattgagttgcaataaaattgttaattgaaatttctttaaataatggcacaacctaaagttatgcaaacatatgcct

SEQ ID NO: 55044 - DNA, 1186 bp, Homo sapiens
gagcttgttctttcccatagtcatggcagatctagtctccacctgtgcacaagtatcaagagataaacagaattgtgtgtctcttaataatgttctttcctaagatgatgtcagagtcttctaaagaatgcatacggtggaggtaaagtggtaaagtggtgaggttaaagctattctttccttttttttttttttgagacaggatcttgctctgttgcccagggtgcagtgcagtgcattggcgtgatgtcagctcactgcaacctccacctcctgggctcaagtgatcttcccaccttagcctccctagttgctgggactacaggtgcacgccaccatgccctgctaagttaaagctattcttataactccagtgcatggaggccatagctttttatttgagtacctttcagattcatattgtagaaagtaatgagcctagtaatgaatagctgtcactatttcattgtgagccttcatttaaaaaaaaaaaccaaaaaaaaaaaccagttttgaacattagtaggagttgaaatggagtgttatgtctcctttttctttaatagtgctaccaataggactttctgatgagtggaaatgttctatatttgtgctgtcagacagtagccactagccacatgtgctattattgagcacttgaactatgtgagtgtgactatgaaactgaacttttaagtttatttatttttgagacagggccccactctggcacacaggctggagtgcaggggtgtgatcttaactcactgcaacctccacctcttgggctcaagtgaccctcccacttcagtctccagaatagctacagttgtgccaacatacctagctaatttttttatttttatttttgtacagatagggtctgactatgttgctcaggctggcctcaaactcttggcctcaagtgatcctcctgtcttggcctcccaaagtgctgggattacaggcatgagccaccatgcctggcttaatttaagtttaaatgtaaatagtcacatgttgctagtatctctagtggttgctgtattggacagtgcaaacctagaatgtaactgagatggtctagttctctaaaaagctcccagggtgagggaggaatattgttcacagtgggtttgacttctctggtgagttccttctttgtaccttgggttgttttttgcct

SEQ ID NO: 55045 - DNA, 2584 bp, Homo sapiens
gcaagcagtcgacctcagcctagctggggaacgccagaatggaggggggctgcaggtcctcgggtcccactcgacctccgagtaccgagtacttcgtgggttttccaggagaatgtcggagccggcaagtcttagatttaggaagcttgtgcccgtgggctgagcaagtggcttttaagccaaaattgtcagtggagcttggaggccgaggggtccctgggccccggaagctcctttaacatggaatacgtgcctcctgcctcttcctctagagtccgtcgccggatgagtttttaattattggggtagggccccaagggtgggatgaaatgttgctttagctgatggggaacagtgctgttttagtgggggaattactgctgaatgtgctcttgcccagttaagctttgtggcaggtaatttaggcttttgaaaaacataacatgggaagcgagagaggtacgtagttgttatttgaggctaggttttcgaagtgggacatagcgtgttccgaacaaaccgacgtttggcatcactgattgctgtctggagcagtgcttcgcaaaagtttggcacaattaccggtgctggtccttgaagaaacaaatatggaaattgaaagcgtttaaaaccttttgaaagcaatataacaataattttatacctgttaaatgtaataaattggggcctgcattttgtatgtttcttttattccatatttctctaaggattcatttttattgttttatgaaactactagtctgtgacatggaaggtagaggaaaaagattcttgaccctagttgcttgtgaaacctgggattctacaagtgacagttgtctgtttactcttgaagttcaagtgttactttgttacatggttaatttatgtcaaaagtatcataggctaagacatcaaagttttaataacattcttttttctttaaggggtttgttaaagttgttaagaataaggcctactttaagagataccaagtgaaatttagaagacgacgaggtactgtcacctttttgtgtttacaatattaatctgctttgcagatgcagtggagtatcctttctacaattatttttttctttcagagggtaaaactgattattatgctcggaaacgcttggtgatacaagataaaaataaatacaacacacccaaatacaggatgatagttcgtgtgacaaacagagatatcatttgtcaggtaagttgtattctagacagtcccctttttttattgctagagaaattgtgcttgggaagcaaagcacatggtgtgtgtgttagaagggctgtctagcacctccaaaagcatccagtgaataatttttccttttagtaggtctagaattggaacctgggaacttggtactttaaaaaatgctcttggttgcgctcatgcctgtaatcccagcacttcgggaagattgcttgagcccaggagtttgagaccagcctgggcaatatagtgagagtttgtcttcacaaaaaatgtaagaaaattagctgggcatggcggggcgcacctgtagtcccagctactcagtgggaggattgtttgagccccgaggttgaggctgcagtgaagtgagatcacacccagccctccaacctaggtgacagagcaagacactgaaacctagtttatgtgtgtggggtggggagattagaagtaagtaagaagttcttgcccatcccaattccagtagaagaatagggtttgtcctgatttttcctatatggccttatatgccacttaaccactgaaaaggtagttgtgaattaaacagggctttaagattgttctgcttattctttgaaataggttttaataaaatgtacaaaggtggctcccgcatgaaagacctttaggaagtgtcagttttgctcttgtactaagagcattctcactggactctgaaagctagaatcctgggcttttacaactaggagaaattctgagagttaagatttattgatattttgcagcaggtaggcacacctgtttcctgggcaaatagtttgttgattgtgaaggcattgtcttcctccgtacccaagttcagataactaaacgttaggttcctgagactttgctgactttagttatgtttagttcaaaagatgattgaaatatttgggtattcctctttgactttttaagcacctctaatttactggtaacccagctaagagtcttaagcattttaagtgatgttcatctgtgtccatcaatgtttttttattcccttgaaaaataattaagatgtagtaagacagtgaaagcaacagattactaacctagtttctctcttactatagattgcttatgcccgtatagagggggatatgatagtctgcgcagcgtatgcacacgaactgccaaaatatggtgtgaaggttggcctgacaaattatgctgcagcatattgtactggcctgctgctggcccgcagggtatgtacaagatgattttaattgatgtagtttgtggctgattgcttggagagttttctgcaagatgtttgtacatggataagatagcttaagttgtgcttcaggagagtgc

SEQ ID NO: 55046 - DNA, 2705 bp, Homo sapiens
agggaacattgtaagtataagaatcaagtttatgcattctcattgattgctgcataagtcaagtgtggacatgtagcaaagatgcaaaagtcataaaacaaaattgtttcaagtgaaattgaatgttttaagttttttttttaaatagcatttaaaaattcatgagcaagtggatctggtgaaagggtgggtgtggaaggaaattttcttttccagatgtcagtggtccttacggttatgacataagctattttaattttagagcagtttgaataattgaaaccagcatttacattggtttcttgaatagcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacaggtaagaatactatttaagaccttggtgcctggaccgtggtacttccctgtttttaactagttggactgtggagataaccgaattaaagtagctatcaattgaatgcctgctgtatgcctaggtaccatgcaggaggaacctagtagggcaggaaggaattatagcccattttataaattaagagtctgaggcccagagttatttgtcccaagtttttcgggccagttattgaaagagatgggattgaaaccactaccttttgcatatgacttaattcttattagaaatgagcaactccatcctctttccccatgcactttcttttttcaatcagaataaaaatgatttactgaattatgcaaaaaggtggatcctagaattttataagaagtttgaggaaaaggcttatgaaagatttctaaacctgcaactaggaataagattgtaggccattttgggaagttaagtaggttaatttgtagttccattggtttaatgatattttttgttgttgagtctgtgcatcttgatttattaacttcttaggaatattttagcatttggtgatttaaccaagaaatagtaatttttggtaagcctaaaatacaacccaactgaaattttgcttttatgatgtggaggtgggtggggggagttagttgcaagtacaccaagagcattctcacttgacaatttcattaactgtgatcttggacaaatcacttattcccatgtacccactgaaaattaaaggatttagagtataagttttgaaactccttcctgtgctgatgtgctggatgactaattttgtagtggtggaaagccttggtaatggcttttaaaggtttttgtagcatgaatttcttttctgtcctggaattcagagatgagctgctgaatgatgatatcccactaactgagcagtcagtagttggtcctttggttgcatatgatgcgataattgtttcaagacgggactgatggcagctactaaagtaaattcttactagtaaactaagttaagtgagtctatactaaaatatgaataactttattttagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatggtaaaacatttacctaaaaatgcctatattggttaatttatggaaataggtttattacttgttttgggggcaggtaacattcttatataggtgtgtttcttgacaacatgagctagacttgtcaacattcttttagtaatcttttagatgctcaagtgtgggagacttcaagcatctgaagatttggctaccttttatgctttggctgttctgtatttgtagatgtcatttctgtaatcatagttgtaatctgctttgttggataagaggtgctagataataaacttcacttattttgataccatctgggaggaaagctcttcatagcatatgtgtgctatattctggactttcccattatctcagacatgtacacaggaaaagagatttgatcactgggtctgcgtgatgttgtagaaatgaggggagccatgtttgcaagaatgagtcccaaagtgctgggcttacagatgagagccattcctgacccaggttctttttcgttagtgtgtagtagcttctattttggcatagctattggttaggaaaatttttaaaaacagtagttgggaaatgaccactttctgttatttctatgctttggacacagtgtaaaggctgaataaacaaatagcttgagtttctgagttaggaaaaggagtagttttttatcaataatgtaggtgcatgttaatttttactgcgttatatttctttgttacttatgacttcatcctggtaaagaggtcatttacttttggattatgattctactagtcttgcaaaatttacttcctaacctatatctttatgtagtcatgtcatacttgctcagaacttttcagactcccagtttgtgctttcagatgtttacttcctaatgctttcctgtatatgtgccttccttcagctagactactttttggctaatgtatttttctagctggctca

SEQ ID NO: 55047 - DNA, 2252 bp, Homo sapiens
tgcagctttttttttttttttttttcagtgagttttagaacaaaattgccctggcggggcatggtggctcacgcctgtaatccccggacttgggaggccgtggtgggcagatcacctgatgtcaggagttcgagaccagcctggccaatatggtgaaaccctgtctctgctaaaaatacaaaaattagctgggcatggtggctcactcctgtaatcccagcgactcgggaggctgaggcagaagaattgcttgaaccctggaggtggaggttgcactgagctgggatcgcgctactgcactccagcctgggcaacagagcgagacttcatgtcaaaaaacaaaaaattgcccaataaaatatctgatcggttggcttttcaggaaaacttctgacatctttctggtctagaggccttatattaccactagatactagggatagattggtggtagtgaaagacagaagagaggtccttggtacataatgctgggaattacttttaaaggcctgtgagataaagatggaaaacaaaagtctagggattgtgggatgacagatgaatttgcttgttggcctgtgtccagtccttggtctcagttaagctatgtcagtgttgtgactcttggtcccatacgttcatcatcttaatatcttaatacttttggcacttgttcttgaatgaaagaatctaggtcagacagtatttaaaatgagaagcgcaatatttgtttctgcagacaaaaatttgatttagagtgactcaagaagtgtggctgaatttctcagaagtacatgcagatttttctttttgttttcttactttttttttttgaggcaggatcttgttctgtttcctgggctggggtgcaatggcacaattatagctcattgcaacttcagacttctgggctcaagcaattctcccacctcagcctctcgaggtagctggggttataggtgtgcaccaccatgccctgctaattttttttttttttttttaatttttggtagagatgaggtctcattctgtcatctaggctggggtccagtgagctgtgattgtgccactgcagccttgacctcctggactcacgtgtagtcctgtagctgggactacaggtgcatgccaccattaataattgccacctggctaattagtttttttatggagacaggtctcactgtgttgccttagctggtctcaaactcctgggctgaagtgatcctcccacttcagactcccaaagtgcttgagattacaggcatgaaccaccacacctggcctgatttttttcttgagtaagatggagttctgtagtgataattcacattgcataaggtgaaaattgggaatttgttaggaaaaggtgagttacatttagaagttaaagtgtttaccaacattgatttagtttagttccttttgagaatctggcttagaaggacaagataagttatggttgcattaatatagtagggcacatgaaatgaaaccaagtactgtttgctttcctttgtttcagatggaggagatgtataagaaagctcatgctgctatacgagagaatccagtctatgaaaagaagcccaagaaagaagttaaaaagaagaggtatgtcgtctttttttttgtcttttcaagaaaacaggttgggaatggttcccacgtggggcagactgttggtgtaattgtgcaaactcgatcactagctctgcgtgatgtggcagaagcgaagggaaccaggtttgcaaaagtaactgtggtgatggaaatgtgttagcctcagacactactgaggtggttctttctatcctagtacagtctaagtactggttactgcatttttttattggctgacaagttgctttttgttgatctttcatgttttgatctttaaatggaatagaaagtaatacttaatgaacatgtaagcataaagtgatgtgatggcccacaaatacaatgtatagtaattaaatcaatgtatttaacatattcacctcaaatacttaacactttgtggcaacaacatttgaaatttattctcttaattgtgaaatgtacgatattctatattcatcatgctgtgcaatagaactaaaaacaaaatcatactcctcctgttggagattttatacttgactatcatctgcccattctttgcacccaccagcctctgtaaccaccattctgctctctgcttctgtgagttccattgttttagattctatatgaatatgaagtatttg

SEQ ID NO: 55048 - DNA, 2101 bp, Homo sapiens
gcaatgaacatgggagtgccactctcttggacaaactgatttcaaaacatttgggcaaatacctagaagtggtattactgaatctaacatgtcttctatttgacttttggccctatggtagtaggacatcacagaagttggggtttgggaaagttagcttaagatcatacataagtaaatgtatttgaacttggattatttaaccttctgattgcaaagtcttaaatattctctatcaaaattaaattttattaaaattttaaattaaatattctattctcttcagttatagtttaaaaaatatatattcctatcttttgtaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagcaactatttctgtgttaagctcttattcttatgaaccttataggaaataccctgaaatattttggaaaagcaaaggagttgacaggtttttttctccaagaaaacaagtgtaactaactttttaagaaaaaaagttgttatttcttgggcttctgttttacctgacaggagtcattatcccttatgttgtatgatgaacagctctccctaaaaatttggcaagcaacagaccaaccatcagtgggaaatatttcttccatccatttattataaccagatgatgaatgggaaaagtaccttaaagtaaacaaaactggtgctaatccatggcgttgaaggaaagttttgagagaaagctgtccagtgatggtcacatagatttttaacatgttccactttaggtaggcgaaacctttgagcagaaaatagtggttcttttctccaaaaggtgtttaattttatggagatgttgaaaggtacatgccaaatctgagtatacgtgtgaaaataatatgaaagaggagcaaatactaaaccttgtatatcaagtttacatggggaaaaaaacattagataaataaatacatttacatgcctctttaagaaatagccctttggcccacaggatatactgtttgaaaatggaaagttattactaaaaagtctgctataatttattttagtcttgcacttacagtcccactttcacatagttcaaaatcaggatatgtggatcttgattgggccttaagatgtcagttttgaagggctcagtcagctgcgtgatactaagatgggccctttgaatctttaggaaagttcatccatttttagtcaataaaattggtgtactgtcaagtataagatttcttgaagtaagccacttgaaccattgtgaagctacacataacttgatgtctgaatgaggttaaaaatgggtgtataagtctttaatacagtaaaccatgctattaacccaacatctgttttataaagaagcaagtttaacctgctttgcagtcttaatttctgttaatgtgcaaactttaccatgctaagacattagtaaatttataaattttcttgttgaacagcagcttcaatgcaaacacaatgcttccagcattggtattttggctaaggtaaatctacaaatcactcactgttgatgtttatggaatgaagcttttcacagcattggtttttaaagtcagtcaaaatagttacacaatgaatgtacttcggagatgtaacagggcttctaaaagggcaggaatgacatcttggggacctgttgatcctacacctgccattacttcagtgatcacatactgatggcttctcaggcctggggggaaggagttttgtgtaactggccggaatttgaagccatttttttttaatgctcaaaattgttctttaaaagtggcaggtttcttaaaatggtaattatgtccaaatgaactaagagtcattagtgtaggaaattttcttccacaataatgtttttaggttatttagtatcaaagaatgttccatttccatttgatttgctgtgactttgagagcaatacaagaataaagctgcttttctaattcttcacgaatttcacttggagcaccac

SEQ ID NO: 55049 - DNA, 1720 bp, Homo sapiens
aataatgcccgtaaagaaacttagtatgttgcatgggaggtatttttcattccttctgtgtaactagccaaattcttgacaggcaaaattgggtgaccaaggaaacctctctgaactggttaatctcatcttgacggtggctgatggagacaaagatggccaggtttccttgggagaagcaaagtcggcatgggcacttcttcaactgaatgaatttcttctcatggtgatacttcaagataaagaacatacccccaaattaatgggattctgtggtgacctctatgtgatggaaagtgttgaatatacctctctttatggaataagccttccttgggtcattgaactttttattccatctgggttcagaagaagcatggatcagctgttcacaccatcatggccaagaaaggccaaaatagccataggacttctagaatttgtggaagatgttttccatggcccctacggaaatttcctcatgtgcgatactagtgccaaaaacctaggatataatgataagtatgatttgaaaatggtggatatgagaaaaattgtgccagagacaaacctgaaagaacttattaaggatcgtcactgtgagtctgatttggactgtgtctatggcacagattgtagaactagctgtgatcagagtacaatgaagtgtacttcagaagtgatacaaccaaacttggcaaaagcttgtcagttactcaaagactacctactgcgtggtgctccaagtgaaattcgtgaagaattagaaaagcagctttattcttgtattgctctcaaagtcacagcaaatcaaatggaaatggaacattctttgatactaaataacctaaaaacattattgtggaagaaaatttcctacactaatgactcttagttcatttggacataattaccattttaagaaacctgccacttttaaagaacaattttgagcattaaaaaaaaatggcttcaaattccggccagttacacaaaactccttccccccaggcctgagaagccatcagtatgtgatcactgaagtaatggcaggtgtaggatcaacaggtccccaagatgtcattcctgcccttttagaagccctgttacatctccgaagtacattcattgtgtaactattttgactgactttaaaaaccaatgctgtgaaaagcttcattccataaacatcaacagtgagtgatttgtagatttaccttagccaaaataccaatgctggaagcattgtgtttgcattgaagctgctgttcaacaagaaaatttataaatttactaatgtcttagcatggtaaagtttgcacattaacagaaattaagactgcaaagcaggttaaacttgcttctttataaaacagatgttgggttaatagcatggtttactgtattaaagacttatacacccatttttaacctcattcagacatcaagttatgtgtagcttcacaatggttcaagtggcttacttcaagaaatcttatacttgacagtacaccaattttattgactaaaaatggatgaactttcctaaagattcaaagggcccatcttagtatcacgcagctgactgagcccttcaaaactgacatcttaaggcccaatcaagatccacatatcctgattttgaactatgtgaaagtgggactgtaagtgcaagactaaaataaattatagcagactttttagtaataactttccattt

SEQ ID NO: 55050 - DNA, 1037 bp, Homo sapiens
aggctaatataagataaaatgctaatgtcatacaaatttagctctttcaaccccacagtttttgttttcattttattgtgtaactgtaagtttctcaaacacattttgggcctgataatgctttgctgtggggggctacattgtacattgcaggatgtttagcagcatctctggctgctaccccacaagatttcagtagcagcctccagttgggaaaccaaacatgtctccagacattgccaagtgtcccctgtggggcaaaactaagtccatttgagaatcactgccatagtgtatttacaaaaattcttatcatgcttttcaggaacaaaattaggaaaaaagcaacataccattactagctaggcacacaatctgccgaacaaaaaactgctgggcagtcattgtgaatagttcagcataaataaaaaggtcagactacatttcttaatcaaagactacattatctaggtaattggtacagaacagaccactagaaacattttagtgagtggcacacagggaaattaaattggttaatagctacagatgtaatttatggctctttcttcaatcattatttttaaatgtgaggctgcaggatctgcagatattaaaggacgcatgaaggtccttttactactttgtgttacccccaaatcacagcaattctcaatggcatgctgaaagaaaaaggtgtctcactccttttatcattttgtctacaacaggtgatgcccagtgccctgctgggaacatcatcaatctaacttcctctcaaaaatgtttggcattctttgtcatgacaagtaggcatcgggcagtccagttcatagggtttttctccatttaaacatatgccagaggaagtagaaaaacgtagctatttgataggtagagaaaagaaaaatatttaaatattgtcacagaaccattatcacaccttaaaaaactaaaataatcctttactatcatcaagtatactgtcattcttaaaattttcaattgtcttataaatgtcattttttacaggtttt

SEQ ID NO: 55051 - DNA, 1108 bp, Homo sapiens
gaaagctaacacctcatcttggtgacttgattttaaaaaaggaagctaacatgttttggcatgaataagatagctgtaaataatggcctgattaactctgttatctttttttttctctctttttctttttcttggtcttactctgtcactcaggctgctcactgcagccccgacctcctgggtttaagcaattctcctgccttagcttcctgagtacctgggtatacagatgcatgccaccatgcctagctaattttttttttttatttcatagagacagggtcttgctgtgttgcacaggctggtctcaaactcctggactcaagtgatcctccttcctcgccctcccaaagtgctgggattgtaggcgtgagccactgtgcctggcctctatggcttatatatatagatacatgatgttgtggctggtagtctaatgtattaggtatagctccatcagggaaaaagaagtgcatattttagattattaaatctggcctctgacttttagttttttataaccacttgggttttggagaaaatttgagtgagaatgttggactctaagctctagatctttggactcatcaagccttggataagagggtatgtgggtcttgaaagtgatctaatatgttttttataggtatctaacattctatagtattttgaaaattacacctatatattcatataacactttagttctctgcattttcccctttagttctgagggaattttttggacctataatgagagatcttcttttaaaattacattaatgtttggcatatatattatatatatgttatttgtaagttatgaatataatatttgtaagttatgaatcatataaaaaactaacgcccacaaacctatcacaactttagtgttaagttagtctgtgttagtaagtgctggggatggggcagcaacttaaacattctcgtaacaagtccacttctcttcctaataagtatccttatatcgatacatttcattccttatttttaaaatgtgtagtgttgtgattaaaacaaattgaaaccaatgacaacaaatgttggtaaggatgtggagaaactggatcactcatacattgctgtt

SEQ ID NO: 55052 - DNA, 1418 bp, Homo sapiens
gagtccctaaattctgtttcagttgaagccaattagagatagactttccatggactaataacgaaaagagtctcaagtaatatgctggagattgtagtttcgtttttgttttgttttgttttgtttcgaaatattccatcatttctgtgtaacactaagcctgatggttggatttgagtttagcagacctgccccagatggaagcctgttaagacactgggaattagattagaagttatgctcatcaactatgcagctgtagattagagcagacgattccactagtacatatgttgacagaatggggccagtggtggttcatatacctgtttgttgtcaaataccaggtctagatgttttcctcatcctcaaatgagagatcacatagcaatatgggacttataaaactttcagaacaaagggaacatcattatgaagatttagaggaagagcaactctctgaaaattatttattatagaaatgtaagaaattttgaaacttttctagcatccttagttgattcaggaagatatagcctctgtggaactgaagtataaaagtataaggaacaggctgagtgaggtggctcatgcctgtaatcctagcactttgggaggccaaggcaggcagtaacaaggtcaggagttcgagaccagcctggccaatatggtgaaatcccgtctctactaaaaatacaaaaattacccaggcgtggtggtgggcgcctatagtcccagctactcggaaggctgaggcagcagaatcacttgaacccaggaggcagaggttgcagtgagccgagatcgtgccactgcaccccagcctgggcaacagagtgagactccatctcaaaaaaacaaaaacaaacatacatacacaaaaagtataaggagcaaataggctgagatgaaaagggaacaataagcatggaaagctacaggtaaactggacatgaaatagcagtgaagatataaactgaagacagtgttaaaagcaggattcaccctgaggtgtactgaagcaatgatgtggaaaacagatttgagaaattttctcagaatgcagaggaaaaaaaaaaaaggagatgaaaactgtgagggagatggtagctatggatgacagacttttctacagcaccagtgccagaacttgtgagccaaagttttcaggggaaaaggttgtgactagagagtgttgtactggctgcattttgtttcattctcgaaggttacagacattcatgtatgccagggttcaaaatatgctgtgcacatagccttcttggagaactaaaacaaatgaacaaagttttaattgactgaaagacaaatcaaaatgaacttaagaataggatttatgttactaaacaccttcagacttccagaggactgccagcaagtatagggccctcccgagt

SEQ ID NO: 55053 - DNA, 1004 bp, Homo sapiens
gagttcaagatcaatctggccaacatagcgagatgccatctcttgaaaaaaaaaaaaaaaaagacatggagaggactgctcccaaagagaaaggcattactgctgtgttagtaaaagaaaaaagtccttcaaagtttagttgataatgatatggttgactgtgagagaactggaacttctaattattatcagtcttttccaagtaaaattcttcatgcaagaacgtataaattggaggttctgaaatctcagttgtttcagggaagccaaaagcatgcaaacttacagaaaagcatcagaaaaactaaaattggccaacatgagatgaaggagtgaaccgtgttagccaaagagcattcttcactcttggatcaaaggcagaagttgaaaaatgcaaataatgtgacccgcaagttgttgaagaaatacatcaggcaaataaagtacttgctaacagatagactgataacatatttgcaataaaatcttgggccaaaagaaaatttgggtttgaagaaaataaaattgataaaactttcggaattccagaagactctgactacatagattaaaatataccagggtggtaaagaatctacgagctcgcaaatatgtaaatttttaaatattatccaactaggctgggcacagtggctcatgcctgtaatcccagcactttgggaggccgaggcgggcagataacttgaggtcaggagttcgagaccagtctgaccaacgtggtgaaaccccatctctaccaaacatacaaaaattagccaggtgtggtggcacatgcctgtagtcctagctactcgggaggctgaggtaggataatcacttaaacctgcgaggcagaggttgcagtgagctgagatcacgccactgcactccagcctgggcaacacagcgagactctgtctcaaaaaaaaaaattaaaaattttaaaaatcttatccaactaaatgtactgaactgtcttttacctgtaacagtgtttatcattt

SEQ ID NO: 55054 - DNA, 1048 bp, Homo sapiens
ccaacatattttcctttttggaattctttttgctctattaaagaggtttttaataaattaatttcatcaggcagttttaattctgtttactattcataagcatgggaactgattaatattcggggtttccctttttctatccaagtccctttctaaccattaggtcatgacagtttgccaagcaaaaaatcaaaagggctactgcaaaacacattactactgagatttgcctgaaatgtttgaatagtgttaaatggtgccatggacactgcagataccactgcttttcttatgattcttaattttaggattaagacatcatgcgactcatctattgccaggaactttagttattaggttcccataaacccagagaatcctatttctcttcttggtgatatataaaacagaactttaggtgcccacaaaaccatggcttcttcactcacttttcccctacaaaatgagttcaaaagaaaggcgaatgcaaagtatatattctgccaggcattatgccatttattttatatatgaagtctcacataatcctcacaataatctcattgtgcatatttgacaaatgagaaaattgaggcttggagtagttagtaacttaaccaaaatcacacaactggcaagttggcagggtgagatccaaacatagacctgcctaacttcaaggtctgggctattctactagatacagcactcagaaaaagacaagggttccttatgtcagctgggcaagaagtgatcagtaaatattttatccaggtgcccataaaaattagaggccaatgcaaaggaaggaattacaaattataaacaagatcaatagaaattagggagatacagatttcacaggtcatggcagaaactaggtgagctctgggggtgggaggtggcgtttgtaacaggctagggaggagcatgtgggcagagaatgaggtcctgtcaggacatagtcagagaactgtctgttcatcccatcctgctgcctttaaatgggtgtggcctgcctgtgcaacaccttccaaagaagtgtatg

SEQ ID NO: 55055 - DNA, 3125 bp, Homo sapiens
ttctccaagttgatcaggttggtctcgaattcccgacctcaggtgatctgcctgtctcggcctcccaaagtgctggaattacaggtgtgagccaccgcgcccggctgcatctgctttttttaagtcaaaattttcctcagccaacgtatgaaggtcacttaagacgaatttatgagagacgatgatgagaattgaaataaagtgaaacctgaaaggtagtaggtaagtagatacagtgagggtacagtaagaagacagacttaaaagattaggactattattcaggagaagcagaggagtggaagggtatgaccacaatatttaaagtattgaatggtattggataaaacgaatatgcttatttgccaaattctgagatcacaggctgagggaaccccttttgaagtatgagccaaatgagcttagaccacaaaaggtactttttcagagacagaaaaaatatggtgttcactatccctgtggcataatatgggacaaaaatataaaatggctttaaaaatattttgacgaaattataaataaagattccacacgtggctactaagaggagctgggttgtatctaggtgtaagttaaagagacaagcatacaatctcacagcttgtcagttgggacccctgtaggcagcagaatctgggcaggctaagggtctgcactaataaacaattctgttttcttaaaccattttgcaggggactattctcagatttcattacaactaggaaggactgcaaagcgggtaaacagaaaacaacctttcatcgttaggaaaaaaatcgtctgaaagtctttcataaaagcagctcctgataaggagtttgggactggacagtgaatcgctgaataaaatttaatctcgacatcctgggtcttctcccctctgaaggaaattctaacagcaggccttaggatgaaagtagaggaaacgtgcttcagttaaggttttctccagggaaaagaaatcggcccagcaagatgcacagagcaccgttacgaccacgcacaccgaaggtcgcacacgacccttttcctgtataacagtgccagcctgccgacgatcaggagcgcagctttcactattgtgttagccccggcggcggaaggactgagcctcactgcaacgttaaagagtccttctttgttcagccccagtcggggacgcagggcgcggtgttcctccgcgctcgccgcgcagtccctgcccccccgcggctttggagagctgccattcggcaccggagtcgctccgcgctcccagaatgcaccggcagtccgcgggaaaccaaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgaggtgagagaccttggcctgggaaccgactcttccggaggagatgggggttgggggaaggaggaagaaaggaagcaagtataaaagggaaagatggaggaccaaggtgggggtgggggctcctgtatgtgggtgcctttgcatttatgtgtatattgaaaagaatggatgaagaggagtagtcagttgagtgttgggagaaaatagggactaaaggagcgaggaggtcgttgggggagtctgttggaggaacaagatgaaacgttgagacggggaagctgtgtttggagggcaggaaggaacctgggggcgggagacggttggaggggcaggatgaacctggtgacgagggggtggggagccgagaggaggagccgttgggaaatgggggctgagggaaatgtggggagcagagtggagggctgcctgggaccttagcagtgcgcaaagggaagtagcagcttggaatcggagggtggaattgtatggaattggagtaaagggggtcgagtgtaagtgctggtaaggataaggggaacacactgaagtggaggttggaagcacaacctgaaagcttaaagggaagcggtgggagggaaagtgagatgggggaaagctaggtagcttatatttggagctcaccaaaaatatgaggcttttcttgtgtttaattaaacctaactcatataatctacgtctaggatgtagatttgtattgtattcatttttacaactgaggtaattacggctcaaggaattttaaccaatttgccaagatttcttaacatatttcggtagtgccagaactctaactctgtgttttacaatctggtgtccttggttgctagaatttttctttggaagcaattagagggaacagatggatttatcggggtaatctgactaacagcaagggtttgtgaacaatgggaaaaggcttatggaatgttactctattctttaaaacatttaactttggttaaagatagaaaccatgtaacactaacttaaatgtgaaaacctagctaggcctgtgtgtaatacataggaaggcaccatgtgaggtcagtacagagctagaaatatgtaaatagtacctgatttaatttgacttcagaacctccggtagtaatagtagttactttctccttcagatggattccatgtgaccctcctgtatacctagcctacaagctggtttcaatttccatggtttcattctctcttgggaattccttttttttttttttttgtcagtaaatttcaaagatagttgtatgtagaagtagttaatgtggataaaatgtaattaaattcacaataacctttttaagatttgaaaatgctttaaagggagttgttttgactgatggctttaagtgccctatagtttagttataacttgagagggaatacaaaatgacttgttttttcagattcctaaatataaaaatgtatttgaattcacattttaaaattagttcacctgcagttttttaaagtgctaaaaatgttctaaatatttgaattaagaacacacctgcttcctgatactacatttataatgttagtgggtattaacggaaatg

SEQ ID NO: 55056 - DNA, 2517 bp, Homo sapiens
gctgattctgagccactagtagcaacccctgaccatgggtttcagcaaggtgagggatgagaggatgacatttacagatggtgagagggggatgtttgtctatattgtaaacagatggacactacccacctatacccagttgtccagccgctcaggtaaagaatgtagagagggtttttacattgataaggtcctgaaaaagacctccatattttggcagagtttatcagtctaagcgttgcctccctacctgatcacactaaggcaaagctgaactctctacaaatcctgcatcatgtgtgaagagatcccatgtggatttatataacctcaatcttaactgtcactggacaactaagggccactaaatagctgaggaaagcctgctgcatcaaaggagagtctaaaataaacagaaaaacaaatgaaaggatttaccaagggctggacagtatgattgaaagaagaccttatgcctagacacatcattatgaaattttaagacattaaggataaatgaagatcctagaaactttctgaggaaaaaatggtaacctataaaggagtaaaagtcagagtggcatcagatttttcattatgaatgctgagtgtggtagaggaatagtatcaaacttccgagggaagttttcaacattcaatattttcaacattaaattctgtatctgggaaagtattggtcaattgtgagggtgggattgaaatagatatgcaaggtttatacagccttctgttgtaagccactgctccagcaaaagaatatgggatctagaaagcagagtgataaggggaacttccaagatgacaagagcaaggcttagaggatagtcattctagattggcacaggaacatggagagctttagaagcaggagttacatgtggaaaaaagatttgaaattatcattgacagtttgaaacaggaggcaacaaagggatatattaagcaattttgggaaaaattgaaagtgaataagaaaggatatttaataagggcataccacttatctttgcatgaccaatatttacacattgtacaataagtaaaacttactgatttaatgaaaatagttcaataagatttgtagaggatgagaggtaggaaataggagttggcataagatgtgaattatcaacttcaatagcaagaagtcagatttgaagttgatcagtttaaaaagagaagtataaacacattatttgtaaatacgagggtaccttcagaaggcatagttgaaagagttaaaaaaaacccacttgcctctgagagtaagactggaatattagaagtggtggagtgaggaactattgattttcaccttaatttttttctatactatttgctatttttataaaaaagcatatatgtggcattatgtttgtttgtttgtttgtttgtttgtttttgagacagagtctcactctgtcgcccaggctggagtgcagtggcatgatctccgctcactgcaacctccgcctcccaggttcacgccattctcctgcctcagcctcctgagtagctgggactacaggcacctgccaccatgcctggctaattttttagtatttttagtagagacggagtttcactgtgtgttagccaagatggtcttgctctcctgacctcatgatctgcccgcctcggcctcccaaagtgctgggattacagccgtgagccaccacccccagctgtttgtattgtttctaaaactaaggagtagagctggcctttaagctgcttgctttatgctttctgtcctttaggttcaaccctggttctctttgacattctactttcagggaaaccttaaccagaaagaaggcaacgagtctcaggcttcattttacatacctgtctcaagagataaaagagaattccttcttcatagctttaatgcagtgccaagcttaagcagattacctgttgcttcccttatacctgggccttactttggccctgtttggcctcatgaatttgactatatctgtatgaaagttttcaccaaaaatagcacttttcttaggttatattatatccttcacatgctattaacccacatatttactacttttcccagggaagggaagaaattgtgggcatgggaaagatggcaactaagaattgagatagttctttatttagttcactaggagaacagattgaggaatggattgggaagaattaatccattttccctaaaccacactatttctgaattaaacatccagttttcaacttcttgaatcagggtcttacttattctggggtagtaaaccaagaaagagttactggcttgaacacttggtctcaagggaagaaacttatttgtccaggcaatctctttcaagatgtatatgactagcagtgatccagtggtagtgactatgagccctctctcccaatctttttattgagttaaaatacatgtaacaaaatttactatcttaaccttttttttttttttttttttttttttaaaaggagataaggtctcactct

SEQ ID NO: 55057 - DNA, 1179 bp, Homo sapiens
agaccagagtcttgctcttttcacccaggctggagtgcaatgctgcggtctcggctcactgcaacctccacctcccgggttcaagcagttctcctgcctcagcctcctgagtagctgggattacaggtgccagccatcacgcccggctaatttttgtattttaagtagagacgtggtttggccatgttgaccaggctggtctcaaactcctgacctcgtgatctgcccgacccgttctcccaaagtgctggaattacaggcgtgagccaccatgcccggccatgaatgtgttgaatgtttaatgtagggttagggacttggtaatctcagtaattttttcctggaggtttgactgtgaatggaagggaaaaaatgaggaggtggtgggaagggggcataaggaatcaagggtaactataattaggttaggtctcatttgagacacagcacaccagaaatattaggagaagcagggcataaacactaggagatggaaaaataaaaaaatgtttgataccttatgacctaaggatgtgctatgcagcaggagtagtacagtggagagtaagacagagacagaccttgccatcctgaaagaaggggataatttattgaaataatagcaaagcatatgaaactgggaatgtttgcaatttttatttttgtacagtttctactttggaattctaggtcttaacgcagacctgccatggcattctactgaggtcatttttcacccatgattgattaattgttcaggctttggctattttttttttttaactgaagggatgcaaaatccctcaagtgaacactgaacttaaagccttttttttttttttttgagacagacttttgcttttgttgcccaggctggagtgcaatggtgcgatcttagctcactgcaacctccacctcctgggttcaagacattttcctgcctcagcctgccaggtagctgggatgacaggcatacgccaccacaccaggctaattttgtatttttagtagagacgggttttttctccatgttggtcaggctggtcttgaactcccagcctcaggtgatctgcccacctcggcctcccaaagtgttgggattacaggcgtgagccaccgcatcctgccccttaaagcttttttcaaagttgattgctaatagagttattcccatactgt

SEQ ID NO: 55058 - DNA, 1035 bp, Homo sapiens
cttggaatttgttgagctgcttggatgtgtagataatgtttttcagcaaatttgggaaggtaccagttatttctttggatatctctaaaatgtatttctttcaaactgaaacactccgtacccattaaacactaactccctattccccattcttcctagccgttggccgccattctgttttccatctctatgactttgagtgtctaggcacctcatataagtggaatagttgtccattttgtctggcttatttcacttagcataatgtcttcaaggttcatccgtgtttgagcatgtgacagggtttcccagaatttctgtatttttagatattgaagttagatattcctaatacttaggaactttttgaaacttttttctttaatttccctgctcattttatttttactaaacttttatgctgtttttagaattattatctagttttacatgtcactgtatgtttaattagtgaaaaatctaatttggaaaagtgaaaccaaacactgctttgttacctttaagaaagctgatggtggtatgctttgctgtttatggaatgtctgatacataagttataatgtaatttcacagtatttaatatatatttttttcctttaagtactcttatagtgtactttcctttttttttgtttttttgttttttgagacagagtcttgctctgttgcccaggctggagtgcagtggcatgatctcagctcactgcaacctccgcctcctgggttcaaatgattctcctgcctcagcctccccagtagctggcatcacaggtgtgtaccaccacgcccggctaatctttgtattttttagtagacacagggtttcaccatgttggccaggctggtcttgaactcctggcctcaggtgatccacccgcctcagcctcccaaagagctgggattacaggcatgagccaccgcacctggccttatagtgtactatttgtctataatgtaatgaaattgctggttctcaatgtttttttttttaaactctcagtctgcatatttgct

SEQ ID NO: 55059 - DNA, 1474 bp, Homo sapiens
ccttcctttgagtgtgaagagtgtgaataacaccagctgtcccttgaagtcactggttaatgtgtcttaactgcatgtggcataatcaagagattaaaatgtaattcacttttattctttacctaaacccagtcatgagattcaagacattatttgctcatgatcatggcctgcatacctcaacataaagctgttattttgatggcagctgccttgaatgtgttatcttggagtgtttgctgagtcttggcctcacttagagtaggcaatgaatggatattgagaattgttatcattttgttttaaactgctttgtttggagagtatttatgatttgaggtactttttatatttttgtcttaaggtttttaacaaatttaaaactttgattaacatataaaatatcccactggtataaaataagctctacaagtaagtcttatgtatggtcttttattctctaaacagagactctacaggggcaggtaattcactggtccacaagcggtctcctttacgtcgaaaccaaaagaccccaacatccttgaccaagctgtctttacaggatggacataaagccaaaaagccagcatgtaaatttgaagagggtcaggatgtcctagctagatggtcagatggcttgttttatcttggcactatcaaaaaggcaagttactttaatgtatcttttgctgtttttgcagtaagcatttaataatcttaaatttaacttcatgtttttaattttaagagatcaccgttaagtatttctctgtattgcagataaacatattgaaacagagctgcttcatcatatttgaagacagttctaaatcctgggttctctggaaggacattcaaacaggcaggtgctactatttctcttgaacatgatttaaattaaaatttgattttcttcaacttgtcatattatgatgttgtctgttgaatacagtgtatttagataactcagtattacttcctaggagaggttaaaaaatcagcatagtcgttattatagaccataagaagaacaagaatactctagaggacagatgcatcactaatttatacctgtaagctatgttaagacccttctaagaactttgaagaaaaatctttagtaactaatctcagtaacggtttgggattcaattcaactgttgcttgcttatatttgtagaaagcaagtgtttattgggagcatactgtttgtcagatgatttgggaaattaggacatataaaactgatttagaataatagaaatattcgttaataagaatggtttaaaattaccatttagttatgggttttttatgtttaaatgggaaaatgaggctatatttgtgtgccaataaaaatgaatgaaagtatgccttggtttggttataggtatgcttcttgtgatgatttctattattagaaaccatgattgtttcatgcttttagcatctgctaaatatagatgtttta

SEQ ID NO: 55060 - DNA, 1179 bp, Homo sapiens
aaatgaatctgaaacctgcgttatggcatatttcagtgaggagtgggtttagtagttttcttccctgtaagaaatctgccaataatgtatatcaaaacttaataaattatatttgtctaatgagtttcttttaaaaattttacataaagaaaaatattagtagtcaacagggtgaaatatatcatgttacaactattacataaatgtaagagggttttgaatcttagcatctaatgctgttttggtttctgtgaaatgatatactcttgcattgctggtggcagtgtaaatttctattttggtggtttagcatttgcattaaatgcagaagtttataattatctaatagactcctttctagcagtttattcataagaagtaattcaaaaaatactaggtgaaaaatgtttcctgaagtttattttaacaacaacaaaaaatttggtatttctaagatgaaatggccaaggctttctagtcaattggatttagagtaaaggagactatagaagattactaagctatataggaaggttcttgtaaacttgatggtaaaaaatatatacatatatgtttgatttcacaagtaaaagttaattcccagctttctcaggattgtttcttgggtcactacccccttttctgaggaattgccttccccatcattagtccaggtagttacagtgagagtcaggtcaggcacctcccctcgcggggctgttgttccatttccagggaattgtaaattttcacagagagttcccaggcttaatctggttgctctcatgatcggaaccataaacccagaagctatgggagaccaccttcaacgaagtgtaccaagaagcaaacagctgggcgcagtgccttatgtctgcaatcccagtgctttgggaggcccaggcaggaggattgcttgagcccaggaatttgagaccagcttgggcaacacagggagatcctgtcgctacaaaaaaaaaaaaaaaaataggcatggtgacacacacgcctgtggttccagttacttgggaggctgaggtgggagcattgcttgggcttgggaagtcaaggctgcagtgagctgtggctgtgccactgcactccagcctggatgacacagcaagaccctatctgaggggaaaaataaaaggaagcaaacaaagcagaagagagaggatg

SEQ ID NO: 55061 - DNA, 1861 bp, Homo sapiens
aaaaggaaatgctctgaattgagcgagaaagaggtagtttacttatcttccttactttttttctttaatttcatggtattagtggtgtaggataagtgaatgtatgtacatgaatagataagtattctataaagtagctctagtgttcacaaaccttctctatctgctgtcgcccatccctcatctccaccttcacctttaagagtgggaatatgagaaatgagtaataagggaagatgctcaagagcaatttaaattatgccttctgccaaaaagcagattaaattatgaaagtaggcatgttaagttaaaggtagaaagaacacagagagcagagagataccattcgtgtactttgtcttgtgaagcattatgatgtacttagcaaacattgcgcatatgtgctgctcactgagtcataaaagtggttttgttttatggaattttttatgactctcttttttaatgtgttttaaatattttaggagccactggaagtggggaaatggtctgtacaatatgtcaagaagagtattcagaagctcccaatgaaatggttatatgtgacaagtgtggccaaggtaaccattgatttcttttaatcttgttacatactgaatgactatgttgaagattaatgactaaaaatactttacattgataatttgaaattatcctttttattaattatattaatgtaggaaataatgctaaaatgcattcttgaaattgtgttgaaagtattaatgaaaccgaatttgctttatgctttttttgatattaaggatatcatcagttgtgtcacacacctcatattgattgcagtgtgattgattcagatgaaaaatggctctgtcggcagtgtgtttttgcaacaacaacaaaggtatattttaagtgttttgggctaaagctctgatggaatttgtaagacattatcaacataatgattgtgtacactgaaagtttgttggaatgaaatgagcaatgaatgctgggtagaaagaggtgctatttatttgactaatgatgcttaagtgactttttaatgatgctttcacttatttgatgatagtaatacgggaattggtgcagtaatttgaaagaagaaaagaaaaatagagattattattaatcagacagtttgtgatatggtaaaagtttggaaaggaaatttctccagaagtgtcagagtcgtttttaaagtatagaattgtgtttaaaattttagccttcactctttcacatttttttccctctaatgtagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagagtaagtaaatacagttatgtaattccctttaagtaatttttatttacttatctatttttcttgattatggtgtgtgagtgatggtgaattgcaactgcatgaacacatcagtgaagaaaaccagggggaaaatctattattttcataaaaaaataattttcatctagtttttgatcatatccacacattaaaatatttgtataagtcttatattctggaaatttaaagtgaattataaatattgtcataaaattaactattgagggaaaacatttactgcaggggcccagtatcagtagtttcattggatgtcatatttaatgtgattgaccatttagaaactggtatatttaatattataatttaaatgggagagtaaaagacaagttttttaagacataaaatcaacatggaactttttcacagatagattactgctttcttc

SEQ ID NO: 55062 - DNA, 2864 bp, Homo sapiens
agtttgaaatattatgggaatttccaaaatgtgacacagagacataaggtgagcacatgaacctagaaaaatagtgctaatagactgaatcaaggtatagctctgtttggaaatggtgccttttattattttccgataaagataaccgtatcaaagtttggaaatggtgccttttattattttcaaataaagataaccatatcaaaaccacatactagctgggtgtggtggtgtgtacctgtactgccagatacttgggaggctgaggtgggaggatcctttgaaccctgaagtccagcttggtcaatgtagcaatgtagccctgtctcttaaaacaaacccaaaatccatgtgctaactgaaaagagaagatatatttcttagatgaagattcaattttagcatctttagctttctcaaacagatctatagaccatacattgaaatatagctaaacctgtcaaaaagcctttatacctggtagagtcttagattagatttatgataatgttaagcaggtttattaaatcgttatattctttttattatagctgacaagaataatagaaacacagtaaagatatgaagtggaatgtttataatctgaaagctgcctaaggccatttgatatttggggcaaacaacagtacctctgaatctgacctctcctggggtttagagagttgatgtgaaaaaaagcccagaggcctggcatggtggctctcgcatgtgatcccagcattttgggaggccgaggacagaggatcacctgggcccaggaattggagaccagctctggcaacacagggagacctcagttttacttaaaaaaaaaatttgcctagcttggtggtgcatgcctgtggtcctagctacttgggaggctgaggtgggagggtcacttgaactgggaggttgaggctgcatgagccatggtcatgctgctgcactccagcctggacaacatagcaatacttgcctctttaaaaaaaaatagcctaggcttgtgttttaacagagctcatttgactagtgtaggagccaggcatttttgactagaagtagtagtgtatctttcaagagcttataaaatttcatgaataaaagagagaagagggatgaaatagctgatactataagcctttttgggaaaggaaatatttacagtaagtatagtagaaatgtgatgctttaattagaacagtattgtggattaggccactttttttttttttttttttaaagaaatgaacctttcccttaagacaggaattttagtgttaacttttttgttttttttaatagctggtatttgaagatgctacagtgctgcaaatgtaagcagtggtttcatgaggcttgtgtgcaatgccttcaaaagccaatgctatttggagacaggtgagaagggcatttgaactttactggctgatttttgtcactttttaattgtggttatatttgtgatttcagatttcctaaagatagtttcaacagtgatttggaaaggggttgtctcagagggaaaatattaaataatatacttaaaatatacgtaatttttgtgcttttggattttattccagaatgcttttaagtattgtcagtgattacatttgctcctattgacccatagtactctaaagtattctcattggtaccttcctttaaagaacctcaaagggatagtattagaattggaaaagaccacagggccttgttaaagacacaactatactttagatatgaaaaatttgtaaaagcagacttaatgtactttctatattagaagaatgcagggtagcacagtgagctccaggaacaaaaagctagaccactaagtttgacatctgaaaacctggttttaaaaatcttggcttatgccacttaattttctttctgaccttagggaagttcacttgtctctttcgggcttattatgttattttgagcgttgaattaaactatgtatgtgggggcagccatcacaattcctggcacacacaagcgattagtaaactataagtacgtgtgagtctgtgtgtgaactttgaaggtctccaatggttaaaaacaaagatcctttctcttcacatatgaactgtttcattatttgttattggaaaagaacttccttcaatcacagaaagcattataatttaaattatattttgttttgagtatcagtctttatatcagctgtaggttattcacttggtgaatattagctataattgttagtttatctctgatgactcagtataaaactttttcttttttttttttttcttagattttatacgtttatatgctctgtctgcagttctggaccagaatacctcaaacgtctaccattacagtggtaagtgtggacctttctgttaaaagaaagaaaagccattttcttaaacctacaagttgaaactttctatatacatttacttggcttaagtaaaaataggttatttatgcttggctttatttcttttatttatcctcatgcctgatgtcatcttcactaagtaacatccacttgtattgctaaattaataaggctgttcagtgttgaatgttataaatgaaactttcagatatcctttagacctaaattcttactcatatttctagttcttttgaacattcagaataccatacagtagaagagagataggtataacaaatatgctaatttctgcttcaatgtagtaattcttgtgtgttggaagtgtgatgaattttagaggtttactaataaaatgcttacagtaagtacttacaaatctttgttgtattttacatattttatcaacagataggatttaacccatgaatcaaatagtttggttaagtatggtatattctgt

SEQ ID NO: 55063 - DNA, 1321 bp, Homo sapiens
ttttaagttatatttttttaaagccagaccctctttgaatgcacttgaagaagtaatttgtggccaggtgcggtggctttcgcctgtaatcccagcactttgggaggccgaggtgggtggatctcctgaggtctggagtttaagaccagcctggccaacacggtgaaaccacgtttctactaaaaatacaaaaaaatttagcctagcgtggtggtgggcgcctgtaatcccagctactcgggaggctgagggaggctgaggcaggagaatcgcttgaacccacggggcggaagttgcagtgagctgacgttgtgccattgtactactccagcctgggcaatcagcgaaactctgtctccaagaaaaaaaaaaaaaaaaaaaagaagtaattcatatatcttctagtttatagttgctattcagaataagtgaatgtttagtcactattttctagttatttttatgtgtagtgatttattgtattgtgaatatgactatccacctaaatatttctctttgcattttaattactgttttataaggaaaccgtgattttttaacagtaaccaaaaacattgttttgtgtatttgattattttcggattccagggtagatatagcacacctatgcctttacaacctaagtgttattcataagaagaaatactttgattctgaacttgagcttatgacatacattaatgaaaactgggatagattgcaccctggagaggtaggtggtctgagaactaacttcagtagctacttgatgtcttttttgttttgttttgtttttcaaaaaacaactgagacacatgtataagtcagacaactaaaatagaattttatttttagttctggggacaaataagtttggtatggatatcaggaccagccttctcatcctcctgtgtgtttgttgcctgttgactctggaaatttgtagaaggaggaggtatattatttgattctttcattttctgaagtgaaagtcattgtagttaaagatagaagggagggagaaatctttagtattgggtatcttacttgtagttcaacctccttttcttctaagttttctataaacttagagatataaccaacattcttccttcctctcttgttggtactcctttatatatttctgacttgtaggaatggtgggatctaataatattgttagaaaaatgagttgtagagtgaagctgcctgaatagaaaattatcccctctcattctgacatctcattttgcttctcatttttgaagtgtaactacctatgctggtttacagtctttttttaaatgaatttaaaagtaat

SEQ ID NO: 55064 - DNA, 9919 bp, Homo sapiens
attggtagttgaaaggaagagttatactgtaagtattagtgtgagattagtatctggagaggggggagcaaaaaaaaaatattcttttggagatttatataataaacctcatggtcagatggaaggtgtagaatatgatgctcttctaatgtagattatctgatttacactataatggttgtacttttagtttgcaaaacactgaaagagggaagtctttggcacttttatggtagctaaaatatgcagttctatgcagagtagtcatggagtgctgaaggaacttagtagataaaatttctgagaaacggtagggagtaaataccaaaagaaagtagagttcattgcgatcgtcagaaagtaaaaaagtgggttttagaaattaggaagttagttttgctgttgactcagcaaattttcagatttttcagatatatggtttgtgaagatttaaaaggcaataaggaaaatctcttattagaataagtcatgtatacccttggtttcttttttgatatgattagcaacgctggtttgtcagtgtttttttttttttttttttttatggttagcaaacactggtttgggcatgatatagacatagtataacttgatttcagatgagatattaaaatgtgaactggttaaaatgaaaattaaatggatttgtaactaatggaaaaacagtaacaaagtcggtgctttggaaacattcttgagggagactcttatggagggccataggggttctgtctttgtctctaccttcaattctagaaggatgacagaatcaagagaaaagatctggaacattgagatgaaaacaagatcaattaacagcagttataaaattctgctttagccataaacacaaacagtacatgggtatgataggggatactcaatttgatagcagttcatctgataagatttcacagttggggtggggaggggggaccaggaagaagacagagttagtcagaagcttaatatgaagtaaccatgtgatatagctattaaacattttaacctaatcttataattagacataataattgcattcagatatttgaagagctgtcttgtaaaagaaggaatgaaagagctctggggaggaagattttgcctacttatggaatgggcttttttagttggtgccttatcagcttttatcagtggcactaattaagccaaggtcgaataaatatctgtactgtaaaagagactgcaatattggtggaaggctgaattggatctagggtctcattcaagctttaaagtctgattctattattcctcctttaaaattgaaattctctatcattagacccttcagaaattacagtaggagttggtggtttgatataggggaatgagtacctaactcgtatttaacatgttttttttttttagcactcagcatattggcacagagtgggctctcagtgagtgtagaatgaatgggcttatcacttgagttcaggttctagctctctcaccaactagacaggtgaatttgagcagttttaacctttatatttgttaactcgtgtaaaatagaattggagtagatgacttacaagttttttctagctccagcattctatttggcagatttgttttctctctcacttaaagcagttctgaggcttgggagtttcaactggtaaagaacatactggctgtaattttgaaagtcaactgtgatattttggaagcagcttttttttttttaaggtgtttgtagcattaattcaggatggtccttttgtaatttaagatttctttgctaatatgccttagtcaagaagaggcagaaaggtctctgagaaaaagccctattggaacaaaatagggtttttttctagaattaaatatttagattttaaaacagtttgttatgatgaaaaattattgagccatttagagctggctaaagtctataattgttatgaaaagatctctcaattttacagtattctaaaaaattatagagattatcggtttatgcttaatgttagaggtactggaaaatggtatgtttcttactactttttgtacttcctattgatatctgttaggaacttttatagtaaatattaaaataattctaatgtattatttccctaggttaaagaatttttgaaaaatttaataactaataatacagtcccatttttgtggtgttttacagtttgtagttccttcataaacatatcgttggattaatgtaatgaacaagtaactagtgtaggatttatacttcattttttataagtgagaaaataagccttgagaggttaaatggccctaggtcacataatagtcagtgaggacttggaattagaacttagatcttctgactaccaatcagtacacttttcctctgcatcacattgcctctatctagcacctgtatattactaattgatgaaattgtagtgcgttaaattgtttcttgatacttcacagctggcagacacaccaaaatctgaaagatatgagcatgttctggaggcattaaatgattacaagaccatgtaagttgatttattttatgtatccctatgagggagacatttagtaagtataaggaataatggcattgtttaagaattgtgggattgatgtacagaagaagtctataccattttaaactttataatgtcctattctattttagttagattaaagcagtgattctcaaggattggaggagggaggagtaatccttctcctgggaatggtgggtgggagacatatcggtatctctgggagaatttagcctgttccattgaaaaagcatattcagtaataacttccttctataatgtaatgtactgaaagtaaaataaaatcttgttagctggtgggaatattcaaaagatagagaatattgtagggaatacgggtttttaaaaagattgagatctgtggttataatagttaacaccattagttacagaaaataatatttctagctgagtagtctaagataattaagtgatattatttgatatattctcatacagatctacaggtcttccccctaccttatttttactttttttttaactcaccactatactaacaaggattcccttctttttaaaacaatgtatctacatttcttagaaacatttttaaatgcaacaaattttataaatgtatgtgttgactccagtgaaattttatattataaaatttttgttggcaataagttggtgttttgaaattgatagtatttcttcattaaataatgtaattaccagtggctggatctttacaccagctcaaaaagccatgaggtacctgatatgaccttgaagtataataaaaaggaaaaaagactgtaaaaaagtcataaggtacctgagcagttattgtgctggtaaaaatgtttcatgggacagtgaattctgaatttcagtttagggtaccagaaatatatctgttcctgttatggtagtaatgagggatcccctttcttaaacctgcaaaaaagtagaacattttggttgggcgtggtggctcacacctgtaatcccagcactttgggaagccgaggcaggcagatcacctggggtcaggagtttgagaccagcctggccaacatggtgaaaccctgtctctactaaaaatacaaaaatagccaggcatgttggtgcacacctgtattcccagctacttaggaggctgaagcaggagaatcgcttgaacccgggaggtagaagttgcagtgagccgaattgagccactgcactctagcctgggtgacagagcgagactctgtctcaaaaaaaaaaaaaaaaaaattaaaaagagagggagaacattctaaacaactgatggaggttcttgtggccaggcaagtttcagtagagctgaggtagatggagttgcttgggaataaggaccatagagactaaaagaaaggtctaaggagcatattttgcagaggcccaagtccataataaactggaataacccttctttgccccaggttatttccatttccagatccggcactctagatactccttttattttctgggcctctaggatttatctcctgctttctttttcaatgctgtcacctattatttctgactaaggtttttctctttataaatccactctgagatggaattcttttttccctaaatcccttttgaaatatttctaacagatgacactaaatatgggaaagcatattgggaccaaaaatataccattctttgttcttctttcttcctttaaaaagttagttgccatgtttaaaaagaaaagtggacatgtgctcttctcctttctggtcctatcccttcctccccatcatatcctactgtagactggctctggggcagataaaaatcaaggaaagcaaggggaagtgaatttttgtagtattgggtgggctttcaagtataagggccttatatatgaaagttaagttagggtctactatgtatatgtgttcagtttttaaaattttagttaatttttttaaaaatttaggtttatgtctgggaaagaaataaagaagaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaaggtaaaagttgatctgtggcttagtttttctctttagcttatttgtaactaaaaatgtatgttatttagtctccttagtatatttgaaagtacaagtggcagttactctgattttttttttttttttttttggtctatcatatcttgcttagacaaggtatgaagagttgatgccagatgcttgtttatttattttaggactttggccttccagaaatagactctattgattttgttagcaaacagcttaagagtactagcctgtttgtttgttcacttttcattgattgattgattgattgattcattcattcagcacagttttcaagtgccttattatctaagttttcaagtgccttattatctaagtgctaggcagtacaatgacagatagatttttcttctgccctgatggggtttacaaaggtgataagtaaaatagttacagattatgctagtgccatgtaggatagcatactgttttagactttactgtggatagagatggggcctttgtactttaacaatgtggcttaaggaaggactatttaagataatatttaaattaagacttaaagaatgagaatgttataacaatgtgaaaaacaaagggaaaaactactccagctagcagaaacagcaagtgcaaaggctttgaaacatattctaagaactcacagaagactggtgtggtataaatgaggatgagagagtagcatcaggtattggaaagattaggtggggcttgatcctgtgtagggtcttgtaggtcttacaaggaatttgggttgttttctaagaataatggggaggcatgtaagggatttaattatcttttagaaatacttggccgggtgcactggctcacacctgtaatcctagcactttgggaggccgaggcaggtggatcacctgaggtcgggagtttgagaccagccttaccaatatggtgaagcccatctctactaaaattacaaaaattagccgggcatggtggcttttgcctgtagtcccagctacttgggaggctgaggcaggagaatcgcttgaatccaggaggcggaggttgcagtgagccgagatcgtgccactgcactccagcctgggcaacagagcgagactctgtctcaaaaaaaaaaaatattgttttggatgctgttttgagaatggatagtatagaggtaagaataaaagcaggagaaaattaacactcaattgtctaggtgagagatagatgatatgagggcttgtgcagaggtaggtggtaacactcaaatggagagaaaacagatatgaggtctttattggaggtagaattaattggatttgctaatgaattaaatttctgaaaataaggaatcaattaaataatgcccagatttctggcctgagcaactggtgggtggttaatcaagatctggaagaacagattttggtatggtgaatgaagcattcttctgtttcatattcattgaatttgagattcttatgagggacaaacacacacacacacacacacacaccctcatacacacaggatgatgtgaaatacaggcaattggatgtgtaattcaggagctcataggagaggtctgggcaggtgatacaaatttggaatctgattgataaaagctatgagaatgagtgaaattaccaagggagcaagtagagagagaagagagggtggtctgggatcatgtcctgatatcatttataaatttggaagaggtgaaataagcaaggagactaaaaaagaatgatcagtgagatgggaggaaaccaggaagtttgatgtcatgacaaccaaaagaaaggtagtgtttcaagagagataggtatattaaagtgtattgaatgctagtgagaggtagattaaaatgaaagaaaaatatttattgcataaggtatcattttgttattagtgaccttgataaaaggaatttctttgaagtggtacagatagaaaccagataggactgggtgaaagtatgactgaacccagcattgccaaatttacgtgtcaaactgggcttctcctgcgtatcagggacacaggcagattcaaaataataacagtagtaaaggaaaggaggaaaataggaaactatctttaaggatcctgaatgagaggggagaaaatggaaagggtatatgtcatcaacacctagaagctttcctatgtagggaggccgacaaatggaatggcagctgaagagggggataggactagtcaaatgatggttttttaaaatagatgggagatagttggaacctgtttttgtgtgtaagtaggaatgatccagtggagaagaggaaattggtataggagagtagaagccaaaagagaagggatgtagagcctgaatgtgggactggccttttctagaaggagaagcatccttctgttgaaatggggtgaaagagaagatgggtacagatgccagttctgttgtagattgggcagttggaaattgaccgaagttcttgcctggtagcctccattttctcgatgaaatataaggtaaagatagctgagagacttgtacagagaggggaatttaagggtcaattaagggtatggaatagtcatcttggagataaggaaattgactgaagttcttgcctggtagcctccattttctcgatgaaatataaggtaaagatagctgagaggcttgtacagagaggggaatttaagggtcagttaaaggtatggaatagtcatcttggagataaggaaaatgtcattacaaagccttgacaatgagtccagttatatgaagtttgtaagaaattagctactaattaagttttctttgaatgaaggaaagaatgcttattctatcactttcagattttgtcactcagatcctttgctagcagttgcccatattatgaatcagaaaaaaaaattccacaagctttttcatttctatcatgattgtgataggatattccctttgtggtagctatcaggtcatctgatgccaccagataaggattcagctgctttctttaaaggcatcctcagttccttctggaccttgtgtataagttgttccttttagtttgagattactttctttagtccaggagtcctttataaatattatgttgatcattttacaaaagaaatggatatcccatccatcttattcttgagacttttgattatagcgtctggttctactttgtccttctagttcccctactttctccttcctcatacttccacctttattccctgaccttttttggcatctggagggataagtttttttcctactttctccattcatctctttctaggctattgtatagtgttcttttttctctccttaattgaagtctcctggacaatttcctcatagccctcactccattttattagcttggcttgtatacacatttgtcactttctaactatattgtgaactctttagcacagggaacacctttgtatccatattatctaatatcatctttatatggtagctattgctgagtaaatgaaatagatattctttctatatatatattttctttttttctataattagtgtctttgcctattgcacttttttccttcctattgcttggtatttggctttatgtttaaaaaatggttttctaggtctttctgatttttccttttgaatgactccctgagaatatgaaggatttcttactcctttctcctttacattctgccactctgggcttcattctctttctgatagtgtcattcaagaatctacatatatatctaaaggcagcctttatgactactacaatgttaacatagatatttcctgactccatgaagttaactgctaaattcatagtcatttttagtagtaaatccttgaaacatcctccaagttgtaaccacctaaaattaaactatataattgagcttttaggagttttgaaatcttccatccagtataattgtctggtttttgttgttgtttttaaatctttaagtggtatatattgttcagaattatattaaagaggactttctttaaacctttcataatgtaaatatctttaaagtcaagaaatatttatttggattagaatatattatctgtgcacttgactaaacttgtggattcaactaatatttactttttattaccattaatataaaataataaaatatatgtatatgtgtctagttacatacatagagtcaatgtctttgttttctttatgcagagattaaatgcataatggttttccatttcagggaagtaagcaatggcatagaaaaaaaaggaaagaaaaaatctgtaggtcgtccacctggcccatatacaagaaaaatgattcaaaaaactgctgagccacttttggtaagaggatatgttggtatatgttctcaagaagaaggatgcatgaaataactgagaagctagtatttttttcagcttactttagagacatgctttaagtatatatttttattttccaggataaggaatcaatttcagagaatcctactttggatttaccttgttctatagggtaaatagaaagttattttctccctttctaggttttgtcttttgagtagatattaatatttgtttgttatataatatagtcgttacacaatttaaattcttttgtctcaggagaactgagggaactgcacattcatccaatacctcagatgtggatttcacgggtgcttccagtgcaaaagaaactacctcgtctagcatttccaggcattatgggtagatattttacattcttattttttttactttttttactctagatttcttttctttgtaaagtgttgattgaataattttttagcaattgaaagtgatgtaagttgtgtctatcagctttttgagaggtaatccatatgtagatcccaatagttgttaatattcatttgaaatatttttgctttctagagtacaaatgtatttttcatgtttgtgtggaaatttgctgtgtacacagagaaaaagtataccattgtttagaagctgtgctcgttaggctttttaatgcctctgctacacaagtgttctttgctttaggaagatatgatttttttttttctttttaagagacagattctcactctgttgcccaggctagagtgcggtggcacaatcatggctcattgcagcctcaaactcctggcttcaaacaatcctcccatgtcggcctctctagtggctgggactacagattgtgccacc

SEQ ID NO: 55065 - DNA, 3512 bp, Homo sapiens
attataaaatcataaaataattgaatttctgtgctgaaaaggacctcacacattatccagtctaaccccttcactcattaagttcatgaacatagagattgagatttgaatttggccaagtaatagagttagggatagacccaggatactctgactgctagtttgtgcttattctgattctggtgtattacttcactaggcctagaactggtaataagagaacctctattctagttccactctttaaggacatggagcagtgtcatagatgtagtttgtgctcattaattatttgttctaatgaacaaatgaatgagctcttttaaatgatgtgattattggcaatacctgatttatgagtagggcctcttcgtaagaattttccttgttggcctcctaagtaaaaaaattaccctaaacttactagtagttaaggaagaaaagctccacaaagttcagctccaagaacgtgacaaaatctaaagtaatgagcccaagtgatagtccatttatatagcatttattgtttgggtttggctcatttttatatcatcaaggatatatggtatagtagagtaatccagaaaagagaacatattgtatgggcataggatgctaaaaaagctcagtagacaattctggccttctctgttacatagattatctgactccagaaaaagaacgcgtacaggaagatcttggcctgctgcaataccacatttgcggagaagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaaggagtctggcttttactatctttcttaaaaaaaaaaaaaagtcaaaaaaattcaaaaaaggggatgatactagccttaacatgtacctgtcaatgttatggatattgtcataaaaaggtatcttttaaaaatcagaacagagacttaattttttaaatcttaagatttgtagaatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgctctgtgactagacttcattgtcgtcttaatatattcttgcatgtgcatatatatacacacgtgtatatatatgtgtgtgattatgtgacctatgcaatacaaattatgggaatgggcagctttggagtatatatcccataattcttttttcaggaatagttgcagtatttacacagcagcatttcttctcaggcttttattgggtgctgttgcttgctatgtatgaagagaaatgtgtcagacaagtttagtgtgttctgaagaagggtgtgaacaacagtgttcatgggcttttagaatgcttttcacttttagtccttgtaactcagctgttcagtacctaaaacaaattcaaataatatgaacattatctcctactagaagtaacgttttcaagttttcatggcacattatgattgtaaatgtctctcatttttaacagtaagtctataggagtcccgtgaagattcctgaaatgtctgtagtaactgttagtcatgtttgaataagtgtagtatgaacaaagtattttattgcacagggttaacaaacagtatgttgccagctgaggctactgctgttttattacaacattacctcttgtttttataaagtgtaccaagatttaaattgataactttattttacttgtaaaaaaaaagtttcttttatcaccagtgttacagttgtcttctgtttctttttgttttgttttatttgttttcctttttagccaaagagtgaacagaagattttcttattttggtggctattcattttacttttaaaagtgattggtggattttagactaattatgggggaatttgccaccaaaataaaaaatatgtaaagtgtagtgattacagagtggttaaaatgtgggttagtacttatttattccattaattgattatttgactgtttataaagaaagttgctttatttctttaaacatcttcaaaagatgatcctttcttgtcacattatagccaaaagaagcagagaacttcattgtctgcatttggttcctggttggccaggtataaatgagctttacaaaagtgcaaattaaaaactgttacttctgtttacctccaccaaaacttgattttcccctagctattaatttaaggttgcctttcctgcagctgcaatattttgaataacacacagagtttgtgttgatttttgaatgtttgtttatatctaggggtaatgaaaaatgtaaatcccgtgtatccttattcactccacctgtatcatattatttcattttccccaaagtcctttaattctaactgaacaccagcagtatttttagaaatttttctttaacatacttggaagatgatttatccagctgaactgtctttagacgtaattattgtgaatgtctgttttattttctcatggtggttcacatggctctgatgttcagtttgtatttttggaattgctttacttagaaattaaaacagaccaacattaaatgtgtgtattttttaaagagctaatgagttttgcttctgtatttgcttgaaaatacacactagtgcagtagttgactgcttttatttagctagggtggtaaggattttctaattccactgctagtatgttcacttgaattaatctttataaaactttgctttcattttcttcatccctcttataatattaataactatcacatgttcatcttaagtggtcttaaagtacgtttagtgagcatgtacactttatatttgaaagacaatatatctctattgtgtccccaaactttaaaaaattcagacttaattttccaactatgtttgcttcttacatagaattgttagggttcatataaaaggatttcctgggccaggtgcggtggctcacacctgtaatcccagcacttagggaggccgaggcgggtggaacatgagatcaggagattgagaccatcctggcta

SEQ ID NO: 55066 - DNA, 1071 bp, Homo sapiens
gaggccggagaatggcgtgaaccctggaggtggagcttgcagtgaagcagtgagccaagatcgcaccactgcactccagcctgggcaacagagtgagactccgtctcaaaaaaaaaaaaaaaaaaaggatttcctgtacttttaaaataagttttgcccctaggcatataaaagatgtggaaacaatataccttactcattgtaattccatttttattcaaaacaaatacatttttataaatattctgctactaagtgataaatgtgtattcctagacccttagaccaccaaactagagccagaatataagctatcagagttactctataaattctaatataggggtgatgaagccagctcttgctacatatattctttactaaatatttaacagaattgaatgttcactgatgtgttagagttgaaggtgcccccggcttttttttttttttatttgcaagatatgtccaagtatgcatggttgttttctataatgtgtatgttgagtatatctctattatctgtgttgggggtagaactaactgttttgggccactttattgagtttctactaggtactattaaattttggttggaatatgatctgacttaggcagttctaccagactgttttacattgtggttctagagttgtttgaatgaggatgtgatgacaaagaagatgctcatgcagcgttgggaaacagttttgtttttttgtttttttaagccctgtttttgtggggagatttttcttagttatatttgagtacctcaatgaatgtacacatcacagtcccctttggttttttttctgtggcagttgatcagtcatgttcaggaaaataaaaactggacagtgaaatgtaaggtaagaactttatctgattatggattcttttctaattggcagcagttagaaaaccagacgtctgtctgatacacatttggagatggaagaagctatgaaagcaaactaataggttctctgtaaaacaagtagatgggctccaggtacaatatttgtaacttttacaaaaatgtcttggagtaatagctacattgaaata

SEQ ID NO: 55067 - DNA, 1025 bp, Homo sapiens
aattagtgttttaatcaataagtggcacttgaatatgttgtcattaatattgtaaaatgtaagggtttttttttgtatacagaatttgggatgacaataagccgataagagattttgtgagaggtatccttgaatattagcttttttgcttgaggagacatggaagcttaaggaaatgaagcttgttggaaagagttttggaagggaaagcctgtgggttcatcaaagacttgtggaagcatggttttggtttctgtatccctttgtcaccaagttcctgccagaatccaagagcgtattctgtaacaggtctgttgatttttaaaaggtttattgtaattttgcataaccttctatcttggatattttgtgttattttaacttgctatgaattttccaatgaagaattgtgtcattagagacccattctttataaactatagtttgttctgtaagcaacttttaaaccatctgaagaccagaaacattgaaaataccttttcgttgaagcatttcctagaaggtattaaatatttcatgcttttaaaaacaccatttttataacatactaacctttcctacctttctactgagagattatgaagattcattattgttcattgctataacatgttgtgctactcacgggaatctggatgtaggtgggggaatcttacccttaacacttaatgacttaggctaggtggtgcttttatatttttctgcttttcacatatcttctgttggaatccctatgttaataatccatgtttatttattcatagtgcactgagcagctttctactctcccacatagcttctgaacattattaattaatttgttacaggctggaaagaattaaggctttctgggacaagtaatcacatgaataaagttcaaaccttttacaaaccacagttctgattttttagactatgagggtttgagagtgatttacttctgaaaaaatgtaaatggcttaaaaatattgttcaccactggaaagatatttttttcagtttgt

SEQ ID NO: 55068 - DNA, 1169 bp, Homo sapiens
ttctgccatctagctttttgaagtctatgggggtcttactcaagtactagtaatttaacttcatcatgaatgaactataatttttaagttatgcccatttataacgttgtttatgactacattgtgagttagaaacaaacttaaaatttggggtatagaacccctcaacaggttagtaatgctggaattcttgatgagcaataatgataaccagagagtgatttcatttacactcatagtagtataaaaagagatacatttccctcttaggcccctgggagaagagcagcttagatttccctactggcaaggtttttaaaaatgaggtaaatgccgtatatgatcaattaccttaattggccaagaaaatgcttcaggtgtctaggggtatcctctgcaacacttgcagaacaaaggtcaataagatccttgcctatgaatacccctcccttttgcgctgttaaatttgcaatgagaagcaaatttacagtaccataactaataaagcagggtacagatataaactactgcatcttttctataaaactgtgattaagaattctacctctcctgtatggctgttactgtactgtactctctgactccttacctaacaatgaatttgttacataatcttctacatgtatgatttgtgccactgatcttaaacctatgattcagtaacttcttaccatataaaaacgataattgctttatttggaaaagaatttaggaatactaaggacaattatttttatagacaaagtaaaaagacagatatttaagaggcataaccaaaaaagcaaaacttgtaaacagagtaaaaatctttaatatttctaaagacatactgtttatctgcttcatatgctttttttaatttcactattccatttctaaattaaagttatgctaaattgagtaagctgtttatcacttaacagctcattttgtctttttcaatatacaaattttaaaaatactacaatatttaactaaggcccaaccgatttccataatgtagcagttaccgtgttcacctcacactaaggcctagagtttgctctgatatgcatttggatgattaatgttatgctgttctttcatgtgaatgtcaagacatggagggtgtttgtaattttatggtaaaattaatccttcttacacat

SEQ ID NO: 55069 - DNA, 1068 bp, Homo sapiens
ggctggagtgcagtggcaccattatggctcattgcaatctcaacctcctggactcaagtgatccccccacctcagcctcccaagtagctgggaccacacttggtgctaccatacccatctttttgtagaggcagagtctgtctgtgttgtccagcccagtcttgaactcctgggttcaaggggtcctcctgccctagtctcccaaagttccaggattacaaggcatgagtcactgcacccagcctcattttttaattaagttaaaatttctgagcattctttaataataaaattattttatttatctccaggaatccatcaacagcatcaagtccagactaagcaaaagtgggcacatacaaactctgcttagagcatttgaagctcgtgatcgaaacatacaagaaagcaactttgatagagtcaatttctggtctatggttaatttagtggtcatggtggtggtgtcagccattcaagtttatatgctgaagagtctgtttgaagataagaggaaaagtagaacttaaaactccaaactagagtacgtaacattgaaaaatgaggcataaaaatgcaataaactgttacagtcaagaccattaatggtcttctccaaaatattttgagatataaaagtaggaaacaggtataattttaatgtgaaaattaagtcttcactttctgtgcaagtaatcctgctgatccagttgtacttaagtgtgtaacaggaatattttgcagaatataggtttaactgaatgaagccatattaataactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattacctaatgatggattgaataaatctttagactacaaaagcccaacttttctctatttacatatgcatctctcctataatgtaaatagaataatagctttgaa

SEQ ID NO: 55070 - DNA, 1353 bp, Homo sapiens
ggattgcttgagcccaggagttcgaggccagccttggcaatatggcgagccactgtctctataaaattaaaaaaaaaaaaaaaaagaggaaactgtcacttccgtcccccacccccgcccccgcttctttcagacggatgtaagattagctgtgtcaagcgatcttgagacaggagactactacataaagttatgacttctttccaaaatgaggaatctttttcgactacagcccattgtatcacatacatagggtataaaagaacacttgtccttcgtttgatgggtgtgcgtgtgcaaacctacaaacacattgttaattagggccgaaagatgatgttgttaaggtcggtgagtaggatgatgtgcttttctaggtatgcatagtcagtgaagatagccttttttgggtaactactgtaaattgaagttaaggacattcatttgacagtaaatgtcccactaggaaaatgaaaacattttagtatcaaatatattcattgctactgcagaagagttagggagttctttcttttttttttgagaccgagtctcactctgtcgcccaggctggagtgcagtggcgcgatctcggctcactgcaacctccgcctcccaggttcaagcaattctctgcctcagcctcccgagtagctgagattacaggcgctcgccaccacccccggctaatttttttgtatttttagtagatacggggtttcaccatcttggccaggttggtctttaacttttgacctcgtgatccacccgccttgacctcccaaagtgctgggattaccggcgtgagccaccgcgcccggactgggagttatttcttgcatggcaatacacagatgttgaactaaaacctgatttaagatgaaatatatagtaccaaatggtattatagaatttgcccaattttctctacccttttctccttcaccatcctacagagagctagagatgttgaataggtaaagcaggatggggacctgatttattgacttgtctgcgagagtcttgtcacttaagcagaagcaaatttgtggaaacaaaaaagggaaagaggatagaaccagtttgtctattaagattacatagtatctcatttaatttcctgccactttctttccataaggtgggagttttctttttaatcttcctccctacatctgagaatttttgagtggggaataaatgtaacataccattctaactggatgagggaaggaaggacagtttagtattcgttaattcattcaaaatattgagcttctctaagtacattgcggtcctgaacgtaatgcacaggacttttaaccttttggaacttgggatgggatcagaatg

SEQ ID NO: 55071 - DNA, 1027 bp, Homo sapiens
acagtgaaaaaggtaaatgggatctgaaagaggaatgtaattttaagattgcgcagaaagctctgtagtagtggagattataaagctttagttttttattgtattaattacaataataaaatgtgatgctttattgtgatttttatatgcaaagaaatttagtagtttcacaaccctagagatactcatccactgaagaaacaaaagcttttcttcatttctatgagttgacctgccaaatgttattttgatccctgtggttgtgacttgtaaatgtgtctttttaaaattttataactattgggcgtaggaggaggagacagcttttatctggtaataaattcccttctaacaaaatatgaatgtaatgataccatttaatcagatgtccagtacttgtaatgtaattatgaaagttcaaacacctcatattgaaattgatatgtaatatgtaataaagctacaatgcgacataatttaatggtctttgcatcctaatgacttggattcaaatcttgatttcaccatttacagtttgtgtgactttgagcaagttatttaatgtctgattcttagtttccttaacatgtaatgaaaataattaacaattgttaggaagatcaggtatgcttacaaaagagaactataataactagaccctggctaaaatgaaaaattcattcattgaaattgtattgaattcctttatggctttacactacagataaattcattattattgattttttgttttgttttaaaccaccatgaaagatttcacaacatttaaaatagaaaactaatgagttaaattctattcatgtgagtattttgactgaaactacagaatctttcagacaaggtacaagaaattcattttttttttaagaaatggaatctagttcatcagactactataataaagacaatgaagaggaaagtttgcttgcaaatgttgcttccttaagacatgaactgaagataacagaatggagtttgcagagtttaggggaagagttatccaggt

SEQ ID NO: 55072 - DNA, 1032 bp, Homo sapiens
aagaaagaaagaaaaaaaattttgtctttccttttcagcatttatactacttattaccttttcatatttgctttttgcagtgggtagaactgtcagaaaagttgttggatgtgggggtgataacagtcatctttatttagtttctgaactatacaggaatgcttctggtatctgactataaaatacgatgtgagttattacttcagatatatttatcatctggtggaagtattcttttattctttaaaaaactcttaattaacaagtgatgaatatgcctttttctctatctctttttgtatattgtttctcttaactcattgatttaaacaaatataattcctaatattaaattattcttgcatacctgggataatctctttagtagtcttaaacaaagtatcctttattttatagagaggcagaaaataagctggaacagagccagaaaatggtaattgaaaaggaacagagtttgcaggagtccaaagaggaatgtataaaattaaaggtggacttacttgaacaaaccaaacaaggaaaaaggtatgtgtttttaaagcaaatacatgtttttgaaagggaataaaaggaaatattacctatttaaaattctagttaatttttgaagtgaaaaaatttcagagatttggcaataaattaacttaatgttcttttttatctattaatttttttaaattttccattaaaatgtttatatgtggaatttatgttattagcatcctggattgggcttaatttctacaaaactgataacgattatcagtttaatgatacttatttctgaaattaagttctatggcctatttgaaaccagtacactgagtttaaaatactaacagggaaaaagcctgtaaattaatattacctctaataaaactaaataaaatgttgaatgaactctttaaaagaaaattttgcctcatagagaaagaaactcaatgcctgtgaatgtgtgcttggatcttcctttagaaatatataaatagtacaaaaatatctattttgtat

SEQ ID NO: 55073 - DNA, 1284 bp, Homo sapiens
atttatttgacctttgcaaaggtcacagaatttactgagtatatttaatattctagacaatagactgattctgtaatacctaacctttgaaaatgtatcatccagcctcaggctatttccctaatctgtcttttccagatagggaaaaaaaaaattgccaacacataagaatttatatatatttcgacatttatgtttattattgttttgtgttttatttttcatattgatagagtgagaaaatttttgtagtatgatctacattcttcattttatactttaagcctaatactcctttttagtgcagagaaatttgtttctctccaattattccttataattaaagattactttggaacttaactcttcaaatgcagagcattcttcacttttattcattatctctttttaaattttagagctgaacgacaaaggaatgaagcactatataatgccgaagagctgagtaaagctttccaacaatataaaaaaaaagtggctgaaaaactggaaaaggtaaaaggcagttgtgcaaattcagtgttttgtattactgtctatattccaacagtaaaggtaggaataattaaaatatgtttatggttgagacagagagtaatttttatgatcttacaaaatcatttaaataaacaatttgtaaatgttagttaaggatgatgttcaccaacccttttattatcaggagaaacttttttatccaaagagggaaaagagtagagagaggagaaggaacaaaatacagagaaggatggaatgtgttaacagagactggagctaaagaagtagaaaaaagaaattcatttttatcacttcaatgaaaatgaagatagattatgtagctttcaactggtctccctcagtctgctactctgagaggggcttgcttctgcctctcggaaggttccttgaactgatttgatatagaaataatagtgagtttattacattcatttattatattcatttattatctttaagtaatatcacatggtaatgaaatgtgtatggaggaacaccacagttggatattcagatattgagctcaaaagagaggtctggtaaagagatactaatatgggagacttccatcttgagatagcaatgaaagcagaggaagtttatgattctgatccaagaaaggtagaaaggcagaggaaggaatgttcaggtagaagggtagagtaagaagatgggtgttcatttattaaacaatcatgaaattccttttacatgccaggtactgtgctagtctctgggagattc

SEQ ID NO: 55074 - DNA, 1090 bp, Homo sapiens
ccctctaaaatgtctaagtttttcctcacagtatctcccagtgtgccattaagacttgttgatgcagtatttcttaaaagaatccttgtaagaacagaaagtcattgatgctgggctcttaagctggttgtacaattatgtagagccagtttactttttctcctgttttaggaatccaaaactttgttgataatgtgaaatgctatgtcagggattttgaagttagatttcctgtcttatataattaaacagggagcagaaatgcttttaagacagtagggctgtccttccctaccatttactgtgagacactaggaaagttatataacctttttgtgcctcagttacctcatctgtaaataagaagtaataatagtgccaaccatataaagttgtgagtgcctggcatgcagaaagtaggtatttagtaaatgtgagcaggtattattttagaattaagcttcaaaaaattttaaaagtgagattaaataaatatgattaaaatgaatgcatatatattttattttcatttttattctcttttcttcataggcagttaaaagaagaaaataacaacggaaaagaaaaattaaggatcatggcagtgaaaaattcagaagtcatggcacaactaactgaatctagacaaagtattttgaagctagagagtgagttagagaacaaagacgaaatacttagagacaaattttctttaatgaatgaaaaccgagaattaaaggtccgtgttgcagcacagaatgagcgactagatttatgtcaacaagaaattgaaagttcaagggtagaactaagaagtttggaaaagattatatcccagttgccagtaagtatgtgtgattacgtaatggaaaagaagaattttactaaagtgttttagaaaagactatcattttgtggttgctttattagcttctaatttctttttctctatacttttagtcatgaatttctcttctgtctaaatctctattttttttcctgcacttaccattctacacttttccccagtttctcagatgccatatataagaatggcacagaattttttttaaacagctttgttgaagta

SEQ ID NO: 55075 - DNA, 1030 bp, Homo sapiens
ttcgtgatccccctgccttggcctcccaaactgctgggattatgggcgtgagccaccatgcccggccttttatttttttgaaacgaagtttcactcttgttgcccaggctggagtgcaatggcgagatcttggcgcactgcaacctcagcctcctgggttcaagcgattctcctgcctcagcctcctgagtagctgggattacaggcatgtgccaccatgcccagctaattttgtatttttagtagagacagggtttctccatgttggtcaggctggtctcgaactcccaacctcaggtgatctgcctgccttagcctcccgaaatgctgggattacaggcatgagccaccacgcctggcctaaaatgtttttataataatggtctaccaccttttctcttttagtaatatttgtgaccatatatataaatgagattaagaagaaggtaagtaaacctattcaggaatttgtaatcaataggtgtaaaatgaaggaaagatcaggggaaactataggtaaatatattatggttggtttcagatatgaatgtatggtagactagatggtagacttaccaatgttaaactgttatgaactgtggaattatgaaccaaaaaaatctcagaaatcatctgattcaatactattttattggtgaagaaacctagacccaagaaagtaaataacttgcccaactggtaagtagtagaatttaaactagaacataagatcttagctcctctgatatctgctttcccaggatgctgtttatttgcttggatttttaatgtactgtttgcttttgaaattagaaagtaatcatatacagataacaattttaatttggcattctcatttgtgtatcaagaattatttcatatatggtcaggcacagtggctcctgcttgtaatcccagcattttggcaggccaaggtgagaggaactcttgaagcaagagttcaagaccagcttgggtaatacagtgagaccctgtctctacaaaaatgcaaaaattagctgggcatggt

SEQ ID NO: 55076 - DNA, 1049 bp, Homo sapiens
ttctttgtgtaccttgtcagatcccaattatcttcctctctcctcagaaatggcaattattctgaaattcatgtgtatccttctcgtccatgttttaaatattgtcacatatcgatgcatctagaaatatatatatgttgcttagtgtttttatgaaaatactgtttgccactataatttgtttttcactcaatattgttatgagatgtatccatactgatttatgtgactcaggtttatttcttttaactattgtagttttccaattatcttaatatttcttaatgtatttatatattctcctattgatggacattaagttgtttccattaaattcatacagtttttaaaatttgaagttctgaataaaaaagcaaatgcatctcatttacataagtttacatatgtttgtttttaaacttgcagttaaaaagagaattatttggctttaaatcatatctttctaaataccagatgagtagcttctcaaacaaggaagaccgttgcattggctgctgtgaggcaaataaattggtgatttcggaattgaggtacaattttcagattctgcagttatagcaaatagaatgttttttattggtaattaagacccttaattggccgggcatggtggctcatgcctgtaatcccaacactttgggaggctgaggcaggcggatcacgaggtcaggagttcgagaccagcctgaccaacatggtgaaacctcgtctctactaaaaatacaaaaattagccaggcatggtggtggcacgcgcctgtaatccccactacttgggaggctgaggcaggagaatcacttgaacccgggaggcggtggttgcagtgagctgagatagtgccactgcactccagcctgagcaacagagtgagactccattaaaaaaaaaaaaaaaagacccttaattgaggaatttaaaaaatatacagaaaagctcagagaatattataacaggtatctgtgattccacaactaagaattgaatcttcttaaccaggattgattctccttaaaatttgtggtatttgt

SEQ ID NO: 55077 - DNA, 1049 bp, Homo sapiens
tttttcactcagcagtatttaaaaaattcattcatattgagatagagtagattaacaaatggatttgtgtaattacttttaatagctgtataggattctgtcctataacagtgtcataatttatttgttcctttataggtatcttgtttctgttttctgttacaaacagtgctgcaaaggacatccttgtacatgttttcttatacatatatatgagagtttctgtagtatatattcctaacagtgaaattgctgggtcatacagtgtgtacattttcaattttactaaataccatcaagtttgtaaagtggctgaaccaatttataattctacagtggtatatgggagttttcatatcctgcctaaagagttgactaatattagaattctaattttttaaatcaacttgaaaggtgaaaaatagtacagtatgagtttttttatagaatctttctaataatttttcccttcttttcttttgtgccagaattaagcttgcaataaaagaggcagaaattcaaaagcttcatgcaaacctgactgcaaatcagttatctcagagtcttattacttgtaatgacagccaagaaagtagcaaattaagtagtttagaaacagaacctgtaaagctaggtggtcatcaagtaggtaagtatattgagttattttaataaattatattcagagttttggatgatagtttttttttaaaaaaacttttatttaaattttttttttaatttaagttcagggatacatgtgcagatttgttacataggtaagcttgtgtcatggaggtttgttttacagattatttcatcacccaggtattaagcctagtaccccttaattatttttcctgatctactccctccttccaccctccaccctctgatagaccccagtatgtgttgttcccctctatgtttccatgtgttctcagatgatagtttttaaagaacaaatttatcaactgtttggtttctattatcaaacatacttgataatctgttactagttgtggtctgataagacagcaaaagttatt

SEQ ID NO: 55078 - DNA, 1685 bp, Homo sapiens
ttctcattagctagtttggagagaaagacgatggggtcgggaaggattcactctttggagcttttgaacctgcttctgtgtgcagtacataaaaatgttcttaatgatctcaaactgtccaaataaattttatgattaccttcagtttaaggaaacagggcaacttaaaaaaaatttttacaatgatttctattaaaaaatggaatttaaaaggtggagaaggattcttacatttctggtacaaaggaatagtcttagctacctagaaaaatgagtgattcagaacttttctcctctttgttacgtatttaatttagagagcacattacttattctttgatttccttaatgaatgtctcattctctgtcccttttagtactctttagatcagaaactaaactttgtttatgactaaatctttcaactatttaagtaggtttttattcttgaagtcctattcagaacaattttccttttatgtttattagcagaaagcgtaaaagatcaaaatcaacatactatgaacaagcaatatgaaaaagagaggcaaagacttgttactggaatagaagaactacgtactaagctgatacaaatagaagctgaaaattctgatttgaaggttaacatggctcacagaactagtcagtttcagctgattcaagaggagctgctagagaaagcttcaaactccagcaaactggaaagtgaagtaagcttggaattagcttggtatatatgttaatttttgaactagaacaaaaggtattattttagggttttataaaaattatatgtttacatccagatttaaagtttttaaaaaatggtaccacataagttataaattgttttaaaattatatttggaaacctttgtattttaacttattaaaagttaaagttattaaaagtaggaaaaactgtagtgggtaaaagtctcaaatttggtggaaataatattgcattgcagcctattatttcttccatagtataagttaatatggttaatatacatttataaataaagactttggattatgctgttggaagaaaaggagtgataataaaggatttcaaattttagcaaaccccaaaccacctaggaagcctgtttaatatgcatatttctgggtcctgttccagcaatttctgattcagtatatatgggcacaagagtctgcttttttcttttctttttctttttttttttttttcttagagacagggtcttgctctgttgcccagtctggagtgtggtggtgtgatcatagctcactgtagctttgaacttctaggctcaagccattctcctgcctcagtcttccaagtatttgagactgcaggcatgtgtcactatgtccagctaagtttttttattttttatttgtagagacagtcgctgtgttgcccaggcttgcctcgaactcctggtttcaggtgatccccacctcagtatcccaaaatgctgggattactggtgtgagccaccacacctagccggaatctgtatttttattttttgtgtatttctgctgtttaaagagtctgtatttttaaacaactgcatgtaaacctgaaacaactacgcaaggaattacattctgaaaaggggataatgagtgttttgtgaatatcttgtcttcattttcactgaggacaggataagggtgcctcattaggta

SEQ ID NO: 55079 - DNA, 1033 bp, Homo sapiens
ctttgaggaaatgccacactgccttccacaatggttgaactaatttacactcccatcagcaatgtaaaagtgttccttttctctgcaacctctccagcatctgttttttgactttttaataattgccattctgactggcatgagatggtatctcattgtggtttcgatttgcatttcttgagcgatcagcaatgttgagctttttttttgtatgtttgttgtccacatatatgtcttcttttgagaagtgtctgttcatgcaagtgatttcatttcttccttaaaaagagagaagctgaagacaatttggcaaaatacaaaaatctatgtaatttcaattatagtgtcacatgtatttaatatttaaaatgtttcaaaattttaaaatatttaatatgaaaattctgttttcatgtttagcttgaagctcaactagagaaaaaggaccaacaatttaaagaacaagaaaagactatgtccatgttgcaacaagatataatatgcaaacaacatcatcttgaatcactagatagactcttgacggaaagcaaaggggtaaaatcatccttataaaagtgctatttagaagttgactaatattttatgtctctataacttgcctttaaatctaatcaaatctgcatacttatacttttcttactgtttttaggaaatgaaaaaggaaaatatgaagaaagatgaagctttaaaagcattacagaaccaagtatctgaagaaacaatcaaggctagtatgctaatactttatttttctttctttccttttttttttttttaacagacagaatctctctcatttgcctaggctggagtgcagtggcatgatgataactcactgcaaccttgaactcctgagctcaagtaatcctcccacatgagcctcctgagcagctaggacaagcgtgcttcaacatgcctggctaattatttttttctatttggagacattcttgtggcttttttacttttctctgtaaattgtaaacattgtacagataaaaggcaattcaga

SEQ ID NO: 55080 - DNA, 1013 bp, Homo sapiens
gttggccctagtttatcttgtcaattgtggctcccaaataaccatttcctacaaattcatcttcttactaccctaggcttttgccaacttctcaccactccctttcgcagggccttgcttctgagcatactcccttttcctggaatgcccttctaaacttgtccaactcttgtttattcttcaggattccataccttggttttctctttggtttcctcatttgcaatgaagaattagtttactcaataaatatcttctataatggcattttatatcctaagtaggactgtatattcactatttgaagcagtcaggtaacattaggagataaatctgtaaaatattgagtatatcgttttgtgttttttttttttttttgctttttttcctgcttaggttaggcaactagattcagcattggaaatttgtaaggaagaacttgtcttgcatttgaatcaattggaaggaaataaggaaaagtttgaaaaacagttaaagaagaaatctgaagaggtaaattaacatttactttatatatagcatatatttcaagtgattttttttaagaagcatgagatgtaggacaaaatatatatatatatatatatttcttttgagacagcgtctccccatgttgcccaggctggagtacagtgtcgcaatcttggctcacttgaacctctgcctcctgggttcaagcaattcttgtgcctcagcctcctgtgtagctaggattacaggtatgcactaccatgcctggctaatttttgtatttttagtaaagatgggatttcaccatgttggccaggctggccttgaactcctggcctcaagtgatccacccacctcggcctcccaaagtgctgggattacaggtgtgagccactgtgcctggccaaaataatatcttttatgtatctgatataaaaaagtatttccaataaaatgtaaattccaattttattttctttaaagagcaaacatttcaatgcaaaatagaatataccttaaaa

SEQ ID NO: 55081 - DNA, 1028 bp, Homo sapiens
cagataaaaccatggctgcctatgctgttccctccttctgggagaggtcagacagaacatgctcctttttatagcagtaaaatgtggcaatatctgtttctgcctagggaagcctatttatgactcaaagttcagggtttttattgggggcttgtcacacaggaacaatgaccagcctacaagtatcaaaaattccagaattctaaaggaaggcatgtttcagtgccccagccaggcaaaacaacctcatcacttaggaacatttttaaagccacatttccagacaccaaccaagagcaatcctataagcaagcccttccagtacatctccccattagaaaaatgaatactgtccttccaatgacaaactatagacatgaatgcaattgtcccacatgacaagtggatggttatctaataaggaggacagctttgacattttattgccatttatttgaaacattgcattgtattgagagatatatatatatatttgccaggtatattgtttacagaaagagctaaagataaaaaatcacagtcttcaagagacttctgagcaaaacgttattctacagcatactcttcagcaacagcagcaaatgttacaacaagagacaattagaaatggagagctagaagatactcaaactaaacttgaaaaacaggtatatattattagcccaagattgttttatttgtatgaaatagaaatttttaaaatcatgaatagatttttcgttagttttttaaattgctgtttggccagatgccgtggctcgtgcccataattccagcactttgggaggctgaggcaggcggatcacctgaggtcaggagttcgagacgagcctggccaacatggccaaacctcgtctctactaaaaatacaaaacttagccaggcattgtggcacatgcctgtaaccccagctactgaggaggctgagacacaagaattgcttgaacccaagaggtggaggttgcagtgagctgcaatcgtgcccttgcactccagcctgggcgaca

SEQ ID NO: 55082 - DNA, 1062 bp, Homo sapiens
tatgtgaagtatctttattattagaaagtaagccttgctttttatattttccaaacattacttcttggtctatatgttgatttttatgatacatcttgaaactgataagctaggttacatatttataaaagtatttttcttctgaatttaaaatgtttactgaaaactgctttacaaggtgtcaaaactggaacaagaacttcaaaaacaaagggaaagttcagctgaaaagttgagaaaaatggaggagaaatgtgaatcagctgcacatgaagcagatttgaaaaggcaaaaagtgattgagcttactggcactgccaggtaaaatgtgaatatgttttatttaccttcccacttcaatatcagtggtatctgagttttgaaatcagataatgttcagtggagcatttgcttgaggaattaatgtctccatagtctgtgttcctattgcattttgtttgtatttccttcatatctctcattatgctttttactgtattacagtttaatgcttttaaccttcctactataagtttcttaaggcaaggatcatacctggtttattttagggtcttacacaacaactggcacagttccttatacctcataggcactcagcaactgttaattgtgaataacattaaaagttgtaggcaaaaatgtaaatgtactcacatagaggaaactttcaggcaatccaattatataggggaagaatgacaatataaaagtggttctcagccttgagtgaatattaaaatcacctcaagagcttgtaaaaaaacatactgatgactgggtcccacttttagattaaataaaacctaaagattctgatttaatttggctaggctggtcccaggcatcgatacttaattggtcaagaaaggaacccatgagctgaaagcagtacccagcctcttcagatctcttctactttgttgggaagaattgacataatttataacataatcagcccacccttctaccaacaggagtcaagagtgaacttaggcactggcactaaaaccacatgtccccaggttccctctcctccattga

SEQ ID NO: 55083 - DNA, 1051 bp, Homo sapiens
taaattagggtttaagagggcttagaatttgtaatatttttatattagatttaagtgcttttttatatgtaaggcatcgttttgagtaacatcctcatgagaaatactatggttaaatgcctcattcaattgtaatgaagtcacaattgttacatgtaaaagactttgaaacactcctttgatctgtgtatgaaaaaatgtggatatgtatttttaaaaattcttataatcattcaatcttggagtcctgggagtgttttagcaattagcttaaattatctgtaataccacagtgtgagttaacttttacccttttagaataccctttattaaattaattgtattgatgtcaatctttttctttatctattattccttaaatttgaccctttcaatctgacttgattgcatatattattttgcttttaatttatagaagaggtaacctggttgacctaactttttaaaattatactcttctactatctgctttgatctttttcctttgataaattgtagagaatgcaagatggagattgaagacaaaaagcaggagctccttgaaatggatcaggcacttaaagagagaaattgggaactaaagcaaagagcagctcaggttgatttttcttgattatattttaatggagttttctgttatgacacagtcacacaggatttgagaggtcaccaattttttgtaaaatgggcatttttatagcatatcttttctctgcacatagggtttactaaattagagatatgtcatctctctttatcttgatatttttctagcaagtagattttgaaaatgaggattagcttagtatctgagccttttgatctcttatattaccccgtatcagaagaagctaagtgttggaggaacaaaaatatttggaaggcgttatttagcactttttgtccagcataaaatgaagtctgaattatttgtcatttatgaacacaactatattttattgtttctataatgtatatgggattgaatgtcactatgtattgttaaaaaaaatgcatatggggctcatga

SEQ ID NO: 55084 - DNA, 1022 bp, Homo sapiens
aaatatttttctgatggtctaggtataggcaaagacagtgtcttatttatctctgtatacaggcctttgcatggtatctttcatatagtaaatctacaatatatgcttatttggttgacaaatatttattgagaagctgctatgtaatagaattgaggagtcagctttttttttttttttttttttttttttttgagactgagtctctctctgttgcccaggctggagtgcagtggctcaatcttggctcactgcaacctctgctttccgggttccagtgattctcctgcctcagcctcccaagtagctgggattacaggcacctgccaccacgcctggctaatttttgtatttttagtagagatggtgtttcaccatattggccaggctggttttgaactcctgaccttgtgatccacctgccttggcctcccaaagtgctgggattacaggcgtgagctaccgtgcccggccgaagagtcagctattaataagatacagtgttttgtctgttaggaactccatcaaaagaatggataaataaataattgtacattgagaccaagtgcactgagttgccagatgaagtttgatgacttcatatcatcagtatgcatgtgtgttgactggtgaattcattcctccacttgctcttttaaaaagtgaatttagggtcaggcacgatgactcacacttataatcccagcattttgggaggccaagttggcagaatcatttgagcccagaaattcaagaccagcctgggcatcgtagcagtgggacccctgtctctacaaaaacattaaaaaactagctaggtgtggtgatgcatgcctgtggtcccagctacttgggaggctgagatgggaggattgcttgagcctgggaggtcaaggctgcagtgatttgtgatcacgccactgccctccaatctgggcaacagagcaggagcctgtaccaaacgaagaagaggaagaagaggaagaagaggaggaagaggaagaagaggaagaagaaggagg

SEQ ID NO: 55085 - DNA, 1018 bp, Homo sapiens
accttaacccagctgtgtggattaaatggtggattttaattatctataccaatatattctctgtctttgacatagataatcaaatgttaacttctcttttctctttatgttttctgtcataaatgttacatttaaaatgataaaagattatatggcttgtgtatgttacagtgatgtaatatatatcaataagagtcccaattatggtatttttgtcattttctcattagatttttttcttgaatatcagtttcacagtgggtgatactcattgtatgttaaattttaacatactcattgtatgttaaaggatttagttggaaggtggaaatttacgtattaagcaaaatcagaataagaaataggttatctatatatttcattctgaaacctacaaataccttatgcttttcaggttatgaaagagcaagaacagtacattgccactcagtacaaggaggccatagatttggggcaagaattgaggctgacccgggagcaggtgcagaactctcatacagaattggcagaggctcgtcatcagcaagtccaagcacagagagaaatagaaaggctctctagtgaactggaggatatgaagcaactctctaaagagaaagtaatccctattttaaataatcttatgtatctgaaatcttacaaatattagcattttttttgaactgtagaatatagttctttcaaaaatgaactgtattgcacaacagtgtgaatgtacttaatcccaccgaattatacacttaaaaatggttaaaatggtcaattttgtgtgtattttaccacaattttagaaaataatgaactgtgttatatatagataactttgtaatataaccaggaagtccttcagaactgagttttggctaaactagttctcaaattgagttataaagcacttttagacttttaagtgagttcgagctcttacttgaagaaaaaataaagctaatcttttttgagtaaaaatttttacatttgtagtgactcttaaaaatga

SEQ ID NO: 55086 - DNA, 1113 bp, Homo sapiens
cacctcccaccaggttgctcctttgacatacaggaattacaattcaagatgaagcctggatggggatacggagccaaactgtaacatagctctaaaagataagggctattttttggaacagaaccacaataccatgatcacacctaaaaattgacagtgactccttaatatcatcaaatacccaatcattgttcacatttccccaattgtctcaaaaatgtctttatagtttatttgttcaaatcagtacccaaatagagtccattgcatttggttaattaagttcttaagtaaattgaagattatggattcctttgttccctttttcctctagtattcattgagaaatcagatgtttgtaactataaacagaatttactttttttaaagaaaaagtaaataaaagtagaaagcattagactgttgtcgaatccagtttccttccatttttttattttttttcttttccaattctggggctatatagatgatttcacatcaagagaaccatgcaaagtggaagatttctgctgactctcaaaagtcttctgttcagcaactaaacgaacagttagagaaggcaaaattggaattagaagaagctcaggatactgtaagcaatttgcatcaacaagtccaagataggaatgaagtaattgaagctgcaaatgaagcattacttactaaagtaagtaaacatataaaagtaataaagcatatctatgaaaacataaatgtctgacttatttacctgtcttagtagtttatagaggactatatgaccaaatattggcctgtttgaataaaaaccatttgatttagaagatgttgaatttaggaaattattaagatgatgtacatcttattaccgtagaagatataatttataaatgttcaaatataaactcatctaatcataatgtttagagggttttatacttgatgtacctaaaaaaaggtagaaacatttttcaaaatcagcaaagttcttttaaaatcataaagtaggccgggcgtggtggctcactcctgtattcccagcacttcaggaggccgaggtgggcagatcacttgaggtcaacaagggcaaagacaattttttgagagccatga

SEQ ID NO: 55087 - DNA, 1455 bp, Homo sapiens
atttatcactttaagtttttgaaaaatttctaatgcactaaagctttcttgtaatgagaacacaaaaagcagaatagcttatctatttattccctactggaaattctgaaaggggtctttttgtgtctatatgtgttagattaacaaaagatagcgtacctctacatctttgcagagaaatttttaggtgtaagatttcaatcttgaatagaaattgatattgtcattaacaccaaaaatatatatataaggagaatctagttttaatggaatttcttagaataagcatatttcaaaggaatatgtgtaattttcccaaagtgaacctatcttaagtaaaggttttaaacagagcttggaaaactctcaagaattataaacagaattcctatagtgggacaaaggttgactttctaaaagtctatgattttctaaggagttcattcatttaacaaaaatgtattgagcacctactatgtaccaatttatctgcaggaatcagaattaaccagattacaggccaaaatttctggacatgaaaaggcagaagacatcaagtttctgccagccccatttacatctccaacagaaattatgcctgatgttcaagatccaaaatttgctaaatgttttcacacatctttttccaagtgtacaaaattacgtcgctctattagtgccagtgatcttactttcaaaattcatggtgatgaagatctttctgaagaattactacaggacttaaagaaaatgcaattagaacagccttcaacattagaagaaagccataagaatctgacttacacccagccagactcatttaaacctctcacatataacctagaagctgatagttctgagaataatgactttaacacgcttagtgggatgctaagatacataaacaaagaagtaagactattaaaaaagtcttctatgcaaacaggtgctggtttaaatcaggtatgtattttatacactgtaaactgtaataatttgtttccaaagaatatcattttattacttggaagaaaattcatatatttaaatgaaaaactactaatatttgaagaaggaagattttacattttatacattaagtaaaatcaataccaaaagacattttctctattgcatggtgtgagacaatacggggaaagagagaggcagagggagacagaacaggaagtagaacgaaaaataggaagatagacatgaaagtgcttaaaaataaaaaaattaaaaaactgaaaaaaagaaaaatggtaagaaatatgcagtgagaggaatccagagaaagtaggttctgaggtgaatgttctcataacttcgtcataatttactgttcatttgggctctgtatgtcaaaataagttattgctggctatcactgatccttggaaagttgatttactgaattagccattatttaaaagcatgaataaggccaactgt

SEQ ID NO: 55088 - DNA, 1115 bp, Homo sapiens
tattttatttattttattttatttttttgagatggagttaccctcttgtctcccaggctggagtgcagtggtgcgatctcggctccctgcaacctccccctccaaggttcaagtgattctcctgccttagcctcctgactagctgggattacagacgctcgccaccacacccagctaatttttgtatgttttagtagagacagggtttcaccatgttggccaggctggtctcaaactcctgacctcaggtgatccatgcacctcggcctcccaaaatgctgggattacaggcagtgagccactgcacccggcctgcattttatattcatgtggttcattattgactttttatgattcatatttttcagtagactaaatatttctcactctcgctttaaattatactcctgttattatggtagacttttaatgctaaatcagtttaggaatatttcaaatattaatctattattttgcattattctagggagaaaatgtgtaattcaaagaagatactgatgtgttgaaaaaatggaatttttggtactgtgctgtttacttattatatgtagctcatacttcatagaagctgttattttgcttttgaataaattttatatttcaatattttaaaagaaagcccttctaaaacttaattatatttttaaagaaaatttattattttatttattgttttttggcttaaacttgctgctttcttttgctttttatataaaaatcattgttaaaatgcataagtacattgaggaatgcaaatttttttttttttttaatgaaaggcctcacatatttattactgaacccagccaaccaatgcgttcataacagatgcagagagacaaaatatattcccaacaaaacatgtcaaactctccggatagtggtgacattttcagcctgatatggtaacatgattgtgaccttcagacagcataaatatgtgtgccatctcatgtgcaattccttatagacccagcttggttcttctccattgtctccttttggttttattttattaataaaatcctgattttattaccagttttcatctgaatccactggggaatgggacaattttgcttttgtttcttggc

SEQ ID NO: 55089 - DNA, 2501 bp, Homo sapiens
agagggaaagagccagagggaatattgtgggtttttcacaatattggttccactttttcaacttcttcagttgaatcaaaggtcataaattacgtgaaataaaacagggccatttataagagatccaagtttgagaaatttcttagacctgtgtagttagaaaaaagcaatctctaattatatttacctatagagtttatgttctccagatgtgtgacaattacatagtacttggacagtatccaagtatgataataaactgtctgaaattggcctaatctacatttaaccaaagtgtatatattgtgggtttgtaaaaaattgttatttttttttatgttttgggtgtttaggctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaactattgaaaatttaaggttcagtataatatcaattttgaatttttaatggtgtttatgaaattttagatagcagcgagtccttcgtttgatcaataaacagtgttacagataacttcaagtttataaaaatacagtgaaatttctacaaagctctaaatctgcatttgcatttcctctgcccttttaactaaactaaaacttgtgaattttaaattattaaggggggggtgctgtgtgaatcagtagacattggattgggttggtgaaagagttcagttctgtagtatctgaatttgtcttttaaaatgagtacatatataggcaataaatatatatgctcagatcaatatacttgtttagaaaaacttcaagacattcaaaaactaggaaggagtatgtttaatagtatttgtataaatttggtggttatgtttttttattttgtttctgttttgtgtagaggtaaaaactatagttttattacagcataattcattttgagctccactatgacatttcaaagactgcccagtttggaagtctgtcatgatttttactctttcactccaattcagtaattgttgatagtattacttacctagtccatccatactcatattattcaaatatataggtggtacttttgaaacaattacattggttctcttggtttaactgaggtttatgaatattcaaacctttgctgggggaaagaaatgaaagttaatgagcatgcttgctatgagagagggatttttaatttaacttgtagttatagtttacttattgtttttagaattacttttacattttcccaactagatggcctagagtccaacattaccttttgagatgacattattgtctccataattgagtgatagctttaaaaaaaagattagttttgcttaagaagttatgttacaactgatcagccctatatgaattaactgatcagccctatatgaaacataagttgtgttataacttatcagccgtatatggaacataaatagtttctacctgcttgttagagaagctttaatttggttctaataaatacagtatggtagtgtttataggaatccaggatgttgaagaaatggcataatgtctatattttggaaacagaaaggaaaagtcacttaagatagtattaagtaattaaattcctatgtcagttgccaaatcttttaaacttatgtattcaccaagcccaaaaatagattgtggctcccaggattccaattttaattggagagctaagtaagtaaagttttataactgttaggtttcttaatgatcatattttgcagttttagtaaaagggaaatattgttatacatttattaaatatacttcccccatgaagtgaaaaggttaattttgctgaatgttttaagttgaagttacttcatggatgtcatacccatgaagtgcatttggatgagatagaagaaattgttttttaaaaagtttaagtaccaaaggtagtctagtctagaacgataagttaatacgtgttggcttttctaatttgtactgtaacatccttatactttctattttaagtatatctgtttcttaagtaaacaacttagatattttccacacctttttttttttttctgatgcagagttcaggttaatattttactgcatctgataatgtattatacgtttgaagcctagtgacttttcattttgacattcttgtgatttcatatgctgtattcttcaagcaataaaattgtgatgtgttttataaatggtttttatatttaatgttctatagagagatttctattattaccatt

SEQ ID NO: 55090 - DNA, 1019 bp, Homo sapiens
ctttccgttctttattctcacttgttctttctccttcgttctctcctttcctttcctccttgcctttctttggcacaggaggctccagacaatgcccagtgtctggccaaggtacgggcggagggtaataggtcggagaatttgctcctggcgccggcgcggaagggtcgaggtgtggagggcagtgatttctcaggtgcggagggcagtgatttctcaggtgcggccgggagaactgggggcgtgggggcgctgtcccgagagccgcctggcctcagccactcccctttttattccacctgtgcctgttttccgtgccttttgttcgcgaggatctcgtgaaatcactgcagagaaaggggagaaataacttttgagtatgtgtgtgcccagctagggtgggagtgaaagccaatgggttaattgaaaggcaaaatgttttcttatttttcacgtctactcatagattgggaatcttagaactgtgagactttagagtccatctagtgaatgctttacttagccagccaggaatctcttgtgcaacattctgtacaagtgcttacccagtctgaaaacacaccacccaagagaaaataccttaggagccccttcattccgtttcttagatagcattaattgttcttatattggggaggattgcatggtaaatgaattacataaagtttaattcttttacattggttagtttctcaggcattattggcctttttcccttacactttgtgcattctataattgattatagtgaattatcaatgaaaggaaatgggtatagttttattttaaatttttaaattttttatttttttcatgcctaccagagtgcattcattcgtttttataattacaaaatattttaacttttgcctacttaaatgacttgtgcttcaaaggaaactaaaatgtaagtagaatacttctaaaaagtaaacataggaaaacagtggaggcatgttatttagatttaactcttaagatttttaaaaaattcactt

SEQ ID NO: 55091 - DNA, 1085 bp, Homo sapiens
tatcaacttggtgtctgaaacttagataagcagaacttggtgtagaggactattgttgggactagaagaaaccttagaaaaatttgagtatgcttcctctttttactgttctcagttttgaaaaaggattatacttctaatggattgtaatgtaatacaaacaacctgtactgtgctcttgccattgaggaatttgaggttgggaaattctctcgaaattttggatttagaaaccagttctcctattatttcatatttagaatcacattactgtcccaaagagttaattattgagaatatgttgttacagaaaaatgatatgtagccatgcacttaaacctgagtctgtttcttgtaacaatcattggaatttttattgctattttaatgcttcttaagtcttatgttaaatttgagaaaaaaaggaattcaatagaacggctctaatactgactttgggggacttttgtagtgatgtgctgagtggatcgtgtcagactttggttgcgtagttgttaggggatatgaattaacttgtaataaatttgagctgtgcttacagggatttctagtgttccaaatgagtaaataagttagtgaatatatactacagtcacagttttgcattgtattctgggtaataccaaggaaagagatgatactgtcttcacttcttcaggatgcgtggtaacatcttaggcattgcttattgtgttcatttctttattacatagcaagaatggatggatcagatagccaaatatgaattaataatttcacaaagcacagattttgaaattactagcttttttttaacagatagggacattagagattggaaaagacctatgtttagtaaataagttttacttattaagaaataggtttttagtttttgaggacctagttaaagttcgacagaaaaaatctgtgtatgggttgtgaatgtgtgtataaatatgaaaaaaatatatggctgagcacctcacattcatatgatttactgaaaaatttgctacccaaggaaaatgctggacaagtctggtagttagaagatggattcaaatatctgatttaatttataa

SEQ ID NO: 55092 - DNA, 1028 bp, Homo sapiens
tgtcagctagtttgtagagaggaaatagtaagagaaatagtaatggcttataaatgtcaaataccttctgtgtatatcaacaagtgctgtcttatttaataatcttcaatctttaaacattttcacttcaatagcaaaaaaaaatctgtcttggggaatatatctatagaatattaaaaactggtaggaaaggttatgtaaaggttttgttctatagaatgtgaaagccgttccatatttcagttcaggccatgtctatctaatacacctgaaacacgtaaacaggactgatgcttgttcattcaacagatgtttatttcatgcctattatggcttcagcactaagctaggctttgtggggcatactaaaagaatcaattagatatcagcatgagcctcaaagcaaccctaaaacaactagaaagtaatagatggactttagggctatgaaaagtgacttttcattctaggtatcacaggaaaatctttaggaagactgtcatttgacctaggttttggaataagaagggttatgcaggtgggggttcctgacaggttcctagagggcagatattgtgtcttactcattgcttattcattgtctgattcattgctgtatcctgcctggattagcctgacattagtagggtctttaataaatgtttgttggactgacctgagtctagtgttgcgtttgacttgaatttgagtgcacaatgtctgaaagtagtgatgaagggtagactggaaccaggcaggcaaagaggttggtctggctgattgcttgattcatgaacctcttgtgtgtgtgtatgggtgtgtctgtgtgtgtgtgtgtgtgtgtagttacacatttgtatataatcaaaccacttttcagaccatttaaaaattcacagaagaaaatcttagtttattggtagaagggattacctcttgcttctgaatactttggtggcaggaggggaatacctctgggttttagaagatgaaagtgtatttattttagcgccgctgcaagaatattt

SEQ ID NO: 55093 - DNA, 1053 bp, Homo sapiens
gagacgggatttccccatgttatccaggatggtctcgatctcctgacctcgtggtccacccgcctcggcctcccagagtgctgggattagcggcgtgagccaccccacctggcctgtttattttgctggagtgcagtggcacagtcatagctcaccgcagcctcaaactcctgggctcaagcgatcctcctgcgtcaacctctcaagtagctaggactccaggcatgtgccaccatacctagctaatgtatcttttgtagagacaaggtctcgctgtattgctcagtctggtcgtgaactcctggcctcaagtgactttcctccctcagcctcccaaagtactgggattacaggcatgagccactgtgcctggctctatgccacatgccattttataagggacttgagcatccatggcgaataccaatgctggtggacaactatatttttacttctatatcagtttaaatatcagtgctttttctggaggtgagagggtgttcactgggaaaaatgcagttagtttagatccccactcttctgctttaattcctagtttcatgagctgatttatgtactaagagtattctaataagaaaatattttagaatatttgaaatatcaccttctaattgatgacaatgataaatgctttaaaactgcaaattgtgctttaaaaataataaaagtaatctgttagtgttacagataattttaatattgtcatctgtgcctttcggcattttcctttttttcccaaaataagttgtattaacttctatgattggttttacagaattttcattgactagttctttgaaacctcttttatactatagggggatgccgtcgggcattgtgagatgttatctacctgggcatgggggtacacccctctagtctcaactatttgggaggttgaggcaggaagatcgcttgagcccaggaatgagtccagcctgggcaatataatgagacactatctccaaggaaaaataatgtctgactgctttttgtaatgtgggagtcagcatttagaatctgtatggagcc

SEQ ID NO: 55094 - DNA, 1027 bp, Homo sapiens
tgattttgaaccattttattttattctggtcaaaaatctttctgaaagatttttgaatttgggcaagaaaggatcttataatttggaacattatctgtgtgccaagcactttgctagatgttcttttattttttattttactttcatgccggctctgcgagataagtagtggtattcccattttacagaaggtgaaacttaaggttaacttttgtcatgtaaagctaaactctgatctagatttgtgtgactccaaaactttttttatatgcctctaatggatgtaatttacctagagatttattaatcctctagtgggggtcgtttccatcttcaacaagcatttataaaatactttatagaaagcactgtgcctagttctgggtatacatccccaactgccttgtagaaattgctacactggataggatgtcttaacttgagcttaacgtgtatttgaacagacatttgtattagtctgtggtcctggtaggaaacagtactcaaaaggcttaactgaggagttttaaataaactttttataaaggtgtgggcctggtctgtggagccagcagtggtggatggtgcattaccctagagctagtaacagttgggagctgctagtagttaggccttaagggcaaggagaggcattggttactagccccctaagcagtagctgtaggcagaaagggctgcgtgacgggatctatggcctttagtaggggaatataggaaatttacagcagagtggtggaggaataaaaacttggatttctaatcctagtactttgggaggccgaggctggtggatcacctgaggtcaggagttcaagaccaacctggccaacatcgtgaaacgccatctctactaaaaatacaaaaattagcgggtgtggtggtgcatgcctgtaattctagctactcaggaggtggagacaggagaattgcttgaaccggaaggcggaggttgcagtgagctgagatcacgccactgcactccagcctgggtgacaaagtgagactc

SEQ ID NO: 55095 - DNA, 1104 bp, Homo sapiens
gagtgggcagagggggggagttcagaaaaaagatgtagcatgtgcaaatactcttaaacaggagggtgtctttctcaatgaaaaatgaaacaaacaaaaaaaatccattgtagccagagcaaaacagacacagagaaagatgtgttactgaagttgataaggtgaccaccattcacaggacacttaccatattagttcgtttaatccttccagtcatttaagatacataaattgacatctctccattttactaatgatgaaacaaggcagagaagttaaatggcttgcccaaggtgacacagctaataaatggcagagtctatatttgaacacaggcagcctagatacagaatcagtgcccgtaatatttgtaccatattgcctgacatgctcacttgcattttgaaaagatcactttaactacaatgtgaaaaatagattagaggataattagaaagcacactgagagatcagtcaagaggctattgcagtattaaacaaatggtaattgtagcttggagtagaatgatggcaatagagatacagggtagtagatggctaattattacaaagtgagtgtatcctgtgtgaataaatgaaaaacgaatgaatgagctgagacacatgtataatatggcagtgtgctgtcttactgtacagtgtttataagcaacaactgctgaattatctgttggaataaaaacgaggtgaatgtaaacctatttagatttgtgttaccaccaactaaggtttttgtcttaaatagatggtagaaaaatgtgttaatctataaaatagtagcttgtatatgttcattctgcaaactttcgggtgcacttgatgctgtaaagctcttctatttctcattagacctttaaatactcttcagcacaaaaatgaattgtagtacaaagctattactgcttctcagaaaatgaagaatgctctaaagataaatataaatgaattaaaaggaagagattattcactctaaaattgaaaatcataaccttcctgaacagtaaaggcagataagcagaataaatacttgagtctaatttgaaaaatccatatttctatttcagatgtcctactataaccata

SEQ ID NO: 55096 - DNA, 1049 bp, Homo sapiens
taaagacaagtgattatttgataactctcctttccactaagtatatttttactcacatccctagtgccaagctcagcactcatttttttgttgcattaaatgaatagtaatagctaccagtgccaagtactatgttaaatgcattatttatatttcgtttctttttttgaagtggagtctctctctgttgcccaggctggagtgcagtggtgtggtctcagctcactgcaacctccgcctcccgggttcaaacgattctcctgccttagcctcccgagtagctgggattacaggtgcctgccaccacgcctggctgattatttttgtatttttagtagagatggggtttcaccatgttggccaggctggtctcgaactcctgaccttgtgatctgcctgcctcagcctcctgaagtgctgggattacaggcgtgagccaacgtgtctggccacattatttatatttcatttaatcttttcactttagaattgtgtaattactccagttttacagatgtggaacaggaagctcagagatcaagtgctagtaaatgacactgtgttagatggcagatgcaaagaattacaaatggattctgtacttagagtttttagtatactaaaagctctaagtgaacatggaaaatgttagcctactgttcatgtgtagttattacagcattgatgtttggtctcatatacctttattgcacggatgtaccactattttggtgtaatacagttattttggaattaaaaaaaatcagaatcacttgcatgttgagatgtgcccagctagttattagagtttcagatgtaaaaatgtcactcttctataattccataattttcaagaagatgaagaaaataatgggtaaaatatggctctgtagcagaatactttttttttttttaaagtgctttaccatttaccagtctttcacatacattctcatttgaccctcacaacaaccctgtaaggtaggcagcataggtgttctcatttgacagttgaggaatgtgaatctcagagcaggtaactgataata

SEQ ID NO: 55097 - DNA, 2973 bp, Homo sapiens
gtttttcttttacaacccatgctcaaaatattagaaaattttgttaacattaccttcggaatatatccaaaatcttaaccacttttcactaccctgctgcttttactctggaccaaactagctcatctctggtctggattattgcagtagcctccttaaaaggtctctcttgctctgagttcggggtgtgtgtgtgtatgtgtgtattgtgtgtgcgtgtaatttttgttttgtttgtcttttttaaaaagaaaaagcctgtagcacccagtatacccaagcagtctcccatccaaatactaaccaggcctgaccctgcttagcttccaagatcagtcaagatcagatgtgttcagggttggtgggtctgtggaccttgagctagtttttaatcaacatggaaactccagtgatctatttaaaaacttgcattgggtcatgccaggtttattggaggttataccctccaatgtatttccaactcagggttaaagccaaggtccttatggtggaagatggggcatataaactggcattctggcgctcacacactccaatatctactactctcccctcttgctcgctcagctgtggcttgcttattcagctttttgctcttcctggaatacatcaaacatatgtaggcccagggttttaaccattttaacaactgaacttgtaactgcactagttctccaggtaagcagaagtattagggttatggacagtttatccgaagtaataaccaggaatgcctaataaaaacatgcaggtattgtggtaaaaaatagagttggtgaacaaggagttaccttctgactgtttctcttttagtgaagtaggaggcaaggttattagctaagagtgagatggttaggagatggtgtaaatttaaaggaaaagaataaggtatgagatagttggctaggataatgaagtagtgaatggttttgagctaagtagtattaaagtcccttaggtaatagacatgaatttcaaagcacaactagccaacctggttctttcttttcttttttccaactttcttcagcagcatgaggaagggttagtaaaaatctaaccataaatcagggttgaaatttggcaaagctagagaggggcaaggacagtgagtatatttggaaggagtgattataatgacggcttagggaatccaagctgtataaaggtggatatgacgacaggagtgggtgaaggataataataatgatgtgttgggaacaatgggttgtggtctctgtggggccaaaaaattgttggacttggggtatttcagggagtgacttgacagggtagctgtctgagaaagatattcttgaaatttattgcagggaagtggagtgggagaaacaagattgacattcttcctacttcataaggcagttattgctattgacaatggagatgaccatgggaatgacttactaaggtggagtggaagtgaaaatcacagagaagttaaaaaaaaaattgcagtagggtattggaaagatcgtttgggtagattttgaagtcactacaaccttaatttaaatttaagaaaaaattaaatgaaaagacttggaggagtttcccaaatatgcgagttttcccctatctttaaaaaaacaacaccatgagaaaccaaaaataactaaattgattttttaaaaattctacaatatttctcaattttctttgaggatagacatggttgatcctgaatggaagttggtgttttagctctatgagactgaaacaaaaagtttctgcagtccataagagttaaagagggagaaaagtcagttgtgttagatctttaaaaacatttttggtggtagtttggtattcagaagtgctggaggaactttggcagaaagtcagagccatagagcaagtccaaactaggacagcaaagtcattattctgctttttagtgaagaaagtatttttaaaatgatgatgacacttggttttttaccaaaaagtactttattggtacttcatttggatgcaaggctgtatcaaagtaattgggaaaacaaggattgaatattaaatagtgacttctaaagtgatacataaaatagttttttttaaattaaattacattaaagacatacagataaaagcaagaagactgagtaaacataatatttattgcctcacattactatacggtagaaccttgtagcaacatataattcgagttatactacataatgtggacatttatgttggtgctgatgccagctttaatttagaatattttccttgtgtttccaagtaaatacagtaaaataactttaaatattttacaaaattaaaaaagaatgcccaaaggaaacagaaaatgagctttcttgagtttacatataagatgataagatttaaattagagctcaccactgatacagagattcatttcacacaagctatggtaagaatgaatgtgttggaaaaggaagtgagaggatatttaagacaaggaaatgaggaagttgaactctgagtaagtccaactagctgaaattactaactagtaatttattccaggttctatctggaataaatccataggaataagaacagtgctaaaggtagagagaatagggaagtgatgcctctttgatgacttaatattcttctttatttctaacttacagatgatttcagaatactgctcaccttcactcctttagtttgtcatgatcttttcccttgaccttttccatagtcccaaagtatttgctgatgtggagccaggaggatgtatgatctcaggctttgaaactaaagaggttggaagatgttacttttgataatctaagacttcatgactttgattcttacattttattatttacttaattatttttaagagattgggttttgtactgtcacccaggctggagtgcagtgtgcgatcatggctcactgcagcctcaacctcccaggctcaagcaatcctcc

SEQ ID NO: 55098 - DNA, 1061 bp, Homo sapiens
taaaataaaaattgataatttataagattaaaaaaaacttcagtaatgtggaatatttaactgtccaggacaacttagacctcaaagcttttgagatggccagggttttgctagtgtaacaggactcatctaatcaaatggcagacttgtttgccttctctctgttctgagactgataataaccattagaattttcacttacttgcaaaaaagggatttgagctccagttcattgaaacaagggtggctagaacccacaacttcatgatatgaaaagtagaattttgtattgagaaagtgggttttattatgtactgatgctttacaaaggtgatttgaaggaatgaagcacacttaaggaatttggcacatttccattctaaggatgattctcaatagcagcgattctcaacaagggcagaattattggagtgttgaagtatgaggagtaatgaagagttgagagaaggcatgtttaatttgaaatgatctacattgagatttgctgctttggatgactacttagtaaatgattggattatcagctgctgtttatagtatgtcttttatccaaagggaagaggtttgccttgtttgtttcctcctctttaatgggaaaaattcttttggttaactccccttatttttgctagtgcagaggataatttctttcatagtgaggcagcacttttttttttctcctaaataatattatattagtccattctcacgctgctaataaagacatacctgagactgggtaatttataagggaaagaggtttaattgactcacagttcagcatggctggggaggcctcagtaaacttataatcatggtggaaggagaagaataagtgccaagcgaagggggaatcccactgtaaaaccatcagatctcgtgagaactaactcactgttgtgagaacaagatgggggaaaccgcccccatgattcagttatctccacctggtccctcccatgacacatggggattatgggaactgtaattcaagatgagatttgggtaaggacacagccaaatcatatcaactatattcc

SEQ ID NO: 55099 - DNA, 1056 bp, Homo sapiens
agacatagttatatgcaattgaatcatgtccattttgattgatggaaaatggttacttcagatcacttggtagagtgttttttgtttgcaaagatatgcaactgaaatcagtcattcttttaataaacattgtatttgtataacagattaagatttctaagtaaaaaaaggagccatatatatgtgataagtttgtatcattttagttttttctagtaaaagtaattgtattaagttctatcatagagatagtgctgtatgaaattatattccccagcctccaccccagagcatacataaatttttggttcagatgtggcagtatggtatagtggaagagaattaggctggaagacaggaagtgcacaaactactcttattttggcaagcagacatctctgaattcctttgatcagagattatattatgtgcatttctctaccccataccaagcctacctggtacctctggaactgggtgattaaatttaagttgaatgaataaataattaaataatctgtgtttcagtttagtttagaaattaggatttctgaccacatgctgaacctttgactacatagcagctttctattaatactggagtttggtgtcgtgtacatcattgtgatgtggtcattaagttggtgttgtgtacatcattgtgtctgctaagaacagtcctaaatatttcgggtaggcttagatacagagcaatccaaatatagctagtctgtaagaagtgcctttcacctcccgccatgagtctgaagcctccccagccatgtggaactataattccaattaaacctctttttcctccctgtctcgggtatgtctttatcagcagcgtgaaaacgaactaatacatagtctctatctcattttacttttctcatacctctttatcagaatttggtttctgtgtcactcttttgtccggctgaaagattttgcattctcaccagcaatacacaaagcttccagttagtccacatccttgttgttttgcaagtagccaccctaatcggtgtgagttgttatctccctgtggttctg

SEQ ID NO: 55100 - DNA, 1064 bp, Homo sapiens
taggatgattgtcaaatttttggcttaaatgtctaaattctagatggatggtagtgccactaatgtaagaaaagaggtatgtaaaagaagattaaaaagtagataaatttcattttagacttgttgaatagaggtacctggggcagatggactgcctatgcaactgccactcctcctcctatagaagctttattgaggtataattcatatgccataagattcatttgctaaagtctacacttgagtgttcttttagtgtatttacagagttgtgcaaccataaccacaattgaattttagaatattttcatcatcccaaaaagaaaaccctgtacccattagcagtcatttcctcctcctccatgtgctagcaactgttatctattttctgtatctgaatttgcctattctagtgaattattctgttgatcatgttttccccttcttcctttttgagttcttttgtagaaaggactgtaggtcatgcccaattactagtttgctaaccatgactcgtcccattctttctgtcagtctagtatctgaaataattaatttatagcagatagtagctttgctgatatttgggtgaattagtaaatcattcataacagtgagttttgttagtgtttgggtaaccaggattaataaccactggtcaagagtatttattcagagttccttcatatgactttagaagggtctctgcttcgttcccctcttacttttcacgttactacttgcaattctctagctcatatttgatgttccagcaacattgaacccacttacagttcttaaatgctctgtttttccccacttctttgtctttgctcattagatcttctctaatgagcagaatcctcccccaggggtttccagttgcccaattcctgtttatctctttaggcttagtcagcaaatcagaaattttagctttttacccctggggaaccctctttacagagccctctattgttcttaccatattatgttatgtaagagtgtctatatatttgatttctctagaccagagatctctgaactttttattgctcacctgt

SEQ ID NO: 55101 - DNA, 3240 bp, Homo sapiens
tttaaatcatctctagattatttagaatgcctaatacagtgtaaatgctatgtaaatacttgttaggctctattggttttttaatttgtattactttttatagctccattgttatttacttacttgaatatttttgacccgtcgttgaatctgtggttgtggaaccctggaatacagagggccaattgtactttgtttcttctattcttcctcttaactattttcttatttgatagtaacatcaaccaaattgttgtgattccattcatatgaaaatacagaaataacctttctttctccaggtatcagtattttaagaacaaattgtaagtaatgattacatattatgatgctaatggagtagagatcatattgctgtcttaattgttttatatcataaaattcatgattgaatgaaattgaaaacttagactatttcaattgtaacaatagttgaaatttttaataaactttaaaaaatcttcttcctatagaaatctggttaagaagtactgccccaaacgttcatccaaagatgaagagccacggtaaattacatacctgttcattaatgcatattaaaaaatttaaaaatacttatatttttattatttagtaagatatattcttagctttttataaagattttataaagtttaatttaaaaattaatgtttatgaaagaaggaactactgtttatcttttatgaggataaatactgtagtgggcttgatcaacagttttctagaatagtcagatacagattttcaattaaaatgtagactaggactccacttgaatgatttagtctgcagaagaaaaggatatttttcatacttggttgtgtagttgttggcttcgtagattcttgcttttactcttatagatagtaaaacaatttgactgattggtataaagggatgttgaaaagcactgagagtttttgcattagaaataaattaaaaggttagaaatcacttatgagtttttttgtggtcttaaagaggaatatgtggatgactgtttagatggagaaacaagaggagactcgacttaaacaaacaactctgtatataattgtcagttgttaggattctcaggtttagtgttaatggagtcctatctgagctgttaatcttcatctgtaagagagtgttccgcagtatgttcaaagtagatatatacattaatacagtgattctctttgtttctctccttccctcacacacgtttttacccttatttttgaccctttacccgctttggtgtcaactataatggcacttcacttccattcaggatatgggcaggcatacaggcagctgtgtccagagctgatagcaaaattgttctgtagatcagccatcgagatgcatttggcaagcacatcatctctgcaacaggttcagctaccaagcctaggaatccaaccaagttcattcccaagctcaggccagtcagttggcaacttaagagattccagtatgccaaaagagcctgcaggtagtattcttattattttttgaccccaaatatccctttactaataaatgaaagactacttgaagatatacaaacatgtatgacttgagcttaatgcaggatttttttccatatgaagttaatttagaactagtagctgagatttaggttgaatatgctaaaatttgcgaaatgttagattcagtccatacctcaccaacatttgtaatgaaaataaaagtaagtctcaccattttgaaatgtttttgccaggtttacctcgtgtgtagccttttttaatatccttaatgagttaaatgactatgcaggacagcgagaagttgtagcagaagaaatggcgcacagagtgtatggtgaattaatgagatatgctcatgatctgaaaactgaaagaaaaatggtaattcttacaattttcatccaattgcaatagtatatgaaatagtcacacagaaacactttgttttctttaaaatgtgtgttcagcataaactggtttttctatttcactacatttcttctagctaaaaattatcacaaaatactcttgctaatttatgatccttttggatttaagtttggcaaactacagcctatgggccagacccaaccaactgcttggttttgtttgctagttgccacaggctaagaatgatttttatatttttagatggttgaaaaaagaataatatttcatgacattgacaattatatgaaattttatttttaatgtccatacataaaattttattggaacagacccacattcattgacttttatattgcctgtggctgcttttgcatcacactagcagagttgagtgtcacagagactgtgtggcttaaaaagcctgcaatatttatctgaccttgtataaaaaatgtttgtcatctactattcaagacaatcattatttttctggaaattgtatctgttttcaaggttatatgtaaagtgttaagacaatatcctataaaatgcatttttaggaagttttgcattactttcttcctaagtcttggtaaagttatataattagtaccttgaaaaaaataaagtgaaaagccttttggggactttagactttagtgtttaaatgtaattatttttatttgtttttgttttattttttatttttattttttttggccgtggttataatcttcagcatctgcaagaaggacgaaaagctcaacaatatcttgacatgtgctggaaacagatggataatgtgagttatgacattttcatggttaacataaaatcttgtagactagattagccctaaatacttttatgcttcatatctatttgagtttaatgtttctcagtgtattattaataatttgacattggtattattgtataatagtcaataaagtgtaaatggaggatgtgaggtcattttgtcatttttcttgttgtcctttataactctatacttaagaactctgtaatcttcaatcattgtgaacatttaaggagattcttttttttttttttttttttactttaaagtagttactataaagtattaatagaggatagaagtaagagggaaaaggagatatatcttagaagactatttcctgaggactgagaataatcaaggttctttttctacctttaacttaacacttgatgtctcttgacttcatttttagcatgtgaaaaatgaagagagtgaacgagatgatatgaaatgtttcttccagttcagtcattgtataatttt

SEQ ID NO: 55102 - DNA, 1935 bp, Homo sapiens
acattttttgagtgagatatataataaatattaactcagtcatgcctatgttatttttcctcatagtctgtaattaatgtctgatatttaaggaacgtggattggttgtaatagtaaaatttattttctaatttagaaaggacaaattttacttagtgcgcagttcatttccacacaatacacagtggcacattttaaagttatttcttttttctctctttttaaaattattatactttaagttctgggatacatgtgcaggacgtgcaggtttgttacataggtatacatgttccatggtggtttgctgcacccatcaacccgtcatctatgttagttatttctcctaatgctctctaaagttatttcttaaatgaagttagcctgattttattttctcagtgtgatattttaatttttttaacagagtaaaaagaagtttgaaagagaatgtagagaggcagaaaaggcacaacagagttatgaaagattggataatgatactaatgcaaccaaggcagatgttgaaaaggtaagaaatactccaaaccaactttaatgtcaaaatattattatttgcataaggaaagtagtcacgacatttgtatgactacagtattaggatttacttgagatacactgtatctaagtctaaaatatacaaatatttgccaactttaaattatacgtattggtctgagaaagtaatatatgttaatttattacaatatcttagctgcattcaaatttagaggaaagacgtagttgctactgggattgagtttttagcctattccaaaataggttagaaagctaagatgtgttgatggggtaataattagttagagaataactgttgtaatttgactttgtacaagagatcaagaggaacagaactgtattctaaataagcattccttaatttgactttgtacaagagatcaagaggaacagaactgtattctaaataagcattccttaaagtatctgtggttctacacattggtggaaacactgttgaatgttgcattattcaacaatcatattattatttagtttcactgtgatttaagttccatattttagttggatatagttggatcataaatgttttactgttaacttttttaacaatctgaaaatattcctaaagctacctgtttttctcttctgattaaaagcacactgtttcaagctataatgttttcatttgtttgtttttttatctggatttggtaaggagagtctatattagaatgtcttattgctatcagggaatactattgtaatgagagagggaagaatattgtaataaggagaccactctgacagtaagatctgcaggtgtctttaaatataaaatatattttaaatgatattaatagttcaaaaaagttatgccacgtcattattcttttgatgtcaggtgttggcttcttcattgataaaatctagttttagtataattttcaaaaaagtgaattgctgtgattttgttgttgataataatttcgaccattttgcccctaggccaaacagcagttgaatctgcgtacgcatatggccgatgaaaataaaaatgaatatgctgcacaattacaaaactttaatggagaacaacataaacatttttatgtagtgattcctcagatttacaaggtaaatcttagatatgaagttaatctagttttagattaactggtgtttaaatataaaacttgtaagtcttagacatcagaatctttctagattcactagacatcagggttggggtgagagattcctttatgattatagatttgaaaacaagtgttttctaacttttaagtcacacattttcctacgtatctactattagtgttataaacagtttactaaaacaatgacatttgtaagatacatttaaatactttaagtattttgacatgacaaagg

SEQ ID NO: 55103 - DNA, 1160 bp, Homo sapiens
tacttgagagaccgaggcaggagaattgcttgaacctgggaggtggaggttgcagtgagccgagatcgcgcaactgcactccatccagcctggcgacagagcgagactccgcctcaaaaaaaaaaaaaaaaaaaagtctcagtcttgtatatgttatgggccagttgctttaaaaaaaaaaaaaagcaccagaattttgtcatcaaatgaaatgttttctggaagcataaacaagaactactctgattgaatagtaaaaggtgggagtgctatggggcagggagctgatagccagtaaggggtccttttagaaggctagaatcccagtgtcatctggttttaggaaaacaatactaagtgccttactattttttttctttcttttgttgtttagcatgtcccaggttttaagtattataagtcaatagcacttgttaaaaggtattaacaacagtgtaactatgagggtagaaatatttaatttttgatgggggatcactaattgaactcctttagaatgattgaaaaattcagttttctctttttaaaaaaattcttgattattagcaactacaagaaatggacgaacgaaggactattaaactcagtgagtgttacagaggatttgctgactcagaacgcaaagttattcccatcatttcaaaatgtttggaaggaatgattcttgcagcaaaatcagttgatgaaagaagagtaagtgctaaataattatctttgaatgcatctgtttggtttaggtgtgcagtttaagttagtgaaatgagttgagaaagggataaagtaatctgatgtgtggttctaaattatattctgtagaagaatgtcttgcaatagattcctttgagttctgagattcattctacatgcaaaagttctaattctttcttaaaaaaaaaaaaaagatttctaactctcttctcccactaagttttcagttcttatcaaagagtctaacctaggaactgtgtgttacaaattgtgttatactattatattagtttagtgaaaatttagagaagtatgtggttagagttgcctttagcacttgagctggatcaagaaatgtgggtagcatatggagtgatgaccaatgaggaggaggaaggagggcattatgtgcagatgaaacagcatagccc

SEQ ID NO: 55104 - DNA, 1637 bp, Homo sapiens
aaagctaccaagtaaaaacattttatgaatattataaattaattaagttgtaatttgcaagtatatttttcttttgggattaaaatactttgagtttgttacacattcatgggaataaattatttaccttaatgattattgtggaattatttatttaaacttatatttgttgtttttttgtactgaaaaagttatgaaagctgatgtagaattatgagcaagtgaaacagttttaaaacctagtttcttttgtataggactctcaaatggtggtagactccttcaaatctggttttgaacctccaggagactttccatttgaagattacagtcaacatatatatagaaccatttctgatgggactatcagtgcatccaaacaggagagtgggaagatggatgccaaaaccacagtaggaaaggccaagggcaaattgtggctctttggaaagaagccaaaggtaaaagtcataaaattcctatatgctaatcagtttaagtgtaccaactaaaacaatgtgggtattgaatgcaaaatgatttaccattaatggagaataaatattttcaatttgaatgattcagttaacctttcacttatattaggaataccttaacagtaacagttatttatggatttaacatttgactaccgcttaataatgggtaagagtattaacaaagttgttaatatctagttaagttatatgcttttgaagtttcatttgtatgtagtttccatcagaatttttaaggaaacatgatctaactaaaatagcactaaaattggaattctcaaatggaatgaatgaccacagccataatacatgtcaagttaggttttatagatcctactactaaaattatttttatcatccatatgagtttttaatgggaaaggttcagtcttggttaattgaagtttaaaacaatttctagtttggtaagagaatctcactcttaacttcttgttagaacccaccttctgatgtgctctttattttagatagatctaggtcagcatgtgagcaaatgaaatagatgggtgctttgtctttcttatcaattaagtggttgtactcgtgtcttattagtaaggagaatagagaaatacttttaatctgatgtgctgtatttattaaagtatacttgattattttaattcattttttgatcatggcatatgagtgtagataaaattaaaatttaactcattataatatacctgtatctttaaaagcacaattataattaactcatgctttatttatgcttttaatcatattgtccagtcaagaagttgagaggtgagacctgttttaagtcagatcgaggtagctagaagagcttagatgtacaaggaatactggaattaaaaaaaaaaaggtgaaataaggatgaaatagaaacagcctgagaggaaagccatgaatgtaatgaaaatttttttgcctatttttggtaataatcagttacagttttaatattttatgtgcgacattacctgtttagataactttaggtgtagctgccagctttatttcttgacaagtaccatggtaatgctaatattctagaaattagaagagaattttaaaatctaggccatattgctttctttgacaatataatttgtg

SEQ ID NO: 55105 - DNA, 1054 bp, Homo sapiens
gaaaagtccccatggatgagtctgtatgataactgtaggcatgcctataatcacttctaaaagctctgaacacttgtttgaaagactttgagaaatcatatttgggatttctattgcctgagttacaaggctagaactcattcccatgttgcttccctatggcagtttatttattacttatttttaatttaaaattgttttaaagagatgtggtcttgctctgttgcccaggctgatctcaaactcctgggctcaagcagtcctcccacttcagcctcccaaagttctgggattacaggcatgaaccactactcctctggcaatttagactacactaaatattatattgttacataaatcatgagaaattactatgtagtagtcacgtttttgtaatcatttgtatatcctatataatgagtctaccaggcccagttaaaatagtcatattttacactatatagtcatagtcatattttccacatgtagtcatagagatgcgaggtaagtgtaattctaaggaaaaaaaaaactcaggcaattagagctatgaaccctggagagaagcttaaatatgtgtcatcttattttttttttttttgaataagtttgtaggtagaattttataactgtaaaacttaaaactatttgcttattgtttctcacaaattatagatattcataagttatttacgtaagatagcataagttatttttgtagggatctagttttagaaggctgaaatcccctcccagatttattattagctataccactccagagaagaaagcagtgtgaaagagaaaatatgacaaaccaactaggggtttagaggacagagcagggaagaaagtggattacaacttggaggttgagaaatttttttcttttgattaccgtttggtatttactagatatttatctcaaaaattaacctatagagattttttttccacataagaattttctcaatatagaaaaattcaaaaagaagaaggtaagctttagtaagcctgcttatatgtttttacatggaattttcagtctattaag

SEQ ID NO: 55106 - DNA, 1048 bp, Homo sapiens
gtacattttaaaagattttaaaatgaaagtaaaaatgttaccctcatctaaccatggtatatttaaattcaaacagtactttgaagtataaaaatgtaggtaatagtgttttctttaacacactggaaagaacattctattttttaatatttcacataagatttctttttaaatgtttaatcttagagttcatattcaacttttcaaatattagtaatttgagaataaagagctatagaagtgaaatccacttacataaaattcactttaaaagaaaatgcatgattacaggtagaatgtttatttttaagttttagttaaacatagaaaatatctgcccattatcatcaatgtatgctttttttttttttttttgcaagtaatttactttcccaaaatgtgcttaaaatggtttttctggcataattgtttggattgtgaaatgtacgtgatttattttagtattgtgaaaaagaataggctattgcatcttctgtattatggtttcctgtgaataatttaccatttctttctgttttccattgaactattcagtggtcggtgaagatggtaagccttatgtgctgatctatatactgtgccaacattaagtaatctcaaaacattgttttgtttaattcaaaacaagtggtaaattacatcccacgttttcaccttgtgtgttttttctttttatagtttcatagtccagcatatgccagtactcttgatgtcataagattagaaaatgtggttaattgtcatcaacccattaagttcttaaatgtcattgaatggagtccttgtcatgttacagaggagcgtaaaattgtggttaaacattttttaaagattacatggtagagccacagtttgttatgcagaaggaaaatttagcaaatattattttgcttaatagcctttaaaaaatcgtataaatttgatttgtagttttatccccagagtcattagatttttccaaaaaaagaaagaaaaatttcaaactagtatcattatggagttagtccttggttcttctgtgctattg

SEQ ID NO: 55107 - DNA, 1058 bp, Homo sapiens
gttgaaatgcatttcttcattttattcaataatttttcaagatttttagaaatatttttaaaaatctaaattaagaagtttatttttggcatatatatatactagttttcaaaacttgtactccttttctgtaatcccagctatttgggaggctaaggcgggaggattggttgagcccaggagttcgaggctatagtgagccatgagagctatgatcactcaactgcattccattgtgggcaacagaatgagaccctatctctacaaaaaaccttcaactccaaagtagattaaatatgacaaatttatgttgcaaattaaccagtaaatctaaaggaactcaacaaaggaaatttcaccattgatttatttaggccagattgggttgattgatatccttgtttctggtgattggtaaatgaaaaaaaaaaaaaaaaaaaaaaagcaacacttaggatgccctacttttttctagcaagcttgttgaatatccataatctacaggccactggggaaagaggctagggattctgttattaattaaatgttacatttaattatagctcatcctaggagtgagttttctcttttctgaaagtaagtgactcattcttacacatggtgaaataaagctatttagcatatgttacaggcataagtggcccaaagagcaagatcgtatttgttttgagagctccttttagcatcactttaacaaatttgaatatttatattcttttttcttttctttaccttttttttttttttttttttttaaaagacggagtctcgctcttgtcgcccagcctggagtgcaatggcgcgatcttggctcactgcaacctctgccttccgggttcaagtgattctcctgcctcagcctctcacgagtagctgggattacaggcgcctgccaccacgcctggctaatttattgtatttttagtagagacagggtttcatcatgtcggccaggctccagtctggcctcaaactcctgaccttaggtgatccacccgcctcagcctcccaaagtgttgggattacaggcgtgagcc

SEQ ID NO: 55108 - DNA, 2734 bp, Homo sapiens
gtggaacataataatagaagttgaggatgaagaagtataggacttgtgaaaaattctgaatgcttttctgtgaagttctgtaggtactacagtccccagttattgagagaaggggtaacattattagctctgtgtgataaaagataattgaaaactgtatgaagagtaaatagtataggaaagagattggaggtagaagcctttaacaatccaggtgagagatactgagggcctaaattaaggcatgaccatgggaatagaaaggaggaatagataaaagaatcatttcaaagccaaagtaggttgtactttcacctgattggatgctggagaagagaaaacatggaggaagcttaaaaaaaaaaaaaagatttgtagctatagatttaattgcaacaataagaaaaaagtttagggcaaagataaagattttgtttatgttgatttttgaaatgtgaaaaatccatattagaagtgtccagttgggtttaaagatatgaatctagaattcaggagagagaggtctggagatatgcatttgaaaatcatctgaagatggatgatattaaaacaattaagagatcatcctccaacaagactgtaggaagagacgagaagaaacctttgtcattttatgtaatacacatttaaaggttgaacaaagaaggagaaagaaggcagtgagggagattgtgagaaagcagaggtgaggaggagggaaaagaaaatgtaacctataggaagtcatgaaggaaaagagtattaaggagtgttagtcaatagtgtcagatgttagagtcaaggacagctaattgaggcacaaccgattgtaatatgattagagaataggaggtaggttgagaggaattggcaaatgactgactttgggtgggggcaagttaaagctgccattcctatttctagcagaggtgagtgggaggacaatgatgatgtatgagctaaggaacactgtggaatagtgtggctgagttggaatataatgagtttgatttgggacatgatgagctgaagaatattcttccagcccttgattttgtgtgtgtgtgtatatgtacatataaataaaattccttgtttagaaagcaggaagtaagaaatgaactctgttctcttttggtattctgattgtcttcataaattagtaactctatatgttatcacctttatgcaaattgtctttaatcaggtcatgttagacaaacttaaaaagatgtgactctacttaagattaagctgcgtacgagtccccagagtccaataaaactcttttatctggaagcatatgaagttaatatttaattctggggttccttctcttttttagagatgcactcaacaaaatgaaagatgtatatgagaagaatccacaaatgggggatccagggagtttgcagcctaaattagcagagaccatgaataacattgaccgcctacgaatggaaatccataagaatgaggtagatttgttattcagcacttgtcaagataaattatttttataaacttcattatgatagattggtttttgttagaattatcttcaaatgtttatatttaatgttagggtttatgatctaaaagtattattgtgatgtgtgttatttaatctcattaaagttttttatttagacctttatataagattaaacatttatactatttttttgaatcagctataaagttgatcctttgaccagtttggaataaaggtttcacatctctaagaattacataattataaaaacttaaacacattttaaatgtagatatcttatgagcttttaaacatatttattgagctcagttgtttgcttattttttttcctaaggcttggctctctgaagtcgaaggcaaaacaggtgggagaggagacagaagacatagcagtgacataaatcatcttgtaacacagggacgagaaaggtgattttttgtattttatttgtatttcttctccccagagttttctcacccttttgtcctaaactttatacaattcgtttttttcttccaaatttaacaagttaagcttttagtaacctcagtcttttgaacctaagtaattttctttagtgataattacaggtgaagtaggaaagttcatcttgctattcaatcctagtttgtcatgcatccaaacacagagctaggaacatagaaaattcttggagctacagtctgagggcctaggctcctcgggcatgggaaggtttcctaaggttcaagtggaattagggtcgcttatgccaaagaaaaattttactatcaaatagctcagagttttgtgaagaaaaaaaaatgtattgttagtttggaccagagcttccaaaagacactttgctaagtttctgtaccacttgtgacatttctttcttgatgtattatatctttttttccagactaaaagtccacaaattaggattcaccttagagaaaaatgtgagaggcctagtaacaactcttagttttctacttaattacagtgtaatctgagcaagttcatttttaatgctccctaagtctcaatttcctgaaatataaaatggaggttaaaatatccaccctttaggtttgttagtaaaaaagtaaataatacacataaagcacctagtagtaaatagtggtaatagtagtatcacttcttgaaagagtacatatctttaatctgttaagagatacccacaaattactggtttttgttattaggtaaaa

SEQ ID NO: 55109 - DNA, 6825 bp, Homo sapiens
tccagattcagaatagaaacaatccacctgaagcgtgtgaactaaacatggatatgcatggatcccttaaggaattttaggatgataaatttgggatgatggaagacaagggtctagaacgtttttctgttttatgtctagaccgagtgatagtgaggtgtatttactgaataatactttgtgcctagaatattgtaatcttgtaatttttttttaattcaggaaattcagcaaagcagcattttgtattagaagtaatttgtatacttgacatttgaaaaaaatagggcttaagtggaaactgtgtcattaatatttaatttttggaattgatcctgaggtgatcaatttataaataatatatagaattctcatgtttatgatacttgatcagagataattttttgttttatagtcctgagggaagttacactgatgatgcaaaccaggaagtccgtgggccaccccagcagcatggtcaccacaatgagtttgatgatgaatttgaggatgatgatcccttgcctgctattggacactgcaaagctatctacccttttgatggtatgattttcttaataatattgtatgtaaaaaaattggttctttaaaagtatttacatcaagtcactcactgtagtatccttatttaagtaatatatgttgtcagaaaattattatcccatttctttagtatgcatacttttgttataactgtattacaaatgtagatatttttcttccgtacatggaattaaaaggaaattgcccacgttactagcatcctaatacagattattaattaattatcaattttggtcagtgcagaattttcaccagagtccttactgtgcacatgtcctaaacaaagtcgaggcagcttgaacatgtagctcaacccaggaagcgggatgctggcggatgccacttcatgctcttccttgtagcttactaacattaagagacaggtacaaggcatagctagctgaatgccatcatcatatactgagtccgtaggccacctgtttagatgaaagtgggagagaatgtagtagctactgactatgttatctcttactctatgaaagttgaagaacaaactctggaagggaagtaaggcactgaggccttctcctgcagatttttagttcctctttatcctggactgtgaaaaatactttccctcaactaacaggagaactgagcgacactttcataaataaacggttgtaaaatggtgcttgatttaaggtctttctccccacttcgtgttggtttaaaattgagcaaagtctctagttacttcttattagaaaatatattaaatttaagaccttgcagccaagtgcagtgatgtgtgcctatagtcccagacacttgggaggctgcggtgagaggattgcttgagcccaggagttcgaatccaacctgggcagtaagaccctatctctaaaacaaaacaaaagaaaacaaacttgctataatgtaatctagagagtagggaagcaatttggcacgtgttaaatgaagattcagttgtgaaaattgttactgctaagcaggttgggcgtggttggggatagagagtgaaagagttgtgtatggccattctgtttctaccatctctagagtcaaacccgtatttttctctgttctcccttcagactctcttttttccttctttcttcctgctcttttgctatctggttactgttttcctaatccatacctgctgaatttttttagatagactactaaaatttgggaaaagagttggaatagtgacataggaattagaataccctgtcaaatcatgtaatgtcactgtgactcagttaacttcatccgttacatgggggtgatgttatccagccctgcgggcttattatgcagctcaaatgagagaatgtatatgaaagtgctgggtaagccacaaagcacaatagagatgttgctagtgagagtcagtagttccaggtacattgaaatctagtagggtttcattgtattttgtgcattgtattagtaactttaaaaaaaattatcacaatgcttaaattatgcttgtgaaaactctcatctaggacataatgaaggtactctagcaatgaaagaaggtgaagttctctacattatagaggaggacaaaggtgacggatggacaagagctcggagacagaacggtgaagaaggctacgttcccacgtcatacatagatgtaactctagagaaaaacagtaaaggtgcagtaacttatatctaaactaaccaggcacctttgtgccatgtgtgacataggaagagtaacataaaatgaaaacacattcaacaggttgaaaaaaataaggaaacttaaagggcatccaagattaattgttcactatgtgagctgagtgtaggcttgatcttgtgaatattaccacaagaaacattttgtggcactttactgtttgagtaacgttggtgtgaagcttaattgatgccttttgctttatgtcccgcttaagtctgtgtgaaggatttgtgtttttctgccttacaaatagaatttgatttattgggcaggaattcatggatagtaatgctctctgccccctttacttcagaaaacacagtgactttagtgaatttgaatagtgaaactgctctgaaatgctatggaaagccgactccccaaagagtggtttcttctagaagtttgaatttgtagctacagtttccaagaagaaaaatagtagttggataatttagtaaaataataacatcattttcattttcttacctattcttaactttggtttcctaaaggaagaaaatgagcaggtagcacataatctatttaagtagatttaaagagagtttcaaaataaatctcctggtctagctcttaggtgaataaaatagattttgtttgagacctcaaaatattttgaggttagctggtaattttcaataatttacaagcttccttccaaactaatctcatacttttgtatgtttcatcttgaaaatatcttttgggaaataccactttagtgattatttagcatttagcagttacacataggaaaatacacagttacatagaaaaatacacatttgaagatagaggaaaccttgaatggaggggaagtgttgacaaattttaatttttaaaggagaaactttttgactatctgggttagaggaagatatgtgtaccgcctttagggcattttgttatttccgctgaatcattagttattaggatagataaatttttccaattagtttcagcaagcgttgttggaaacactgtgcagtcaaggattgtgcagtgctggttgtgtgaccacaccctgagtcagtggtgtggggaagtaaagtgtgaagaagcagtaagattggtttttaattttgcccatgttttaaattttcctggtgttttcggtagctgactataaaatgatagagacatttgggacaggcactttaaactgaacaccccttttggttttaccaaaggtcttcagtaattgttcttttctttttcctcctggactgcaggttcctgaagagggtttctgaggaaatgggcaagatgttgaaggaggttacatgcagctgcttttgggggagggtattagagttgtcaggctcaaagagagtgagagaagcaagttgcatgagtgcatgcagacatgattttttttttactaacttcattagcatttccatacattgtttttaaaaatcataataccaacccttaagttcctagttcacagttattcccacaaaagaaaaagccaacaatagtgtaccatttttctatttattttattgctgtctaatcaataaagaatgcagagctgtcaaaaaatgtgtcttacattagctgtcccaacaggattgtcttccctcccagctctgttttaattggcttttagacccactatctgtcagatccttgccatctgtcagtgtctgcctgcgccacctccgtgcttgcttaacatcctgttgcatgtctagcgtgattgagctagatttttcaggcatgtctttagattcccttgttcttgtcaaagccttgttttgttttacatttgtagtgcaaatcactttgtcaaacatctccagcactaatgtttccatcttagtatttgtgcacactgctataacttccccactgcaaacattccagttttggcattacgaagaagtagctgtgaacctgaagtatttatgataagaaaaagaaaacatctctgctgtagcctacagcccagttgaaagaactctttgaaacgtgatacatcttcagcacctcagtctgggaagaatctagtcagcactgaaatcctggcataataaacacagaagatattcaccacctcaagacaaaggactattgtcaaaagtcagctgcttccattcaaatgctgccttaaacttgagtgcctaaatctgttgattgccaacactaccactacagtatcccacaaagggctttatgtgtcagctcagtgcgacctgctttaactctgcagcaccgctgcagctgccgatgtagcctcggtaggtggctattagagctctaccatatacagtggtgcatcttcaaatttatgcatcaaactaaagacatgtccaagtccattttaatttcctcagtggttttatgagaagttttatgggcctcccccaattgtctttttattttgggttatgacgatcatgtttgataattacaatgatagtctctttccacgtgatgcttttgtttgaacctgataaaatttagtgaaactttgtaatgatctatgtgcacttttacttgtaaaatggaatttctgtatgtttatacttgtaaatatgattgttgttagtgctcctgttgctcatggtgtcctgcctcgcatttgtgattctgttaatgacatgtatcttaactaatttcttagtggtgttgtaatagggagatggggcaggtggggggttatttgtaccactgaatcttcattaatttggttctttactgttttgaggggagaaagaacgtgaaatggtttgtgtattattgaattttaagcaatattttagaagctgtgtgactgctttaataactttttcccagtgttatttgaatcatactacccgttatactaaagctgaatgacaattgtgtgaaagttactgccttcataagatcaagtcaccactgttacacagctgacatatagtgtattacctttgcagctagtaaactataaagtttagatattgaatctcgttacagggttatttatataatgtgacattattcagtactgacagactacatgaagtagttttaaaatctagtgctatttttattttaaaggttagcaatgaggaggaaatgtgatctggctgtgtttgtcttctgtacaaagcctgaagtgcttatggttttttggctaacagccacagagggcaaagtttaagactttcttgtaaggactaactgttcttttcaagctactgtttgtttttctaaaagcaggatttgcttccgtaggaggcaagttccttgatgtggaatagtgcaacctgtatatgggttattataataggaaagacatttgtacttgcacagtttaaatcattcttaaattttgaacatgtgaattgtcccaaaaaatctttaattttttggtaatttttactctttttgtgcacatgttgatttcttaatggtaaatccttcatttaaagatagtgttctctgttgagaatatttacatggaataaaacaatcttttcatggcctgttaaggtgtttagtgtgtgatctttcattgctatgtgaatcagagatgtgatgattttgttcttgaatgtgccaagtctcagataatacagagtagatgacaaattccataagtgggacaagttttttttgttttttgcaaagcagttttggaaattgtattctaattttggtttctctaagctttcctaaaggaaaaaaaaagtttgctgtctctttagagtgaatttaaattgcatgcaataatttggatttatctttcttctccagtagctgtgttgcatagactttccttttacaccatctgtccactgcaaccatacgaactgtccctgtacctcatagcccaatctagccactacacgctggacagcatttcctgtgctccggcttgattcctaatcagttacaacacccaagtcttcctggcatttcaaagcatggaaagaacatttgccataattagtgacacattatctgtaacttcaggaagtctaatttcagaagattcaccttttaaaaaatgcaaatgtgaaactatgactgcaaacttttagaaactcagaaaagggaataaaattcagggtagatgctgaacaatgagaggttacgattgttgagatgaaaatttagggatcaatgccaagtttggaagtaggaacacacaaaacaatgaaaatagcaggaaaatagtgtcaattgttaaagcttcagatggacagaggtttggggtggagagctcaaaacaatgaagaaagcttttattatcaaaactaagatcagtgaaatcacttcctatttgcgaggggaagataacgtccttgataacaacaaatgaaaagtctctctagtctcattgaaaagggttttattttgaagaatgtacaggttaagtattccttatctgaaatgctggggaccagaaatatttccgatttttttttttttagatatttgcattacatacttaacagttgagcatccttaatccccaaatccaaaattctccagtcagcatttcctttgagcat

SEQ ID NO: 55110 - DNA, 1002 bp, Homo sapiens
ctttggggacattttttaaagttctgagagagagaagatgttcattttgatgctactttaagcaagctttcagtctatttttttttttttttttttttttgagatggagtctcgcttgtcacccaggctgcagtgcagtggcgcagtctcgctcactgcaagctccacctcccgggttcacgccattctcctgcctcagcctcccgagtagctgggactacaggcgctcgccaccacgcctggctaattttttgtatttttttagtagagacgggatttcactgtgttagccaggatggtctcgatctcctgatcttgtgatccacccacctcggcctcccaaagtgctgggattacaggcgtgagccaccgcgcctggtgctttcagtctatttttaacacatcttaggcagaactgaagtaactttttgtttattttgtttcattaggttttcaaccagatgaagaaatgaatgaaatctgcaagactgaatttcaaatgcgattgctatggggcagcaaaggtgcacaagtcaatcagacagagagatatgagaaattcaaccagattttaactgccctctcgcgtaaattggaacctcctcctgtaaagcaggcagagctttgataactctccagagaacctttagaatatcttttcaagtttccccagcttcatctttgggaaagcttactgtttttgataaagtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggt

SEQ ID NO: 55111 - DNA, 1033 bp, Homo sapiens
cgtgggcagagcaagcatggggctaccccgctggggagtggagtacaagtacacagggcatgttatgaggccctgagttatctgcagcactgtggatggctcatcagggcttttatcagatgacagcgttgcttgtagaaggctgcagttgctgtaacaagacaagggctatgagtcacctcattctgtgcttaactttggaaaacatgtgatatggaaaactctactccttattcttcagagtccacatgtgttcccccaaacaatgtatcagtcccactgctgatgccgcttgtgacgttaatggagcgccaggctgtgacttttgaaggaaccgacatgtgggaaaaaaacgaccagagctgtgaaatcatgctgaaccatttggcaacagcgcgattcatggccgaggctgcagacagctaccggatgaatgctgagaggatcctggcaggtaagagatgggttttgtaagctgttctctaacactgtatcgtaattgaaatgaaggaatggaagagcatggctgacttcacttagaaaaagaccaaaaaggaaggattaaagaatggaattccatttcctatatggctagttattacttcctcttaattccagaatgactcaagtgccctgtttctccttgtgtgttctgttgttcaatggtatagaataaacagagagaaggggtcaagaaagaactggggccgggcgtggtggttcaagcctgtaatcccagcactctgggaggctgaggcaggtagatcacttgaagtcaggagttcaagaccagcttggccaacatgatgaaaccctgtctctaatagaaatacaaaaattagctgggcgtgatggtgtgtgcctgtgatcccagctactcaggaggctgaggcaggagaatcacttgaacccgggaggcggaggttgcagtgagccgagatcgcaccactgcactccagcctgggcgctgggcaacagaacaagaattggccaacttgcctaccacttattaatagtacctctaataggtgag

SEQ ID NO: 55112 - DNA, 1016 bp, Homo sapiens
gggccgggaccccatcagggctctcctgggtccgtgcagcagcctccaaggcagtggaagaaggagcagagggtggagtccagagatgcagcagagcagaccagctaagatttggagggcagaaggaagcctcatcgggggtgcttctgccaccctgccctgtggagtcggctcacagtaaatgctctagacatgtttgtccttcctttgtgtcagtgagctgcataaccttgggcatttgtcagggaacctaatgcaggccctgcggtgtgagcttgggatcccctcagccctcaggcaagcaggcgtggctccagggaagtgacccaggcatggcatatatgtgccgacgaaatgcagactggagagcaggggccgccgcccatctgccaggttttccagagcaaacctgaatcaatcacaggccttttaatctcgccacccagagcgtgggggacacccctcagaagtacagggtttgggacctctgacagagggcagctgtctaaatatgcgaggaagcgtgcatggcgtgcgtctgggctgccttgccaaggtcaagttgtaaatctctttcccaagatctggccagaattcttcccctttccacatggctgatgattcaaaacttgtattttcaggtagcttttaggggttctaaagttatctgaatcctttgcaaagtccttgagaaaggtgaacttagcagttatgttagaaaaggggaaactgaggcccagagagcacaggtaggagcacagtaggaattctgcatcctgtcgtggcgtctaccactagagagctcatccacagggtcatcccctcagggttgacagtagttcagccacagaagttacagggtagggttagtaataccacctaaacatccagatgtgttttgatagcctggggtaattaaggttgaggacaagtgtaccagatcaaggagaggaaccgtcccatgcctgccgtgtgttcaggtggctagacttgttgttgcatctgttagttccact

SEQ ID NO: 55113 - DNA, 1066 bp, Homo sapiens
cagaagcttgcattccttatataaaatggaatagtatttgcatataacctatgcaatcctcctgtagattttaaatcatctctagattacttacaacacctaatacaacgtatatgctttgtaaatagctattatactgcattatttagggaataatggcaaggaaaaaagtctacatgtttcataccaatgcagctttttttttttttttcctgaatatttttgatccttggttggttgaatctactgttgcagaagccacggataaggagggctgactgtattctagacaccagatgttgtctcaggcgatggtgggctcggtccatcttttcaatataaagaggctggttcctgggcatttgaagcccttttttatttgtagctcagtgaagtcaattagcttcagacgtcagggcttatttaggaactgggttttccttcctatgtgttgaatcatggcaagaagtccagtctcagaacactcctgcagggagtgccaaagttgatggagggctccccaaaacaggcttgaggaactttaggcagctgctgaccatcctggagtaaacaagacccttgctgacaacagaacttgagggatgactcagaaaccagagtaactcattgcccaggcctgggaggtggggctgagggtggacttctgctgagcaggccttgagaagagagccagggctgcactggaagaacaagggcctgctgtacttttggccagatggcctcgggcagtgctcacaggtagtcacgcaatttgcgaagttatccggacctcactttaaagcgagcttaacctgtttgggaggtaggaggattgaggatttctgttctagtcagtcaggcacattgggccctgaatctgagagcagaaccatgtcagtgggccaggagggagactctggcctggtatgaacctgcgtgggttctccatagaggaagctcctcgtagaaacaggcctgggtttacagagcagcccgattcccaggggaatgaatccttcctgtggccctgggcagggcttaatgatcctctaggtggaggagagat

SEQ ID NO: 55114 - DNA, 1469 bp, Homo sapiens
tctatgaccatacaacatttgtagcccaggtgtcagcagtccccgggatttctatttgcacccaggagtgtgggatggggcaagcccagcccagccctcacgatgctgtagactccctgagattgggcgtgggacagtcacactgaattttcttttggaaatgaaaatgaaaattgaagcccaagggcatgaatggagggctggggagctgccactctggttttgtttgttttatattctccacacagatgagctttctctgaccttttcttatcccccacaggctgcaagctgccacctcagtcctcgggtgtggacacaagcccctgcccaaactcacctgtgttcaggacgggaagcgagcctgccctgagcccagcagtggttcggagggtctcctcagacgccagggctggggaggcgctgaggggatcagacagtcaactgtgccctaagcccccgcctaagccctgcaaggtgccgttcctcaaggttccctcgtctccctctgcctggctcaactcagaggccaactactgtgaactgaacccagcgtttgccacaggctgcggcaggggagcaaagctaccctcatgtgcccagggaagccacacagaactgctcacagccaagcagaatgaggcgccaggtccccggaactctggcgtcaactacttgatccttgatgatgatgacagggaaagaccttgggaacctgcggcagctcagatggagaaggggcagtgggacaagggcgagtttgtgacgcccctcctggagactgtctcctccttcaggcccaacgagtttgagtcaaagttccttccccctgagaataagcccctggaaacagcaatgttgaaacgtgcaaaagaactgttcaccaacaacgaccccaaggtcatcgcccagcacgtactgagcatggactgcagggtaagcgctgggggtcctggtgctcctctggcttttcaaggtttggtaagagctaggggtcccggtgctcctctggcttttgtaggtttggaaggaggggatccatctggcctcactctgcctcacccattaaatgctttgcccataggaaagtctgaagataacaccagcatgggaatttatttaaggggtgggaaccacaagctgggacaacctttgcccaagcaggaagcttataaaattcatctcagacagagggatggcaggctgctgccgggggtgggggccgccctcttctcccacccacccctgctggcatcagcagctgcaacagaatcctcctcacacctggtgcttatttataaactacccccttgcctcagctccatcagaattggtaaagccaaagctacaggagagtagattgtagatgaaaatgtagtttctggagtagcagaccttggttatttttattacattatacttatgcattacatatttattttattactaaaatgatctttagtataaac

SEQ ID NO: 55115 - DNA, 1055 bp, Homo sapiens
gatatttccttttgtaatttgccctcggtcttgtcttatcttcgaaaggttgctggaatttctctgttccttggagtttgggggttttttgatttgttttttctttggtgcttgtaaaggtaggaaagaacttcgtgatttctgtaacataacaatgttttatgcttatgggaaggccaattaaagttcataacaacttggctggtgcagtgcctctgtctctagctagggagattctggtgcttggtgctggagaaattcccagtctgaattggaaagggacagaaggaataacagcgagtgtgttgaaagttaccttccaccttttccttgtgtggttacacagtgtgcctcccaactgctgcttggtgaccgtgccggtgccttttcccagctcagcaggaggaggctgtgtgggggtcccccgagagcagccaggaggttggggatggcagcctccccaggcagtcctgcaggttatttgggggatgctgagatttgcaccaaaatggaagtttccccacagcttccttcctaactgcaacactatggagcatgtggaaaatgcatgttagttaggcaagccattccctctgggcctgtaagtaattttaggctctgttaaaagtacacattccagttcatcagattttcccgggagtatcgtaaaacttttaccctactctgttcaacaggatggaacagcccagaggaggcatcctaggactcagctgctgcattggtcatggggacagggggatggagtacacaacacagtcatatattaatcgtcccatcagtaatttgtttctccagcggtcattcctttacttttagggtatgctgtagcactctcgttctgagcagttttctttttttttgtttttgtttaagttcccatggcattgcctaaaagttttattttacacgttagtaacacatttccatcctatgtgtcttttacttcagaaacaaagaaaagagtggtagccagcccgcctgcctggatcacatgcaggacagaagagccttgtccctcaaagcccaccagtcag

SEQ ID NO: 55116 - DNA, 1023 bp, Homo sapiens
cttcctagttcgtgactctctgtccagccctgggaactttgtcctgacctgtcagtggaagaacctcgctcagcacttcaaaatcaaccggacagttctgcgactcagcgaggcctacagccgcgtgcagtaccagttcgagatggagagcttcgactccatccccggcctggtgcgctgctacgtgggcaaccgccggcccatctcccagcagagtggcgccatcatcttccagcccatcaacaggacggtgcctctgcggtgcctggaggagcattatggcacctccccaggccaggcccgggagggcagcctcaccaagggaaggccggatgtggccaagaggctgagcctcaccatgggtggcgtccaggcccgagagcagaatttgcccaggggaaacctcctcaggtaggtcagggcctcctctgcaggactatgaggggcgccggggtgcccaaggttagttaggcaggtgaagaattcatcatggaacaaagaaataaaagatgttaataggaatgccgactgttcgcagaatagctgtcacgaggcagtgaacaattagctcccagctgagcagtgtcagcaatgaatggtacaggagctgaggaagaatttcggggggtgctgatggggataccttgtgaagggggtagacttaggctggtctgatggctgggggaaatttggatagatgctgcaaagggctgggggtgttccaggtgggaggcatagcatgggcataagtgtggggacagaaaatggtatgaagagcttgaagtgaatgtgctggtagggctggaacaaagggtctgtgcaagggacccgtagcagtgggcttagggagatagccccagccagatcatgggggccttaatgccaggtgcagggctttaagggagctgtacagactcagcatagcgaacacggtgtcctaagaatagaaatggacagtgatgtaccgggggtgaggagagagacaggaacaggaaacccagttagtgagtcatggagggcccc

SEQ ID NO: 55117 - DNA, 1275 bp, Homo sapiens
attaatttatgtgacgaaggcagtagtgaaagttctagaaggtttccactcccaaaataaccactgtgtcatcatgaggtggccatatggggtgatccttttgaattgctttcttcagttgtctgggagacattgtccacatcatctgctaaggcagaggctcccagcagcaaacctggctctctgcagtgtattcgagccagccctcactggctggaaatggaaaaccttttgcaattgcttgttcactctgggtctccctctctccctcctttcctctcattttcctccctctctctttccctccttcccttttaaaatacaagtctaggcagttgtgtaaccttcaaacttttcataaaatatgcaagagcttaaaggcatagtttttgaagtctggtctttcatcccaaattatttgagagcgtcaatcttaatatcttcatttctctctctctaggtactttcctgtaataccctacctcctatagtaccctgtaggattcactctctggagtctacagggagaaagagcaataatttaggattttcctgttcttctcttaggaattaggacagaagtaacaagatagctgattttatattttttgtaaccagtttaaaagcattatctcaaaacctggaataaaagattgatgcatataaagtgctaaaaagaataataacccttgctgttatgagcagggctgagaaaggagccggggagagggagaggtggctgagtgttaggacatcagggaggaaggaaaatgcaaagataactgtggaaatagcttcttggatataagcaaataaattttcaacaaagaactgtgcaagacctgctgtatattttcagatctccacattttcagaggtcagaccaagaagtgggcccagggtgcagcacaagggatttaggctaagcctgcagactgcctgtcagggtgactcaatgggggtcaggtcacaatatgggttaggatttagttcagctgccagtgacgggaacacccacaaatcacaggcttccataaggtagatcacctagaagacctggaggctggcggtccagggctggtgtgttggccccacagtcatcagggacccagcctcaatcagaccttccacccagccaattccttggtgtggctccccactcaccgtccagaatggtgttgagtctccagccatcacatctcagctccttggtcagaactgagtcctgtggccacatctccctggaagagacagagattgaggaatgtggtcttt

SEQ ID NO: 55118 - DNA, 1118 bp, Homo sapiens
cgggcagtgagtgaggattgaagaaacttgtggcaggcagcctccaggcacttggcaggctccaggctgctttccttaactgcttgcctcccaaacacctgcctccctcagcctcctgcatcagaccttgaacatgaagtctgcttattttatagaaacagattagtagcatcctgatatgagtctattatgacaattaacagtgctgactacatgccagggatgttcttagtgctttccagatgttgacccatttaatccttattaacacctcatgacatattatcatgcccattttgtagatgaggagcctgaggctctacagagttaatgtcacctgcccgaggccacacagcaggtgcgtggcacagtggcctgtggattgaggtggctcttaaacaccttgctgtaacactttttgatatcagggctattaaaatgctggggataggaaagatgtagctagactcagattttcatgaaaagcatcaattatagtaacttattaattttctaactatcctgcaatttggttggacaagagggggcctcatccaccccctacatttgccctgtttgtcactttacctacatctcatctcagaccccaatgctaatgactgggacaaacatgaacatttcgaagtggggccatgtgagtgggtaaccatgtacagtagttactaactctccttcccttcttttctttctttcctgctgaagttatacttattatttatgtacatagtaccttttcttactctccctgtgcctctaaaaggactactcaaatttcctgaagcacaagatatgagccctgcctgcatgtttgtctcattgtggtctcatcatggttgtaggtagatttggtccctagaatgaagctggcaagacctgtgggcacaatgttcttgatccaaagcccagcagcatcccttcctctggaggctgagcccacagctgctgtgtggggtgagctcaggatggctggagcctctgctgaggcagcgaaaaccaactttgtctctctgactcctcctctgctgccacctccttcccctcaagacaaaacactagaaaaacaaggaatcagatgccttctaggaatgaggttcaaa

SEQ ID NO: 55119 - DNA, 1078 bp, Homo sapiens
gagcccttggaagcataaccaatatttcctcaggccttggcagccaacagccccaaataatgtcctgaaaactttaatgcctcaactctgctgactcttggaacccacttcataatggcaggacccttgcccatctcccctgccagtcatgcctctgacagttatttctgggggcccacagggacgcttcctgtttgcatccacagccctctcatgatctgggcctcctagcaaattcagagccaaatcccagtgtgtctgcaagttcagtatatgtcaggggccatgggtcagctccctggggcaacaggaaatggtgcttaaagctcaggattctggaggaacagggcaggactggggtctgcgcccccagggaccaggcccgaaccctggcatgaatgaaaactaaatattagaagctcgttgattctgtgtatatgtgtgtgtggtgggagaggagttgaaagagactgtggctgtcatgtcggccttagctggagcacccttggactaaaatctctgaacctaggggcaatatgacaaggttggtggtattgtaggtggcaggttgtgggactagaaatgggaggtagggaaactgttaggaggctattgcagaagttctaggagaaaagaacagtaatctaaacagtggggattcgaatggggataggtaaaagaatcaggaatgtcttaaccaatggaagccgattctgagggttctagttcaggtaatgaggacagaagagatgccagtgactggggaaaagggcgaagatcaggctttgcagaggggatgagttcaatttatccatattgacatctgagctttaatgcggattccagtaaatatccctaccaggcaccgaccctaagggctggagatggagatctgggcgttgtcagcacatttcaaaagactctgacctgtgcctccagccctggccccatccagcccattgctctcactgcagccagatctctctaaaagtatctttttatatacctgttgccttcctgggcaaagattttccgtgactctgactttctggagtgtgatggtctaaaccctcagcca

SEQ ID NO: 55120 - DNA, 2088 bp, Homo sapiens
gccaagggtccaacacctaaaaggcagagaagtctcagggacacactcagggaccctccctgctggcctgtagagtgcctcttgagtgaataagagtaagacaccctttcctcaggacactttattgtcatatgttgggcagctgttgtaatcaatatatagatccatgacagctgtgtacaagtggcacctccttagctatggttctggcaacgtcctggaccgctggccaggccaccatgtgcccactgggctgggtcaggcaaagatgcccaattgcccacgttcacatttggttttgtttacccaacagggatataaaatatgaatttttttctctttgaacttttttatttgtaaagttaattatttaagtaaatgctttggctttaatcacagttattagcataagaaactatttttctagcctagcatcccagtgggaaaagtaggattggtgaattcaaacctttcttcatttatctttggattataataaaataaactatttttaagtaagccacaaaaccagcaagtgtcagtaaaaggtgaaacagaaccaatctactaattatttcattgcaaggctttaggatcgccacaagtgccattcctgttctttctgttctactttagatgaaaacacccaagggctcgtactagaagtaactggtcttcaaacttgtggagaactggatttttattttcagcttcgggcagggtttagagtgatgaaagtaattggggtttattcattctttgggttcatgatcaatttatgcaggttttcaattgtaaaaataccaattgggtctttaaaagtcctttatatacttcagaatttggttgtaaacttggcttgaaattcaacgcaaggcaggggttcaaaagggctgagtttctgaattctccaaagaacttcatttcgggttggatttacttgtaagacgatgccagatgtagcagccttcttcagaggaagggttcagactgctttgtgtagtgcttttgaaagtgtgctttttggggattcagtttctttacatgtttacaacattattgggggcagtgatgatgcaggtctcaggtcatcacagggattcccagagttcagtggatttgagatgtggatctgtctttttggacccccagcttgggccacctggtacagttcacagcccaacccccgtggggtttcccaccctgagctcattggaagacactggccttgcttagaaattagaccaatggccgggtgtggtggtgcagacctgtagtcctggctacctgggaggctgaggcgggaggatcacttgagctatgaatgcgccactgcactccagcctgggagacagagcaagaccctgtctcaaaaaaaaaaatgaaaaagaaattagaccaatgttaacatcgaagatccagaactccagtcagacttataattttatttgtaatcaaaatttctggataggatttctagaaaatcccaacctgtggagttgtttgatacaatttgataagaggcctggactgttgtggacttctccctcaagctaataaactgttccaaaactgaagaaaggaggcttttgtttgagaaccctgatagcattccgggtgttggagcctgacactcccaactaggatagaatagcccagcagcttgctagcttgctccttctccagcctcctctcccttctcctccccacctcctctttttatgcacacattccctccttcttctttttctttattcaaccaagttaattgccaggcttgatcatggaataaatgaatgactagaaaatcatctcagtttttaaaattcaacaaaaaatttctcaacaactaagtgtccaagaagacagaatctacatacaaggacctcttagtcttgtgcaaacacaaaactgtcttgcactcgcatgctgggctgtgtcacctgtgtatttgtggatatgtgagccacctggcgctaatacatatacttgttaatagtgagatatatgcatacaaagtgcttgccaccaagcgacagtatgcctgcttactcaccctgcatctatagaaccattgagtgctactca

SEQ ID NO: 55121 - DNA, 1762 bp, Homo sapiens
attgccaagtgcagcggatgctgtccaattctgatatgattggaactctctgcagcacttgacaatgttgaccatttcttcctgaaatcagctttctcaacctccaggacactgcattctgtttgttctcctgtgtccttcctgtccagtcctactgtcttcttgggtttctctttctagtctgcctctgaaaagcctcccccagccctcttctcatgctgtatcccatctgtttggtgaaagttgggatagaatacccctctatactgaggactcccaagccgtagttctccagataggctctccagtcaacctatgtccatagcacctggaccccatggcccagtaagtgactccatccagaaggcccagcagaccttagttctacatcttcttccacaaacccactatgccctcgtgcatttttattggatgttggtggctcagtcatctttctggaatgcccatgccccttcctcctattcattttccacatgtaattaatgagtaggtcttcatgatattaccttctaaacaccactctcacctgtctctttctttctgtccctaccaccaccctattttcttgtgagatgtaaacattcttgctcactgtttagcccacaggaatgctgtatgaactcatgagatctgagttgtattgggttgagtatcttgtgtctttaagtccagtttctggttctctgtttctctgcatgacatgtaggatgtttgctgtttgcattttttaaaatgcttgttaaatgagatatgtgggtatctagtgctttgagctcctctagaaggaatatacctttaaagtgacctgtgagttgtatattgaaagtggtgcagttgatgtctggccaaaacccatcttgtgatgaatcattttgttttactgcaagcctgctgcgtacttagcactgacatgtgatgcgctttgtcccagagcagagttctaagatggtagttagtcatggtactattttggagagagagaatttgaaagtcatttgttctacaccccacgctggaaggctgtctgaatctttggcttttcctccatgtgtttggcatatcttgtttttccttccaattacatctttgggtgtctttcaactacggtgcattttgttcattcagtactctccttttcctaattcatctcattcattcaaggtgaattaggaaatgagagtatttgaattaagttgattttgatttgctgacattcttattgaagagcaaataggacatctggtttgatgaatagctgtgttccagatcattcataatttgcattaagatgttgaattaacaagattgaattaccagtggtgaggatttctggcttggatcttctagcattttgaactctgatcagccggttttcaaactcttttattagggtctgccttagccagggcagtctttgttcttttcattctttaaagatgttaagaaagcactactattactgagtgtaatcttgctgctgaactcagcgattaatatttcacttgcattgtttcttttaacccaagtgccagccctgtgaaagcaagagagatattattcaaagtcgctcgaggacatggttaaagggagcaaagtagtttagacagggttttcacagtaggttggactggtgtttagcttttatcaaagcccttcatttctctagtccaataatgattaagtgcacccattgaccttcggccttcctctgaagtgtggcacatccgacttctctctagga

SEQ ID NO: 55122 - DNA, 1316 bp, Homo sapiens
atagggacggcatttcagcctgggggagcagcagacccagtagctcagagatagaaaagccactggcatttgcaggagtgcagaaggccaggcctgctcagagcagaaggttcactgggaaggttagtgtgtgacatggtcagagaagtcacagaggatctaggaataatcccagcagccaggcctcctgtaccaggggttaataagtatttgaggcacatttccccattggctttcatcccattgcatccttagttcagctcagcagtcaccggttgtggtacctcggatgtgtcggtgctggggacccagtgggagttgttggtccagtggggatctctgctgtaataccatgcctggtgggcattctgcagacatttaactctggttgaaggaaacgatcggttatcactgatttggtgttgctctctttagagggtgctgtggctccctggaggcacatgcctggcatagatggggcaggagtggcgaggatcagggatggcctcctgcagggaggcagagcctttgctgagtctggtgaattagtcgaagttatccagagaaggaggagaattggccttcttcgtggagagaggagcacgcacaaagtgtagagacgtggagtaccccggtgtgggcaggcagggaggcatcagcctggaaggggagcacagggagtggccgctggcaggcccgcccccaggtccctggtgagctagaggaggaacttggtaaaaagcacaatgggtcacatttctggggctggcactggaaacaaacccctacctcttctggccccttgtgtctctgactgttagtaacttatttatttaggtatttttgtggacaggggacaaaggagctgaaacttgtcactttgtcaatgtttgcgcctgaggaaggtcaggggtgcctgtgtcagaggaacctaagagacgggaattaccttgcaagggcggaaaagccacctttctgaaagagcgcagatagagaggttggggtgtggtgcctgtggatagatggaatcagtaagtctcagctaaccaggccttaagtctagtggccatggtcttgtcaatgagcagccacagaaggcagggatgttagacatgtgctttcctagacttatattcgactgtctttgcagccaggaagtgctatgtagtattgtttcttttttgttttcctttaaagtcatttcccctaccctgaaaaaaatatctggagcctcttggaatccatattacagcctgaggagtcacatctgcccatcctagagtgccaggcccctggaacttggtttcatgtgaaac

SEQ ID NO: 55123 - DNA, 5370 bp, Homo sapiens
tgcttatgcaggggtcttcctccggcctgccttaaccccctttttgaattagagggtgggcaacatttggcctgaggtaatagaggtttccttcaaggacccacctggcttcccagccatggctttaatcacaagtgtttccctcggtgcaaaggagtgagccttccaggcagccagagaagggcggtggatgggagttcaccctgtaggaccttttccagagctcagagctgcctgactgggcccctcccttcctcagtccctgggagttccttagaaatgccctcccctatcccgaaaggggcatggtgtttagaaagccctgtatccaaatttgatgagtcccaaatcccacacaccagatcatcagaaagtggcccactgccccaggtcacagccctttcacggggctgtgtgagtaacaggtttaattataagacattaaaaaatctatttgtgtttctatgtgatcagataccagattctgcagtctgaggttggagtccctagccctttgttctctgctgagtggtacacaggtctggtcctctatttctttgtaactagaataatcattgtggggagaatgggaggaattgatcagcgtaaataggcagcgtttaaaagcttaacaagtcagtgaagggcactttgagaatgtatgcaattatcatctttagttacaaaaacaacacgttattttagtctctctccttgaccgtttcaggagaaaattgattaaaacctttgagtgctgcttcagaaattatttttggtgtgaaataaaaataaaagatgcttaggaaacagttacctaataagattagtcattatttaatcccggtggaacaaattctttgggtattttggagatattcttagaataaacagagaaaacctcaggtaacaagagctgtgataccacagtgacctaagtgtctttggttttgtttttaccctggctgtggagcactttattcgtaattctatgtgatttacatgtctgagttatttgcatattactttcaggaatgcatttcattcacgatttctgggggaagggtgtctgggcttcggagtctcttggctgactaatctcacgaatttctgtgcaggatttcagtcactgcccccctcccttttctcaggcctgggatggtgcctgtctagcctcttggggaggtttttagcttgaaggaatcgttatttgctctccaaggagaataccaggtgaaaatggcccattctgtggtggctaatggcctgattgatgagtcatgctcacagaactgctggggcctgggcctggctgctcacacggacttaccctttgaactccatctaacggaaatgagggcaagccagaaaacgcttcctcacaggtgcggtactggaccttcgaggacagtggggacccactgaccagacagtcttcaagggctcttccagctcagaaaacccttctgagttctgccaccttggtgcttccttctaggttctctggtggactttctgtggcctgggagccgtcaagactgcagaccagacctccagagtcagagaggagaatgagtgagggaggaaagcagaaaggaagtcatcgcccacactcgctgtggcaatagcgcctcacttagcagctccatccccatgttgacacgttgatgaggccgggcccttgcccttgcgtgggtgtgagactgtggctctccatacctgctcactgggcccagagcaatttcctatttttgtgggcagacttgacctagtccaaaggccaaggtctcccgaggatttgacgctaatcccgttggatatttctcatacctccctcatgcctcatctggtattgttcctttctggactgaatagatcttgtttcttcctcattacaagtttctgcctgtgtgaagttttagaaagcttcaggacacattccatatttgaggccgaagccacaaaaagttaatatttggagcggtaggataggagaggaagagctacaggcagaaatctggatttgattaaaaaaaaaaaaaaaaaaaaagaactcgttgagcatccgctataactggaatgaagggaaaagcagttagttttccctaaaggtgttatgtggctcttggtaggggtagaggcctcaggtcgcagggaatccaggagggccttgcttggctgcgttggatgcgaggtttgtgtgcaggatctaggttacgcaaagtgggtaatcagagtggcgatgagtaattaaagtgaaggatttaaaggaaggtataggacaaacagttgagtcagaagtgggtacacagtccccatcctcccaacaggttgcacagccaggtgggagggcatagggcgctcagggtgtttgctgacagacttgctaattaaacaccaaaaggcaatattgctttgccagtagtgatggctgtgccaacgttatcagctgcaaactggctgccaggagcatcttaattaaaaataaacagctctggaggtgggcttgggagagtgaggacagggatcctgcctgggttacttagtacatctagtatttctcctagggaaagtcacttttaggccacctcctttcctcaaaggagcctctgttcataacaaggtggtgtgaatgtacaacttaccctgcttccttaaacctctgggtgctggagtgacaagcagacagaaccactaggagcaggtcgcatggtacagttcagccccagaaggaaattctgggtcgggggagaggggctgctaatgatttctgcctggtctctaaattgaggggacagctaaagcccaaggcctcttctaagaggggttagaatttcatcagaaagcaagtctggtcacatgagaatttctggcactgtgtgcatggcaggctggacaccagcctgcgagaattgagcgagtggatcgtattggcttcagcagaggggaaaagtcccagactagcctgggagaaggagccgactcactcccccggctgccgacttccctgacttctgggcagaaacagcacagctgctgtggtgggctagggctttaacgtccgaagccccctttcttttaaccctaaagaaagtgtgtggtccccgggactgaagaccgaaagatgcctaaggaatgcagtgctttccacgccctctcagcagctctgtgctgcttctatcaccgcaagtctttcattggagtcaaggtaggtttggtttggaaataaagtacatctgtcaatcttttgggggaccctgaaagcatgagtttcctaaagggcaatagataaaagtttgcagcttgctgattgtgaaaacagaggtgctttctttgactgatgggtcttcaagagcccctagtggtgtacctcccctggaagcagaacccagtggcacagaacagggctccttgtctgttttgggctgaagctgtttttcaggacactttcagttctctgtaggctgaaattttatactaaagtagctcaataggacagagctatttttcttctttctctctttgtctctcttccttcatttctaacgaacacaaggtagctgagcccttttctctgtttatcctgctggtccattacttatcaataatgtacataatgtacagaagccacacaatatttcctttcaaattgcagccaggtttcaaaacatctcagggttcagaactgttgttgtctttactgctcacattttaacatttgttataagacaccggtgccaagagctttgtataatatgtcaatacactattttgatgaaaatattcagagaacctcctttggctaattcaagatgaggcctgtgttctatttgcctgcctgtgacgcactaggaattaagattaatataggctttcgtggatcttggggtttgtctgccttggaaaaagcctgtcggccccagcctgactgcggacctcgtttattcctgggaaattggactctgaaagctctcaaggaatccttcccaccctgaagcagagctccctctcctgtgggactggctcattcattacctttgaaaaggctgcagcagggttatgatgttctgcttctttcttctcaatacgcttttaaaaaaatcaggaaaactacctgttagtgggagaaaacctttttgtttaaaaatatacagagtgggaaaagggtgagtttccattgattttgctccctggtaggagtgttcatttttgtccctttgtcaagaaatttgacagaggatgagtaattaatcattggttagaagcattcccttcctgacttgagcccctttctgtcctggagcccagtgaagtgatgcgagatccatgtggtttctggcctaaatatggatcgttcaagtgtggggcagatgaagtcatgccattaacagtattttaaagcttccaagatagactaggaggtcccaaagggtatggtgcacttcggggattggcagtgggtttcactctaatagaagtccttccacaagccaacttctgctaattcagtgaagtgcaactcagcattgggtgtatgagggagtcagcctataaatatctgggtctgagggatgagtttctgtttgggtacctgttggtctgcagttacggccccaaggctacataatatatagaaaaggccacttaatatatggggtagtcgggtccagctgtccttcagcttgtgcactctctatctctccaccgtggccactcttggtggttgactgtggtagaaacacccttctttccgcctggacttctactctattcccagtttgtcgaagtcttcatagcacagagagaaggcctgagctgctcactcactggaaactgtagccctcggtcccaacttagggtttaccaactgcaccctcaagatgagtctccctgttttgttttgcttagctagttacttgggaaagaaatctgcttgtacttaatcccccatcctgccagtggtgccccagttgataatgccgagtcgctttattgactcccactttaattaggggttccagatcttgctgctcataattagtttccgttgcaattagagtttcaaaattaaattgggattgattgcctgatagcaaagaggaaataaagctccaattcttgaccatgtatactgcttctcttggcatgaatttctcataccaaaaataacactgcggtagccatggtaactttccatttggtctaatccatatcatctctggagaaagtacgatggtattaatagtgtttgctgtatgggaacaaaactaaaaatatagagggtccctccttacataggagaatgattatacaggtgtttttagagagtaagatcttatttgcagcggtcttacagaatttaggatgtattta

SEQ ID NO: 55124 - DNA, 1934 bp, Homo sapiens
ggcagtatctgggaggacacagagagaaagtctagagagggcagaggggtcacaacatctgaggagctataccagacacggttgtagttctagaattggttggtatcagacaacccagtaatacagggcggggaaatatgaaggagtcggcatgtgagaggtggttctctggggatgctaaacacatgtggaagatctgttcccagggctgaattgcagggccagggcaggaggaggtggggctggaggagtgaggatcctgtagggcatccaatcaggactgaggctgaagtccaattctgcaactagcttggtcccaaggcaatgggaaaggaggggtaccacccaggccccataggcagagggggcccacaggatccccagtcagattggctcagacaagggtggtacatggagagctggtagttgtggatgaacccaggagtcccctgggttaggatcatgtgagcagatgctgtggatacacctgctgcctgttaaacaactcctaacatgacagagactctggagtagacaatcctgagacatctgggcaagtgtgattaaaaccatatgtggtatttgaataagcagttttagaatttaatgagtaacatatattttaaggctaaaagcttttagaagtctccttattataccagctcctaagtataccagctgggagccagccagtggtcagtggctcatggcatgggtgggtgtccactctcttctcgtggctacaggcgtggttcctgtagcccagcgtgtgggtgggcgtgtgccctgcgagtacagtggggaagatggggtttgttgtcccttctttcgaagggggaaggaagctcatgtttgtagagtgcctactatgtgttgggtgccaggccctccatgtgatatctcacttgatgcttacaataacttggtaagtctggggaggaaactaaggctcagagaagttaattaattccccaaagtcacccagctagctagtggtgaagaccagaacccatcctggctcgctctctagcctcctacctccagggtgtgttacagagccattttgaagacaagcaggtgtctgtctcacagctcagttttggaagatgccattttgcagaggtgcttgtgagacagagaactggcgcagtggaggtgggagagaggcagctgttcctggctggtaaggcctccagagggcctcgcagatgcccgtctgcccatttctgcagcactctgcatgggagggacctctgaagggctttgtggtcgttgcctattagttgcttacatagctcatgcctaccaaaagtggatggaaagggaaagagaaaagtgtacagcaaagaaaacccaggagctgagatggcaggagaagtaagtgattgctccaggtgtaattgcttgcatagtaagtgtagaagaaaaggaatcttgggaagtaggtggtgaatcatcttggatggataagactccaaggggtatatggatgggcttctagtggatacaagaatcccctgaagcagaggtgtccaagagggagaatgggttcttagtttctgtttctggttgggccagtaaagccccttcctcatccctcttttccacttatcactagagacagaaactaaaaaccatggctttggctgggcacagtggctcacgcctgtaatcccagcactttgggaggccgaggtgggcggatcacgaggtcaggagatcgagcccatcctggccaacatggtgaaaccaagtgtctactaaaatacaaaaaaaaaaaaaaaaaaaattggcgtggtggcatgtgcctgtagtcccagctactcgggaggctgaggcaggagaattgctcgaacctgggaggcagaggttgcagtgagccaagatcgcgccactgcactccagcctggcgacagagcgagattccgtctcag

SEQ ID NO: 55125 - DNA, 1035 bp, Homo sapiens
tatattcttaaggcttgtggtccaaggggaaaaggggatgtctctctcagccctagtttgaaaagtctcagggaaggactctgtttggtctcatgtcattcacctgcttactcttggaccattcagtgttcagtattctgattggctcacacatccattaaaaggatgaatacacatgctactcagtaaagcttttaaatataatagccaccacctgctatctataccattcccccccttacatttttaggatcagaagtatattctgctatatttctattatctctattcaggatacatatataaaatgttgagacatgaatgctaagttttgcgaaaaaaaagaaaatcttttcaagtcctattcccatctttccctagtttatctccctcctggtttatgtactggatacccattgcctccaagtttgccagatttgctactgttacagagaagttatgggcagggggtggggatgtccagaggggctgtggatccccagcccatctatagcttgtccttggatggattcccacatcttatcacaagtgacccaaccgggagtcctggtgttcctggatagttacccagatgggtttctgctgctctccctagtaattctcccttcctccacccagcccttccacccatttggatatacactgcaaggcgtacccaaatctttgagccactggcaaaggaatttattgtccccaccttggcaccaggaagggcaaatattgaccttctggatgtcactcctgcagacagcattatgcttggcagttgactacgttaggaagtgaagaaactggccggcagtcaatgaggtccttccatgcacagaaccctctgaattggcctcttcctatagaggaaggggtactgtttgtgtttccatgtgacaaaagcggtcccttagcccttcttgtgcagcaagcctttgttgcctcctggttcttctcagattctgatgtcagcatccatctctcccagccctgcactttcctttcagctgtgagcggaataggacc

SEQ ID NO: 55126 - DNA, 1042 bp, Homo sapiens
ccattctcctgcctcagcctcccgagtagctgggactacaggcccccgccaccatgcctggctaatttttttgtatttttagtagaggtggggtttcaccatgttagtgaggatggtcttgatctcctgacctcgtgatccgccctcctcggcctcccaaagtgctgggattacaggcatgagccaccgcgcctggccgtaaaatgactcttagggccaaagtgggaagcagccgtaattcagccagaggctggcaaggctggcttacccggtgaggagcatgacttctgtgtggcctgtcatccctcacgcctctgcagttctgaactatttttggagagacagggaagggcccctaccttcttgcaaataccatgaacaagagccacgtctctagaaatatgcatgcacacttactgcacatcttagttccaggtgtttgtggaccccaggttgagaatccctgagctatctccaaatgttcagtgggcccctatcatgttcaggcattccaatgatgacaataagacatgggtcatgaggccaacagacaagggcaccagtcattttaatgagtgcttcagtagctgaaccctggaggacagggttggagctagggcttcttaaggggagaaggaaacccctacgggcccacacagactgagagcaggggctcccaaacttccaggccatgtccacctaaggactgtctaaggagcacatttgggaagatttgaatgtgatttggagatgatgtaaacgtcctgtcctttgacctggaaagaagtcatgagggttgccctcgcaggtgactgtaccgggaaaagctcacctggcctcaataaggggatgtctcagccagtacctctaaattgggtcctgtggccttccacatagcagaaaagccttttggaaacatcctccaggagctgaggatggtgctgatgccacataagcagggctgagaatgcagtttgtttgtgctttcccctggctgggaggtgctgggtgtgggagcagaactcacccctacaccagtggc

SEQ ID NO: 55127 - DNA, 1712 bp, Homo sapiens
tctcaagactttttaaattattgaggaccctaaaaagtttttgttatgtgacttctagctattgatactcatcatgttagaaattaaaatggaatattttaaaatgtttatttaacttatttttacttgatgagcatttcatgtaattcatttaaaaataagaataaacccattatataccagtgaatgtacatttgtggtaagaatgacattgttttacatatttgcacatctctttagtgtctgatagaacacaacttgattcttatatttgcttcggtgttcactctgttgttttgtgttactttggttgaagtctcaaataatgtggccctgcacaggtatgcagttcagaaagggaggagtattttaatagcctcttcagatcattatagttgttggtctttgatactagagttcaacaagttgtagttccttaaaagttaactgcaatgtggactctgaaatcctgtcaatgaacttgttttatttccttaaaattcaatttgaatggatctctcttgcaatttgaatggatcttttacccatgcatgagtttatatcatcatgcattggccatttgaaaaatattggtttacgagttatgcagatcttataaatgttacatatttcactatgtaatatcagaactcacattcattaatatgaccaccgatctcatcagaaaaatcattaaagtattggaaagctgtcaaactcatgtggtgaatacaagttttccaaaattctaattttcacttgaaacctggaattttatcattggcaacaaacactgtctgttgttttccttgaagtaacaggctcactttgttcgtttttcagaaaatggctgccaaataaatacccgagtctgaataaccaagtttgtcagacattctttgaagtaaaaattgtgctctatgaaaaagcagctagttgagcccacaattcaattgcacagttgcttttccttcacacaaactctgtgcttggaaacacagcagaattgttttctgtgcatgtcctgttgcattgtatagaatactaaagagacatgtactcgagggcccatatttaataaagtgagtaattctcactgcttcatcaaagacttctaggtggaactggctatttttcttcaattctttgagccaatgggagtcaagagtgcaatggcccctggtagagtttggtgcctctgccttgctttgtgctgaggcaccaggaattaacccatcatagcttttgcaccaccagtataaatgtcaacccagtgaaacaggcaaaaaatgtctctgtattattatgaaaataagttttgacctctcagacccccagaagaccccccagcctgcagatcagcctgtggaacacactttgagcaccactgtaccagagggtcttttgctacttaagagactaaaagctgcaaaaacacttaaaacacaaataatcccctcttgtttatctaaatccatatttatttctctagcaaagtttacttttaagctcagcttgcccaacagttgcatttacatttaaagagacttgtttttaatgtaggaaagacattaaattttcatttaaaagtaaggaaaaaattgagagtcaatccttgaagtaagggttctcaattgtgggcctgttccttgcagtggagtggattgtgacacctctggaaatgctaactctatgtaacataaccaagtcat

SEQ ID NO: 55128 - DNA, 1542 bp, Homo sapiens
actcacatatttgggcagagatatacactgtttttaaaagtgtagttctggcaacttctatgacttagacctatctactctttgggagatcttgttaactatagggagtcagtaacttcaacaccaaaacgagaggcctggattgctagctttagaatcatttgctgttaagctctgccctctagtgctcatcagtgtcacaacagttcagcatttggctacaattcggtttctaaatattctaagagcttttaatattaaatgtaatagcatgtcaggacttgtattcaacttcagaaagaagagctgtgtttacaatacatgaaaatgcagatttaaattgtcaaggaattttattattagaattaattgtcaatgttcttgaatgaagagctctaaaatgctatgatactgtatgtagattttgagataggaggtttgcatttggcccaaagtgttacctccggtaaccaagaagtttcctgggaacaacttgtatttgaattgtgatttggtatctgaaaaaacatctcggcttggcaggaaggatgctggtattgggtaaggcagaagactccatgcctgggagacagcgtgtgcccaggctgactggagcaggagagaacagtgggaggagccttgggagaagcagtaggtgctccatgttgcttgaatgggaaaagagattccgagaagaagatcacgttaagaaatgagtttgggaggaatttatttattgccaaactgtctaactacatataactttgcaacttgcttttttcattggacatcattccatattaaacgtatgggcctccctccttctttcgaatgggtacccagtattccattgtatgaaatacagttatagttaactagttgcctactgacatttgggttttgctaatgttctgttagaaacaattttgtggttagtacatagtcatttagtaagtatttgttgagtctcttccctgtgctggtcactgttccaggggctgaggatacagcagtgaacaaaacaatatccctgcccctgtggagcttttactctgggggtggaggactggaaagacaataagaaagacagtcaagtcaatcctgttagctgacgatgagtgcttagcagaaaagatgcatcagggaaagcagctatgaaagttggagtaaggggacattaaattttagatagggtgaccagggaagggcctcaccaagaaggtgacttttgagtggaaatacaagtcaactgtaatgtctaaggggaagaagaagggcaaggctttgaagccagggtccgcctcttccatggaggaacgaggaggccagaggctggagctggtgaaagcagctggtgttagagtggcagaaggtgatgtgcgagggattgtgtgtcagagtaaagacttcaattttttctggaatgagatgggaggcatctcaggttcactttggcttctgtgttgctgctagactgcaggggacaggggcagaagcagggagaccagtgaggaggctactgtgattgtccagatgagagat

SEQ ID NO: 55129 - DNA, 1074 bp, Homo sapiens
acctaatctagagaatattatagcttagcctactgaatattatagtttaccccagcatcacctaagagtatcatagtgcatgttgctaggccagaaaagatcacatttcaaaatttgaagtacagtttctactgaatatatatcacttcagcaccgtcgtaaagttgaaaatcagtggaaccattgttaagttagggcctctgtagttgtgacactatggcctcaaaagcctaacagaaccttttacagagttttctgacccttgctctaggctgtttgcacctttgctgtttctgttttgccttcccaataatgcataacaggctttcaacaaaagtgagtccttgggcaaattttatgatcttgcacaatcacaaggatagtgcttttgtcacactgtgcaggatttggacgcatctctgcatcttatgaggtgtacctgtcagctctgagcagcatctctctgctgccctggtcggttctggcatctttagcccagatggatgaacaggtgtgtgggggcagcatgggtacttgaaccctgactgctcctgcctggggcttgcgtggataactcctcaggccagacactgctttgtccatgcagcctgagatgggttttcttgtgccacaagtcagagagaagggacttctcactgggcctcctgaacttgatggtttgagataaggtcaaaccctggagctgccctctggaggtgctgaaaggaacatggtctggccagtgagaggaataagaccagatttacattctgtgtgaatttgtattctgtgctgcaggcatcagccttgaagctgaggcaccatcctccctaactcgaggaaggattcttctgagatcccgaactgtagggatgactgagagactcaaaaactaacaggcaggcaagaattgaaactgtggcttctgacgggactcagctccatattggacttcgaatctggtgtggcctgtccacctctaacctcatctcctgccaccccaatagtcactgtcctctgccaccctggctttccctagtgtctctggggctttgccttcccattggcctggaa

SEQ ID NO: 55130 - DNA, 1676 bp, Homo sapiens
taggcatgagccactgcgcccagccaaaactccccattttaaacatcagatctcatgagacttattcactatcatgagaacagcatgggaaagacctgcccccatgattcaattacctcccaccaggtccctcccacaacacatgggaattcaagatgagatttgggtggggacacagccaaaccatatcatgggtgaatcttgaatacattacgttgagtgaaagtagacagtctcaaaggctacgtactctaaaattacatttgtatgatattctggaaaaggcaaaacttatagtgacagaaaacaaataaatggttgaaaagaggttggagaagagatgaagtacaccaaggagcttccagggatgatagaaatagaaatatcgtgattgtagtggtagttacccaactggggttggctgtcagtgctcatggaattgtactgaaaagggtgacttttgctgaatgcaaattatacccaataagcctgaccttaaaaagcaagctaggctgggtgtggtggctcacgccctttgggaggccgaggcaggcggatcacaaggtcaggagttcgagaccagcttggccaacatggtgaagcccctgactactaactaaaaaaatacaaaaattacccgggcatggtggcatgcgcctgtaatcccagctactcgggaggcggaggcaggagaattgcttgaacctgagaggtggaggttgcagtgagcaaagattgcgccactgcactccagactgggcgatagagccagagtgtatcaaaacagacaaaaaaaggcaagttaaagccttgtatttcagtccttaagtgctgccacctcagtaggagaaattttccattttgagatgggccacaccagggaggccagacccttgatgagatggaaaaagtgccgagcttgaagatttttgactgcagtggctcattcaacagatattttttagtatataccatgtgtttgtaattgttcagtcaggtcagaccaggtgggaagaaagtgttaccaggagcctaacctgagatagtcgcagtgggaatggaaagttaggccacatggtgaagggcttttagagatagaattaagacccagttattagggaagctgagagattctaacaggatgtaaatggtgcaggtgagggagagaagctaggggcagttcctgggaccacaccagtacctagcattgtgccagaagccagtaaatagggaggaaaggagatgtccatttggaaaccttgttaccacagtgacgttaatcttcgagcatttgtggatatctttagaccaaggggtcagcaaactatagcctaagaccaaatctagcccaccacctatttttatatgaccactaagctaaaagtggattttatattttaatatggctttttttttatgtggagtttcgctcttgttgcccaggctggagtgcaaccatgcaatctcggctcactgcaacctctgcctcccaggttcaagcaattctcctgcctcagcctcccaagtagctgggattataggcacccgccaccacgcctggctaattttttatatttttattagagacggggtttcatcatgttggtcaggctggtcttgaactcctgacctcaggtgatccactgcctcggcctcctgaagtgctaaaatggctt

SEQ ID NO: 55131 - DNA, 1039 bp, Homo sapiens
ctacagttattttagtaaagagttcttttctaggggtggtttaagctgtagttttttaagggaggaagtgattggctagggcagggctgggtgatttttcttttagaagaagtgtttattatacattttccattttaaaataaattgtcctcaaaaaagttacattagaaaatatggtgaagtagaaaaaaatattggaatgcctgttttttttgtttttttttttcaaattagccatgaataggcaagtgtttttttgtggccaggctgtaaacagcacgcttgcccgcctgtggacaaaggcctgctctccaggctaccgcagtgaggaagtgtcaggacggaatgcaaccttttgttcctggctagattcctagtgaacgcatgtcctctttcttttgtagtcagccttggtgggttcttgttagacccactgtgagctgtaatagaatgacctacagtctctgagcttgttgcgcaggttaggagaagaaaggacaaggctgcagctgttatcctgagtggggacagagccctgcagcttctcccttcacagtgcagatgaccccagagaaactcaggaagctgtcctttctggggtcaatgctctgaaaattctccttccccaagggtcttctaggtctatagacgttacaggccatccaaggctcagatctcagcaaggccatttcctgcagccggctggggatatattaggtcacccagcatatttaaaaaggagtaattatgcaaattccaatgccaagaataagtgccctggctgccggagacctcagtggagaaggggtgatgtgacttcagctccctttttgtgctcaagatggctgcagccatggtcacaattaaatagctgtctttgagagaagccttttcttccagcaggaaagcaggccagtctgctctgaattagccagctcacaaagccatgaaagggacttacaaaaacaatggcacgctgtacattccatgagattttaacaagttatatgaaccaaataatgggccgattggctggctc

SEQ ID NO: 55132 - DNA, 1050 bp, Homo sapiens
ccactcacctcggcctcccaaagtgctgggattacaggcgtgagccaccgcgccccagcccacacttttgttctaattagcaatgtgaccctggatttgccacctgctctctgtgggttccattgtccccacgatagaaaccttggagtgggctattgttccttctagcttacgtttataggattctccatgcctagaataggctggagaggaaaatcttgtagccagtggtaaggagttcttaattgtgcgatatccctgttgatcctaagattgccgtattgattggaacaggataccatttcatgttgtatcttggatatgaagaccaaggtcatgatggatcataactgccaccaccatgttcccagaagagtggaagttaccccagcactcctgcattgctctgtgatccattatggttcacttctgtaaccccctttcaacctatgaagcctaggctcacttccactctttatcactctcttccttttattttcccctggaactgcatctttaagcttcagaagttgcccccacaaccagcactaaatataaatgtatattatctcctctgggtgcgatggctcatgtctgtaatcccagcactttgggagcccgaggtgggtggatcgcctgaggtcaggagttcgagaccagcctgaccaacatggtgaagccccgactctactaaaaatacaaaaattagctgggcatggtggcaggcacctcaggaggctggagcaggagaatcgcttgaacctggggggcggaggttgcagtgagccgagattgggccattgcactccagcctgggcaacagagcaagactcgtctcaaaaaaaaaaaaattttacattttctccttcccctttatacctatattccttttagcctcaagactagtgctgctttgtttgttttgttttttgagacaggggcttactctgttgcccaggctggagtgcagtagcaggatcatagctcactgaagctttgaactcctcggctcaagcaatcctcccacctcagccccctcaggtaactggg

SEQ ID NO: 55133 - DNA, 1063 bp, Homo sapiens
ggaaatggatgccatcgtcaaaggagagatctagagctctatgtaaagagtaaagggaaggaaccctaagaacgacctcagaggaatcccagcacagtttgttccagggagtcagcagaggaggccgagtgcagagaaataagataggatatggatagataggatctggatagggttggtgttcaaaagaagatttttttttttttgatgatagaattcaataggagactatcttgccatttaaactaaagcatattttatccactacttgatttttttaaataaggcagacatgttttcagggccaccctccctggggtctgtgtcagcagcatggtgattatactcctgtggtttcttcccagcggtcctggacattccccaaggaccctgtagacagaggaggtacatggacactgcagtgtctgcctttgcctaaagggtgatggctgctttttcaaggtttaggtaggtggccacgttgaggatgggtgtctgcccgggaagacaggtcaaggggatatgttcctttatctggtaggcagaagcccttcctcttagaggcttgaggacattatctcaaaaccatagcatttttattctgcctctcgattagttagaaaaagcctttacaaacacactctttcagaagccggtagggaatgggtgggggtggggtagatgggactggtgggattggaggaagggcagatagatagcagccaaacaaagcatctgcttttatcagaagtgctgtgtttgagcttagacagcctgaagcctgatgattcactgatgccagatcctctctgcctgccaagagacatactggccttgatacggtttttcttgttcttaccctattcaatttgactgactgctgccaagttaaaatttcaacagtggcttttagcttcatgctgtcactagaattctgctgagcccaggttaacccatgactgggtcaagtttttatcaaccagtaccactgtgtattagtcttggattcctatatagactcaccatagtgtaatatgcaggatatttaaatgatgctgtttta

SEQ ID NO: 55134 - DNA, 1061 bp, Homo sapiens
gagcctttgcctgattgttcttgtgcttaatatcagtgtctttgctgtttattcttcgatgcgtatttattagcttgttttatgccaggcattgtgctagatgccaggtacctagtgaagcacgaaatagatgtatcccctgtccttagggagttctcagtttagggggcattcaggcaaatgcatcattaagtacgtaactacaaaatgaggaggtacaaggaagatacaacatcagaggaccccaagttacttagactggtggagagaaggcctctctggcatgggaatttgaagatttgatataaaaagagaatatatttcagtaataatttttatgtaaccgtgttgaaataatgtctttgaaatagtaggttaaataaaggattaaaattaacttcagctattttttaaattgactatcagaaaatttaaaattacccatgtggctcacgttgtgtttttattggctagcactggtctagatttgggtaaggacttcagattttctctgtagggcaaaaggaaatctacctttaaaggattttaagcaagggaatggcacgatcagtttttagaagattgctttgtctccctgtggaggaggattgatggagaagaggatgaggagggaaggcaggaggtggttgtaaaagtacagggagcaggtggggttctgcactagcgtggtggtagaggagagaagtctgtggattcgagatatagtttgcaggtacagtctgccatatctgctgaggtttggatatggtggggtgggggagaggtatagtcaagcatggctcaggcagctgggtatatgggatagggcatttgctgagatagggaagcttgggagaggaccaaggctttatttgtttggttgattgcattttcttagggaagggggttatggtagattgctgagaatcaggacttctgtttggggtttgctaagtttgagatgcatgcatgtctaagtggaggtgttaaacagacaggcggttggaattatgagcctggagctctgcaaaaaaggtctggcctgaaaggtataaagttag

SEQ ID NO: 55135 - DNA, 2043 bp, Homo sapiens
tttgtgagattttggtgcacccatcacccaagcagtatacactgcaccctatttgtagtcttttatccctcgctcccctcccactcttccctccaagtccccaaagtccattgtatcattcttatgcctttgcatctcatagcttagctcctacatatcagtgagaacatatgatgtttggttttccattcctgagtcacttcacttagaataatagtctccaatctcatccaggtcactgcaaatgctgttaattcattctcaaggatgaatttgtattcaaatctggaatcttccttgggctgagaggggactggttcctgttgtcgggatgtctgtgttgctaggatagctgagggatcagtgcttggataccattcaggtctttttcctgcctgtgggtacgtggaggcacacattcctgggaacagctgtgagtgcctaattccttcggcctcttgtgctgtgggagcatgtggtaggacaatgtggtgtttcattagtttgcatgagtggaactgactgactcgtcacaagtgttttaactgacagtggccagaaagtctgcagaattatccctagttaaaatgagcagtacattttcccaggcagtaagtaacctaccctgtcacaatgtcagatcttcaaggttgaagcaaagatgtaaggtccagaatctatgcagcttttttcctctaaaacattgatttaaagccctaactctgggctgtatcaatgccctcatctgaaaaatggttttagttattcctcttcagaaccattggtttctgtaactactgccttctctttaacaaagcaagatgttccctcagacacgcaaatacaccagcctttagctcagggttaatcagaaggatgtacgatgcgaaggtccacatgcaaacatctgcagtttatttatacccaggcatgtctgctgtctgcaaattggaagctttttgtgtactttttggagaaaaaaattggattttgagttaaaaaaaaaaatcttgggccgggtgcggtggctcattgcctgtattcccagcactttgggaggctgaggcaggtggatcacctgaggtcaggagttcgagaccagcctggccaacatggtgaaaccctgtctctactaataatacaaaaattagttgggcgtagtggcacatgcctataatcccagctactggggaggctgaggcaggagaatcacttgaactcaggaggcggaggttttagtgagtcaagatcacaccactactctccagcctggatgacgagagtagaactccgtcttagaaaaaaaaaaagaaaaaaaaaaaagcttttattagattaatagattctatttaatagaaggtatacttagcatagtgacaatggcttaacagcccaagttcaagaatgtttctgaaaagtaatagtccatgggttgaattgatgtttttataagtttaaagttgagttttagtaacattttgaaatacccctcggtgtttgaacgcagctgttgcgaatggtttagtgcattccgaggaatggtgaatgtcccggtccctggtggcctctggtgtgctgaggacaggagcagctgggtcagaggtgagctcagcccctgcatcttgcgctgctcctgggttgaagaagcccagagggtgggaagtgcctgcagatctaccagctgtctgatggttgtcctaaatcctctactgacaaggatgatttgaacctaaatgccaggatctacgcattctcagctgttctggggcaaaaaaaaattgttaacagattgcaaaccacaaccaagaaaatgatcagagaattacacaatgcagtccttgttgagtggagctgtgtaacatctcctctggactgccccctcctcactcccaccccaggacagacctgttttaaatcatgttttttttcaggccaccagcatgctatttgggaaaggtgaggtattttagtcttctgggtttttcacgcccctcaatatatgttgaaacaccttgtaaacagaggtgctatgcagttataaat

SEQ ID NO: 55136 - DNA, 2374 bp, Homo sapiens
tggtggaccgcttttcatttattaacttaaactgtcctgagctagatgtctaccatgtactagacacagacagtttatagacttactccttgaagttctgaggccctggctaggtgccagctcttacaaagggaaactccacactaggggggtgggtggggaggcagtagtgatggagtcacccttcctatcttggggaagttcttggtaaacacccaaggtccaagctgtcaagctgccaagagtgtaaagctttttgatttgaaaactgacttggacagaggtcatatttctgtaaaagatcttatcggagggtgggtgcaggtcctgagtttgaagtccaggctgtggaagacttaacaagcactcctggtttagggtttgtttatgattgagagctatattaatccaaattcacatctttttttcttaactgaaaatatcttattgttaaagatgaatacaggaagtaacaaatgcatatccctcaaaaattgtgctgagtgagaaggcacatggttctctgttaaagggtcgtaaagtcctaccctgctctgtactactattaatatatttatttctctaacacattaaaaaaaaaatctcctgaggtgttcccaattttgaggagtacaaaataccttatattctttttttgttaagtattcttaataagattataagctgcctgaattcctttttgaaaccagcaatgatataaacaaagtttttgcatatgcagagctaggaccaagcagcctgaatgagaacccaaggctctagagaaggaggttttgccaaaggtgccacagcaaaaatacagtgagagaaatggaacttctcattcaactcttccagttgaaaggagctgcgaaacaccaaccattcactccagctcagtcacctctttttttcttttcgtagtgaattcaggggttaatttcagttgacagtgacttgcccagatgtcagctctgaaaacattgcatctcatcatgttgggtattggcctgacgggtattggcatgaagatagtgggccgccttggatgtctcctgcctcctctatcttgctcagagggaggccctccagataagcacctctttgtcttgtgaagtactctgttgcaagtttgctcttttccaaaaaaatatgtttagcttgttaatcattaaaaagtcacctttataggccgggcttggtggctcacgcctgtaatcccagcactttgggcagccgaggtggacagatcacgaggtcaggagttcgagaccatcctggccaacatgacgaaaccccatctctactaaaaatacaaaaaaattagctgggcatattggcgtgtgcttgtaatcccagctacttaggagactgaggcaagagaatcgcttgaacctgggaggtggaggttgcagtgagctgagatcacgccactgcactctgccttgggtgacagagtgagactccatttcaaaaaataataataataacctttattataattgaacattcattgaaaatacatcctctcggaggcccaagacaaagcagaggaagtctcctctttgaccttaaaacttgcatgattaagctttcatatctacatgtgtcatttcctccattattaattcctccattattaattatcccaataattataacatgaataattatcctaatattattaattgttatctcctacattttatagttttcagatagcttaaaggatatgttcataaactaccttgtttgaacattgtaaccctgtgtgagagacatagcagatttcattatgaacattgttatcaccatcatcagtgtcatcatttagagttgaggaaatgggttcagggatgttgaggcacctaagatcataccttaatggataactgagctaggattagaacctagaaagtattatagggccttccccagacagtgtgttccatagcctccgaagaatgttggcaccagctgtgggcatcctctgagctatcttcttgcacaggggtcagtaccctgcttgtattcagtgctttggacacctactttggggagaatggagccttgcctgctgagagccaggcagaaggcaggcctggaagggggagttggtcttctcttttggtgactgtatctcttggctttgttgttgtcttggctgcccttggatgtacttgtggttttgaaagagggccaaagccagaagccagggagctcttaaacctgctgcttgatgtcacagaaggagcctttgttctgcaagcagacccaggtttctctgagaggtctgcagacaggatttcctcttgacattcacattgttcagctgatatccccttgattcatttatcttcaaggatgaattttt

SEQ ID NO: 55137 - DNA, 2463 bp, Homo sapiens
tggagctggaggcactgactctgctcagggtaaatgcttctactcatggtcctagataggagagagtgtcggggctacttgctgcacacagcctgacgtgccattctcctttccctttccatgcttcctttgccccccaccattttttttcttttcttcttcccttctcctgtctcttcttccccgactgtacaggcacccatgggcattacctaaccctgctggtggcaggcagatcctgacccctctgtgggggccatgtacatgcagcccccaccccagtggctttcctctgcagctgagcctgctggtgtatggcagaatggcccacctcctgaccctgaccctagcccgtgttcactaattagagtgcattgatttatttataaacactgggtctttgccagaaaaattctgtcccatcctgtgtagcacaactgaggactggtctggcactgaagacaattctagcagctaaagaatttcaataatccctgcctgttcttatcatttacagggcagtgaaaataatgtgagctaattatctaacagtttataatattttctttcgtacatttattactgcaactatgagtcctctcttaatcatctttttttgctggttgtgcatggcttatatgcctctaacaactctgaaagtgtttgccctcttggttttgctgccaacccaggacaattcctatgtaggatcatttcaggaggaagataagtaaacttcccattcttattagactccactagtgatgccattaaatgttgatctgttaatggtctgtgaatatttcattttatgtggcatatttccatttccttttgtaagtaggaagtcagttcttgtgactctcatagatttataccttcactcttttctttcccccttagagttgagaattatggctgcaggaaaatttgcaagccttcccagaaacatgccggtgaatcaccagttccccctggcctcatccatggaccttctgagcagcaggtcccctctcgctgagcatcgcccagatgcctatcaagatgtgtctatacatggcacccttccacggaagaaaaaaggtcctcctcccataaggtcctgtgatgacttcagtcacatgggcaccctcccccactccaaatccccacggcagaactcgcctgtgacccaggatggcatccaggagagcccatggcaggaccggcacggcgaaaccttcaccttcaggtaacttctgtaatttcactagtgaagatgatttgtcttaaacagctttttaaaaggtttttatggccgggcgtggtggctcacacctgtaatcccagcactttgggaggctgagatgggtggatcatgaggttaggagtttgagaccagaccaacatggtgaaaccctgtctatactaaaaatacaaaaattagctgggcatggtggcatgtgcctgtaatcccagctactcaggaggctaaggcaggagaatcacttgaatccgggaggcagaggttgcagtaagccaagatcgctccactgcactccagcctgggcaacagagtgagactccgaagtttttattaggaaaaacatcaaacatacacaaagttgagcgaataattaactcccatgcacctgtcagccggctccaacagttaccagctcaaggccagtcccgttttgtctgtactcccacctacttccctcctttggtattattttgaagcaaatctcagatttcatattatttcatctggaaatattttggtatgttcctttcaaagataaggactcttattttaaaaactgtataaccacaatgtaaaaaaaactataacacctaaataaaaaccacttcttaacattatgtaacatttgaggatattttaaaatccagcttcctctcttaagtcccttaaaagaaagcccaagtattttctttttatcatagcatcagattctgaactatgtccatccacttctatagagatgccaggatgtctataaattagaccccatatctccttatatttagttgtcagcatgctgaaataaaattttatgtggatgcaccagcaggtcagcttcagaatactttaggacaagaattgatttttccctctctgtgacagagatctgggtaaatgagccttatggttgtaaatgctttttctctgggtttgtaatgggcctggctgtgattggtttctgcctgttagagctagtttggaaactgcactccttttcctgttggggaagatcagcagcctgtgatgctatctggtaaagaatgggactgtttcttttgttatctctctttttgtccaagcttgtcgcaaagccacttggatcctagctcatttatttgttcaatatttatatatggagcacctatattagagtatgttgatttcataagccccagggcttaccaggaaaattctgctcagtcctgattatcttaaat
